United States Patent 11,913,074 (METHODS FOR ASSESSING RISK OF DEVELOPING A VIRAL DISEASE USING A GENETIC TEST) - sequence listing, part 25

SEQ ID NO: 2553 - DNA, 246826 bp, Homo sapiens
  source 1..246826: mol_type = genomic DNA
gagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggtgaggagagggctgcaaggcggcggcctggaccacgggcggctgcagcgggggcgggggtcggcgcgggggtctgcgcgatggctgcccggggcatccgtcccgcgcccggcgcttgtctccccggccgcccttagcccctcgccgcgcgcccgagagacggcagcggctgcccctctgccttgtccttcccgtcctcgggggtggcggcggagtggcgggcggacccgcactgggaggccgggggccgcggtgggccgtggggtggcggccgcgggacgggcgtggggatgaatgggcgccgcggccccgccgccgagcgggctccctcctctcgcggggaccccgggcggccgctccttcccgggctgacctcgctgccctcggccgccggcgaggggcggcccggcctcgcctcccgccggcctcccggggacccgcgttggcgggagcggcgccgcctctgcctggagccccggctccttcctcggcccctcgctcgcaagcctgcagaatcctgggtcagtgaagggcaggcaatgccgttcggccccagggcgcgccgcggggccgcccctgaaggcatttaaaggggagcgtcttccgcgccctgtgagcgcgtccccgggtccgccgcgtcccttcccttcttacgcaccgacacggttttgtggtgtggacccaagacacaattgcagtcccttgcttgcacgaatgcaatccgaattcccaaaaaaaggaaaccggcgaggaatcggccgcaccttcctgcgcttctgcttgccttgggattagaaaacaacttcggagattacatttcctatgggcaatcttttgttgtgattcagactcaagaaggctttgctttggaagaaatagattagcggcttctctgtggagttggaggctatagagatttttatagcctcttcaatatgaaagtttcctctagaactttgccatcatcagtgctattctgagggcagcagcaacctggaaatttagatacatgcaggctccggccagatgcgtttctttgtgcttgtctgttggcattcttctcttgctgctcctcttgatcaaaacgtacagataataaaggcaaggccaatgaagagggtagataataacagcaaatcccatacaaacaaatgcctctagaaattctcagttctgtcagcggggaggcagttttgctaatcccgtggaacggatgaaaagaaaggcacagagatctcatggattatgtagtggacaggatgtgagggcaggaactggggccaggacccagcaggccagctggtttgcatggtgccactctaaacccccaaaatatgaataggaggaatgtatttgttgggatacctttatttttagatgactttaaggttgagagtgcagaagcttaaacatccttcatagttattatttcttagtttatctctgagaacaaaatatgtttctgtttaaaatttcttttactggtgtgcttgaaacgttattttgatgggagtttccttgtaagtaaaaacattgaaaaatacatacatatgaaagaaaaatccttagtgcagatgggtttgtaaagaatccagggacttttaagtcatataaattaagaagtgagggacactaatttgatgatggtgttaaaattatttcagacacctttaagtagtccagtggagatcatttctgatagtatgatctttttttaaaaaaatggtatttctttatctaggaatgcttctgttgaaattgctacggcgcatggtaccgtcacaaaactcttttattattctgcctgagtaagagaggaaatgaacaaatttttaatgtactttggaaccctgcggattgcacagatactaagcattgtgaaatagggcataaaatgagtggtagcaagttagttctgtgaaatgtttgtcgctgttagcatttttttttttttttggcagtcgactagcaattttcttttccctaaagcttatcttcaatattggtagtagaacctctgctcaagtttatcttttccccaagtgcctagactgggacaaactatcaagcctcctgtaagagattaaggaggagctgctggtaaattcctttcctttttttttttcttgaggcagggtctggctatgtcacaggctggagtgcagtggcgcaatcttggcatactgcagcctcgacctcctgggctccagtgatcttcccaccccagcttccagagtatctgggatcacagatgcacgccaccatgcccagctaattttaaaattttttctagagacagggtctctctgtgttgctcaggctggtctaaaacgcctaccttaaacgattctcccacctaggcagcctcccaaagagctaggattagaggaatgagccaccatgcttcgtccaaattcctctactctaaattatctttttaatttgctaacatttgtgagttgtagagaattgatgacacgagagttgggattatattatgcacctcaaattcttctgccatagagctgttcccttctgaatgatcacttcctcctgaatggctccacttaactggttgggtttcttaaagtgtgggcctcagatcacttacatcagcattaatggaggcacttgttaaaaatataggttttgggcatggtggatcaaacttgtaatcccaacactttgggaggctgaagtaggaatagcttgggcccaggaatttgagaccagcttgggcaacacagggaaacctggtctctaaaaaaaaattttttttaatattctgggcttagtgactcgtgcctatattcccagcttttctagaggctgaggtgggaggatctggttcgcttgagcccaggagatggaggctgcagtgagccatgattgccctactgcattctagcctgggcgacagagagagcgagcctgtgtccaaaaagtaagtaagtaaataaatacataaaaataaatacgggtttctgtcacctcgcttcagaatcagacagctagaggtggggccctggaattggtgttgttaatgcattctccaggaatttctcctgcatagggaagttggaaaccactggcttccttctctctgagcatctcctgagactagctcctgaagtggatagaaagtttttcaagtagcagattaagttttatcccttaggctgctaataaaaaacaattgactgtgattgcgtaattttacctgtcgtacacctttcagaaggcagaggctttggttcacccctctacctccagggcctaaaacagtgcctggaggaactcaattaaacatttgttgagtgaatacgtgaattacattgcagcgaggccaatcttttaaaagttacttgtcaaattaatctatcagttagtggcatattaaagcccagcatattacaaaaaaattttttttagtagtcactgattttataaattaggagccacaagcactataccccagtgacttctgtaagtttggttagtttagaaaggagagagcctttcccaggcgtagtgtgctcaaggtgattagccagaaagaagattcagaacaaagcatttgcttagagagtcaaaatgtaaatttaagtcacagtgtagtggtaaatcatatatcaaacttatatttggtatattgtcttatatcaaaatatcattttataaaccataagtccaacatactgctataaaaattggtttctagcaaatagagaaaattgttatgttttccaatttcacttttcatactaataaaatttgacctttacaccttcttttcaagagttcaccacagggcaccatagatattatgtagttaagagctcaaactttggagaatattgtgtttgaccacacatagtcagggagtttgatctaacctctcaatgcctcatttctcagctgaacatggaaatagtaataataaagttcacatacttctaagtgcttacctaagtttttgagacacatccacttaataaatggtagttacagtgatgataaagaattggggtgtataaaaatacctaaaactcaaaagctaacccatttaattattgtactactggacttttatgatagtaagtagaaatctgttgcttaaaaaagaagtttctttggtggtgtgcgtctatagtcccagctacttcggaggctgaggtgggagaatcacttgaacccaggagatcaaggctgcagtgagctatgattgtgccactgcactctagcctgggtgacagagcaaggccctgtctcaaaaaaaaaagaaaaaaaaaagtttattgctaactccttggtactatgtataatttttttaattgaatgactagactaaacattgaaagtatttaataagctatcaaatatgtattaatataagttttgaaaataaatactaaatctcctgatctcttttaggttaaaatatagtttatgatgagcaactaatattctttgtatttaaaaagataattgttttatggtagaaaaattgaaatacagaaaagtataaagtagaaaactatgaaatacccgtaagtctactacctgcatacatatttcttcaaatccttttgtgtgtgtgcatatggctattcatatacaatttctggtaacaaaaatgggatcttgctatacatatggttgtaacctgctttttttttgcttaacatcttgtcatgagtgtcttttcctatatatatattgcattataacaattttagtaaccaaataatattccgttttatggatctatggtagttttttttttaatttttattttttcagacggagtctcagtctgttacccaggctggtgtatagtggctcaatcttggctcactgcaacctacgcttcccaggttcaaatgaatctcttgccttagcctcctgattaactgggattacacatgcctgccaccatgcctggctaatgtttgtatttttagtggagatggggtttcgtcatgttggccaggctggtctcatgctcctaacctcaggtgatccacctgcctcagcctcccaaagtgctgggatcacaggcgtgagccaccacacccagtcatggatctctggtggtttagccaatttatttttattagacattagtttgtttatttttcctccacggttacttataaccctgcagtgactgtccttctacatatgtctctgaatgtacttgtgagattattttcattaggataaatttctacaaatggaatttgcaggatcaaagcctatgctaaattttaggattttttaaatccgtatttccaatttgtcatttagaaagattgtatcattttatactcttaccatggtatatcagacttccagtctcccagccccttgtaccttcccccattttatggaatgacttaaccagtgacaaacctagtgaatttttgcttttaggaagaagaatggactgttagtataatgtgtttagtagtgtgatatggaaactcagaaatcttgtgcatgggtaatagtgatagctaatgtcgattaagttcttttgcagcatcttatatacattaactcacttcacaaaaaactctcatcttacagatgccttggaaactagggtaccagcaattagagagccagcaagtgtctgagcagatttttactgtagagtccaaaactcttagcctgtttcctagacatgttttataggcatttgggtactttttatgttctcgattgctgttgtggagtaactaagaggttctctgacatgtactaatatataaactgggtggggcacaaatttgaatccctttcactgaagagttggtcacataagttagctcagaaattagctttgggaccggtgctgtgggtcactcctgtaatcccaatacttgagaggccaaggtgggagcattacttgagcccaggagttccagactggccagggcaacatagcaagaccctacaaaaaattttttaaaaagtagcccagtgaggtgatgcccacctgtagtcctagctactagggaggctgaggtgggaggactgtttgtacccagaagttggaggctgcagatgccacagcactccagactgggcaacatagtgagatcttgtcaaaaaagaaaggggagggcagggcaagagagagagaaaagaaaggagagaaagagaaagagaaggaaggagaaagaaagaggagagagagaaaaattagcctcatcaactgtccagcattcatccttaaagtagtcttgttatcctttactctgtagtggttttcctaaagtacccctgcatgaaaaacaggattagagtgctagagaagactagtgaaatttgaaaaggcagttcacttgtgatgtggacttgtcttagaaacgcaagactgtacagaagtgtgatgagggagacagctgggtgtgtgtgtccaggtagttccatgttggcgagtttggagatagaaagtggcctaaggaagtttacttcctgaatgtgaatgttggccactttggagatagaaagtggcctaaggaagtttgcttcctgaatgtgaaggcctcagtgtagagagatatcatccactgggagatcactgaaaagtaaaccaaaacatttttattaatacatgggatggtagaatgtcactccagttttgttcctaaagttcgtagctctctaagaaagtgaattttaagcaagttaatctattttaatgcatcactgctctttcggtgtttttctagtagaattaatgataggtagcttgctttattagcttactgcccagagagaacattggtgaaattgttttggcttcagctctctggactgagtttggctgcctagctcagttttcagttggtcaccaaaacctgtcattgtttttgtgtggtatggggtctgctggagtcatgtggtagtgcgtttggcccttcattgagtggtggagccaggagttgagctgagggctgtggcagaattttgaattcaagtgaattcgaatgtgaaaataacaatgtctggccgggcgtggtggctcacacctgtaatcccagcactttgagaggccgaggtgtgcggatcatgaggtcaggagtttgagaccagcctggccaacatggtgaaaccccatctctactaaaaaatacaaaaattaggcgggcgtggtggcgcacaagtgtaatcccagctacttgggaggctgaagcaggagaattgcttcaattccctgcttgaacccaggaggtggagatttcagtgagctgacatcgcaccattacactccagccttggcgacagagcgagactctgtctcagaaaaaaaaaaaaaaaagaaagaaagaaaataacaaggtcatagcaacacagcaagtggtcagaattttacccttggtggttaaaattaaacatcctctttttaatacaggaggacaatgctcttgctcctctgttgcactggtgagcatttgatgtgttcctccttgcattatgtctgcaaatcgttctggtgtctggtggcatgcatttgcaagacatggatacagttcatggacgtggacgaggtcagctggcttttagtgtcaggctttaaccaacctagttaagaaggacgctgactcttaccataaaagcactgcaacaagattggaattggagctccaacgaattggagccattcgttttgtgtgtgtgtgtctgtttgcctgtgtgtgtgtacagggttaattacttctctgcaaggcaaatttcctgaccggttttattgttctaacacagacaaaatgttgtgtaaacacatatatcattccagtgtgttatctataataggagtgttcattgtggatccagtgtttcacaaaaatcaattcatttccgctctgaacttaagatagtagattttaaaaccaagttatctttcaatttctgaagttatctgaaactcagctgccccagtcttgcagaattggagaattgcattttggccactgatgaatgaaagctatatagctagtaatgagagaaaccttgaaaaattgacaagaaaatgagtgccattcttggtatatagcagatttcaatgaatagtagttccctttgcctttatttttcctctttcctgcacttaatataaagagctaatattaaagtcattaaatgagaatagatctgtattataggtagcactgcttatttttagaccccttcagatacagttattacaattgttgttttaatattctttaaatgattacaggaggaagaaacttggtagcggggttaccaggatgttagctccatgagggcagggagtgtatcgctgttgtccagggggctagccccaggccctagagcagcgcctgctgcctggcagacacgcaagggttatttgttggtttattaaatcaaggagtgtttgaggtccttcaagcctggaggcccgagggctctgagctggtacagagcaagtgctgggggcaagagagacaggtggggagtgaaggagagaggcccacttgggacttgactctgaatgtctgggaagtaggaagttaatgtaagttttaagcaggggagtcccatgatgtgcttttgtttaaaaatctccttctgagtatcatgtgggagtggattggaggatggatagagaggaacattccattgactcggcttccagctgtctatggatgttgacgtttctacctagccttctgctttatctttgtgatgaggataatgtggtgtactttgtgaggtctcaggaatggtttgagatgaatggtaatttgtgtaaactttccggagtttctctgaggaaaagagaaccccataaaattattactattgatcaaatgaaatagcagtgtaagacaaagatcaagaattatttagctttataaacaaattaattgaggttatgaatataggtttctataggagagattttgtttcctttttttagtgaaagaaatcttaaatgtatgggaatgaatccttaaaatagcaggcttttgcattgtctatagaagctgttctctttgaggaagatctgttttgtaaaatgctgctgttgtctgtccaatctggagttttaattagtatcaaagggagggaaatcctgcagtaatcgtaaccttactttaattcttagttcaattagttttaaaccacagtcattatctgttatctttagttgttttgatcttggtagatgaagtgattaatattacagttgtgatttggtaatttaaaaaataacatgttttttcctactacaaaaggaatacatgtttattgaagaaaacttttggaaacatatataaggaaagaagactaaaagcctaccaagatcttaccatccagtgataatgactgttaataccctgtgaaggtcaacatgctcaaattacccagcaggtgcctggtgtgaagctacttagcccgggagagttgaaggcctgttagggaccacgagcactgaaggtggcaggacggtccagggccagtcaacccagacctttgtggttctgggaggatgcgtcctggtgttactacaccttatagttatttaggagaatgtgggtttaatatgaaatcttctgatttttatgtgggccacactttttattgttaacacactggggttcaaagcatacctgagggctggattcagtcttcgttgccttgccagtttgtagcctcaggtacgtacagttttgtagcctgtgtttttcacttaatgtgttgtatttgcagccttttttgctacatcgtcatatatgtaatcagtcacttattgctggacctatagattctttgtctttttgctttttaataaagataggtaaaattcttggaccaaaagttgtttgtaaagcctttgcagcataccgctctcagatgcattccccctatcatgtaaaaggtacttgtttcctgttctcttaccaggactgggtaaaaccatctccaaaaacatcttagccaattttatttgttttaacttgcattattttctgtattaccaatgagtgtgaatgattattaaatgcctattggccttacacaaatttatttggtaaccaacttgtcttgctggaactctaagttccagcaatgttttggtcttgcattcaatgcttctcagtctttgtgattccagataatattagtactgtgttagtagcaataattagtactaattgtaggcatcgttccccaaaactgagggcatcagtatctttggcacaactataatccacttaaagtactgtgactgggaagttctttttttttttttttttgacagagtcgtgttttgttgcccaggctggagcgcagtggcacagtcttggctcactgcaacctctgcctcccgggttcaagtgattctcctgcctcagcctcctgagtagctgggactgcaggcatgtgccaccatgcccagctaatttttatattttcagtggagacggggtttcgccatgttggccaggctgatctcgaactcctcacttcagatgatctgccctcctcagcctcccaaagtgctgggattacaggcgtgagccaccgcacccagccgtgattgggaagttctgagtttagttagctgttcagtgaatgtttgagtacacgctgtatatgcctggcattgctctaggtgagtagccttgaaccaagatagaatctcagccctctaagacttctatgcttttttaaaaattctcgagtttttcatacagaccatcatgtttataaaggaccattttcattcctagaatttataatttatttttaacttgtatttctttcttttttttcttttttgagacagagtctcgctctgttgcccaggctggagtgcagtggcacgatctcagctcactgcaagctccacctcccgggatcatgccattctcctgcctcagcctcccgagtagctgggactacaggcatcagccaccacgcccagctaattttttgtatttttagtagagacggggtttcaccgtgttagccaagatggcctcgatctcctgacctcgtgatccgcccgtctcggcctcccacagttctggaattacaggcgtgagccactgcgcccggccaatgtctttcttttttttgagatgatgtcttgttatatcgcccaggatggtcttgaactgctgggttccagcagttctcctgtcgcagcctcccaaagtgctgagattataggcatgagccaccataacttgtatttgtttattggcatggaacttctaaaacagtgatgaatgcttgttaccctttaattccttccttctttccttcctctttctctttctttctctctttgtctcttctttctctcttttgtctcactctgtcacccaggctgagtgcagtggcatgaccatgattcactgtatccccaaccttccaggttcaaggaatcctcccacctcagcctcccaagtagctttgactacagccacagccacgcaccaccacacctggctaatttttttttttttttttttggagagacgatctcgctgtgttgcctaggctggtcatgaacttctggactcaagtggacctctcgcctcagcctccccaagtgctgggcttacgggcatgaaccgctgcacctggcctttgattttttaaattcactttaattatcttaagttctgttatactctagactcttagcaagagtctagaatcaacgttagttattagttccgtattttgattatgagacaaggtacaaagctgagactgtgtgatgagaacctttggaatgtatatctgacccaacacagatcccctaagtgcccttcaacctacacatccaatttcttcctacctccttctctacacaaaagacataatacattgaactcgggttgggcacctgaccaacctggcccaatcagtgttcgtttcttccctggaaatttgaaactaggctcaatagagaaggatttggccttaatatgctcaaggaccctaagtaaaggattgggagttataagcagttatgttctgctgtctggggactaagaaagatgatttatggatggggagaataaagtaactgtctaaagagaagcagagagaacactacctgactctctgacagcattaagccactctcttccagtctgttcttggtccagctgcattctcgttcttgagttcttaaggttacctccttccccttgatttaggtagctggagtttctgttactgtgaactaaacattcttctcattcttaccacaatattctttttatgatactaccttgtctctttttttttttcactatgtctagggacgttgtgaatttgttattattttctccatataataacatcaacagttaaggatagcaagaaacatggaagtaccaaaatttaatctaattcaggcaatcacaatttgattggaaaggccattttacaaatgcggactctggctcggacctgttttaaaccggtgtagatctctagctgagggaaaacaggaaggaagaaattttgaagttacttttaaatgttgcagaatttcagtggtgtcatttcctttcacatccatataaaatgttgacctcctgcaaaaaccaatactagggacattcacagtgtacagtattatgtgcatctgtatagggggtgagtctgaattctgttcaagtgtgtagccactgaaacaagattttttttttgtttgaggcagagtcttactctgtcacccaggctggagtgtgcagcggtgcaatcttggctcactgcaatctctacctcctgggttcaaacaatccccccacctcagcccccagagtgggtaggattacaggcaccaccatgcctggctaattttttttttttttttttttggtatttttagtagagatggggtttcgccatgttggctaggctggtcttgaacgcctgacccaaagtgatctgcctgctttgacctcccaaagtgctggaattacaggcgtgagccactgcgaagggccttgaaacaagactctaaagtgtactgtcgaaataccaagaagttgaatcacagaatagtttacctggggctgggcttagttcttagattagctttctgtgtcgtggtgatgtcatgtatcaggaatccttaacttaaaaaaaactcagtgataagtttaagtagtccactatctaaatgcagttgggtggggaggtggaaaaagtgatagggagagaaaaaagaggattgtaggagagagaaggaagaaaaaggaaggttgctttattgccacagttttctttattcataattgtatttgtatgagctttttcatttccaagtggaagaagcacagcattgaaatgtagtgactcacatacctgtcaagtccaaggattctgattggcctggcatgatcgtgtgtctgaacccatcatatgaccaagggaaacgtgtactctcattggctctcctgggccttgggtctaccttttcccccagttggtgagaccagtacctaaactcgtggaattaacagaaagcattaaagagaagtaggatctgtcaagaggagaaaaaaacgctaggcaggcaaaacagatggcctttactcagtgtatgatcagtgtcatacaaattaataattaataattgaagttacttttaaatgttgtagtatttcagtggtgtcatttcctttcacatacatataaaatgttgacctcatgcaaaaaccaatactacagacattcacagtgtacagtgttgtgtgcatctgtatagggggtgagtttgaattctgttcaagtgtgtagccactgaaacaagctttttttttgagacggagtctcactctgtcacccaggctggagagtgcagtggtgcaatcttggctcactgcaacctctacctccagggttcaaacggtccccccacctcagcccccggagtaggtagatcaggtctgtggcgtgccacttgttttatttatttatttatttgtttatttatttatttggcagagtctcactctatcgcccaggctggagcgcaatcgtgcgatctcggctcactgcaacctccgcctaccaggttcaagcaattctcctgcctcagcttcccaagtagatgggattacaggcgcctgccaccacgcctggctaattttttgcatttttagcatttttagtagagacggggttttaccatgttggccaggctggtcacgaactcctgacctcaggtgatccacctgcctcagcctcccaaagtgctgggattacaggcgtgagccaccatgtccggccttttttaatttttttattttaatttttagattcagagggtacatgcacaggtttgctatgtaggtttattgcatgatgctgaggtttgggcttctaatgaaccagttgcccaagtagtgaacatagcaccagataggtaggttttcaacccctgcccccgttttggaatccccagtgtttattgttcttaattttgtgtcagtgtgtacccagtgtttagttcctacttgtaagtgagaacatgcggtatttggttttctgcagaagctttcttgaccttctccttttatctctgattgtcagtttcctcttagtttcatttctttccataagcagctgtgacctcagcatgggtcatttcagctatttccttgccctgttgctctgttacatttaggacttcccaattccctttgagggcttcttatccttaaaatgttgctgtcgccagggcttttcataccctcttttgacatttcactggtcttccacggcagtcattttcactgtatttatctgtctgtacctggagcggtgtctttttttctaaccctgcatcgtgtaatgatgatgttctgataggtgattttgtctttgtgcaaacatcataaagtgtatggttgacctttgaacaagggagggattaggggtgttggtccccaacacaggcaaatccacatataagcagggctccgtggcccttgcctgtaatcccagcactttgggaggccaaagtgagaaggttgctcgagaccaggagtttgagaccatccaagcaacaaagtgagactcccatctctacaaaaattttaaaaatcagctgggcatggtggtgtactcttgtagtcccagctactagggaggctgaggcaggaggattgcttgagcccaggaatttgaggttacagtgacctgtggttgtgccagtgcactccagcctgagcgacagagccagattctgtttttaaaaaaaatcatataacctttttgactcccccaaaacgtaactactaatgacctattgttgaccagaagccttactgataacatagtccatgaacgcatactttgtatgctatatgtatgatatattctattcttacaataaactagagaaaggaaaatagtattaagaaaattataaggaagataaaatatatttactattcattaagtggaagtgggtcatcataacattcttcatcctcattgtcttcacgttgagtaggctgaggaggaggaagaagggttggtcttactgtctcaggggtgacaaaggtagaagaaaatctgaatatgagtggacccacacagttaaaactcatgttattcaagggtcaactacttatacaaaccgaggtggtatagcctactatacacctaggttatatgtatagcctattttgctccttggttacaaacccctacagcctgttactatactgaatactgtaggcagctgtaacacaagtatttacagtggtatttgtgtatcgagacatatctaaacatagaaaaggcacggtaaaaatatgctgttacaatcttacgggaccacgattgtatgtgcagttcatcattgactcaaatgttactggctgcatgactgtacctactggatccattgggcgcttaaaacttcaatacatctagagcattgctcacctgccacctttcttctgaccaacctcttcctctgtctgtatatcccatcttggtgaatgatactattatctatccttttgttcattgtttcagcagttatttattgattacttactgtgtgtcagatagtctgtggtataattttatatcattttgttcctgattcctagcacatagcttccaaaatctttggaatttcctgagtggtgggagtgtcttcttattcataatgagtccttttggatcttatctgagttcatgctaatgaactggctcctggggatgaggggctggacaccctcagaattgggggtggtccggaggaagcagtcaggaaactgcaggattggagggttggaactttcagccctccgccaccaccagctccagggaagagagagggactggaaattgagttcagtcacgtggtcagtgatctacttaatcatgcctatgcaatgaaattgcaaacgaaagccctggaactgtgaggttcggagagctgggttggtgaacccatgatgtgcagaaaggtgagtgcctatattgcacagaggaggagagggcatggaagctctgtacttcctctcccccatgctttgtgcagtgagtctcttccatttggctgttcctgagttgcacagagcttttccatgttcggtgagttgttctagtcaattacttaacttgaagtggagttaggggaacccctaaatttgtagtcagcctggcagaagtgcaagacttgaggctggcatctgaagtggggaagtcttatgggaccaagcccttgatttggggagtctgcactaactccggtagtgtcagaattgaaatgaatggtaggacacccagttagtgttggagaacattttttagaactcagtctgcctatagtatttttgaatactgtgtctatacacagtatagacttagtacctgcccttaagctagataggtgaacaagcaattataatttagctttgtaagctattcatggactaagtcagcagcctgtactttttttttttttttttttttttttgagataaaatcttgctgtgtcacccaggctggagtgcagtgagatgatcattgatcatggctaactgcagcctcaacctcccaggctcaggcaatcctctcacctcagcctcccgagtggctaggaccacagttgtacaccaccacacctggctaatttaaaaaaaaatttttgtagagatgggatctcactggtctcaaactcctaggctcaagcagccctcccacctcagcctcccaaagtgctgggattagaggtgtgagccactgcacccagcctggattctatctgatgctgaagtcggtggcttgattctgtcaattcagcctctgaaaggtcgtttgaattcaccctttctagccccactgctctggtcttagtccaggcctttatatattttttcactttactactttgctcttaatggttgctgcttcctgactcgtctggcttctctgttccacttcattttacactcacatgttgccaaaataatctttgttatgtgctgctcccacaataagatctttccccgtgcttttatctcctaaggtggtggacctcaagccttttggtatcaaaacccttgtgtcctcttaagtgattgaggtccccaaggaacttttcttcatgtggatttttgtcttatcattgtctgccagattagaaattaaaaccaagaaatttacacttaaaatagctgtaataaacctattacatgttaacataaataacatttttatgaaaactgttcacaaaacaaaaaaatttagtgaaaagtggccttgttttacattttttgcagatctctttcatgcctcactgaataaaaagatggctgaattccataactgctcctgtagtcagtttgttgtgaaacgttgttttggttgaaatagttgaagaaaatctggccttatacagatatgtagttggaaagaacaggagtcttttagtggcatttccagaaaattgtggttattttgtgatactgtaccaaaacttgacactgggtagtttcttaaggattggttgcagtgtagaatctgaagtcatataagtgaactttttatcctctgttacaataaaatctgttgatccatcctatactttgaatggctattttacccctgtttgatttgaccaatacatacaacatcatgtattggtcatttggaaaatactgggtcactgagttatgtaaatcttacaaatgttgacacatttcattaaacaatatcacaaaatcgtgtttgttatcaccacccatcttattagaaaattctttaaatgttgagaagcagtctagctcataatggcagatacaagttttccaaaattctaattttcaccccaaattcaaattttatcatgaacagcaagtactgtcagttgtttttcttgcagcatcaggcttgctttatttttgagaaactgtgccagatacccaaatctgaataatcatagttttttttggttgttgttttgccaaataaaaatcgagttcctgtaaaaaaaaaatggctagtttagctcacaactcaaatgattgcacagtgattttcttggacattgttgtttggtgtagcacataaatgctttgagtatctagtcatacaagcattaagcatgtgtactcaagggctgagatttaataaagtaataatttttcatgattcatcaaagacatcctgttgtaaaactgacttttttttttttatgtgagtgtttggcagtgaagaatccagtgaccacactggtacagtttggtgccactgctaaggtgggagcagttttacccaccattgtttttgtatcagtgtaaataaaatcacagtgaaaagagcaggtcttgcctgagtaccatcatgatgatatggtttggctgtgtccccacccaaatctcatcttgaaatgtagctcccataattcccatgcgttatgggagggacctgatgggagataactgaatcatgggggcagttcccccatactgttcttgtggtagtgagtgagtcttaggagatctgatggttttctaaggggtttcccctttcatttggctctcatttctctcttgtgaccgccatgtgagacataccttttgccttccaccatgattatgaggcctccccagccacctgtaactgtgagtccattaaacctctttttctttataaattacccagtctcggtgaaaatgaactaatacacgtaagaattttgaccatctgaacccccatgaaagggtcttaggactcccagggatccacagaccacaagagaattgctgccttgtaggataaaatctaaaccttcactcacagtttagagtgcattatgctgtatccctgttgaccttccccttttcctcttctatttctcttccatctggatctcaccatagaatgttcttttgtcactttagctttacagtttatttcccttctgcctccccctatctgtcccttatcctttaggcctaactgggtgttactgaagtgaaaatacccgtacctgccgcagctatgagtcattttccctttgatttccagcactgaacttttggctctacctctttccatctattttctagggacctctgatttaaagttccgaatttacaaatcccatcataacaggaaagcattttacatccctcttgtgacttaaacttaatttatactaatatttttcattttgaaccttcttatacctaattaaatgaaacatttgagcaaataggtgatggggtattgccttttttggggtcttctgttctgtcagaaatggtattatagttaggtctagcccagggaaaaaactgatttcctttaacagttatttgaatgatacccattttcctaatcaggaaggtttcttggtattatctaggtactgggttttatgctgccaagttcatcagttaaatggcctttagataaaggacaggttggagttgtgctcagctcatataaaatgtgctttagaaggacttctggtattatctgacccacactgcccctcatgtcacacatgtttctgcacgtacacaggatgagtactgagtacccttcatgtttcagggattctgcaggtctttcacatatgccatctaaaatttgtttttcacaattttgtgaactagatgacaagatccttgtgttacagatgaggacctcgaatttgctgccatttgtgtaatgaaaatataaatggcatagtgagtagctgaacttaaataaaaaatcattgacttaccacataaataatagtattataacattataaaacaagatttggtataaatgagctttcatcagtatagacacatctcaggcattagtctaccttgcctagaaggagcaggaattatttattgagcactgttttggatatatactgaagttccctcaaattctaatgtctcataactcttcaggcagttatagtaattgctggatataccaggaagttatgcctgtaattactgctcagaaatgaaatatgtaaactctagcattatattcatactggttttattatgagatatattaccttttagatttcttataagatctattttttagatttagcttacaaagccattaactgttataaaattatactgtaaattataagctttagttagatgggccgttaggcatagctttgctggcaactgtaaccttttatgattgcagtcaaaatgtaatccagatgctcttcgtaatagaccattgagtcagaatatcctgaatattgttttgcaggttcaaaatgttggaagagatctgaatcaggatgataaaatgacattcacccatctgattttgggcttacttctttgtgacatacctaacctggtgattaaattctttttttttttgagatggagttttgctgttgttgcccaggctggagtgcaatggcacgatctcggcttaccgcaacctccacctcccaggttcaagcaattctcctgcctcagcctcccgagtagctgggattgcaggcatgcatcaccacgcctggctaattttttgtatttttagtagagacggggtttctccgtgttgaggctggtctcgaactcctgacgtcaggtgatccgcccacctcggcctcccaaagtgctaggattacgggcgtgagccaccacacccggcctctgatgattaaattctaaaaccaagagttatttaaaagattttgtagacagtgggggttggaacttgaaagtgacccatcagctatgtagctactagcattttcctaaaaagtcctcagtgaggcagctggacaaggttgagaggcaggcagcatagccaagggattctggagccaagctgctcagctactgtcttagcccacttcgtgttgctgtaatagaatatctgaggctgggtaatttataaagaaaaaggtttatttggctcacaattctgatggctaggaaggtcaagttagagcatccggtgaggtcctcaggttgctttcactcagtgtggactcctgaatgtgatgtggatgtgaagaaactggaatcctcatacattgttggtgtgaatgtagcttggtgccgctgctgtgctaaggggagctagagagtgcagaggtcacatggtgagagaggtagtaggagcgggatgggaaggggccaggttgttaacagccagctcatgtgagaactaagagtgagaactcactcactcttggggagggccttaatctattcatgaaggatccaccccatgacctgaaaacacctcccactaagccccacctccctacactgccacagtggggaccaaatttcaacctgagatttggtggggacacatagcagttactagctgtgtaaccataagcaagctatttaacttttctgtgcctcagtttcctcatctgtagaatgaggtcgatcacagttcctgtctcataagattgttgtgaggatgttaaaacagcgcagtgcctcactaaatagtaaacactgtataagaaatgattgttattattcttatcacctgtgatccaagcctggaatttataatttaagatacgaatgaagttattatatgtagttttgttaccagttgattatatgacctctcttaatttctcagttgctctttccatcatctggaagcttcgccatttgttttaacctttgaagagatgagaggaaaagatgcatgataggcttaaattgctctcatctacttataaaaaataattagacataacgtggccaggcgcagtggctcactactgtaatcccagcactttgggaggccgaggtgggtggatcacgaggtcaggagttcgagaccagcctggccaacatggtgaaaccccgtgtctactaaaaatacaaaaattagctgggcgtggtggcgggtgcttgtaatcccagctactcgggaggctgaggcaggagaatcgcttgaacctgggaggtggaggttgcagtgagccaaggccgcaccattgcactctagcctgggtgacagaatgagactctgtctcaaaaaaaaagaaaaaaatagacataatgcaagataacgtcattaaaaagtgggcaaagacctgagtaggcatttttccaaagaagatatccaaatggtcaaccagtacatgaacagatagatgctcaaaattgttagtcattagggaaatggaaatcaaaactatgagaataccactttacaaccattagtatggctatcatttttttttaaaaaggaaaataacaagtattggtaaggatgtgaagaaactggaatcctcatatattgctggtgtgaatgtagcatggtgccacagctgtgtaaaataatttttcagctcctcaattagatagatacagagttatatggcttagcaattccattcctagctatataccaaaagaaaacaggtgttcaaacaaaaacttgtacataatattcatagcagcattatttaccatagccaaaaggtggaaacaacccaaatgtccatcaacttttgtgcatcagtggacaatgtggcatattcatataatgggatatgattcagctataaaaagaaacgaatgatatatggtacagtataaacgtaccttgaaagcatgtagaataaacatgaaaacatgtataacatagatgtaccttgaaaacatgctaagtgaaagaaggcaatatactgtatggttcctttttttttttttttgagagggagtctcgctctgttgcccaggctgaagtgcagtggcatgatctcagctcactgcaacctctgcctcccaggttcaagctattctcgtgcctgagcctcctgagtagctgggattacaggtgcccactgtcgtgcccagctaattcttttgcatttttagtagagacagggtttcaccatgttggtcaggctggttttgaactcctgacctcaagtgatccacctgccttggacttccaaagtgctgggattacaggtttgagccactgcacctggcctgtatggttccatttatatgaaatacccagaataggcaaatctgtggagacagaaagcagatgagtagctggggcagagcataggatttctatttggggtgatgaaaatgttctggaactagatactggtggtggttgcacaacttcatgattgtctgagatgtcactgaattgcatactttaaaatcagttcaacagtaaattttatgttatttgtatgatgctgcaatttaaaaaaaataaatatttcgacatgacgttttttccaagtttaccttagttgtaattttgccaaaatactttcttaaaccattttattgtaattttaggctaagatcatttgcactttatatatagttgaatgaaatatatcgtagttgttttattctcttgtaaatctagaaaagatgaaaaatgaaagccatgagagttttaagtatgtctttgccttgtgcagatattctcaaagggtattgtggagcccttggggctccttatgaccttttcaaagggtctgcaggttcaggttattttcatagtaattgttgagagttatttgcttttcaaatttttatttatttatttatttagagacggggctttgctctgtccccagcctgcagtgcagtggtgcaatgacagctcactgcagcctcgacttctgggcacaagtgatcctcctgcctctcagcctcccaactgggactgcagggaggcattgttttacatttacatgccaccatgcccgctagtttttttatttttcatagagatggggttttgccacatgttgcccaggctgatcttgaactcctgggcttaagtgatccacccccatctcggcctcccaaattctgagattacagaatttgtaagcataagccaccacacccagcctatttgctttttttttttttaaactctttttctccacaggtgtaaagtgtagttttccaaacgctctataatatatgatggtgtagtctctttgttggctaatggtctatgtacttgtatatgtctggatttttttgttttttttttacaattctctaaggtaagctctttgtgatcctcaataatttttaagtgtataaaagagtcctgaggccaaaaagtttgagaacaaaatgtcttggtaaaaaatgtatgtgccaataatgaaaaagcatatacgaactacttgtattatatatttttgaaaacagaaggaaaataaattgtaagccaaatgactcttttggctgcttagcttttatcatctttactgcttcagaggttactagatttggaaccaaagtgtactttttgggatgcggtaggtttctggttttaaaaaaggatgtctggtattgattaaatctatagttttgaactttctaatccagcagctctgtggagtaggtactgatacttggattttataaccagggcacaaaatggttaagtaacttatctgtggtccgacggctagtaagtggcaggtctggtgtttggatccatgaagtctgtttcctgagtctgcactgttcacagtatgcgatctatgtaataccgctccttatgtacattgtataataatagctccctgggaatgtatgtgtgaagttcccatttggaaggctggcatcgtagtactgcactgatagtggtggcagtgattgtgaggtgggttgggttctggtgcctatggcaggggctccagcaagcagatggttagaagacagatagggagcaaggataggaggatgggctgctataggggccagacctcctgcccaggatatttctggtccagttcgaaagttggacctttccttcctagagattggctccacttatggctttataataggacctcttccccttctggagtcctttggagcaagatgcattttcacagttttctcccaacctctttacttgagtctagcacttactgcctttgaacttctctgagggtttttactaccaactagaaatgaaagaaaaagttgaagagggagatggtattcaaaagataagtgatacaaattggagtcttttaggattcatattattgaaacgcaatttgtcaacctccctaagagggtcacatcactgtggtgtgggcccccccaaggcatgtcatcactgaggttaggatgggctctctgccatgaggagtaagccagtgcctccagctactggctagaaacagggagtgttgtcaggagatctgcactggggctgaaggacatccccgcctacttcccttttgctcttcttactatcagtctttactaccgcagatccctttctagggtccacgacctttgctggggtaaagtgggatgcagggatggggcctggggatgctctaggcagtttgcatgaaggagtggctccattggtgttaaagattaggccttctgatactttcttctccacttgtactttgagttaaaggctcttacctcaagagattttctttactctgtggccatatctgtaactgtccttaactctctgtgcatggcagccccaaaccttcccagtggaacagtgcaagctcagagccttgcaggtcagtgaccccacacttggcacaggaattccagggaaaagtgtgaaagggcagtaggtggctcctccgtcctgcttctttgaaaacctctgacctaaaaggtttttgaagctgaatatttaaagaaaatatgtatgagattgtagagatagatgcctaggcggctgaaggggatgtggcaagtggatggcctccctcagggctcctttccacctgtggtggccacaggttcaagactcctgtccaaacattctggtttgtttatgtgttccagaaacagacagagaagaaggtattgtattttttgagacagtcttgctctgttgcccaggctggagtgcaatggtgcgatctctgctcactgcaggctccgcctcctgggttcaagcgattctcctgtctcagccacctgagtagctgggattacaggtgtgcgccactatgcctggctaatttttgtatttttagtagagatggggtttcaccacattggccaggctggtcttgaactcttggcctcaagtgatccacccgtcttggcctcccaaagtgctgagattataggtgtgagccaccatgcctggcccaaactggtattatatctgcatgaaaaagggtcactgtgccaatacttttttcatttaagtttttttttttttttgagacggagtctcgctctgtcacccaggctggagtgtcgtggtgcgatctcggctcactgcaacctccgcctcccgggttcaagcaattctcctgcctcagccgcccgattagctggaattacaggcatgcgccaccaagcccagctaatttatttgtatttttagtagacatgggggtttcactatattggccaggttggtcttgaactcctgaccttgtgatccacccaccttgacctcccaaagtgctgggattacaggcgtgagccaccgctctcggccctcatttaagttttaatatgtttgtgggtagaaaacgtcttaattttttttttttaatctcagaaaatgacatgtgttggtgttgagatctctcttgagtggcttcatcatttgttcgtatgcccaatgtagaaccttattctttatcctgaattccttcctcccccttacacctgatttaattgtgcactattgatctggcttagttctggaacttctctcactctcactcaggtgttgccctagactcataggtgctctctctccagccagttttgacctctccatatctttttccattagagcagtagttgtcaaactttttgattaaaactgagaggccaggtgccgtggctcatgcctgtaataccaacagtttgagaagcccaggtggtaggatcacttgagcccaggaccagcttggacaacatagtgagaccttgcctctaccaaaaagtaaaaaaattagccaggggtggtgacatgtgcctgtggttccagctatgtgggaggctgaggtgaaagcattgcttcagcccaggagttggaggctggattgagtcgtgattatgtcatgacactctagcctggattacagagcaagacactgtcccagaaaacaaaacaaaacaaaatctgagaaattacttattccctaatttatgatttggttattaacttatttaaaatgaaaaataaacccatgtaaagttagtatacatagctttttaatgaaaatcgctttttttttttcccaaaacaacaacataaaatgtagtcggaagagtggccatcgttcacttatgtgttgcagacctccttaatgtctgcctggatggaagagtttctcatccagtgcatacatgcatgaatcattgcagccaggtctcaaccctgtcagacaacactctctttttgtagtaagtctttggtaatgcttcttttattcttaagaaatgtattcatctcagaattcaaatgaaagtaacatactaacatgataatagttcagtgtgtcagtgttgtctcagctacactaggatcacatgctcactaggtcaggtgcactgagaatgcagtggctgcaaatgcacacggtagaggtacattacttggtgattcaaatatcaagaagggcattagatgtaatgacatgttctctaaaactgtgagcaacttttggtaaaatacaaaacagtcttttgatttatgtggtaattatattcctagcaaattgaatgtgtagtgaaacttggaaaaagtcttttgtgattctgtgtgaaatggaatttggttttaggttccgataattatacatggggttttcccctacattactatctagagaaacattcaaaagtcgtatgggacaattcctcatatgggactgttctgcacaacctgttaaataaatgccagtggtgcctcccagcgaatgagaccaccaaaaataccccacggattttcacacatccattagggaatggtacatacctattaagaacactgataagtggaatcttggctgtattttttttcttgttttttgtttgtttgtttgttttgagacagagtttcaatcttgtcacccaggctggattgcagtggtgatcttgactcaccgcaacccccgcctcccggattcaagtgattcttctgcctcagcctccggagtagctgggattacaggcgccggccaccacgcccgactaattttgtatttttagtagacacgggtttcaccgcgttggtcaggctggtcttgacctcctgacctcagtgctgggattacaggtgtgagccgctgtgcccggcctgttttgtttttttaagttggatgataatttaaaaaataacttacaatacagcctgaccaacatggtgaaaccccatctctactaaaaatacaaaaattagcaggcatggtggcgcacgcctgtaatccgagctactcaggaggctgaggcaggagaattgcttgagtgaggttgcagtgagctgagattgcgccattgcactccagtctgggcgacaaagcgagactccgtctcaaataaataaataaataaataaataacttacaataataattacttgaatctcaccgttaatcagtgttaatattttgttgtatatccatcttgtccttttttgtacatttgtagtttttttccattcaaaaatgggatcatttaaaaatttaaaaagagtcgatgtcttggctgggcacagtgactcaacgcctgtaattcccagcactttgggaggccgaggtgggcagatcacctgaggttgggagttcaagaccagcctgaccaacatggagaaactccgtctctactaaaaatacaaaattagccagcgtggtggtgcatgcctgtaatcccagctactcgggaggctgaggcaggagaatcgcttgaacctgggagacggaggttacggtgagctgggcaacaagagcgaaactctgtctaaaaaaaaaaaaagaattgatgtcttgatgctacttaattttatctaattcacgtgtttttaaaaatcataacaaaatcagttttattcttcattctatcatacaattagtacaatctcaggtaagatgcaaacaatgtatactcataagtctctttttaacatgaaaactggtgctacctagggaagtacaaatgaaaccacaatgaggtaccacctccaacatgttaggatggccattataaaaaaagactgaaataataagaattggccaggatatgaagaaaagggaacgcttgtacactgttggtgggaatgtaaattgatatgaagcagttatggaaaacaatatggaaattcctcagaacattaaaaatagaactactgtatgacccagcaatccctatacccaaaggaaatgaaatcagcatcttgggaagatatctgcactcccatgttccttgtggcattattcccaatagacaagatatggaaacgattttttttttttttttgagacggagtctccttctgtcgccaggctggagtgcggtggcgcaaactcggctcactgcaacctccgcctcccgggttcaagcaatttttctgcctcaggcacccgagtagctgggactacaggtgcgtgccaccacgccctgctaatttttgtatttttcgtagagatagggtttcaccatgttggccaggatggtctcgatctcttgacctcgtgatccacctgcctcggcctccaaagtggtaggattacgggcgggaggcaccacgcctggcggaaacgatttaataagtgtctgttgccagacaaaaaaaataaattggggcatatacatccagtggaatagccattaaaaaggtgatcctgtcatttgtgacaacatagatgaacctggagagcatgctgctaagtgaaataaactagaaaaagaaaagaaaaatattgcaagatctcacttatatgtggaatctgaaataaagctgaatatgtaagaatagagtggctgagtggttatcgggggaaggggaagtgggagatgtaggtcaaagttgcagttacataggatgaataaaactagagatctaatatttagcatgatgactctggctaatattgtattggaaaatttgctgagagtagatttcaggtactcttaacacacacacgtagctatgtgaggagatggatgtattacttctgactgtagtagccatttcactgtgtatatgtataacaaaacatcgtgtcatgtaccttaaattatacaataaacaaagaagaggtgccggtttgaaggggcgaggacagagcgtggacttgcggaaagttaggtggccttggtgatttaatctctcaaaccttcggttttcttatctgtaacacgtattagagaaactgtgtcttgtcggaacctacccctcagtgggggtaatcccagctgtttgtcctcagctcatttctaactgaactgcaggcttctcaagagcagccaggatgtcaccttttcatcacctagcaccagctcaggacctggctcattaatttattgaacaaatgaatgtggcagaaaatttgctattggtgttggactgtgtttaaactttgtttcatgtttatcatggttaaacctccatcagaggtaaacaactatgttaattattacatcaaacttctgtacatcttgccccaaatgggatcatttatttgttcaggataaaatgtttttgaagtttttagcacacctgatagttgtatttcttctagattgggcttggatattgttattactcaggaatctggttgaatgtttgattgtataactctgcctttgacatatgtaattaaatgagtttgtatttaatgtgttccttgaggcagccaggtgtatttacctcagaactgttgaaggcttgccatgtctctaggactcattggtacctttaaggcatctctacaggtatgattttcttttactgtggattctttttttctttcaaaagtttttcagctgttagatatttagcagctcagtctgtttgaatgatttaatgtgttactattgaaaattactttgaaatacaatttgactgttttcaagagagtttggattctgaaggcccacagcgtataggctgaaacagtggttctcaaatctagcatgcattcactggatctgggacaggatccaacagtttgcatttctaacaagttccccattaatgctggtgctgttggtgtggggaccagactttgagaactattgggctaaagtgtggaagacaattaaaaataataatatggaggggaaatggggcccagtgtgtttgggaacaggatccctttgtgctctccacagacaatagagcagtaaagaaaaactggttttggcacctgaaaagaaggaaaatagacataaactttagaaaatactgtttgatagttgcagtggtccttaaaattaagataggagaagagatttggaaataatttaattttaaaaagtttattttaccttttttattataggagtaatgcatgttcataatggaaagtgtcataaatacagaaacatttctattctaaaagagaggaaaaatttccccaaagtatcttctgacatttttggcaatgtccattcagtatctcttttatgtgtaggacttttgtttttgttttgccatgaaataaagtttttattgtcaaaataatatatgctcattataatgaaagaaaaagaaagatcataaaggacactcactctttccagaaacaatactgataacatactgaagtttattatttggtatctcttcatgtgaatatatccatttatgtgaattaccttgaccatatggttttataacctaattttttcagtcactatcttttcatatcattagatgtaattctgaagcatcttttttaggcgcagagtatcttactctgaaaaactttgttgtagctgatgctcttcatccactggcccctcccatttctcatttctctactaggaatttgtaggtcaaagagcatgtaaaaatcttgatatgggccgggcacggtggctcaagcctgtaatcccagcactttgggaggctgagacagggggatcatgaggtcaggagaccgagaccgtcctagccaacacggtgaaaccctgtctctattaaaaaaaaatacaaaaaattagccaggtgcagtggcgggtgcttgtagtcccagctacttgggaggctgaggtgggagaatgacttgaacccgggacggggagcttacagtgagccgaggttgcgccactgcactccagcctgggcgacagagcgagactctgtctcaaaaaataaaaaataaagaataaatcttgatatgtattaccagatacccacaaagggcatagaagtttctgttctcactagtagctgtgtgcctgtacccagaccccaagtctatgctcattgccggtttaataattgccagcctgataggtgaaaatagtatcttttcattcacttcttttactgataagaagcttaacacttttcttcatgtgtcagttggtcgtttaaatttcttttgaatttctgctcttgtccttgtcacattttcttttggggttaatcttttttcttgatttatatgaactcttcatacttagggacattaattccttacatcatatgcttcagatatttgtttccaaaatttcatttgcttttaaaactaacttgtggaattttttttctttcatagaagtgttttaagtgtttcatagaagtgccatccactatgattttccttttttttgtttttttttttgtttgacatggagttttgctgttgttgcccaggctggagtgcagtggcacgatctcggctcactgcaacctctgcctcctgggttcaagcgattcctgctaatttttgtatttttagtagaaacggggtttcaccacgttggtcaggctggtttcaaactcctgaccttaggtgatccctccgcttcggcctcccagagtgctaggattacacgcatgagccattgcgcctgtcctgattttccatttttaaggatttctgctcatggtgtcaaatgagaacatcccctgtcacttcaagattttacgaatattaacctgcattttcttctacaacactttctcttttttaaaaaacgtttttaaaggtggagttttgctaagttgcccaggctggtcttcaactcctgggctcaagcaaacctcccacctcagcctttcaaagcgctgggattataggcatgagccaccgtgcccagcctctgccacacttccatgatttcatttgttcactagggtcttcaaactgtctgtagtttgttttgatgcaagcaaatacatttattttagtgtggccaaatgtaatttacatttttaaatattgaattattttggttgcactgtgcaaacattaggcaaatttaggtataaagttggaaaaagccactaagtgtcacactgttctgaggagcactgggaattctgagaaggcttaaagagtttgccatggttttctgtccttgtgatagtttgttcggaatgatggtttccagcttcatccatgcccctacaaaggatgtgaactcatccttttctatggctgcatagtatttcatggtgtatatgtgccacattttcgacagaaaaccaaacactgcatgttctcactcataggtgggaattgaacaatgagaacacttggacacagggtggggaacatcacacaccgggacctgtcgtgaggtgcggggaggggggagggatagcattaggagataaacctaatgtaaatgacaaattaatgggtgcagcacaccaacatggcacatgtatacatatgtaacaaaacctgcacgttgtgcacatgtaccctagaacttaaagtataattaaaaaaaaagagtttgccatggaagtggaggtcaggagaggggagaactgagcaagtatgtgggtatttccagctcctacttctcccaagaactgcaggcttagatgggcagctgtctagtaggcagatcttcttgggcatctaataataagctgttcaaaattaacatagccaaagcagaattcttttttttttttttttaagacagagtctcacttatcacctaggctggagtgcagtggcatgatctcggctcactgcaagcctcgcctccctggttcaagggattttcttgcctcaacctcccgagtacctgggattacagttgtgtgccaccatgtccagctaatttttatatttttagtagagacagggtttcgccctgttggccaggctggtcccaaacatctggcatcaagtgatccacccgcctaggcctcccaaagtgctgggattacagacttgagccaccgcacccagcccaaaacggaattcttgatgctgtccccaccctaatgcgcacaccccagtcctttctcgtcttagtaaatagcgctgtcaaacacccatttaggcaggccagaaacttcaaaggtgtctttgattccgctcttccaccactttatatctactccatcatgaagtcttgtagactttctgtccagaatatatcctgagtctgaccactcctaatcatttccactgttaaaacattaggccaccactgtctctcatgtgggtgttattgtggtcttctggacgttgtcttggttccactttgtctctccctgtaatctgtttcacatagtagcttctacagtgtaaataagatcatattattcccttgattaaaacctttcaaagacttcccattacatttaaaataaaatccaagccttactataaaagatccacttgtctggcctctgtgcttctccagtttcttccttctgcactccccttgtctgctttgcggtagcctaacatgtctctttctatctcttgaacaggttcttttctttcgttgggtctttatacaggctgaacctcctctagaactaactagaagctacctctgatgtcttctcagagagactttccttgactatccccaggcacatgaagaagccccacacaccccctctagtcaccatctatcttgttaaccttacttattttcttaaagtggggttctgtatgtaaaatgatcttctttatttgtttactggtttattagctgtcttcctattcgagaatgtaagctcccagaggacactctgttttgttcacttctgaatccctagcacttagccccgtgcttggcccatgacatttgtggtaagtactaggtgaccatttttggaactgttcccaccccacggcctgcattcacactttaatcacagcagctcagcttttatatcgtgagcttcagtgggaggttttgtttacagaaagttttcttggttgacaaaagcctgaagatgattttcttggaagatgaggatttattctaaggatatgtgaggaagcaaagtttttgttgttgttgttgttttggaggggtggtgggggatccgagtctcgctttgtcatccaggctggagtgtagtggcgcaatcatggctcactgcaacctctgcctcccgggtttaagcgattctcctgcctcagccacctgagtagctgggattacaggcatgcgccaccacgcccagctaatttttgtatttttagtagagacagggtttcacggaagcagagattttctgtcagtgttccatctacttcataatgtattgttgatatggttcttgattttttaacctgaaggcataagcatgaaaatagcataatgatttttcacagttcctgtccaagagtactttttctttacatgttgaattacctaccatagattgttttatcctataattagaaagattatgagattacatcatcttatatttacccttaaagagtgtttcccgaatcataagccaaagcctttgtataaccttattatgtaaatatttatgtttcaggtgtgttattccctttgtgtgtgtgtgtatctatatacatatatatgcatagtatttgtgttctcttattcctatgacattgtaaacgttctagttgatgatgtctgtgcttccattgcaactcttcactgcatgggtactctgatgtgtatggcttgctgctccccagatattcgttgactttgtgacatctgtcctaggacaatttcactattttagtttttggctactcagttaattagaaatgcatctcagttgtattttaagttattgctttctacattttaatcagtaaatacaaagagattgcctttagtttttgttatgtgtattttcaggttatgttactgggagtacaaagttttacaattgttgctttctttgtggattataggttttaggaaaataaaatttatcgtattgacagtttttgccttgaaaggcttattaaatttagcagtcctcccttttttgtgtgttttttgatccttatcctttttttttttttttttttttttgagacggagtctcgctctgtcacacaggctggagtgcagtggcagagctcactgcaagctccgcctcccaggttcatgccattctcctgcctcagcctcccaagtagctgggactacaggtgcccgcccccacatccagctaatttttttgtatttttagtagagacgaggtttcaccgtgttagccaggatggtcttgatctcctgacctcgtgatccgcctgtctggtcctcccaaagtgctgggattacaggcgtgagacaccgcgcccagcccatccttttgtttttaatctgtcattttattttaggtgcatttctagttcgcttggcctgctgtctttttcataacactttattcctatgtaatagatataatgttcttttgcattttattgtttctaaagcaaatatcttctaattaagaaaaataacttctagttaatttatttcaaggggaagcagtgggggttttattcctctggatgtttgttgtcttgtgtcctgtggaatattttctttctgtttttgttcttttctttctctaactcaggacagtgctgaggaatgttttcattggtgccgtattttctttttctttcttttcttttttcttttttttttttttgagacagggtctctgtctgttgcccaagctggaatgcaatggcgcaatctcggctcactgcaacttctgcctgctgggttcaagcgattctcatgcctcagcctctcgagtagctggcattacaggcatgcaccaccacacccggctaatttttgtgtttttatagagaaagggtttcgccatgttggccaggctggtcttgaactcctgacctcaagtgatccacccacctcagcctcccaaagtgctgggattgcaggcgtgagccgatgtgcgtggcctggtgccatactttctgcatttttctttaaggaaggttccaaatgtctgaagtccaccaaatgtctgaagtcctgcccagacttttggagagaaaacacagcaaagcaatcagtaggttaatgactgcatggtttctggaccaaattatcctcatctaccacttagaacattaagttgtaaaccagagtcagcacagccagggtggagattacttatttgtatcccttgctcgtaggttatttaatattctctgttgtgtcaaagtttagtcgggtatattaattagtcagcttttgctaaattatgttgtggtaacaatctccaaatctcagtagtttacgacaacaaaactttgtttctcagtttaaggctctttgtgggcttcatgccatggtagaacctcaaaagtggcatgtgccatttcaactcatacttcattggccaaaagcaagtcacgtggtcatgcagggcctcagtaagcaagaaatatttacccgcccggggatggacaggtaggaaagggtctgttaaggaagggcagcaaatatttggataacagtactatgtgtttgtatggagcgatatttaagaaggtttcctaggttttttgaggggtattgaagctgagaggttgggggcaggcaggaagctctgcagcctgtagcctatggtatcaagcttcatgagaacgagaattaactagttacatctttattaccatttttggcatctctgcagacagtggatctaatgcatgatagctgattaataaatgtttgttgaattaatgaacaaaatagcaagaaagtaacgtattctgaggcaggagaattgcttgaaccaggaggcagaggttgcagtgagctgacatcatgccattgcactccagcctgggcgacagagtgagactccgtctcaaaaaacaaaagaaagtaaacagattattttcatgctatttgatgcctccgcttagtttggaaccagtttttattttattttattttattttattttattttattttattttttgttttgtttttgttttcgtgttttttgagacggagtctcgctctgtcgcccaggctggagtgcagtggcgagatctgggttcattgcaagctccgcctcccgggttcacgtcattctcctgcctcagcctcctgagtagctgggactacaggcgcccaccactatgcccggctaatttttttgtatttttagtagaggggtttcaccgtgttaaccagggtggtcttgatctcctgacctcgtgatccacccgtctcggcctcccaaagtgctgggattacaggcatgaaccaccgcgcctggccttggaaccagttttatagagcagttcctacaatagctccttttatatttaaaatgaaaagtgctttcttgggggtcattttgccataccaaaagattatgtgcttaaaaaaaaaactacatactaattacagaaaaaattttaaatatgcattaaatacaagcaagtagaggttgtgttctatttggctactcaggacaactattggtgttttgttatatatcctcctatataattcctttctttcttttcttttttttttttttgagatggagtttcactcttgttgcccaggctggagtgcaatggcgcaatctcagctcaccgcaacctctgcctcccaggttcaagcgattctcgcttctcagcctccctagtagctgggattacaggcatgcgccaccacgcccggctaattttgtatttttggtagaggcggggtttctccatgttggtcaggctggtctcgaactcccgacctcaggtgatccacccgcctcggcctcccaaagtgcaggggttacaggcatgagccacatagtgcccagcctctttcttttcttttctttctttttttgagatggagcctctctctgttgcccaggctggaagaatacagtggcaccatcttggctcactgtaacctctgcttcccgggtacaagtgatgcttgtgtgtcagcctcccagtagctggcactacaggtgtgcaccaccacacccagctaatttttgtatttttagtagagacggggtttcatcacattggccaggctgatctcctgacctcaggtgatccactcacctcggctgcccaaagtgctgggattgcaggcttgagcccttttttttttccccatatggcttctgaacattgtttatatttattgtcacactaggatcacttagttttgtacttttagtagtatctattgctttatttgttatgttgccaatcggcagttgtaaaggtcgtagatgaaatagacaagtatttataagattaattttatcttacccttgttctctttttctcttcttgaatttcctccttcaaatatatgaactatttacttaaccaaacactctctttctcttccctctcaccatggcaagagtgaaagggaccagaatgatgaaaggtagacagttggcctgaggaaataaggtgccttggcgattctcagactggataatcagctcctggggaatcaggcgctgacttttttttttttcctcctgcttttactcagagatcatcttttcatattttgggatttgtgcagtcatttcaatgatctaaaagtgaagagcttgataataagttgattttagtcctactgtctttttgtgacggatgtgctagataagcttaatgtgagtcattcaagaaccaagcccctgtttgaacctgtccattgagggccctgtttatcagaggttgaagcattttttagctagcagctgatcttgggtaagcaagccattgtacaagttccccatgcctagttgttttgcatcattaatcatcttttcttcaagccatggaaacatggctgagtcttgagtcatctggctcttcccagtgctggaaatccaccctgctgaggtgaatgtgtgaaatattttttgttctcggtagagatctgagaactggtttgtctcctgcaatgaacagattgaattccttataaatatgttactaaaaggtaccttttgtgtccattttacagatatctgacatgattatttattaaactcctttaaataactcctgtgcttaatgcagtttccaaatatttgaaatactaaatgtagatttagggaactcagtgaccagttttcatttgcattttgatgaatttctctattttaatatttgtagttgctatccattttagaaatatccactctgccaagtaggttgggaatgtgtgcaagaatgacagcttaaataatgtgcttgtttgctattggagccgatgcccctaagtaaagctaccagataaagagaggaaagggggaaaaaaggaggagaatgaagccaccgtgtaacatctgttagagactcaatgtgagccctgtgagttagtcttcatttcccatgctatgttttatttttatttttcctgttccattaaagcatttcggttaattctgtataagtagaatgctgataactccttagagaaatgtgattcagtaataaccttgtttccatgtgactacttatctaatctgccatgcatctgctttaaggaaggtgtccattagggtcaactcacaggtcagacattaatcttaattgtcaaatgtctcaactcattgctagagactaaattgatcttgatggcactcatctgagtaccgattcacactaaaagacagtcaaggggttgttttcctttgtgtgttgtaattcttagcaggatcctaaaaatgaaagttttaaaatgtggaatagcatgattaatgaggacatttattaaggttaaggcagtttaaaagttcagtttaatctaaggttagcttgtaggaactgatataagagatagttaaaaatttgttaagctttacttaaaacctgtatttgggggtagaaacagttttcctagggtacttataatttcctttaattatctcagaaagagggtctcttattaggatgagggaaaaaaatgacccgtcattcttttaaatcaggtttaatttattcctgatatttatatgattcttatatgtcatgtaattcttatgacatataagagagaaaacattaatctagagtaggtaatttcctagttcagcttcttccacttgtgtgaactacagaagaactgaagagtaattgtaattgttttataactttaaagaatttaagagattaaattgctgtccttgtgaattctttgttaagtaactctcaaagaaatagtcaagttaaaggggatttactttctaaaactagctttcttttctttctgtctaaccttttattatgaaaaatttcaacatctacaaaagaaaggagagtagtatcattacccagctacagtcactgttaactctcagctaatcttgtctccatcctgccaccctccactccagattattttgaagcaaattctagacatcacttccttttattaaagcaagttgcgtttcatagtgacaatagaaaccatttactcttggcacaggtgctaaggtctgaatacaactttaaggagacagtgtctgcattgaagagcttatgttttaagaaaggagtttatgttttcactggatatactcggcgttcagggaatcagagactttcttcaagtttcccttgtcttttaaatagggacgtatttgcaagttcttatctgtttggaaattcctgtagcaagttcaggtttagtcattctgtactgctttggtggtgccttatctaaatagtattgaaaggaagaaagaattatttcaccaagagttggccttgaaaggagttagatgtattgggtatatttaggaagtaccccttcaacgctgtaataatataccaacttttaaagctacctcataatagctcttaaaaacacatttaaaacacttagaggtgatcctttttcctagccatcagtgggacaaattaattcctttttgagtaaaaaaaaaaaaaaaaaaaaaattctctttttttagtactcaagatcagcaagtattggttgactcattctttgttgttaaacctcttggtttctcaggccagtgtgtctttttgtatactttgaccttgcactttaaactgaattccttttgtcctttgagggaggcataaagctgtcagttcctgttggtgagtgtgggaaattgagttttcactcttctctataatttctgcatttcaagtggttttaataataatcataactatttctcaattttacttcttaaaaaagtagattcatcagactgaattgaatatttgttttccttctaaagctgaagccaattttgccatacttgtttgtgcattcttaagagtttagtacttaagcatagaaaactgtggggttcacatttatattttgctttattacaacttagaaggtaattgatgacttggctctgtggtatgctcaaagtgctggactgagctagttcaagaatgtcattagcagtgaatgggaaatatgtgtctacttttcttcagtagctaaacagaagtaattatatatttacattctacctatttcatagggatgttgttagaattactgtgattagatttttttttttaatttccaaatgtatttaagcttctttacagataggtgccatatcaaagcaaggtgttaatgtcatttttctcaatttgtgtttttgtcactagaaatatatatatattgctttttctcttttcctggtatatttttctgataaatgttttgaaatttgttatcttaagtttttcatagctggaatgctagaaaagcatttatgtcctatttttagtgcaagtgatgagtctggctgggtgggtaagttaatggcaaggtaattgaactgtgctgagtgctcgccgatgtatccttctggcctctccattttcagggtagagttactgtttacagtgacatgtttcacagtctgtgtgaccagccagtgtgaatcagttcgtctattgcctggctttcttgagctcaatttttgtctcatttcccctttccattttatatatcacatttcaagatggatgatctacttgtctaaccactccagggaagattggtgccatctaataaagtcaaaatgaggtcctgcatgttacctggcataaattagagaattatagaatgaatgtgtgaacagatctgagactagagctaggtcacgaaactcctcagtttttttgggttctcattatgtgtttatggatggaattgttctctttatctggtttgggtggttttgtttgtcagtggccaatgtggtggatatttcaacacaatttggacatgcttcctatatattttgcagaatggtctttttcttttggttaactttataactaatagttaaagaattttcaagcctcagctgggtacggtggcccatgcctgtaatcccagcactttgggaggccaaggtgggcagattacctgaggtcaggagttttgagaccagcctggccaaaatggtgaaaccctgtctttactaaaaatacaaaaattagtcaggcctcactccagcctgggtgacagagcgagactctgtctcaaaagaaaaaaaaaaaaattatttgggcttggtgacgtgcacctgtaatctcagctactcgggaggctgtggcacgagaattgcttgaacctgtgaggcagaggttgcagtgagccaagatcgtgccattgcacttcagcctgggcaacaagagcagaactccatcttaaaaaaaaaaaaaaaaaaaaaaaaaaaaaagaattttcaagccacattaggatgcttatcggcatgagttttacataataagacaatctgaaatgtatttgagttttgatgtttctaatctgtagaacttgaaggcctaaggattttgtagttttttagggaacagcattcctctttctctcaggtgatctatgttatgttgacctactcaaacatgttaactttgaaaatgaaccaacgttcaggaacaaatgaaatgacattttcaggacagcattccaaatacatagttagggacagttgttcgtagcttctggagtgtttgaaaatggccctcatatcatacaacttgaattggcattcattgacaatcactttgcttttaaaagatgcttaacaaagagttgtaagtaacatactttgagactgagtaaataaaataaacatgcgaacctttgatgttaagctgagtttgtttgatttttcaggctgaatatacaaagactgtttctaggaaaacttgtgctttgtacagatagaggaacctcctaagaattttgattgtggcttccaaaatagcagatttctagaatatgattacctactttatctaagatttcaaaaagctgctttgtctattttatgatataaagttttcaaaaaatcatcactgttttgtttgccttttttttttttcttgaaaaggcatgtgtttaagcatcagccttattagctggactgttatttcatgtatttctgttagaacgctggataatggacttgaaacttacatggctaatataataccatgaagtttaggaaactaagggctcatttctgttgtattccttggaacgtatgtgggttcaagatcaaaatcattatttcttctttgttttggtatttgtctctttcgggaattaaaatttgttcccaaacattcgtaggactacactgtagcaggaatctgaatagaaaacactccttgtttagttctgagtttatgtggatgaggactaagtgaccattgaaggtggaagggtgatcacagagattactcagaacttaatttattaattctaaaatgcgttcattgaatacacatggtttgtgtgctttttatgggccaaaccatgtaacagaggctgggaatgcagttcttgctctcaggggaatgtagtcttgtctgagaaacagacaatgaacatcagtttccaatagatctagttgtaggcttagagcatgcagagggaacaacagaaaaaatccactgagaccattctggggtccaaataggacccatggcccaagtttagaatggcaagaaagaggaaagacagagggagcttgggcagtgttctgcaaaggataaattcagttctctaagaatagttcactagtccttttttttttctttttttttttgagatggagtttcgctcctgtcacccaggctggagtgcagtggtgcagtggtgcagtggcacgatctcggtgcactgcaccctctgcctcccaggttcaagcaattctcctgtcttagcctcctgagtcactggaattacaagcacgcccggctaattttggtatttttagtagagatggggtttcaccgtcttggctaggctggtcttgaacacctgacctcaggtgatccacccacctcggcctcccaaagtgctgggattacaggcatgagccattgtgcctggcctggtcacttgctcatagttattaatctgaagaagttctacagtaaatcaaatgttcaggattgcctaatgttgacttactgatttagaatatcattctcttggtatgcttctataaactaccagtgctcaatttttcttttcaattttgaacttgttgatggacagtgtctacagtctcttgacagttatgtaatttgtgtctatttaggtttaagctgtcaccttcccaaatgcggcatctgtgtagccccagagggagcattctaaaaggtaaatctgagcctggcgcagtggcccaggcctgtaatcccagcactttttgggagctgaggtgggaggatcacttgagtccaggagttttagaccagcctggtagcaagaccctgtctctacaaaaaataacaataaataaaattaacaggcacagtgatgtatacctctagtcctagctaccgtagaggctaacatgggaggattgcttgcactcaggagttcgaggctacagtgagctatgatcgcaccactgtactccagcctggtagcaagggcctatctctaaagaataaaaaatagactaggcatggtggctcatgcctgtaatgctagcactcggggaggctgaggccggtggatcacctgaggtcaggagttcaagaccaacctggccaacatagtgaaaccctgtctctactgaaaatacaaaagttagccgggcatggtggcgcacgcctgtaatcccagctactcaggaggctgaggcaggagaatcgcttgaaatcgggaggtggaggttgcagtgagctgagattgcaccactgcattccagcatgggcgacagaccaagactctgtctcaaaaaaaaaaaaaaataattaaaaaaaaaaataaggccgggtgcagtggctcacacttgtaatcctagcactttgggaggccaaggcaggcgaatcacttgaggtcaggagtttgagaccagcctggccaacatagtgaaacctcatctctaccaaaaatactagcctggcgtggtggtgcatgcctgtagtcccagctattcaggaggctgaggcaggagaattgcttgaacctgggaggtggaggttgtagtgagccaagatcacacttctgcattccagcctgggtgatagagcaagactctgtctcaaaaagaattaaaaataaatgaacaaaaataagccaggcgtggcccggtgcagtggctcaccctgtaatcccagcactttgggaggctgaggcaggaggatcacgaggtcaggagatcgagaccatcctggctaacatggtgaaaccccgtctctactaaaaaatagaaaaaagtagccggtcatggtggcgggtgcctgtagtcccagctactcgagaggctgaggcaggagaatggcgtgaacccgggaggcagagcttgcagtgagccaagatcgcaccactgcactccagcctgggcaacagagcgagactccgtttcaaaaaaaaaaaattagccaggcatggtggtggatgcctgtaatcttagctactggggaagttgaggcaggagaatgacttgcactggggaggtggaggttgcagtgagctgagattgcaccattgcactccagcctgggcaacagagcaaggctctgcctcagaaaaaaaaaagtgtatatatatatatacatatatatatatatatatatatatgtatatatatatatatatatatatgtaaaagttaaaaaaaaaaaaaaaaagacccatttctgccgaaaatctttcagtgactccatcaccccaatgggccatgggcaagtcctgtttccactctcacatccttgcctttgggattgttttcattcctgctgagtatttaccctcacctggaaagcagctgtgtgaacttctcttcatccttcgtaggctggtggcctttcttccatgctcagttaatcagtttctcttctctgcttcctttgttctttggcctgctctgcggtgttgtatgaaacacactgtgccagaattgtttgtttactttctgttcctgttctaaatatgagctctttgaggcaggacctgtgtctttctttggacctttacgtttgtcgcagtaactgtcatataataaacagtcaatacttgatttaagctgagcaatgtaacacttaaacattaattttgttacatttactggattataatggtgactgaaaaaaacatttttaagttttttactccacctgggacaattctaactaagtgttttacttatgttaaaactcatttaattatctttgttaaagaattactctgatgcttgttaaaatagttaggaagactttattcaagactattgcaatggcggggagagatccagctcaattctgaatccagcaaggacaaatagagaattacagtcaagtagcagaatatggtcagtgaatggtaaattgctaagtggagacatcaaggtcagtagatcttataaaactggcttagtctgcttgggctactgtaacaaactactatagactagatgccttaagcaatcgaaatttatttcttatagttctggaggctaagtctcagatcaagatgccgacagatttagttcctggtgagggccctctttgtggtgtgcagacagtcaccttcctgctggcagaaggagagatcatctctctgatgtctgttcttataagggtaccaatcccattcatgaaggctccactctcatgattttaattacctcccaaaggctcgctttccaaataccatgaccttggggataagtgcttcagtgtatgtattttgagaggacacatttggtccatggcactgacctaacaagattgttgccgaaggcaggcctagaatgtatacatcaaaggtgggggtgaggaatttgatcaaatatcaaaggtgatcagatatctcagatgggggtgattctcactaaactgacttagcaggattgtttgtaaaactgagttaggtaggctgaagacaggaggggactggaggaggttgcggcttcgttgaggagggctcagagaagcctgagtttggtcaaggagagggtctttgtcactgttaggagccttttaacttaggtgctaattatactagcattttatagacaaagaatctgaagcttagaaagaggctaagcaactcacgaggtccgtaccagtaagcaccctacctggattctagctggcgtgctttctgttccataactttaaagcattgatcatctggaccctgcctgtgatggctcaatttgcttttgctaacctgctgtgagaatcagtgggagtttgcctctgctttaaaattactcatggtcttgctgcccttagtgctgtcaatcctgtgatttccactggagcaacatactcaggttacaacactgggtaacatttacattttagcagctttcttgaaatttaaaatatatgtgtaagtatctcatttatatgcatttctagtttctttatacaacagaataacttcttttacatcaaatttctgaatttgactaaatttagaaataatggaatctcatccattaaatatagtcatagaaggaaggaaatatgaaaattaggatttcagatgtttgaacataaaagataattttaaacattgtcagtaatctatttctttttttttttcgagacggagttttgctctgtcacccaggctggagtgcagtggcacgatcttggcttactgcaccctctgcctcccagttcaagtgattctcctgcctcaacctcctgagtagctgggattacaggggcatgccaacatgccgggctaatttttgcatgccaccatgccaggctgatttttgtatttgtagtggaaatggggtttcgccatattggccaggctggtcttgaactcctgacctcatgtgatccgcccacctcgcctcccgaagtgctgggattataggcatgagccaccgcgcccagcccagtaaaatctatttctatgaaaagctcttcaaatgtaggtgaacgctgtaagctttatgaatcaactgttttctaaatggtaatacatgaaatctgacaattttttatgtgattttattcaattttctaagaaaagtaaaaaatcagatacatagccgctcttctcttgggactagtcttgataccttttgtatttttatatagtgctttgctcatacccttcttgctgttttttgttttgttttgttttgttttgttttttttggtgggggggtgggggatggagttttactcttattgtccaggctggagtgcaatggtgtgatctcggctcactgcaacctccgcctcccaggttcgagcaattctcctgcctcagccttgcaagtagctgggattataggcatgcgccatcacactttgctaattttggtatttttagtggggacagggtttcactatgttggtcaggctggtcttgaactcctgacctcaggtgatctaccctcctcgacctcccacagtgctgggactacaggcgtgagccactgtacccagccccttcttgctatgttttagcctgcaatgctgttcccacttgtgtctatatagcactcctaatttaaatcatacacactgctattctgcagtgatttcttactctttcagtcagggttggtagcttttttctctgggctttcacagtcctgtggaagggcacagggttatcttatctgatacaatgtgtacgaaaggagtaactgtatcatagtaaaagttttatatataagtgaaaatatttacaacactttatccagcttacaagtttttgatatattttgtttctgtgtcttaaacacaatggacaaatacctcatataaagttttatatttttaattgtcatatatttcattatatggatatatcttttttggagacagagtcttgctcttttgctcaggctggagtgcaatagcacgatcgtagctcactgcagcctccaattcctgggctcaagcgatccttccacctcagcctcccaagtagctggaactacaggcatgtgctcccatacctagctaatgttttggtcttatttttgttacttatttatttatttttaaacactttgttgcttaggctagtgtcaaactcctgggctcaaggaatcctcccaaactttggctacccaaagtgctgggattacagatgtgaaccaccatgcctggctggatgtttcataatttacctaactgttcctatgctattgaacagttaagattatttaagtttttaattgttaaaaataaagtcatggtgaatgcctttggacatatatctttgtattttggattattttcttatggcagatttgcaggagttttgttattgggtaaaatggaaagaacatttttcctttattttttaagagaaagggtctggccaggcgctgtggctcacacctgtaatcccagcactttgggaggccgaggcgggcagatcacctgaggtcaggagttcaaaaccagcctggccaacatggcgaaaccccgtctctactaaaaatacaaaaattagccaggcgtggtggtgggtgcctgtaatcccagcgacttgggaggctgacaggagaattacttgaacctgggaggcggagattgcagtgagccgatatcacaccactgcactccagcctgggagacagagcaagagtgtctcaaaaaaaacaaaaaacaaaaaacagacagggtctttcactcaggctgcaatgcagtggtgcaatcatggttctctgcagcctccaactcctaggctccatcaatcctgcctgagcagttcctaggactgcaggtgcgtgccatcatgcccagctgatttctgtatttgttttttttatttgtagagatgaggtcttaccatctttcccagctggtctcagacttctggcctcaagcagtcctcctgccttggcctcccaaaatgctgggattacaggcgtgagccaccgtgcccggccacttttttctactcttgatatacttacctatgatacgctttccaaaggagttgtaacagtttgccctcccaccagtggtgtgagagagggtctctttgctctaacagtattaatatcagatatctgtattaaacttatttattttgaggccttacctctttccttgtggtaaactttctgaactaggttgacctaaagtaaactggtttagattcccaaataaaattgacaaaaactttataagatccattttaaaagttggagtgtcaaggaaataggaaaagctttgttagagagggaaatgttattcagtgaagtacatattgaatgtgtgaacttttcttcagtaacagttgttatcttttaaaaatcttctccatggtatttggaattttaaagcttaatacctctgctggattttgcaagcgtgaaactaaaacacagtgaaatttgaatgtgcaaacatacataaactggaattgtgaataaattagattataaaccaaacacattttgagtataagtgggcctttagaaagttttttatattatgggtagaaggtgaacctttctaaagaaaataagaaattgaggaaatctaggattttcttctttttattttggatctcagtgtgtttgtgatttttaacagaaacgttcttttctgtactttaatggtgcagccagatccatgtaaagaaaaggagtgaaatccccaggaaagatgaccagcagcaggattcttttcagcttttctccctttcctcaggcttgaatatatttcagtgcacctcaatcaagtgaagtgagattaaatatttgagtcatctgtctgttgccttctaaaatggtctggctttctgttggctgcagtctatttagtgttttagtgatgctaatgttattgaatggtttttagttctaaaacttctagtagtgataaatcttgtgcatagaagtcccctaggtcacttagcagagcgcagttggtttttgttaatgactgcattgtcctttgctctcattcgtgatacccagtgacttttcattgatgttgcagtaaggctttttttttgttgttggacttctcccattctttacacattggtaaataatcttcagctgtagcaggaggtagccagcatctatgtgtggatcagatttatcaatatgtacctgtgcagattgcctttatctcctgattgggcaaatacttaacagtccttagcagtctctccattgagttttccaccaactctaactggcaaaaggactcagttgtattggacaggaaaatcttattgtctttgctgtccattgtggcactaaagctgtgaagatgtcatacatgtgaagtattcactggattctcagttacttactcgttatcaaggcttacatgtagccaatttaattttgatgaatatgtttaaatgtagggcattttataattactggctcatggttttttatacagtatgtgcatatttcatttcttttactaccgtctttcagcccatatttaattcatccatttgcagctgttgcactgttttgttgaaactggcttaaaaatctggcaggaggcttccctactttcttgcccttttcggtgttatggtgttattttacacagttagtactttctatgtagtttcttctttcctaaagctgaagggccatatctctcaaacttttctctgcttacctttaaccactgttcgtgccgatgagctgataataccaggcttggttgctggctgtatttagaggtatacaatttaaatacccagagataaaggtgacagtagtaaattagtgcactgtattgtcttaagactaagtgtgatttcagttcttatgctacaacatggaagtttattttaatgttttcctttatgtatgggctttgcaatggttgaaacttgagtttttatttggaagttttggaagacaacttttagattgtctcttttttttttttttgagacggattctcactctgtcgcccaagttggagtgcagaggcgtgatctcggctcactgcaacctctagctcccgagttgaagcgattctcctgcctcagcctcccgaggcatacacgaccacacctggctaatttttttttttttttttttgtatttttagtagagatgggctttcaccatattggcccggctggtctcaaactcctaacctcaggtgatctgcctgcctcggtttcccaaagcactgagattacaggtgtgagccactgtgcctagcctagattatctcttctttagtgactgtatatatctacattacacagatgacaacattttgttttcctgtaacctaggccattacatttttttttcatgtgacaaagtgtttgcaattatttgtgaaattttaattttttcatcacttattaatttatatttgagaggactggaaagtatgtgagttgaaaatagtttaaacttatacaatctcattattaatttggctgttaatttgaatctattccataacttatatttaaaataaaattttgatttgaaaggctcttatctcaatcagtggttcttaaaattattgtttgctgtttagagttatattttttttccaggaagtacttttttagctttcaggaacttgatataatgttttattcttgatgacccactggaaaatagaaccttctagaagaaataaagtcactttattgaagctttatgaatggctctcctatctgcatctgtagggctctacaatctgatttttccaaacaaatagacaaactatggataataacttttcagatgttactttgcagttagttggtggtctggaagaagaaaaaagagcttcaaagaggggactgttaattccatttatctcttgaacaggaattgctttcctgtctttcattgctgtcccttatttttcacctttatgttgtagctaggttttggttttattagctccctgatgaattctctcttcctgccaatattaaagtaaggatgatttagaagaactgaggttaaaatctgcctattgaagctctccaggctagataccctgacatttctctttgtggaaagtaagcaggagtaaagggacaaatcgtccgaaatgccattgagtgttgccaagtgatgtgctgacagctgtacctgacagtgattgctggaccctggtcattcctgagtgtctccttttcacctcccatcccctgctgccactcccccctaacaacaacagaaattctgggaggaatgcctgttccctatttagaggacaacttgagtgatcatgatagtttgtcagatataatgtggacaatgacctttttcagttttagtaataagattcttctttttatcaggttctttatcctttatgcagttttaaaatattacttatgaacaagctgcatatcccttttaggtcatcttgttcttctacttcaaatagcacatgtagaagccacatttgaggctcagggcttcagacatgacaatagggcattgatcaggttggctatatgtttgggatttgtcagttcctttgtccattttttgtctcgctttcagtaccttttctctgtgttttaaaagggctttgtgtacctcttgcctttatgtgtaatcttacagggcagctttcttctttttcattcatttcctgctctaagagtcatctcaagataggaatctggtataagactcacttatagaacagggacataggctcttccagttgttttcattcattgcagattattttaaataagagaaaggtttccttgtatttttctttaatgttttccaattttgaattgttatagatgcaaagcctttaaaaggataatatgtggaggcagtatttgtttggggtatcttttaattgtttttctagatcaaggacagatatagatagattaatacctgaaacgaaaccctaacaactctcaaatatcagataatttttttttatgtttctgaggatgtttttatatcctttgagatatttaaaatatacacatttttatgtttctcccacatttggacatttctttcccctcaatgtttcattgatgccacatttctaccaattttaatcttgtattctatatcttactatcctatagtttcttcaagctgaaattagaccttttgagcaactttaaaacaaatttttaaaaatatttatttataaaagatcaattacacttattaccttagtaccataataaaaatctgtttcaaataaatgagtctgaagatgggaagggacaccattcagtgggtttagaaatagacctgttaaaatacaagtccagctggctgggcacggtgcctcatgcactttgggaggctgaggcgggcagattgcttgtgctcaggagttcaggaccaggctgggcaacatggtgaaaccctgtctctacaaaaatacaaaaattagccaggtgtggtggtacacacctatagtcccagctacttgggagactgaggtaggaggatggcttaagccctggatgtggaggttgtggtgaactgagattgtgccactgctttccagcctgggtgacagagccaggtcctatctcaaaaaattatagaataaataaataagcaagcccaaaggcaatttcattttattttatttagagacagtgtctgactgccgcccaggctgcagtgccagtggtgccatcatagctcactacaacctcgaactcctgggacaaaagcattttttcctgcctcagcctccccaagtagctgggattgtaggcatgtaccacacacccaatttttaagtttgttttttgtagagacagcatcttgctatgttgcccaggctggtcttgaattcctggcctcaagagatcctcctgcctcagcttcccaaagtgctaggagtatcggtgtgagccacctgccctgcttgaattgttttttttttgttgttgttttgtttttttttggagacggagtcttgttctctgttgcccaggctggagtgcagtggcacgatctcagctcactgcaacctaaacctccttgggttcaagcaattctcctgcctcagcctcccgagtagctgggattgcaggtgcccaccaccatgcctggcttatttttgtatttttagtagagatggcattttgccatgttggccaggctggtctcgaactcctaacctcaggtgatccacctgcctcggcttcccaaagtgctgggattacaggtgtgagccaccgcacttggccctgaattgtttaaatatgaagatgaagaggtctctgctgtccttactcctctggcctctaataccttctagccatcttgccttactttggaagggagggagacagatgtagttgttcacagttgagagctgctgaaacactgtgactttatggacagtagtagggagaaagcaagcctaatccgtttataaatgttccattatatacaaaataccctttctaccaacagtaggttcttaattactgacaccaggcatgctttggttgtgactccagcagcgcgggttggtggcatcttacactgaacagcctgggcctccactctccccttctgtaaattttgcctgtcactaattgtttgggcccagtttcttcatttatataagaggattataagatttttgtgaggggatggtcaataattaagtgaaaaacagatgatgtatgttcataatcaccttttagtctctaggtcattaagcctagattagcctattttggtgtattagaaatttgctgattatctggactatgtattagtagtacatgtagaagatttcttttttctgtgtgtgtgtgtgtgtgtgtgtgtgtgtgtgtgtgtgttttcttatagatgtggtctcactctgtttcccaggctgaagtgcagtggtgcaatctcagctcatgcaatgccaccaatccatgttgctggagtcacaaccaaagcatgcctggtctcagtagttaagaacctactgttggtagaaagggtattttgtatataatggaacatttataaatggattaggcttgcttaggcctgggttcaagcaatccttccgccctagactcctaagtaattggaactataggcacatgccaccacgcccagctagtttttgtgtattttttgtagagacggggttttgccacgtcacccagaacagccttgaactcctgtgactgttgtgggaaattgatctagactcaagtgatctccctgcttcggcctccaaaagtgctgggattacaggtgtgagccactgtgcctggcctgtaaatatgtttgaattacctcatttcatcttgcatgcttgttatttttaacatgccttttctccctttaatttttaaaaaatttggctgggcatggtgacgcacgcctgtaatcccagcactttgagaggcataggtgggtggatcacttgaagccaggagtttgagaccaacctggccaacatggtgaaaccctgtgtctgttaaaaaaaaaaaaaaattagccaagtgtggtggcacgcacctgtaatcccagctatttgggaggctgaggcaggagaatcacttgaacccaggaggcggaggctgcagtgagcagagattgtgccactgcactccagcctgagtaacagagcgagactccatctcaaaaaaaaaaaggccggaatcctagcactttgggaggctgaggtgggcggattgcctgagctcaggagttccagaccagcctggtcaacatgatgaaaccccgtctctactaaaaatagaaaaattagctgggcgtggtggtgggtgcctataatcccagctactggagaggctgaggcaggagaagtgcttgaacctggagggcggatgttgcaatgagccaagattgcaccacttcactccagcctgggcgaaagagcgaaactctctctcaaaaaacaaaaaaacaaacaaaaaaatttttttttttttttttttttttttttttttttttttttttagacggagtcttgctccgttgctcaggctggagtgcagtggcactatctcaggtcactgcagcctccgcctcccaggttcaagcgattcccctgcactcagcctcctaagtagctgggattacaggtgctcaccaccacacccagctaatttttatatttttagtagagatggggttttgccatgttggccaggctggtctcgaacacctgacctcaggcgatctgcccacctcggactcccaaagtgctgggtttacaggcgtgagccaccgcacctggccaaaaaaatttgaaaattttcaaacattcaggaaagttgaaagaacagcacaatgacatacttgttttaaaagaccaattacagtttaattatttgatataaagttaagttttaaattatgccagtaattaatactttagacattttattccacatggttaaattttacctttttaactattcaacttagtatttatgtgctagaacctaaaatccctaattgtttatgttttgttttgatttttattttttggaattgttgcatattttctgaataatcttcccatgtttatgatagcaaaacattggaactgaaataacaaatctgtttcaatatacttttttatcatgcaaaatgacattttaataaatattgttttagccaggcacggtggctcacgcctgtaatcctagcactttgggaggctgaggcgggcagatcacctgaggtcaggagttcaggaccagcctggccaacatggtgaaaccctgtctctaccaaagtacaaaaattagccgggcatgatggccggtgcctgtaattccagctactcgggaggctgagatggaaaaatcgcttgaacttgggagatggtggttgcagtgattgcagtgagccgagatcgcaccactgcactccagcctgggtggctgagcgagactctgtctgtgtgtgtgtgtgtgtgtgtgtgtgtgtgtatacacatatatacgtatatataaattgtatatatataaagaaagaatatatatataaagaatatatatgcgtatatatataaagaaataaagttgttttaaggatggtcattctagtttataaatacatgtttattagaggccttctacttatctatatcaacattagggattttaatgtaagtgccaaaattaaggatcatcagtattttttcttttgactttctgtaattggctcttttttcctgaagctgaaatgaagaaagattaaagacttcttaaacatattctagctttggtttaaaaatctgaacattatccaaacttgaagaaactatttacctgtttcttcattgcttaatacttagtctctatgtttttctattttttgtacctaaataaggagtgtttgtctcaataaaatatctaggtccagcaatatgtttagaaaggttttaataacttgctgaaagcatgcattttgtgtaaagtgtggcaaagaaggaaacaattgtactttcactgggaaaagactaaaaggaaatataaataccaagctgttgatagaggttgccttcggagagtggaattgtggatttttttttcacctatcttttcagttttctaaatttcccacaattgtcacctataacctttaaagggggaaagtgtaagcaatcatgatgtaggccctgttgtaaaacagaagtaaatgggactgtgcctatttgcctacttggtgctgcccttttccgtgtgttgtctcctcgccgaagagctccgggcccttagccctgaggtgctgcctctgcttggggctgagcttcctgcactcctgggtaactctcctgctttctaggccacagggccagggacctcagagagaagaatgcctttccttttctctaggtatgtttctgtttgttttcagcgtaggtgacctaccttatgctgctgaagtcccctcatagagatagaactgatttcgttcacttttttcttttcttaactgctctaggctttctgttagattttcaaaaaatgtgtgacttcctgcttacatatggtaaatgtttacacgtcaggaagcttttcctttttgtgtgtaagaagtagaagctcactggacttatatgtcagcattctattaatcttaattcccccattttgtttctgtgatctgctatgacattacaaaaaaaattggtttatctttcttctttcgttttccagtgcctttattgcatggaacagtatcccctgcacccacgcttcaccctggttagtttaccaggctaactactttgtgcctctttggtgaagttcgtattcctaaaagtatgaggttatcatcatgggctctgaatccagactctctcttccattgtttaataactgtataaactgtgttttagtctctggaagagggaatactaataatatttagtccatagctttgttaataggattaaattggctaatataggtcaggtgtacttgcaagcacttaaactttccattcgttattataagctattactattaaggatcatgccagtaaatcctcaccaaaattgacttcattattttggcataatgttattgtagactattatctttgattccgggagtaaggctaagttgtcatttgaatgagataaggacctcgaaatcagttgtaaagacaatcttggccgggcgcggtggctcacacctgtaatcccagcactttgggaggccagggtgggcagatcacgaggtcaggagattgagaccatcctggctaacatggagaaacccatctctactaaaaaaaaaaaaaaaaaaaaaaaatacaaacaaaaacattagccaggcgtggtggcaggtgcctgtagtcccagctacttgggaggctgaggccggagaatggcgtgaacctgggaggcagaggttgcagtgagccgagatcgggccactgcactccagcctgggcaacagagcaagactccgtctcaaaaaaaaaaaaaaaaaaagacaaaatgttttaatgaggagataaaaatcactgaaccagcctgttgtttttatattggatcagtatagctttgtaccgtacctggaaataaaaataaaaatttttcctgagtaaattaataagatgtaggaaagatattaaggtttatttttaagtaagctctaaatagaaatgataatctgattataaaaagaagaatatgaaaaatatttaatatgctagtgctctgactcaaaaattaaaacctacattttttctttattatttgttttttgagacagagtctcgctctatcacccaggctggagtgcagtggcacgatctcagctcactgcaagctctgcctcctgggttcacaccattctcctgcctcagcttcccgagtagctgcgactacaggtgcctgccaccacacccggctaatttttttttttgtatttttagtagagacagggtttcactgtgttagccaggatagtcttgatctcctgacctcatgatccgcccgcctcagcctcccaaagtgctgggattacaggcgtgagccactgcacctggctaaaacctacatttttttcaattctctttttaacatttgaaaattttgcttaatctaaaatatactccagaagtttaaatggaaagaccttaataaaatattcagtcaaatgctcttcctttagaaatggaggtactgaagttcatttctcctatcattctaaattgatgtttcattttgactatatatttagtgagttatggcagtaaaagcagctttaattttttttctgaaagcctactcatattggagccctttataacttgcctcttgaagtatatatatttattcatacaaatcaaacactgatgtctgtgaagtttcatatcatcttttatatttgaattttgttcatatacttattgtcacccaggctggaagtacagtggtgtaatctcagctcactgcaacctctgcctcctgggttcaagtgattctcctgcctcagcctcccgagtagctgggattacaggcatgtgccaccatgctggctaatttttctatttttagtagagatggggtttcgccatgttggccaggctggtctggaactcctgacctcaagtgatctgcccacctcagcctcccaaagtgctgggattacaggcatgagccaccaagtttttaattgatggcattttaaagaatacctcatattttatactttccagacattttccccacttatatgaaatttaaaatgagagtatagctgttatttgttacttggtcataaaggtatttggaaaagcactgatcttagaattttaataaaaggcatttattaccaaaaaaaaaaaaacactggatatattgaccttaaaatgagtaattagtattttccagtaaagcattttggattcaacatagactatgcttcaccctacctcacttctattagaaaaccttttttaaaaagaaattttctttttgtcagctttagtaaataatgtcattcaggattcctattcacaatctgagatctgccacttaacttgctcagaagccttacagtccacaccatttgttctatcctttcaattcaggttttatttgtttatttatttatttattttttttggcgtgctgttgcacaatcttggctcactgcaacctctgccttctgggttcaagtgattctcctgcctcagcctcccgagtagctaaggttacaggcgtgcgctatcacgcccagctaatttttgtatttttagtagagatggggtttcaccatgttagccaggctggtgttgaactcctgacctcaagtgatccacccgcctcggcctcccaaagtgctgggattacaggtgtgagccactgcacctggcctcaattcagtttttaacttgagcttaaacgagatattttttaaaagttaaaatctgtgttgaggcatatcaagaattgctatgtctcttgggggagagatgtgaattccatcaacatagatatgctagtttatagtgaactgttaggaatgctgtacccttgactcatacttagtcttttctttgtggcttgtggctctcttttcaacttcattaacatgtaattgaagtgtactaaatgcatatacttattttttatgttttttcaattttttattttttgtgtgtgttggggggtctcactatgttgcccaggctagtcttgaactcctggcctaaagtgatgctcccaccttggcatcccaaagcactttacagatgtgaggcactgcactttaaatgtgtatatttaaaaatgtacagtttggttagttttgacatgagcatatgcctgtgaaatcatcattcccaagagagcaaacacttctgttcccccaaaaggttcttgtgcctctctgttttgtgtcctttcttctcctcccatcttcaggaaaccactgatggggtttttgtcactataattagtttacattttctagaatttttctggaagtggaatcatagatatatacttcttttttaatctgacttctttcacttagcataataattttgagattcacgcatgttgttgcctgtgtaacagttggttactttttattgccaagtagcatttcattggatggatagatcatcatttgtttattcattgatcagttgattgacatttgggtttcagtttttggctcttaaaaataaagcttgatagtacatttgtatagaaatctttgtgtgggcataaattttcatttctcttaaccaaatacctagaagtagagtggctaggtggagtggtagctgtgtaatgttttaagaaaactatatttttaaaagtttgtacaattttacattcctctcagcagtgtgtagagctgttccacatcctcaccaacactagatgtggtcattctttctcatattagccattctagtggaaatatagtggcatatcagtgtgattttagtttgcatttccctgatgattaataatgttgaacatcttttcatgggtttattgcccatttctagaagttattttacatctcagccatttcctcactgagctgtcttattcttaaattgtaagagttctttagatattgtggatacaagtactttttctaatgtatgtgttgcaagtaagtgttttctttgtggtttgcttttttgttttcataagggttatcttttgaagaactgtttttttgttttttttattactttgaagcccagtttactaattttttcttttttgtttttttttgagatggagttttgctcttgttgcccaggctggagtgcaatggcgcgatctcggctcacagcaacttcgcctcccaggttcaggccattctcctgcctcagcctccagagtagctaggattacaggcatgcgccaccacgcccggctaattttgtatttttagtagagacgggtttctccatgttggtcaggctggtctggaactccggacctcaggtgatccacccgccttggcctcccaaagtgctgggattataggcgtgagccaccgcacccggcctaattttttcttttataaatcatgcttccttgtgttttgagaaattgcctagcctaagttcaggaagatattctcccatcttttaagatttttatatgaagcatatatggttttgcatttaggcctaggacccgttttgaattaatttttgtgtattatgtaaagtgtcagtgttggcttttctccccacctggatatccagttgatccactttgtttgttgaaagacttttttcctccagtgatttgtctttacaactttgccaaaaatcagttaaccaaacgggtaggtctttctgaactcttcttttctgttttattgatctgtctctttacaccaatcccaaaaggccttgactactgttgttttatagtaaatcttgaaatcagggtaaatctttcaactttgttcttttaaaaagttgctctgcttattctaggtctttactatcagcttgccgatttctgccacaaagcctgctgcaattttgattgggattgcattgaatatacaaaccctttggaaagaatggcattttcacagtatttaatctttcaacccatgaacttagtatcttagtaccatttatttaggtcttctttaagttttcttcgcaatattttgtagttctaagtgtagaggccttgtatatgtttttttgtgtgtttgtttgagacggagtttcactcttgttgcccaggctgggcctcccgggttcaagcgattttcatgcctcagcctcccaagtagctggaattacgggcatgtgccaccatgcctggctgattttgtatttttagtggtcaggctggtctcgaactcctgtcctcaggtgactcacccgccttggcttcccaaagtgctgaggttacaggcgtgaggcaccgcgcccagcctgtcttttgttaaatttacatttagaaattttacatattttgatgctactgtaaaacagttgtttttcttaattccactttccaattttttgcttgctagtatttaagaattcagttcattttaatacattaaccttttatcctgcagttttgttaaattcacttattgaatatagttattgttttctagattctctgggattttctatataaatagtgatatctgtaaataaggagagctttatttttactttccaatcttcatgcctattttttgcttgttgtttttcttgtcttattactttattgagtaatctccatatcagtgttgcacagaagtggtaaaagcagatatccttgtcttcttcctgatctcaggctgagaaattcagtctttaaccgttaactgtgatgttagatgtaggttgttcatggatcccctatatctgtttgtagaagtttcctactaattctaatttgctgagaggcatttttttttgtttttttttttttttgagacagagtctcgctttgtcacccgggctggagtgcagtggcatgatctcggctcactgcaagctctgcctcccgggttcacgccattctcctgcctcagcttcccgagtagctgggactgcaggcaccggccaccacgcctggctaattttttgtatttttaggagagacggggtttcaccgtgttagccaggatggtctcgacctcctgacctcgtgaaccgcccgtcccaaagtgctgggattacaggcgtgagccaccacacccggcctggttttttttaatcatgattggatgttgcgtttttgtcagaagcttttaaaaaaatatctgttcacatgatcatatgggctttctgctttattctgctaatatagtatattacattttctgaatggtttaatcttgccatttctaggataaactatttggttatattttagtatcctttttatataatattgatgttcaatttttaatttttgtgaatgatttttgtatctgtattctttagggatcttgttctattattttttgtaacgtctgtgaggttttggtattatagttgtatgacctaaaaaagtgaagtgggtagtgatctcctttttttttgtttgtaaaacttttcataatttttgtattatttcttctttgaaagaattcaccagtgaaacagactatggctttcttttgggggaagttttttgttttttttttttttcttttgagacggagtcttgctccgtcgccaggctggagtgcagtgctgcgatctcggctcactgcaacctccgcctcttgggttcaagtgattctcctgcctcagcctcctgagcagctgggactacaggcgcgtgctaccacacccagctaattattgtatttttagtagagacgttggccaggatggtctcgatctcctgacctcgtgatcccaaagtgctgggattacaggcatgagccaccgcgcctggccggggaaggtttttaatgataaaatcagcttctttaataaatataagagtattcacattctcgtatcaattttagtaagctttattttccaagaaatttgtttcttttatctacactgtcaaatttattggcataaggctttttactatttcttattttttaaatgtttgtaggattgatggggatgccccttatttctacgatttttttttctctctgtatctagctcgaggtttgtaaattttttttttcaaagaaccaaagtttgattttgtaattttctctattgtctgcatttttattcatcctgccatatcactgtaatttcctttcttctacttactgttggtttacatttctttttccaagtttttttctgttattgtttagattactaacatttaatgtaattatcggttgttggaattagacctgccatcttcctattactggttttgtttgtcctttctgtttttttttctttctttcttctgtttcttttttcttgacatctttggatttttaacattccattttcatttgcctcttgactttttggctatgtctttttctgtgtgttgtgtgtgtgtgtgtgtgtgtgtgtgtgtgtgtgtgtgttgtgtaattgctccaggtagtaaatatatttacttaaccttttattatcagcttagagttaatattttatcacttcacatagaatgtagaaggcttgcagccataaaagtccctttaccctccccccagagacatttatgttacagttgtcatatgtgttatatttatgttgaaaccctactacacagtgttacagtatttgctttcaacagtctacatattttaaagaccctaataggaaaaataaatttatatttactcagatgtttgccatttcttttgctctgctttcattcttaaagatctcagcttctctctaaaattttcatttgattctttttaaactagtttttctttctctgctgataacttgtatctttccatgcatttgtgtttgtgtttgcctcatggaaagtaggtgtaatggctgttctacagtctttgtgtgataatctcaacattttcattgtcttggagttggcatctgttgattgcaattttttttttttaagaatttgtcagattttcctacttctttgtatgtccagtagttttggattatatcctggacattgtgagtttcatgttgtatagatgttgtgtgctgttgtaatcctctgcagaatgctgtttgtttcagtaggtatctaacttggttagatctgccttggttatataccagactataaattctctatgctgtctgtggacaggggttcctttctcagttcagttttcaagaccagtgagtgctgtgcttctttgagcctgccgtgcatatccatatctcaggtgtgagcctaagacaagcgggagttaattcacacaatggcaggtcccatttctaccttctttcctctctggttttccccacactttacagcccacaggtgcctttttcattagttcctttaaccacaaagaccgtgtttctgttggagttttagtctctgcacctgtgcttcactgcatagctccctgactggggcccacctgtggggcagagttgtagagaaaagacaaaaaagaaagtttttactccatggaaaggaaactttttagaaactttttactcacctcccaaatctgcctgcttttgtctacttcttattgtcctcaagtattatagttacattttgtgttctgtctgctatagcagaagcagaactctggtttgtgacattttattttatttttatttttgagactgagtcttgctcttgctgcccaggctggagtgctgtggcaggatctcggttcactgtaacctctgcctcctgggttcaagcgattcttgagcctcaccctcctgagtagctgggattacgagtgcccaccaccacgcccatctaatttttgtatttttattagagacagggttttatcatgttggccaggctggtcacgaactcctgacctcaagtgatccgcctgccttggcctcgcaaagtgctgggattccaggtgggagccaccgtgcctgaccaggttttgtgacattatttaatgtgttggatatgtgattattctttttcaacatggtagcctttttttgtttttgtttttgagacggagtcttgctccgtctcccaggctggagtgcggtggcacgatctaggctcactgcaagctctgcctcccaggttcacgccattctcctgcctcagcctcccgagtagctgggactacaggcgcccgccaccacgcctggctaattttttttggtatttttagtagagacggggtttcaccatgttagccaggatggtctcaatctgctgacctcatgatctgcttgcctcggcctcccagagtgctgggattacaggcgtgagcaccactcccggtctcaacatggtagccttttacaaattactatatttttttcaaattgtagtaattcatacagcaagcatatataatggtaggacaaaacaccttaagccaagatgtcatctccatggtctgtccaggtagcatagaacacaaaaggagatgtgattgaaagatgttgcttcatctacatgtttctactattgtctggggttccttaggagccaaggagaacctcgctgtgattggcattggaaagacctgtggttggaagaaaattacctgggaacattccagcctcatcttttttttttttttttttttttttgagacggagtcttgctctgtcacccaagctggagtgcagtggcgctatctcggctcactgcaacctccggctctcgggttcaagcaattctcctgcctcagcctcctgagtagctgggactacaggcatgtgccaccacaccgggctaattttttgtttggtggagacggggttttaccgtgttagccaggatggtctccatctcttgacctcgtgatccacccgccttggcctcccaaagtgctggaattacaggcgtgagccaccgcccctggcccagcctcatctttaagccataatttggctattgtgttagtgaataaacctgaaaggtacatcttcattcatacataaacataatttagttttcattaggtagattccttgttcacatccagctgagaacatgacactaaagaaatcgggctttaattggggagggaaagagagagaacgtggagtccctttggttgtcacttaagagatacagatgaaggagaagtagagttggaggtcagaagggccagaaggtaaatgtagtctaatattagtcatagtgaggtgaaggcttttggagggtagagattcacctagggtgagaattatttcctaagttctagagtagcatggtaaataacaaatagtcttaggtgctttgtcaggaactgataatgactacaagtatatttgaaatcataagagttatatttatgtttgctgtgatcctctcatagtagctgtgaaatatttaaagtaaggcataaaattattatatctatatctatatctataagtaaaaatggtctattttaatgccttcagtatcatagttgagtattaagctaatgctaacttcataaaatcattttttcctaagataatttttgagatttataggaaggtagaaatgcatgcatttcctctggatttgccatttgttgcatagtattatgtataacattttcttaaacaaaaagcttaaagaaaatattagcaaatcaaacctagctgtgtagtgaaagaataacatgcatatatgaattggtctattgtacaaattctaggataattcagtatttgcaaatatgtcactataattcagaatgtaagtaaaggagaaattcattatctcactagatgcttaaagaaagcttctgaaaaaaatttagccatttcttaataaaattataaaaaataggaatagaaggaaactacataaatatggtaaataatctttactaaaatacaacaacaaaccaacctattaaaatatgaaataccaaaactgtcactgtgaaagtcacaggcaatacaaaaattattgctatcacaactattttgtatagcttagtattattgctttgggctagtaatgtaaggctaaattctttatttccagaaaatataggtctaggaaatctaaagagattcatatgtgagactattagcactaataagaaagtatggtaaagtagctggatacaaagaagagaaatcaataacctctttattttgcaacacagtaaaaaaatggaagtaaaactgaatgaacagaatgtattctcatatatattaaatatctgttttactatgcatttaaaatccagagcttaccatttttgggaaactctacaaaaagatatatgacatgttgattccaaaaggattttatgaggactaagtgagataaaacacactaaaatgttcaagagaattatcaaggttgcctatacaatatattgaatgagaaattgtcgaggaaaagaaaggcagctgcaatttctaaagggaatctacagtgagaagtagtctgattcacaaacctctggttaaatatggtgtcttgactacacttgttttctccttccctaaagtctgcaataatctcaaaggaagcttaaaaatgttaattcatagctgggcagatggggtgttgtcacctgtaatcccagctacttcggaggcagaggcaggagaattgcttgaacccaggaggtggaggttgcagtgagccaagattgcaccactgcactccagcctggggacggagtgagactctgtctcaataaataaataaaataataaaatacataaataagtgaaatcttaattcataaggagaaacataacagtaaaggagacagtgaccaaagattttaacaatttttcaaaacagaaagtgaatggagggagtagtaactgagttcacagagaaagataccacctaagtacctgcagaggtcagttatggagataacagcatgccccagggatatcttgagagagttccttgtgcttgggggctccacgtattccaaaaggctgaagtcagttttacagctcacagtggaaattccttaaaagtccatatccagatctcttagaccttcctctcctacactccagcagatgggtaactacttcagtcccgtctgctggggaaatgggaggagcgctagaaccggaagtgctccagactagagaggtgaagcacgggattgaaagtcaagtgagcctgtacaggtctgcacactgaagtgtagggccctacctccttccttcttcactcctcctcaaggcagcacttagatgagttgatcccttcacaccccacccagcagttcgttctacctggcaaaacttaacagcttcggtgaagaaacctccacattactgaacatttggaggtgtcccaatgaaaaggtaactcaatatacctgatcattttacagagaagcccatcagtcaacaagcttgccacccacgctgagcttgggcagttttttagtgcctcattattaaatatggaggcgcatccagggaccactagatatacaaggaaaaccttaaaagtgaaagagacgaccgagacaggcggatcacaaggtcaggagttcgagaccagcctggccaacatggtgaaactccatctctactaaaaatacaaaaattagccgggcatggtggggcgagcctgtaatcccagctactcaggaggctgaggcaagagaattgcttgaacctgggaggcagaggttgcagtgagctgagatcgcctgggcaacaaagcaagactccgtctcaaaaaaaaaaaaaagtgaaagagacccagtcaatgagccaatgaacaaaaaaggaacccagaggaatccaatgatccaagaaacagaagaacagagaacaagaaagtgcttttggaaatttaaaaatgtgatagttggaaaaaacttctgtggacaaattggaagatgaaattgagatgtattagggcaagagactcattttttttaatttaaatttaagattttaaatctgtgagtatttagtactcattctttttttttttttaatttttgtttttgagacagggtctctctccagttgctcaggctggagtacagtgacaccgtcttagctcactgtagccttgacctcccgagctcaggttattctgccacctcagcctcctgagtagctgggactacaggctcatgcaaccacgcctggctaatttttgtatttttactagaaacagggttttgccatgttgcccaggctgatcttgaactcttggactcaagtgatctgcccgactcagcctctcaaagtgctgggattacaggtgtgagccactgtgcccagtcaatactcatttttaactgtgcatttaccctgttaaattaaacgtaaggaaaaatattcactaaatctggatttttttgagacggagtctggctaagtcacccaggctggagtgcaggggtgcaatctcggctcactgcaagctccatctcctgggttcacgccattctcctgcctcagcctcccgagtagctgggactacaggcgcccgccaccacgcccagctaattttttttgtgtgtgtgtgtgtttccagtagagatggggttttaccgtgttagctaggatggtctcgatctcctgaccttgtgatccgcccgccttggcctcccaaagttctgggattacaggcgtgagccactgcgcccggccctaaatctggatttttgtttttagttagagaagaggactggctttttttcacatcggctgttgatgaataaataatgcctgatggagatttttggagcattagatttgtgtttggtagtctgggacagatgttagtgtaatatgcattgtttacaggatatggagttagcaggacagctaactccacagcgtttggtcaccaaacgaatgatatcgtgctaatcacgtaccctttctgattttcatttacctgatccataatatggggatggtaataatggtaacctatctcacagggctgtgatgatgagtagaagagataagacctataataaattacctagtataatgtgtagcatgtactaaatgctcaatgaaaagaagctttgattataaccatcaagtagatggactggtaattatagatggttaagaaaaaggtacagtcagccctccgtatccatgggtttcacagagtccataggttcagcctaccatagattgaaaacatttgggggaagaaattatgtctatactaaacatgtacagacttttaagcttacagaataacagttgtttacatagcatttaccttgtattaaatattgtaagtaatctagagattatttgaagtatgcaagaggacgtgcttaggttatatgcaaatactgtgccattttatatcagggacttgaggatccacggatttttttttaatccatgggaggtcttggaaccagtgttcctgggataatgagggacaactgtatacttaaaaagtaacacgtgaatgaatgaattccttaattgtagagctatgctctggctctagtattagtcctctgaccattaaagatagcatgttggtgtgtttatgattatacaggaattaagttttcataaacttaaatgttgcattttcacttacaggcgtcgattagcaaggtaaaagtaacagaaccatggctcagtttccaacaccttttggtggtaagttttcagaaatttctctttttaatgtactttgggaccagattttaaaaacttgatattatggcaaatttaaaattaaaaagtagagaaaataatataatcagcattcatgtattccatcatatagtttcattaattatcaactcatgcccaatattgtttcatctggattcttttggagcaactcccaggcatcatttcatctataaatattttagtatgtgtacctaaaagataagaaaacgtttaaagacataacttcagtaccattatcacatctataaaaatttacaataccgggccgggcatggtggctcacgcctgtaatcccagcactttgggaggccgaggctggtggatcacctgaggtctggagttcaagaccagcctggccaacatagtgaaaccctgtctctatgaaaaatacaaaaattagccgggcgtggtggcaggcacctgtagtcccagctacttgggaggctgaggcaggagaatgacatgaacccgggaggcggaggttgcagtgagccgaggtcgcaccactgcactccagcctgggcgacagagcaagactccatctctaaataaacaaacaaacaaacaataccatattattgtacctgtaaaatgttcgctacatctagtctgtaccttatagtctttggacatttccctgatagtctttagacatttcttgttatggtttgtttgtttaaattgggatccaaataagatacaaacattgcaattaggtcatgtgtttcccaagtctcttagtgaattttcccccactcctctgtttttttatcagcaagttatttgttgaagtgatggggtcatttacactttttcaaagcctggatttgaagcatgacatttttgtttgttttacttcagttaaactaaacataagtttgaaacatatcagtctgcataaaatgtgttttttgggtaatttttcctaatgttattaggaaattgttaagtgttcttgcttacacccaagttactttttaacaaaaatacttattaaaaagtacttattaaaaaatacttattaaaagttcatattaacggattactcttggaagctgtctaatcttgtcatgaagagagtaaaagtctccgtgggattctggtacagagatctgtaaacttttaaaaatcactagttattctattttatttttgtcccccttcttaattactgtacaatttctggtttttgtttatagttacagggatgaattctgacagggcagtgaaaatttcttctagaagttgcagaactgtaaggcctgtgaggaaggggtcatttctgtcttggacacccgttcatccccacagtaaatatttttccagtgactgaatggatttttactttatctgtcagtgtcatcccagacccggtagagaggagagatgcaatgtttagatgtttttgctggtgtgctgggcacattcacattttgtgtgaaacatacgtattgtgtattcccagttttgtggaaggtgtccgagcttttgaaagctttcatgtatgtaatctagaattattttagtcaatttgaggagacctaggactaaagtctgcaagatctcagtcgtgagtggacatctagtcagcctaagagctgaaactgaaggaaaacctaaaacccattctctttggctattatttcatatcaggacatcccctgcccttctttttttttaagtctgtttcctgcatactgagatacctgtttttaaaaacagctttagtgaaatataatttatattccataaaatttactagctttagttgtataataatttttagcaaattatatagagttgtgcagccatcaccacaatctaatatattaatattttaatcaccccccaaaagattttcatggatatttatcacactcaccttcttctttcataacttttgcctgtggcatttaaggcacttgagagtacagttttaggtttaagttaatttagtctgttgcttgggtttatgtaagtaaattattaatttactataatcttgctaactatgggattataaaacaagtttctaaaaaaggaatgtgtgcctcttcttttctttccctcccattctctctctttctgtttcttacattttgtgtcctgttttacacttttctaactttatatgcataacttccaaggacaagaagatgtgaatttatcaagtctttataatacattgacagaatcttgaagtgctgtggaaatagtgtgtgagagcattttgttttccttttctcactgaataatttgtttgtcttttctttggattttaggcagcctggatatctgggccataactgtagaggaaagagcgaagcatgatcagcagttccatagtttaaagccaatatctggattcattactggtaatcacagtcagcattttttcatttttacttatcagtagtgcagatgtctgtggaaactctatcatgcaaagacgagatgggcaaatatgaccaaggagagacatttacctgttttgccctaaccttgtgcctgtccttttacaatttttttacacataatggaatcataccttgtttgcaatttttagtgcatgtcaaaccacttgttttgtgcatgtaatttatgggaattggttaagatcaaaggaccaatggctcacacctgtaatcccagcactctgggaggccgaggtgggcagatcccttgaggtcaggagttccaaaccagcctggccaacatggtgaaaccccgtctctactaaaaataaaaaattagctgggtgtcgtggtgggcgcctgtaatcccagctacttggaggctgaggcaggagaattgtttgaaccctagaggcagaggttgcagtgagccgagatcacgccactgcactccagcctgggtgacagagcgagactccatctcaaaaataaacaaactaattttcctgtttgattatttttcagaattcactttataaaaagtggaatctttatttccaggggaattgttctgctaccatgcccagctaattttttcttcttctttttttttttgagacagaatttcgctcttgttacccaggctggagtacaatggcgtgatctcggctcactgcaacctccccttccagtttcaaacgattctcctgcctcagcctccgaagtagctgggattacaggcacccactaccatgcccagcttattttttatatttttagtagagatggggcttcaccatgttggccaggctggtcttgaacttctgacctcaggtgtcgttcttaatcattgttatttattctctgtaaatacttcagaagtacccagaatttggagtataggtattgggaatggcaaataactttttttataaagtgaaagtatgggtcatcagtttcctaaggatttctataaatgtgcttttgcacaatgggtagctgttcatatcttagttaatagcagattaattaaagtggaaaatctatgccaggaaatggtaggccctttttgagatgattttttgaattctaaagtcagtgctgatggattcttttactgttgcctatgggcttatccttggacttttataatgcactcaactggtatttatagtattaccagcctctttgtaaattttgtaattttgctattacaggatttctgtcagctgttgtttttttttttttttcctgaaactttttctgtttaatttacaggtgatcaagctagaaactttttttttcaatctgggttacctcaacctgttttagcacagatatggtaagttggaattttacatgaaattttacataagcataaggcaaaataaaatatcgttttgttctatttggtaatatgatttcttatgttataaaaggagaacatgtatctctagcctgaaatatcttgttacttcttaccagagagttatgtctgaaaagtgtctttctcatatggaactaaaacaaaacaacaaaaaaagtggtgacatttgaatgacaacactgtcaaaaagttgaatttccatggagacatctaaattttggtgttccttcaccaattagttttggcttcacccatatcacccacatttatttgaatgtcccacatttcttgctttataatggaatgattttttatctttcattgactgaagaataaaaggtaaagaaaatatttgagagttagtgcatggtaaatccataacattaatagataatagtgaattatttgactatcacaaataggcattcaatcttttaagccacaggaaatacagagagtataataaaaagggtggcaaatacagttttggattcttggctcatggctttggagagccatgctgaattctgttgtcctctaagatgtctcatttttttcaccaagggtgcttaatacttcacttccctgagttaattagtgatacgaaggcagctcgctatgaagaaagagcatgtaggctgggcgcggtggctcatgcctgtaatcccagcactttgggaggccgaggcgggcggatcacgaggtcaggagatggagaccatcctggataacacggtgaaaccccatctctcctaaaaatacaaaaaattagccaggtgtggtggcgggcgcctgtagtcccagctactcgggaggctgaggcaggagaatgatgtgaacccaggaggcagagcttgcagtgagccgagatcatgccactgcactccagcctgggcgacagagcgagactccgtctccaaaaaaaaaagagcatgtgatttgtagtcgtacacctgagtttgattcccaggtgtaccattttcagtgtctctgatttggagatacagttaccctctttgacctcaagttttctaatctagaaaataggaatggttatagttttgtgagagttgttgagaggattccagaaaaaccaaggacttattgtggctcctgtcacataataggccctcaaagtaaaacccaaaaaggtatcatctccaggggctgggtattctacataactgaattttccagctaactactttgtcctcttaaattaccaaacttttaaatttataatcttgtggaaattaataaaggttgatacagctttttgtttcttttaagcacagtctacagaacacaatctaagcttttcttgatgaaatgtcatcattatgaaaattagtaactgtcctgaaatagcaaaactttcacaggagattgtgtgtgtgtgtttgtgtgtgtgtgtgtgtgtatttggatatatttgaattgaaacgaaatgataccagatctctgtgctttttttgggtatctgctttattttctttttcctggttgtcagcatattggccgccagactgtctctaaactagtgtgcttgctcctctgaagccattctaattctaacttctgatctattagagctaaaaaatcagataaccaagcggttttggaattacagtttaagtaaagtaagatgctcagatgaagaaacagcctgcaagaaagaagtcatgtgcaagtgagcacagaagccctgttctgtcagttaaatgtgaaagtttaaacgcaagagacctgtggcacctttgtgaattttaacaagcttctgctttgcagctcatacatgatcatgtctcataccatcaggacctctcgctggaaccttcttccgcagacttaacttcctccactggattatgcttttgtgttatattcccaatttttcaaagttcatttattctttcaacattgaaaaattatttatcagatatctcctgtgggccagggactgttaagaggtgctgcggatatagcaatgaacaaaatagacagaatccattcttttactgaaacggcagtctagtggagggagacaataacaacacaaaaattgtcacatggtggtaagtgtggtggagaaaaataaaatacactctaatgaatttcattttttttcttctgttttttgtaaaggtgggatcttgctatgttgtccatgctggtctcgaactcctggactcaggccatcttcctgcctttgcctcccaaagtgctgggattataggtgtggccaccatgcctggcaaagacaactgtcttaattgaaaaaagtgacatttggctgggtgtggtggcccacgtctgtaatctcaatgctttgggaggccaaggtgggagcatcgcttgcgcccaggagtttgagaccaacctgggcaatataatgagccctcatctttaaaaaaaaaaaaaaaattttttttttttgtttttttttttttttttttgagatggagttttgcccttgttgtccaggctggattgcaatggcacgatcttagctcactgcaacctctgcctcccggcttcaagcgattctcctgcctcagcctcctgagtagctgggattacaggcgtacaccaccacgcctggctgattttggtatttttagtagagatgggatttcaccatgttggtcatgctggtctcaaactcctgaccttgtgatccacctgcctcgacctcccaaagtgctgggattacaggcgtgagtcactgtgcccggccaaaaaaattttttttaattagctgggcattgtggtgcatgcctgtagtcttagctgctagggaggctgaagtgggaggattgcttgagccctggagtttgaggctgcagtcagctatgattgtgccttctagcgtgggtgacagagcaagaccctgtctctaaaaaataaaaacagttgtcctaactttctaaactatttttacctgagtggcccaaagtcaggtttttataatgactatgtatattaattaaagatggtaatgtggcaatcttagattgaatgaatctttaatttttttcttacgttttgctaaataaatttgtgatggcgtattttactatcaaaaatgtctgtaactctcttttcccaaaagaaatgtctttgaaaagtcattggaaatttcatgaaccactgatatcctgcccagatgatggaataatgcagtgcaaattatgagtttagcaagatctgcctttcaactgagctgatttgatacttattcacatagtaaccctgagtagtacttgatctcttaaagcctaggtttttttgtttgtttgtttgtgtttatgttttgagacggagtcttgctctgttgctcaggctggagtgcaatggcacgatcttagctcactgcaacctctgcctcccaggttcaagtgattctcctgcctcagcctcccaagtagctgagattacaggtgcccacgaccatgcccgcctaacctttgtatttttagtagagacaggttttcaccatgttggctagcctggtctcgaactcctgacctgaagtgatctgcctgcctcggcctcccaaagtgctagaattacaggcatgacccactgcagccggccaagcctaggtttttaaaattgcaactaataatagctgatctaaagaagcagctccctccaacccccatactatttttatgttcttctgtgatttttctggtagggtcccagggtaagtccttactccttttggtagacggaagaatgggtttgactctgaagttttaggcagtccttgtgtcagtcatctggggaagaagataattttttgcttttttgtttgtttttgagacagggtcttactctgtcaccaagactggagtgcagtggcatgatcatagctcactgcagcctcaatattctgggctcaaacaatcctccggactcaaacaatcctcccacctcagcctcctgagtagctgagtctacaggcatacaccaccatgcctggctaatttttgtattttatgtagagatggggttttgtcatgttgcccaggctggtcttgaactcctagattcaagccgtctgcccgcctcagcctcccaaagtgctgggattataggcattagccatcacatccagcaaagaagagaagtttggattaagaattggaaactgtgtctagtttctctctctgagctttacttactttgttctggactttgtttcaaatatttgagtgatacgaactgatggacagtatatgttagaaacctttattatgttttatttccatgtagaaactatattccagttaactaatttgttaactttcaactgtaatctgttaatgctttggggactccttgtctctcctggctgatttccaattaagaatacaagaaaaccttaattctcggaggatggagtcaagtcagtgtgtgtcatgccaaattataaccgtggccaaagatggtacatcttcctagaaattgtcttattaataaggagctggaaggaggttggcagatatccttttggcaattgaagtgcttagaattttttcaactttgctatgatgtggaggggaggagaataaagcagtgggaatagacaagagccagaaggtacaggaaggaagaagagacggggtgaagaggctggatgagggctctggaatctgagacggagggccagcagaaatggagagaaaagagggagtgagggagcactacctggaaatgggccctgagaggaaagaagggagccagacacatgaaggcaaggattagatcaactttgtgatctggttcagaatgggtgtcagggcaaacagccatatagtcatagtttgtactttcttaagacactcctgagtatgtgtcagaagggccttcagccccaacaagatcaatttgctaaactcatacaaaaaaaaaaaaaaaaaagaataagcaccctggactcttgatcccctctcctccatccctcattcctgagtctttaccatccagtagctcatggcgttgaactaagatgacatcttagttacctggctgcccaaaccaacacctgggcaccgtgcttgatttccctcttttcttcaccctgcatacccagtccatcaacgtaattgcatttacggactttatccccaatctggccacttctttcctactgctaccatcctaacctgtcatctcacctgggcccactgttcgagcatctggactgggttctctctttcacacttgcccctttagagtctagtctccaaacagcagctggaattttttttttttttttttgagacaaagtctcactctgtcgcccaagctgggcagtggcgcaatctgggctcactgcaacctctgtctcccgggtctaagtgattcttctgcatcagcaccttgactaactgggattacaggtgcacactaccatgcctggctaatttttgtatttttagtagagacggggtttcaccatgtcagccaggctgggctcgaactcctgacctcagatgatccacctgcctcggcctctcaaagtgctgggattataggcatgagccaccgcacccggccaggaataatcttttgaggagtgcagtggtgcgatctcagctcactgcaacctctgcctcacagcttcaagtgattctcctgcctcagcctcccgagtagctgggactacaggcgcgcgccactatgcccagctaatttttgtatttttagtagcagggtttcaccatgttgggcaggatggtctggatctcctgacattgtgatccgcctgcctcggcctcccaaagtgctgggattacaggcttgagccaccctgcccagccttcttcctgttctttaaatgggccaggtttctccttgcctcagggtcattgtacttagtgtttcctcttcctataattcagttgctctagttcctcacatcgcaggttcattgcctttcaggtttcagttcatatgtcacctccccaaagtggcattccctgaccagctagtgtaaagtggtcccctctgcccacctctttccctttaccttggtagcacttatcaccatgtaaaataatctggtttgttctcttgttagttctgcttgcactaaaatataagctctgtggtgctaggaactgtgtctttttcatagatataaccccaatttccagatagatgcccagccccccactcccccctgccccataattggtttttgaatgaatgagaatgaatgactggattagtctgcactgctgctgggtctcacctccagcccaaggggcagcaggtgagagatgagcagcctgaggccaggctttgtggatgaactgggctcctaaaggaatctgtaggtgccaacactgcagggaatgaggtgggacaagaggagcctggcctcatcccttcatcctgtaacacacacaaagtagtttcagaattgttacattcacctccactacaaacaacaaatttaggcccagtgcagtggctcatgcctgtaatctcagcactttgggaggtcgaggcaggaggatcacttgagcccaggagtttgagacctgcctgggcaacatagtgagaccccgtctctactttaaaaaaaaaattatccaggtatggtggcacatgcctgtagtctcagctactcagaggatggggtgggaggatcacttgagctgaggattcaagcctgcattgcgctatgattgtgccactgtactccagcctgggcaacagagtgagaccctgtctcaaacaaacaaacaaataaaaaaaaaaaaaagaacctagtaagtagtgtaaaccaaaaagtatctgagacaagaggtctcaatcattttaggagtttattttgctaaagttaaggacatgccgggaggaaataagcacagaatcacagaaactgtgcttttctccaacgatgattttgatggcttcagtatttaaagggaacaggtaggctggagggcaaagagggaggatatggtaatccatatattgccagagaaaaggagcaggcaggggaatagtcagttaggtaatagtaaatcagtaaagtgctcagtaagtcggcactttacataagataaaatggaacataaagtagcctgtagaggtgtttgaccttttatttgtagctccctgcttaggaacaaagggactcagctttcagggactcagctttcagcttacttttctaccttttgcatagtgaattgaagtcctgcgtttttattttcctttcacagtagatttcaagattactttgtagttccttttgtttttaaacagaggacatataaagtactatgtgaagttacttggactaggcttttttttctacctcttacgtggatatgttagttatttataatatgattaggtttattttcatttttatttaatttagatatgcctcctcatctttgtggacttaattttattatttaaatacataacagattaaaaaggttctaaaaaccgaaactaacaaaaaggtgtgctcagacaaggtcactccctcttctatccctttaccctgtttccacccattgtattagtttcctgttatccttcatttatttttgttggaaaaaagcaggtacataatgtatataacgtgtatgtattcatatttaaattacttcctttcctccttacattaaggtaacctgctataaatgctctctgttcttttttttttttttttttttttttttttctggagacagagtcttgctctgtcacccaggctggagtgcagtgacgtgatctcggctcactgcaacctccatctcctaggtttaagcaactctctgcctcagcctcctgagtagctgggattacaggcacgtgccaccatgcccagctaattttttgtatttttagtagagatggggtttcaccatcttggccaggctggtcttgaactcctgacctcatgatccacccttctcggcctcccaaagtgctgggattacaggcgtgagccaccgtgcccagcctgtttttttgtttttgtttttgtttgagatggagtcttgctccgtcacccaggctggaggtgctatcttaggtcactgcaacctccgtctcccaggttcaagcaattctcatgcctcagtctcccaaatagctgggactacaggcgcccgcgtgcccagccaatttttgtgtttttagtagagacagggtttcaccttgttggtcagactggtctcgaactcctgacctcaggtgatccacctgcctcggcctcccaaagtgctgggattagaggcatgagccaccgcgcccagccgtaactaccatatttccataaatttcttagaattttcattaccagggattccccacagttatgtttattgagaaaagcgttttttgagtatcacgacattttcaactaaatgttgggattgtcgtatgtggtttaaagtcaagtccctagaacctcatggttaagtttcttctcctcacccatgaaaacacttctgtaggacacctttagagtctaattaagccattacctaaagtcttctcccctaacctactcattatcccacactggatattcctgtttctcaccagagaccatactgggcagtggtgtggggaacagggagtgggcacctgcctgactgattgattggttttagtgtgcatgttgatgttgatttttattaatgggaactcttccccaccaaaccgttttaaatagttgcgtatcttttaaaaaactacttagcaaaagaaggaagttcaccatttcattttatttacttagtttcctttataaaacctgaaaggtagtacaaaaataaagcaaccagaagccagtttcatttatgagcatagatccaaaaaagtcaaaatcttagcaaatagaatttcacaatgtatgaaaagaatacacaatgaccaactttatgccagaggtgcaagattggttcagagtcgaaaaattctatcaacattagtcattatttcagcagataaaaggaagaagaaaacttgtgatcggattggtaattacagattaggcacccgatgaaaaatacagtaaccatttctaataagtagaaaggaaactacttaaatatgtgagactactatccatgaaaagagtcaaactctgtaaaatatttgaaaaggtttattccaagccgaatatgagtcaccaatggcctgtgacacagccctcaggagatcctgagaccatttgcccaaggtggttggtatataacatggttttatacattttagggagacataagacatcaatcaatatatgtaaaatgtacactatttcggtctggaacaatgggacaactggaagcagaggcttccaggtcatacgtggattcaagagtttttaattggcatttcattgaaagagttattatccaaagagctggaatcaatagaagggaatgtgtgggttatcataagtggttttggagaacaaagttttgtcatgcgggtgaagcctcccggtagtagacttcagagaaaatagatggtaaatatttcttatcagactttaagagcctcctttatcagtcttaaggcctgtgttgatgctaatgctggtcagctgggcctgaattccaaaagggaggagggtataatgaggcatgtctgacttcctcttcccatcttggcttgaactagtttttcaggttaattttgaaatgcccttggctgagatgaggggtccattcagatggtggggggctcaaaattttgttttcagtttacattactttccagaaatcactaccaactgtcattctaaacaatgaactctattaaactattagctctagtaaatctactgtttcatttaaactcagaactgagcaagaacgcattcagtaatgtcttagaaggcagtaagaccaataaaaaagattggcctaaatattggaaaagaaagataatgctcatttttttctagttatgtgattgtatacttagtacacccaagagattttagttttaaaacattaataagaacttgtaggagtctggtaggatagctaaatacagcctaaataattttttaaaataaaaaatgttctctgtgcttgaaataagcacctaaaaatggaaatggggggaatgtttcatctaaaatctggcaaaaatgataaaattcttcagaatacatttagcaagaaaagcatattatatgaaaaaagtgatacaattttattaaaggaaatagtatatttgaacaaccggaaagattgtcttttctttggttgggtaaactattggtgcaaaagcaattgtggtttaatcaattctccaaaaatccccttctaaggcagtttttggatcccagtagggttgtttgtataacagataaaataatctaaatgttcataggaaaatagacacccatgaataaccaagggggaaaaaaaaccttcccagaccttcccggatcacaatataccagagagccagtgtgatcaaatcattgtaatattgacctggaaattgttcagtcagaacagatagtccagaaatagttctcacttcatatgaacatttgatacatgataaaaatgtatattagttcagtgagaagaagagggattgattaataaatattactgggaaagctaggaatccatgtagaagaaatgtgattggaccctggaataactcccccacccctacccataattattggtttaaggattgaaatgaaataaaataatacaatgttagaaaatcaaggactaacaaccttctaatcatatgataaaagaaatattttatatacaaaaatttagaatttttatgccgtacatatacataaatcaacaaataatgaatttttaaaagtctttcagcagtcagcagataaacagttaatttgtgatacactatgagctcttataaactaacaacaaaagacatgcaatatatagaaaatttggcaaaggatttgaataagcagttcatagaagtgcaaatccaaatggccacgaaatacagaaaaatgatgctcaggttcacaagtagtgagaagaattcagattctgaattctttgctgaagggcccatgactacaggagaatggggaactcctatctgaggcaaaaaggtttctgcaaccacagagctttgtttcctgcgttatgatccttattttctaaaatgtgccaacttttacaatcttgatcacttttagagatttttttatctttgtcttatgccatactttttattgtgttacatgttttctttctttgagttaattccagctatgcagaattgttttctgtgtaacttaattttcttttgtgaacactgtccggatatggctcagtctaaaagatcatggtattttaattgaactgtcttatttagatctttcaaatacatttttcataatattggtttaaaaaaatcctcatgcttttaatatctggattaaaagaaataaaatctgaataaaacttttttatgcagaagaggttaagtcatgaatatgcacagttttgatgatataatgtagtttccagttacaaggacaaacttttgcttacttgatcttagccaaaaggccgagaagcgattccttttgcttactcttctttgagaaaatactttacattaaagctcattacagtttgcacttggaccgtgtatatttgagtaccattttcaaatagcagacacattttgtaagctaacttacaaaattgttgagtgatatggggcatgattctaaagaaaagttagtttcaagagctttagaggtttagtagcattatagttgagtaaccctagcatagcataagtaggtagcatagcatactgtgtcatgttcccacattgaggtttgtagagctctacaaagaatgcaatctaagtatctctagcaatattaacattccgcttctaaatctttttcttttctaatagctttattgtgaaagaattcacataataaaatttactcgtttaaagtatctaattcattggttttagtttattcacagagttgtgcgacagtcactattagctaattttagaatgttttcatcacttcagaaagaaaccccttttgatgtctaaagtacaaatcctcacactgaggctgaaaattacctgctaaagtggcagagtgaaagatattttatgtttatataaaacttggccagtatttacaggctattccccatagtttggtaaacagttatgttttctgttgttgtctctaggggtaagagtgctaattattttgttttcgtgttggtgggagtggtggttttggaaaggttcttttatggtcacagttgttctcaggccatgctgttggtttgcagggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtaagtctgaaaatgaattggtttctgtattttcttgtatattttaaaaataaatgttttcctttttttccctctcggtttataacattatgaaattctaggaggtaattctgtctgaaaaatgatggccccctgcaggaagatagtgctggggagaagaaggagcatgttcacatttgaaccctgggatgtaaagtaatcaaaatgaaagcagagatgcaggccgccagtcaggggaaaaggaagaaacttacagtccgctgctgcagcttctgggtttttttttttttttctcttccattatccttcaggttgttgcatacttccttttgattttcggtttccataatgtctgtttctccttgtgcataaacaattcctttggattatggcatctagaaatatatatattttgaatcacagtactgagtcacttggccacattaaattctttcttagaacaaaatggaatagagaaaaaataaacattgttatcctgattaaaaacctaattccagccgggcatggtggcttacacctctaatcccagcactttgggaggctgaggcaggtggatcacctgaggtcaggagttcgagaccagcctggtcaacatggcgaaatcccatctctactgaaaatataaaaaattagccaggtgtggtggtgcgcacctgtaatcccagctactcggagaggctgaggcaggagaacctgggaggcagtggctgcagtgagccaaaattgtgccactgtactccagcctgtgcgacagagcaagacttcgtctcaaaacaaacgtgattccataaaaaattatctttcaaccaggtatttttcttataagctaattgattaattagttgactgagatcagtagttctgatttctgttctcattctagactttaggttaatttgaagatcacagtaataaaatctaacatctgattcatggggaggttctttaacagtttaaaacaaaacatgaaaattgtggctagagtttcttttcatctcttcatcctcagatagctgatgataggtgataaagtgaaatagatttcggagggggcagtcaacagtaattcagggtgtctctgatataattaatgataagctaagatacagaaatactctggttttacttactaggtttcctattaaaaacaatgtattgcctttcttttagtaagttttagccacaaggctggtttttgtaaggggaaaggttttggaagatttttaggcaaataggatagtggtccaagaaaagaaagaaaaatccatatatgagcaaaggcgaggaagagcagaagtgaacactgcagcagcctccacatgactggggccgttgtttgtcttgtccagtgtgtgctcacaatgtttagcctttagttaaccagctaatttaagtggaacttgctctgaatccctgaagatctctgtagccaatctttggtcaggacccaggcgttaaaataattcaagggtgtttggggtcgaacacagtggctcatgcctgtaatcctaatgctttgggaggccaaagcaggaggattgcttggtcccaggtgttggagaccagcctggcaacataacaaggcctcgttgctactgaaaatttaaaaattaaccaggcatagtggtgggtgcctatagtcccagccacttgggaagctgagacaagaggatcacttgagcacaagaggtcaagcctgcagtgagccaagatcacactactgcaccccagcctgggtgacaaagtgataccctgtcttaaaaaacaaaaacaaaaaacaacggtatttggttttcttttggctttcttccaatgctacaagaagaaatctcatagtggagaaaaggtcaaatgactagaggcaccccatttctcctttttctctcaaacctggggtcaataatttttcctgtaccatttaattcattttctcttattccattctgccatcagaatttcagttgtggagctattgctgatttagtttcaggaggttgtgaccttactgctgagaaagttttacagtcgttaagtaacctgctactgttaaacctgccaggatttctgacctaatactctgccaggcagcccatcactcttccccccagacttctccctgtctttcctcaccacattgatgttctcagtaaatgattttgatgaggctaaaccatgaaggatatcagaacataggagaagttaccagtatatgatcttgatcaagtttacttaagtattttctagttctacctctcagctcaatctagggtaaaatacatatatatattttatagtttgttgagccacttgagaataaaataatttattactattgtcattgttttatttatttatttatttattttgagacagactctcacttagtcgcccaggctggagtgcagtagcatgatcttggctcactgcaacctctgcctcccgggttcaagcagttctcctgtctcagcctcccgagtagctgggactacagggacatgccgcaacacccagctaatttttgtatttttaatagagacagggttccaccatgttggtcacgctggtcttgaattcctgacctcaggtgatccacccacctcagcctcccaaagtgttggcattacaggatgagccactgcacctggcctgctttctaattaatattgaaaattattggttaggtgtggtggctcatacctgtaatctcagcactttgggaggccgaggtgggcagatcgcttgcgctcaggagtttgagaccaacctgggaaacatggcaaaaccccatctctacaaaaaatacaaaaattagctgggtatggtggtgtgtgcctgtagtcctaactgcttgggaggctgaggcaaggggatggcttgagcccaggaggtggaggttgcagtgagccaagggagatcgtgccactgcactccagcctgggtgacagagccagaccctatctcaaaaaacaaaacaaaacaaaaatctgactctgcatttccttgcccttatatatagtatgtgccttcacatataatatttgatcacaatgataaccctaaaaagtatgcagactgtattagccctgttatataaatgagggaactgagattctcagaaattgaacattttgcttaaggccatatttctaacaaaggagatagaacctgtccaaagctaccatttatctaaaggcgagatggagtctcactctgtcgcccaggctggagtgcagtggcatgatctcggctcactgcaacctccgcctctcgagttcaagcaattctccttcgtcagcctcccgagtagctgggattacaggcacccaccaccacacccggctaatttttctatttttagtagcgacggggtttcaccatcttggccaggctggtcttgaactcctgaccttgtgatccacccgcctcggcctcccaaactcctggcattacaggcatgagccaccgcacccggatggctttaggttttttaaaattaccttctccgtgccttcattatcaccaaactaactgggtgacatgacgtgtcactcttccatggttccttgtctgcatgggttttttgttttgagacagggtctcactctgttgcccagactagagtgcaatggcacgatcatagctcactgtagcctccaactcctaggctcaagcgttcctcctgcttcagcctcctgtgtagctgggactacaggcatgtaccaccacactgaagtaattaaaaaattttttttatagatagagtcttgctcttttgcccaggctggtctcaaactcctaatctcaagtaatcctcccattttggcttcccaaagtgctgagattacagcataagccatggcaccaagcctcagatattttttaatgtagttgttaacacactatagaattaaggctcagactggagtctgaacaatgattttgttcaactcccctacagagaagagagaaaaatggggtgcagtgatactgtgacttgccttagagcaccctgaaaatagaattttctattgtaggaaattctatgggtagacttggtaccttctttcaccagtgtgcactcagcataattcttttgttctggacccagcttatacaggaggagtctgtttttcttttgcttggtttttgttttgccagagtacatggttttattggattaaaccagtgttttgtaagcccctactgtgtgtcctagttgctgggaacatgctggccagcaagacctcatggcttctaccactgtggatcttattttcaaattgtggggagcaaggaaataaatacttttaggtgagaataagtgcaataagttcattaaaacagagtaatagtagagagacagagagagagaaaccagtagaacaagatggccagggaagaattctttgagcagatgacttttggaactgatgtagatgatgagagccatgtgaagacctaggggagaggccttccaggctaaaggaactgcactggcaaaagtcctaaggcaaaaactagcttggggtttggaaggtgtgcgaggggcgtcgtagctgaagcatggggagaccataaggaaaagcaagcaaacaacagattaagcagaagagtgacgtggttgatagacttatctgtgttatctgaagactggaatgtaggggacaagaatggaatcctggagatcagttaggaggcttttgccacgggcaagaggcaatggtgatttatatctggtggtgataatcaatgtggaggacagattagattcattctagcctgtattttgggaaaaaagtaaaaaggacttgtcagtagattggaaataagaaatgaaaaaggagtattaaggcttttcacatgaataactagatggatggtataagtgtatactgagatggggataacaggaagaggaatggttttaaaggagaaattaagagttttggtgattttgagagtcctagtagatttccgagttgggatgttaaggagacagggatgactacgtttgactgaagctcagaggaaggatcgatcagctctggggcagtttggatatggagagcatgtcttaggggcaagcttagctataaggagtacagtgtagacccaagccttgatgtgatgtgacatttaaaggtcaggcaaaagaggagaagccagaaactgaggctgacaaaagtgaaatggcagaagattggtgtcctgctaccaagaaaaagtgtttcaagaaggagggaatgctccattgtttgagctgcttttgagagatggagtaagaatatggcagaacagtgctgattagatttgatgtgatgagcttttgagtgaccttgacaagcagtttcagtatagtgatagggacaaaatcctgattggaggcttggaagaggggagagaatttcaagaattaagacttacacaggaagaggtgatggcagccagaatacggcttctggtagatgtatttatttagaaagtcattcattcagaaaaggtagtcagttgtcaaaaggatgatagtctttttgcagtggctatttaaagcacagtaggccaggcacggtggctcatgcctgtaatcgcagcactttgggaggccaaggctggaggattgcttgaggctcctagttcaggaccagcctgggcaacatagtgagatcctatttatatttttttaatgtaagtagatagatagatagatagctaataaatttttccttttctgtaaaatggaaaaattattatgtaagagaagatttctaacaaatttggaagcttaaaagatgcttttaccagtctgatgattaaacagtatttttaaacttggccttttcctcagtgtctttttgaggttagcctccttttaggttaggggtctgcagcacagatggggtacgtgtcttgaaggttaactggttgcgcagtatgctgtgtcaagccttttgaaagtctgaatgatggctcatgaaaacttttggtttgtttccatctatttttatttgttgcttgagtagattgacattcttacttaagcaaaaaccaggatttggagtataattcagtatagttatcaaaagaaccaaatttttaaaaagaaaaacacattaaaaatatagttatcaaataatcttagaaaattttggaattctaaaactgacaaggtaaacctgatacatgttgctatgtgtggatatgtaaagttaatctgattccaaatgagatgtgtggtaatgtgcttgatagtgtgcacgtgaactgtaaaccagtcatctagatgactataattataaacttactcagtaaagcccaagttagaatttttttcttctctttgttggattttcagtgtctataaacattgtttttaaaaatgaaaataggccgggcgcagtgactcacgcctgtaatcccagcactttggggggcccaggtgggcggatcatgaggtcaggagatcgagaccatcctggctaacatgatgaaactccgtctctactaaaaatacaaaaaaaaattaaccaagcatggtggcgggtgtctgtagtcccagctgctcgggaggctgaggcaggagaatggcgtgaaccctggaggcagagcttgcagtgagctgagatcgcgtcactgcactccatcctgggcgacagagcgagattccgtctcaaaaaaaaaaaaaaaaaaaaaggaaatagtctgattttcttactgtataagtaatagatgctgcttgcgagtcaacaatgcaaaaagacttaaaaagtaaaaattactattaattctgttacccagtgatgaccactgtgttcaacaacactatttttaaaatcttttttttttttttttgaggtggagtcttgctctgtcccccaggctggagtgcagtggcaccttctcggctcactgcaacctccgcttcctgggttcaagcgattgtcctgcctcagcctccccggtagctgggattacaggcatgtgccaccacgcctggctaatttttgtatttttagtagagacggggtttcaccatgttggccaggctggtctcgaacttctgatctcaagatccacccaccttggcctcccaaagtgctgggattacaggcgtgagccaccgcgcctggccctatttttaaaattttacacaagtaatacatgctcttagtaaaaagaaatacaaacaaaacagaattgtgtacatttgtaacagtgcaggaggaagagggaagaattagggtacctggtgcacttgaaacaggagaaccccaaaatagctaacaggtatttgcaagaaagttcaaccaggctgagagcagcaatagaaataggaaagggttatgctctctgcagtactgagtgagtacaaaggatctgagagatttggagcagtccagcccctatgaactcaaaagactggcccaacaagccttccttttgggacagggcttcatactcaggaaaaatgactgggagtggaatcaaaattgagcagtatagggacatggatacaaaggaaagagatggtccagacaaaagtaggggaggagaatggagactggaattcctaagaagcaaggctcacataaaaatgagcaacagaaagtatcaagcaaggtcaaatccactgcagaaagtgtcaagcaaggtcaaataacacaaagttattattaggaaaaaggagaataaagggagaaataacacccctgtggacagtgaaagcacaccagtaaatcactacttcaaaacaagctcaaagagaataagaaaatgatacaagacttgaaagatgaaaatcagagtttttaaggctcataaataaggtgacagaaagaatgagaaataaaagaaaaattcattctagaaatgaggatgcaactagaagcaacacaggggatactaactgaagaaaaatagaagttacaaagaggaaaaaaatttaaattaaaaggaaatgaggctgggcgcagtggctcacgcctgtaatcccagcactttaagaggccgaggtgagcggatcacctgaggtcaggagttcaagaccagcctggccaacatggcaaaaccccgtctgtactaaaattacaaaaattagctgggtatggtggcacatgcctttaatcccagctactttggaggctgaggcatgagaatcgcttgaacccgggaggcagaggtggcagtaagctgagatcacaccactgcactccagcctcggggatagagtgagactaggtctcctaaataaataaaaggaaatggaaaagatataaaaagaatttgagaaacagtaacaagtatttaagacaaagaagattgaatgtatgggcagcaggagtccctgaggaagaaaactaaaccaatggaatagaacaaatgataaaaatgaattcaagacaactttcttaaaataagagattctaaactatatttaaaagagtatcatgtggccaagaatatcaatctaaaaagtccaacactaagatatattctagttaaaggagaaattatttagacatgtagaaaaagaaagcatatgacttacaagggggaaaattagattatgttcagatttttcaacagcagtgctttctgctagaagaaaatggagtaacatatttagaattctcagggaaagaacaagccaaggattttgtgtccagaaaaactgactttcaagtagaaaaaacagacaaaacgttaccaatttataaggcttcggggtatattaacatgagcctttcttaaggaatctattagagaatgtgcttcagacaatcaaaatagctagacctaggtcatcataaggactgatggtgagcactaaatatatagttagctgtagagctaagactgaaggaaggctgaggaggagagagtatcggatgtaattcccatgcactgtcaattggatacgataaaactttaaggggagcaggactgcatgcaaaaaaataatttaatgcattcagaaattagtattagtattgttattctgaaactgttgtctgagatatgtggtaaaaacaaataagtaattacggaatagtctaattctgtcattttctatacctttgaaatctgtattcttggtgtggaagaaaggagataacaaatataatagtatcaaatgtaatgaaaaagcagtatagtcttggatttgaattttcaaattgaaagtattaatatgaactcagaaggcgtctctcaccacaccccccattctcttcatctatccatctatttgtctcctagttctgttcactgaaaagactagatacaatcatctaccccagcagcactgagcatccttagcgtccagattgtgaacttgaaatatcatttctcaccaaaagaaaccagagtttcttggagaaatggctgaatccaggtctagatatgaaatgtgaagagcttgaaggacccatcttgtaatactggtcagcaaggaagttatcaaagcatagtaggaggatatcagaaattctcagaagccaacccgaagaggcttacattggccaaagagaggacagtttgaacttcaagaatgataatgtgccatgaattaaaactcaataaatatttgtaaatttatgactcaataatgatttaataatgtatttaacaagaataatttaccttaagaagatcctaagaaaccagttcattaccttgaaaacaggtaaagggaaagaatcaggcatttattatgccttttgtatatgagctgtacaactggatagccaactagtatatcctcattagaagcacctctttataaaattattacagctaataaatgacaaagacatagtaggattagaacatcactattttcaactccccataaatgaataaatataggcgttaagcatcaatgactgccaagatcacaaaaagacagctacattttgtgtgtttcctgtagtcttgccaaagagatccaccgtcagcttgatccattctttggatgtagctgcgtatttgcaggaaatacagaatatagagggaaatgttgaaccgcaccatgagaatgcaatcagcaaaatccagactgggaaactccacaggtcacatggcctgggtctttcaacagaaaagaaaatgaaaaggatggagaggggactgtggattaaaggaaacctaaaagacatttcagcagtgagatttccgaccatgcctgagttgagatgagcaaattcttccctcaagggcagaattgacagaataaccatttcagtgctctggaaattaaccaaaggtatataacatctgagaatcatttatgcctgaaaagctgctgagcttcagatatgaagcagaagtctgttgcattctttcctgggcattttcctatcccccaacacttcagcttggtaatgtggagggacaggttgtaaatattagcagtcttaactgctgtcactgaagggggcttacttgctttgggagtgggaagtcatgcctgtgcccagcagctttgtcagtggaaatgacaattctggccacagaagagcaggtatgaccagccactctattatcctgaactcgtggtcatggccagggcaagtatattcttggctgaggctatgcacatgtgtcgcggagaccagggtgggcccgagtcagctgcaaactcctgactagccctcaaactgcatgcacgtatagagaatatgcagaaaggccctgtgaaatgttaaagttgaggaagactttaaaatggtctgaactttgaatgcatttttgtgctgacagattgtcagagaaaggaagccttactgacttgaggtgtttgagcacaacttccgtcccatcattggctgactactgtgctacaaagatgcaggtgcaatccgtaaaaagccaggcttaaagataaaaacgaattttttaaaaacccaactgagcagaaccatcaggggctgcacaacaagggaagacagatttttctgaattagcctatgccggttactaaataaagatagaaacaacaaccttcagggggaaaatcagagccagagtagctacaatgtattatctgaatgtccattttcacctaaatttgagacattaaaaaataacaggaaagtattgtctcaccctcaagaaaagaggcagtcagtaggaactatctctgatccagctgttggattcatttagcagacaaaggcttcaaagcagcaattacgttcaaagaactgaagaactaaaggaaaacgtggaaatgaatcaacagacagacactctccaaaaaacaatagaaattacaaaaaagaggaaaattgaaattctagaaaagtatgacaattgatgtgaaaagttcaataactggccggccacagtggctcacacgtgtaatcccagcactttgggaggccgaggcctgtggatcacctgaggtagagagttcgagacccacctggccaacatgatgaaaccccgtctctgctgaaaatacaaaaaattagctggacatgatggcaggcgcctataatcccagctatgtgggaggctgaagcaggagaatcccttgaagccgggaggcagaggttacagtgagacgaaattgcgccattatactccagcctgggaaacaagagtgaaactctgtcacagaaaaaaaaaggaaagttcaataactaaggctgggagcggtggctcacggctgtaatcccagctctttgggaggctgaggtgggcggatcacccgaggttagaagttggagaccagtctggccaacatgacgaaaccccgtctctactaaaaatgcagaaattagctgggcgtggtggcagatgcctgtaatcccagttattggggagtctgaggcaggagaataacttgaacccgggaagtggaggctgcagtgagccaagaccacgccactgcactccagcctgggcaacagagtgaggccttgtctcaaaacaaaaacaaaacctgaaaagttcaataactaaaatgaaaaatttaccacagggtcttaatagcagattcaagatagcagaagacagagtcagtgaagttgaagattaatcaatagaaattattcaatctgaagaatatggaacaaaaagattgaaaaaaaataacaaagtttcagagacttatggaacaagaccaagtttaccaatatgtgtgtcatgggagtcttagaaggaggatcatgagagaaaggtacagaaaaatatttgaagaataaaagccaaacacttgccaaatttggtgaaaagcaatagtctacacaatcaaaagctcaacacacctcaagtagggtaaatacaaagagatctacacccagacacatcatagttaacctacggaagccaaacacagagataaaaccttgaaagcagcaagagaaaagcaactcatcatggataggggagcatagatataaataacagcagacttgtaattgaaaacaatggaggttagaaggcagtggaatattcaaaatgccgcaagaaaaaattcaacccaaaattctatattcagcaaaactatcatttaaaaatgaaggtgaaataatgactttttcaaataaacaaagactgagagaattcattgctactagacctaccttagaagaaatactaaatgaagactttcaggatgaaatgaaatgacaaaaggtggtaactttaatatatggaaagaaatgaagagcatcaaaaatggtaaatatgtaggttaatttagaagaccacataaatctatttttcttcttttctctcaagtttaaaagatataagattgtataaagtaataattataactctattattgggcttataacatattataatgtatgtgacagtaatagcacagaagaggagaaagggaattgagctatatttgtgtaaagtttctatattctgccattagaagttgattatgataaattaatttggagattttaatccctacaacaaccacatagaaaattacttttggatgcatacagtggctcagccctgtaatcccagcaccgtgagaggcttgaggccaggagtttgagaccagactgagtaacatagcaagaccctgtctctacaaaaaaataaaaacttagctgcatttggtggtgcgtgtctatagtcccagctacttggaggctgaggcaaaagaatcccctgagcccaggagttcaaggttacagtgagctgtgatcacgtgactgtacttcagcctgggtgagagtgagaccttatctctaataataaaagaaaaaaaagaaaattttaattactattattatgtaataatactcttttcagttagctctctcaggttgaaaagaaaatttacttttaaaaaatagtaaaggtcagacatggtgactcacgcttgtaatcccagcactttgagaggctgaggcaggacgatcacttgagcccagaagttcgagacgagctcaggcaacatagtaagacctcatctctaccgccccaccaaaaaaaaaaatacacgtatatatatatatgaaactgggtgtagggatgcacacctgtggttccagcaagttgggaggctgagctgggacgatcgcttgagcccagaaggtgaaggctacagtgagctatgatcatgccatttcactctagcttgggcaacagagtgagatcttgtctcaaacaaacaaaaatatttaaaaaaaatcaatagggggcatttaaacactaaaatttatttactccacatgaaagaaggtattaaagttgggacagagaaataaaaaagaaggtaagcttttttacttttttttttttttttgagacaaggatctcactgtattgcccaggctggagtactgcggtgtgattgtggctcactgtagcctcaacctcttcggcataagtgatcctcccacctcagccttccatgtagctaggcctacaggcgggtaccaccatgcctggctaatttttaaaattttttgtagagatgggattttgctatgttgccctgtctggttttggactcctgccctcaagagatcttcctgccttggccttccaaagtagtgagtttacaggcataagccactgtgcccagctggaaacatttatttttgttttatcatttcttctttattggttagaatatttttgtataaagatgcttccagggccaggcacagtggctcatgcctgtaatcccagcactttgggaggccaaggcaggtggatcacctgaggtcaggagtttgagaccatcctggccaacatggtgaaacctcatctctactaaaaatgtaaaaatagccgggcatggtggtgggcacctgtaatcccagctattcaggagactgaggcaggagaatcacttgaactcgggaggtggaggttgcagtgagccaagatcacgccactgcactccagcctgggtgacagagcgagactccatctcaaaaaaaaaaagaaaagaaaaaagaaaagaaaatgaataaagatgctttccccatcaaacatgtggtttccctgaggtataataaacataggaaaggcaggttgcagtttgatttttctaccttttatttactagttttcaaagtagtaaattgattgccttagtgtcctccttttttgaccagttaggattttatttatttttaaatatcattttgaactcatggatttaattatatttgagcctttaagtccactgcagttattattctttttgattctcatcttgtttgttctgtcttcaggttgagtcttgagtccttttgatgtgatccttgacataatttttgttactctttaaaatgattaacttgaagccctattttaattggaatatattacagctggaaagtgattttctttaagcagtactgggttaattattattcagtgttgaaatgtgattggatgtgaatggtgttgagctgttttttcttcataggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctggtatgtgacttgctgaaaccataggctgagtttttactacttgtattttgctgttcattattaaaatattttctcttcacgttctgattatgtttaaatgatattttagtccagaggaaaatatctttatttttttcacttgatttcacattttttccactgtattaaatgggatatgttagtgtggagagagtcaaagagaattatagatttctgggtaccactgtggacaaaggtgagctcagcagtgaaagccacaaatgtaattttctttcaagggctgagaagagcaattgaagttgaactgtagttgaacattttctatttttatgtatcagttactacttttctttagccactatgaattgctaataagcaagccaatcccctaggaatagaactatgttgggggttgtgggaaagaataaaaaagaacagtttatactattttatggtattacatgcctgcttaattgaaggaaaggatttaaaagtttctggtttaattaattccactttgagactttattaagtcttttttcctttagttaaagtataaaactgtagatgtagatagccttggtctaacatcttaatgaattcatatcaatatggaaagtattatttttaaagtactttgactacatctaagtaaattcagtattgacgacatgggttttagcatcatacttgaaacatttctgcgcctttggccccctgaatttgttgtatatttatcaggatatatatttaagttatggccaaataagctaaatgtatctcctttttttagattttttcttgtcacatgtagttcatcttgcatatatgaccatgactgtggacatgatggtagcccagaaagtgtgtgcagttgtttttccaggagcataagcaaatccacacactctgagtcttctattcttttgtgactaatggcacatgttgcaagtcatttgccatcaggcaagagtgagggaatgtggctaagacgcagtgttttttttctgacactcaactaaccaaccccagtgataatcagacacaaaagctgaccttccctagtgtcacatgttatctggccaagactacagtttgtgacttcttggctcttacatctggaactaatacttcagctccttcagtgcagtgaataaaataccattttatatatttaagctgttacctctttaactgttggaataggtcctataaaatgtgatacaaaatgtttaatgaagagtaaaattttatggaaatcagcattactacatagtaaggtgattttcagtagaacaagtaaatctagaaacctttttggcaggaggacagagggtaaggagggaaaagctcttttcagtctaggctggcaagaagggggaattatttctgcctcagatttgttgactgtgcattttaatttttgtaaattggggaaagtttcttatctttgtagaattaaaattattcaacatttatttttacagcagccacattgccaaagagttcttcctttagtagatctggtccagggtcacaactaaacactaaattacaaaaggcacagtcatttgatgtggccaggtaagtttgcttgtttttaaatgggaagtttggttaaggccattacctgattaaatcataaatttgaccatgaatcatctatattctttttgttgttgtcatcttttttgtaggcttttgtagagtgctaataataattttcttaatttctggatagtgtcactagtttttatcattaatttgttgcagagatgagagaaatcaaggacataacatttccttaaaggctttgtgtatttttttttttttaaagaggataacaaatggatagtaataaaatgtttaaaaacagtaagataaaattctgggtataagggaaaaaagcaaatgaactattttatgtgtttatgatttacaagtttatgtataaaatttttgtatgaagattggagttatagttggccttatttttaattctatctcagataatcttgtggagtttatatgggtaattagtaaaatcctattaaagacgatttattatgaaaagaattatccagatagtggacaattcacattaatcaaatgtgtggctcaattttattaaagctgacatgacattattgcttatgttttggccaaccttggtttcaattattacctttcatatttttattttactcctatgttttacccttgcatactgctacattaagaagagaaattaagtctcttttaagccatctcagaacttttgggccgggtgtggtggctcacacctgtaatcccagcactctgagaggctgaggcaggaggatcgcttgagctcatgagtttgagaccagcctgggcaacatagggagaccttgtcgatacaaaaatttaaaaatgagatgggaggatggctggagccagggagatcgaggctgcagtaagctgtgattgtgccactgcactcttgcctgggtgagcctgcctaaaaaaaaaaaaaaagcttttggaatttatcctgtcttatgtcaatcctcactagaaattgttaagtgaatcaagtcattttcccactttcaagagaaaagcatgttgaatataattcagtgatgccttcattaccttttaaaaatgatttaaagaaaatccataaactgaaaagcactgtgccaaaagctttacattaactcattcttccccatgagatgattctgttactctctgttatagatgagggacaagctcagagacattatgttactcgtgcaacagaacgtaactcataagtgacagagctgagtcaaactgagatgtctgattttaaggcgtgtgttcttaactatgcaagttttctctaaaaaacttaattgtaggatacaggtatttatttgtgttccatttaattgcggttttacccttaagatgcctcaatatgtattgggcatctactttgccaggcacatcattaatcctattcaaccccatagctacctatgcagtagatgtctcaagatggtgcatgaggaagcacacccagagaagctctagtcctcacccatagtttacagcttagtgcatggtggagctgagagttaaacctatatcatcttacactaagttcctttttaaaaaaaattctcctgggctgggtgcagtggctcacgcctgtaatcccagcactttggtaggccaaggtgggcagatcacaaggtcaggagttcgagaccagcctggccaacatggtgaaaccccgtctctactaaaaatacaaaaaattagctgggcgtggtggcgggcacctgtaatcccagctactcgggaggctgaggcaagagaattgcttgaatccaggaggtggaggttgcagtgagctgagatcgcggcattgcattccagcctgggtgacacggcaagtctctttcttaaaaaaaaaaaaaaaaaaaaaaaaaaaattctcctataccatgctgaagttttgagtttattatgactttgcagaagcaattttgaaatctgctttattgatttgtgacattagaatgaactatcagtattagtgaacattagtgctattgaaacaactgttttatgttgtcacctttttaataacttaaatttctagccaatttttgcaatgcagtattgaacttttgggtacatcttcatgagtttttagtctatttaaattctcaggaatttggcagaaaactctgatgtgataagtgtaatctgggacaacttgtgtatgtaacacccaacattcctggcgtgtagcaactagatagttagcttcttgacaaataggtgggagttggaatcagcaaaatattagttagttaacatgagagggttggtgcagaagtacccacagcagaatagatcatggtaagtgttttttattaagaaattcataaaaattgaaaaaggtgaattcatataagtacttctcgagtgtttgggaggtatttcctatacttgaactgtatataatagatataagtgcatagataacacatggaaatgatgattaaaaagttcagtatttcagtaagattgtgcttttacatgtttgaatagatatttttgttgaagtgaaattgcagacagagcattagctgtaatctgtcctggaaggggaatgccagttttactgtctgagctcagccattgggtttaattcagatgtcgaagcttaacaagccattggtaccagtgtgatatttgtgtggacagtggcatctgaggaactaatcactaaggaagtgtagacgcagcctaactactggcaagtgtgtccttgggccagctcaggattgtggcacattggcaaggagagatcagtattggattgtagtcgagaaagtgaagctgtctccattcccactctgcttatgtgtgaccatggaaatgttctgttctctctctctctgggaaactgtccaatgggtctgaatttaaacttaccagaatggagtaatttcacttcattaagaaatgggtcctgtatattcacgtatagaaagttaaaacattttggagaattagtacctttaaaggcagttattggtttgcttttagcattgctttttaaccaaaaaagaagtgttttagaaattagaatagcctggacattattgttttacctcagttacaagaggtttttcatacttttatagaacctttaaattattatatatacaacttgaaacagcctctcagtctattgtgtttatccatgattctggaaaaataattatctatttgagggaaatgtttatgatcttaaaaatgggaaatacccatggcaaaaaaaatcagaagtagtgataataaaatgaataaaatatgaaagttagagatgattatctagagaagttcttagtttactgtcattaaggaactttaccaggctgttccttatggataatcctctttctctcctttttcttttccccacagtgtcccaccagtggcagagtgggctgttcctcagtcatcaagactgaaatacaggcaattattcaatagtcatgacaaaactatgagtggacacttaacaggtatttacaaataaaaattagtgaaatatgatctttgttttcaatgtaaactgtttctagatattgggtcatagatattttccatgtctgtgtgcttatttcttggcagtgtttcctttgtctctgttatctcatgttcttatccactgataactctttacatagttatatcattctctcatgccccattgctttgtggtaaaatggaatatagaccagggatactcctgtacgctgaaagccactgatatgcaaatcaaggcactagcaaagaaacacttctttgaacaaaaactagcttcaacttctgaagtccagctttgaacttgatgaacttgaagctgtctgttcactaggttagagttggaggcagcaggcagggtaaaagcagggagttgagaacatggctctgtctcagataactgcctagatagggctcaccactttggatatttctttatctattaatataaaaggccagagttaacttaggtgatctcaatggatttttttaaaagaagaatgattctgttatctacgtcagaaggatagacaggaattttagcatactgttcaaaatttttctcacgaaggtttaaatacttgttagaaagttataaagaaggctgggtgcagtggctcacgcctgtaatcccaatcccagccctttgggaggctgaggcgggtggatcacctgaggtcaggagttcaagaccagcctggccaacatggtctctactaaaaatacaaaaattagccgggtgtggtggtgggcacctgtaatcccagctactgaggcaggagaattgctggaacctgggaggcggttgcagtgagtcaagatcatgccactgcactccatcctgggctgcagagtgagactccgtctcaaaaaaaaaaaaaaaaaaaagaaagttataaagaaaagcataactttaatgaaagaaaatagagacctctgatatgaatattaaatgttaaagggaaaaactaactgccctctaacaaatatgaaaggaagggaaaaaaattaggtttcctgtgtggtggagtggggtaaggggaggattataatccaaaacacttttaagaaatgattcttactattttttccttgctattacttaaaattgcaatttttactcccaaaagaaaaaaggtatcttatgtttaaaaatgtcagagttggacgagattttgaagggttctaatctaatcttgaactctggtccctttaaggatctcagcagtcaccccaaataagcatgtatttatgtttgaatgggtgaatagtaaatacacacagattctcgatgtgtcatactgcctcataaagcagtagctgtcaaaaccagcctaccttatgcaggctctgcttttttttttgagatggagcttcactcttgttgcccaggccggagtgcaatggtgtgatctcagctcactgcaatctccacctcctgggttcaagtgagtctcctgcctcagcctcccaagtagctgggattacaggcatgtaccaccacgcccggctaattttgtatttttagtagaaacagggtttcaccatgttgctcaggctggtctcaaactcctgacctcaggtgatccacccacctcagcctcccaaagtgctgggattacaggcatgagccaccacacccggcccactgaaggtatatttaatagcatatttttaagtactgttttacatggtttgtttgacaccagtgctccatacaaacccagaactacattgccaatgaatccaaaaatatttcttgaaaacgttggtgtttgctgtgagttgattaaaatagtattcaattgagacattgattgagaaattctctctttcttggtgggatgtgtgttttatgaatgaaatgcagtatctacattccaaatataatgacccaggcacttgagcatttagaacttttaaatatctgaggcagaaagtaaaatttgaaatatactggaaagaaagcagattttgatattgtttatctgcatacttattgctactttgatccagcaagaatttaaggtgggaattttacttttgagccagacctttgtatagtcatgtcaagtagaataatttattacagtaaattttaaaatgggaataaacaatagaaatttaattttttttccctttatgtacttaggaatcaatatgaagtatgttttatactaaattagaatgttgatggaaacagctgatttgttgaggtggatggaacataaaggtcattgtcttgatcacaattataaaaataattttatgaagtcagaatccccaaagcagttcactcagctgcaggagaagcaaaatatcaagaaagttgagaaaaggtttcagtatataacatggcccaaaagaaatatataatttatatttgtaatctcttgtttttcatccttcttgcttttgttttttgtgggtttttgttttcaggagctaaaaagcacttcttttctttctttttttgaaacagagacttgctttgttacccaggctggagtgctgtggtgcgatagtagctcactgcagccttgaactcctgggctcaagcaatcctctcaccttagcctcctgagtagcagggactacaggcgtgcatgcaccaccacacctggctaatttttttaaaaaagttttctttagaggtgggatctttgttgtccaggctggttttgaactcctgacctcaagcagtcctaccaccttgtcctcccaaagtactgggattacaggcacccaggctgaagtacagtgacataatcatggttcactgctgcctggatttcccaggctcgggggatcctcccacctcagcccccaagtagctgcgactacaggcatgtgccaccatgcccagctaattttttgtagaaactgggttttgccatgttccccaggctggtctcgaactcctgagcttaagcgatctgcttacctctgcctcccaaagtggtgggattataggcgtgagccaccgcgtctggccttaatagtggcactgtttaccccactgactatctgggttgatttagccgatacatcctgttggacaccctgttcttccttcatggcttgatgtgtaactgttgcatgcccttaaaagagactgccttataaaatagagagggatcattctttaattaaggttatgtaagaagctctagaactctggtattcctgttaataatgctagcccttcttctcaaagaggtattttattgttgcattctgaaacaatgaatatgctatttggtaattcatctattaatcagaaaagctaaagtcttagtcattgttttaaataaagctcatttcatgtagttactctctcctttctagccatacttccctgcccaaacatggatgccagaagtggggtttgtgtgcttgggatttctggttttattcctatgttcccttataagccagtactccaaaaccgatatccctttatgtacctaggtttccacagaagagttctgtgcactcaaagctcaactgtgtgttgtccaaatgtgctaagatgctatcttagctgttgctgatctatttttaatattttgcaacattgatttaggacatatgtagacaaatagtagaattacaagagataattgtgatcttctagtgtggggattggcaaacattttctgtaaagaatagcacaataaatattttaggctcataggtcatatgttctctgctgcaactactcaactttgccatcgtagcatgacaacaaccatatatcatgcttatatcagtggatatggctgttttaataaaactttgcttaccaaaacaggcagtgggccagatctggcctaagggctataatttaccaatccctgttgtagattattttcctcatttcacagatggaagaacttcattttagaaagttaaagtagttttgttaatgtcacatgccattagggagtcaggactagaatccaagtcccctgatatccaggtttagagctagttcttcacatttattgttaggctttttatgtgtaatagataaaatattaacttccttttttatagttctggagtaagggcaattgttacaagtgtaaattaaatcacccactaaagttttgttaattctactttgttaccaacattctagatacaatgttacagactaaagaaagtgatgcctgaactttgctcattccattgtaccacagtcctttagaatcttcacatgaattcagtagattgttttttattcttagatgctcccaaaacacacacgtgctcatgtatgcacacacatccagcaggaatgtgttcatatattcaccaaaagttagaatgctcactattaatagtagccctaattgaagactaactgaatgcctatcaacagtataatggacaggccgggcacagtgactcatacctgtaatcccagcactttgggaggccaaggcgggtggatcacgtgaggtcaggagttcgagaccagcttggccaacatggggaaaccctgtctctactaaaaaaaatagaaaaattagccaggtgtggtggcgcatgcctgtagtcccagctattcaggaggctgaggcagaagaatcattgaacccgggtggaggaggttgcagggagccaagatggcgccactgcactccagcctgggtgacagagcgagaccgagactccatctcaaaaaaaaaaaagaaaagaaaagaaaacagtagaatggacaatgaattaggatgtaatgacacaatgatacactccatagcagtgaggattaatgttctacaactctacacgacaatatattgagcaaaataagccaggtggaacagcggacaggctatttggttagaagttaggctaccttggtggtagctgagtctaaaagagaggcaaataggggcatctggggtgcgattatactctctttcatgacctccatagtgtttgagtattttcactttggaaaattaattcagctgtgtacatgtgcacatgtatatatccacatgtatccgtatgtgtgcttttctgtcaggattttatatgtaaataaaagttgaactattgtcagtaatgttacctgccattagagcacctctcatgtgctaatgtgatgctaagctcattgccccaatggatcatagactggtttatctgaaatgagcaaactaggatccagactacctggcccagtcactcagcaaagtctagactaagccaggactagagcctacagctccttggttccctgacctctactgctggccatgcaaaaacacatccagttttgtggtttttgatgaggtgacgtttgaataaagaaatagcaaaaagcaaaaacatatacaccagaatcttcccaacaaaattgccacagccttccattcctctgtccagcagtcttcctgggaccacatcttgagaggcagtgctggaaaggaagacgtatttatttctccctctctgactgtagtttatttaaactgagtctcctactgtgcgtttgtctgatgtctaaggccactttcataccagaagtgaagatgtttatgattattttaagaaatgagagcttattttgagagaagagtagaaattccaggaattcttcttttttttttttttcttggctaacataggaaatgtgttttgttttgtttttttaattgagacagtgtctcactctgttgcccaggatggagtgcagtggcataatcttggctcactgcagcctccgcctctggggctcaagcgatcctcctacttcagcatcccgagtaactgtgaccacaggctcatgccaccattcccagctaattttttgcacttttggtggagatggggttttgccatctggtcttgaactcctgagctcgagccatctgcctgcctcagcctcccagaatgctgggattacaggcacgagtgaccacaccaggctggaaatgtgttttaatcctggctattagcgcttcctgcaactttttttttttttctttttaagtctgtttagtgaaacagtttcccggagatctctccgaggtcccttcctcctctaagattctccgaatcttccctgaatttgcctgaggttgagcagggtggagacagcaggtggtagcagcggcaaaagatgttaaacttaaagagaataactttcaagtttgtaaataaagcccaatacaaataaagatggtaatgtggacaaaaggtcaggttatattttgaaactctaaatctttcacatggtcattctttatcaaacatccatttaacaaaaatttattatgtgtcagatgctgtgctctgtgtttctcctctttttcattggggcttaatttcctttttacaaagccctgcggtagtagcaaatgttatttaaagcattgtgattgcatgaggtcatggagtagtccacatacgcagaaccctggtcctcctgtacagtgagtatttgctgactcatctgtatgtccttttcctggttcctgtttaggtccccaagcaagaactattcttatgcagtcaagtttaccacaggctcagctggcttcaatatggtaaggaatgaaaagttctttggtttggataaagtggaaacttggttagattggtgtggcctcatgggttttagattaataccgttttttatgggggaatatgtagaatttgcttaatttcagtgagttgtaatgattgcctcttttataatactatttcccctctcaattttgaaaaatacaaaagcagattaatacaataaattctgaaggagtgataatacaacttaacaattctcaactcgtgaccagtcttggctctccctgtctttgatttctttttctttttttttttttgagatggagttttactctagttgcccaggctggagtgcagtggtacgatctcggctcaccgcaacctccacctcccgggttcaagcgattctcctgcctcagcctcctgagtagctgggattataggcatgcaccaccatgcccggctaattttgaatttttagtaggacagggtttctccatgttggtcaggctggtcttgaactcccaacctcagatgatccacccgcctcagcctcccaaagtgctggaattacaggcgtgagccaccatgcccagcctctttgattattttaagccaaatcttagttattatataatttctactgcaaatattttagcttttatcttcaaaagagagggattttcctttttttcattcattattattattattacttttgagatggagtctcactctttcatccagatggcagtggtgccatcttggctcactgcaacctccacttcccaggttcagcctattctcctgcctcagcctccttagtagctgggactgcaggcatgaacccccacgcttggctaatttttgtttttttagtagagacagggtgttgccatgttggccaggctggtctcgagctcctgacctcaggtgacctgcccacctcagcctcccaaaatgctgagattccgggggtgagcactgcgcctgaccgactttcttcttagcacagtcataacagcaatagctcacctaagtttttcagtagtcatccttatcattaaattaatcagggaatgttcacattccttagagtgcctcagaatgtttttatagttcatttgttcagctcaggactgaaataagcctgtattttgcaatacttgagttttccatcttttatgtctcctttaatctataaatttccccttgtcttgttctctgcttcttttcccaagtcccccaggccgccccccaaccaaaaaaaaaaaaaaaaaaaaaaaactccgttaaaaacaaaccagatcatttgtcctgtagtttcttaatggcttaacttttgaagagtgcgtcactgtgggattgtctaatttgtttctgtatttcctgtaaattgataattagatctagagcaaagtttcccaaccccagcactattgacattttgggcccgataaatctttgttgttgggggatgtcctgtatactgtaggatgttcagtagcatctgtggccactactcactggatgctagatgccagtagcatgagctccacacccagcatgacaatcagaaatgtctccagactttgatagatgtgccttggggtacaaaatcttccctggttgagaattgcggatcagatttgatttttttttttgttttgttgttttgtttttgataagactgtgccagagaggtctctgtgtactctcctcaaaaggcacataatgtctctattgtgtaatgattttgaatagctatcgatgagcattgcctgggtcctacaggcttccttaaatttaaatgttaactagaatggtttcttaagaagtgtgcatgttatagctgtatgttggtgattgtccctggaaaataaactttgtctacaagactcactgcaaagttcgtgattttcttgcaggccacattgatagggttgtttcacaaatgatcaagctctaatgcagcttcctttgcccttctcttcccttctgttttgtatgaaagagcttgcctttggcagtagaccagaccagttaataaacatcttatatctttgacacacccagaactctttaaatcagggtattgaacagtatcctagggccccctgaaatataaacttaagatctaacattaatggaggttggttgacaatttattaggttgttctcatgataccagattatattgaaatatttattttaaatttctcatttataacttatcctatttgagaaaaacgcttgaggcttcttctgttagaatgttatattctggtgctacacactaaaaaagatattttaattaaatgcttataatcataatttaggtaagtgtggtgaaaaaacaagaatttcagccaccttctaactggtttacctaggactggctaattgtgagacacaaaaaggaacagaataaggaagagcgggcaggggtttcattttatttcatttgcatttctttttaaaactgggtatcttgcatatgggtatcttgcaaaactagaggaacagaaaaaagatcagcagttgccaggggatgggggcaaaggagggagttgctacaatcagatgtggaattttaggtagagctgacactattctgtatgttgtggttcatgtttgtcaaaactctcagacctatactctagaaggtgtgcattctactttatggaaattataacaaaaaaagtttatagcacctaaggaaatttcagaattaagaaggtttcttaatttttggcattggcaaaaccagtttcccattgcatttgtcctgttgacattctagtgaatggatgtgttgtcatgtatcttcttttgatggtccagaaattgtttagtaaaatcacattcttggacttgccaggagaatgtttgctgtaattagctacttgggcaagttcattatgaagaatgatggagattgaatcctgagattgaggaagaggaaacacttagactctgtggctggagttcataaagatccactgtgtaggcctagattaaggggtggccagctctgcccagtgggccgaatctggcctgcatctgtttttgtgaagaaagtttttatcgtacaaatagccatgcccattcatttatatgttgtctatggctactttctgccaaaatgacagaattcagtatgataaggattgtatgtcttataaactgtaaaatatttactacctgaccctttactgatagtttgtcatttcctggtctagagcagaacatttaacaatatagagctgggtatggtggcttatgcctataatcccagcgatttgataggctcacttgaggccaggacagatcagcctgggcaacacagtgagacccccatctctacaaaatattttaaaaattagctaggcatggtggcgcacaccttgtaatctcacgtttgggaggctgaggcaggaggatcatttaagcccggaaaggctgtggtgaactatgatcttgactgcagtgaggctgcagtgaactgtgatcatgactgcagtgagtctgcagtgagctgtgatcatgactgcagtgaggctgcagtgaactgtgatcatgtcattgcacatcagcctgggtaacagtgagagctcatctgttaaaaaagattcatggaatatgagtgtattatatgttaaatatgcaaaggttggggaagagtatcattataatcatagcatttgttgaatgaggaacactgtcccaactacctgtaattttatctttgcagcagtataaaataggtactattttgacaaaatgagggacaaagagactcagttggcctgtggtcaataagaaaacataacttttaaatcactaatgaatagtaaaaagcatgaattttcatgaaaccggattacagttaactttttgttgaataggaatctttctgacattgatcaagatggaaaacttacagcagaggaatttatcctggcaatgcacctcattgatgtagctatgtctggccaaccactgccacctgtcctgcctccagaatacattccaccttcttttaggtaaggaacatgggctctgatcaggaattgtatgcggagtatatgaattccaaacttggctttattgactatgtgtcttacctgattttcatccctgacaaggaaactaagtatccgtgaattctagagactctcatctaggtctatgttaatcttgggcccattttgttcttcaaagtacttgaagtatattagtgaaacaatgaagtaaaacatcaatagattgttgattttctaccaacctatgtcatcaatgcttaccagaaattttcacaacagatgccagcagcaagagagaaactgcatgagcctatgcatagagaagaaaccaaggagatcacacttgtgaattccacacatttcagtggtaacaaaagctgctagcaatgtagaaattataatcaggaagacaaagaaaattaccctggactgaaagacagtctcagtaaagatgtcaagagagtcacctgaggtccagtattgtgactggcatcctcatttacatccatgcatgcatgcacacgctgtccaggacagctctgtctcctggctttgaacataaaaactgaatatgagatcttacaagtacaaaggagaatgaaagaaagattaagatttctgacctgagtcctcaaactgcaggaaggactggggcaaaatcccctttaaatgaagagaaatagagccattactgtcagcacacacgtggtacaggagcaagctgaggaaactgtgactatgtaggaagcaacagatagctgaggcactttgcctgtgaaatcccacaactgcaacattggaagctgataatgaatgcgtaaaaaggattgggagacggtttaaacacagcaaagttaaaagtgtaaagtggggagggtggtgcggtggctcacgcctgtaatcccagcacgttgggaggccgaggcgggtggatcacttgaggtcaggagtttgagatcagcctggccaacatggtgaaaccccgtctctactaaaaatacaaaaattagccaggcgtggtggcaggtgcctgtaatcccagctactcgggaggctgaggcaggagaatcgcttgagcccaggaggcggaggttgcagtgagccaagattgcaccattgcactccagcctgggggacaagagtgagactttgtctcaaaaaataaaataaaataaaatgacataaataaataaataaataaaagtgtaaagtggaagaaattagtaaacaaagtgatttgttttacgaactatatagacattgcatgtgtttcttagggggtgaaatggagagatgggaaagggaagagagatgctcctagtgagctgagctgctgatcttcccttggaggaatttaaggttacttgagagggcaatggaaatagcagctcccacttagtgctcaccatgtcccaggcattgttcttaccactttttgattattaactactttcatcctttggaattgtttcaattttggtggtgattcttaagcttggcactcagagtctgatgacattccaatattcattaaaaaactctttgtaaatagagaagaccaaatctttatattttccttactgtaaatgaaatttgctccatggcatggtaaaatctttaaaaatccttcttcataacttgtccaactccacccagacagctctgtgtgaatctatttttctttttccccgcaattgcagaagagttcgatctggcagtggtatatctgtcataagctcaacatctgtagatcagaggctaccagaggaaccagttttagaagatgaacaacaacaattagaaaagaaattacctggtaaggcagcctttatgttgagttaaatcatttagattaaacgaaattagagatttcctatctctaagacaaagatagaggtaaacataaatttagtttttgacatttttgccttgtaacttaactgaccttagttggagataattgttaattaagcttgtggatttgggtctggatagagaaataagaacattatgcactctgctaatgcaccgttgttctaacttgtaacttgaaatctgattataaactgctaaacaaaaattatgtaaatgttatccatagaatatacagcactaaaaactgatgagtattaaggtgattgcttaataccaccagtgcagaaatagaaaatcaaatcatctactgttgttttctcatgttgttataagagaattggaaactccttaattgcaggaacctattttaaatttaatgtgaacctattttattttatttattttgttttttgagatggagtctcactctgttacccaggcaggagtggagtggcgcaatctaggctcactgcaacctccgcctcccaggttcaagtgattctcctgcctcagcctctggagtagttgggactacaggcacatgcaccacgcccggctaatttttgtatttttagtagagatggggtttcaccatgttggccaggctgatctcaaactcctgacctcaagtgatccacctacctcagcctcccaaagtgctgggattataggcgtgagtcactgtgcccagctgaacctattttaaataatactcatttacaatgataaatccatcatactattaaaatattctaaggtggctatgaattattaatgatgagatgataatgatactaagaagcaaatgaaattatggagtcttttatgataaatactttgtcagtgtcattttgctgcatttaagatgctcagcagttaattggtctggtcagaacactggctgtcccagtttattgtctaaactaaattaccttttgttcactgatgaaatactattggaaatattttacgtgcaagcctgcatgttgagcaaagaatctaaatgttaatacatggttcatactttctagaacctttaaaatatattagaggatttaagacatccatataagcaatcacttcagcagtatgtgagtgggataaattcctggagagtattatagatgcacaacagacctcacttatggttggttggtgtagactggggaagatatgaggaattaaatgtctgtggaagaggtcacagttgagttgagagttgaagatgaatagggtcaccacaagtggaagtgagaatagttcaggttttgataacaatgagaatgaaatttcaatggcagataaggacaggaatgcttggaatgcagaattttctttttctgtttttagtagacattcatttaaaattttgaacaggaagcaacattatcagagatttcatttgtgcattcattccttcaacagccgtttattatatgcctcctacatactaggaatattgccagatgctggaattaaaaagatgtatagagacttggagagttttttaaattgagatgagattcacataatacaaaatgtacagttcagaggctgtcttagtctgcttggactaccataacaaaatagcatagaccgggcagcttgaacagtgggaattttatctctcaccgttctggaggctggaagtccaagatcacggtgtgcagatttggttcccagtgagggccctcttcgtagcatgcagacagcagccttcagtttttttgctcacatgggatttccttggtttgtgcatgcagagggagacagatctctcctctctctgttttctctatctctgtctctgccttttttttttttgagacggttgtttcgctcttgttgcccaggctggagtgcaatggcgtaatctcggctcactgcagcctccgcctcctgggttctagcgattctcctgcctcaacctcccaagtagctgggactaaaggcatgtgccaccacacccagctaattttgtatttttagtagagacggaggtttcaccatgttggtcaggctggtcttgaacttttgactttaggtgatccacccaccttggcctcccaaaaagtgttgggattacaggtgtgagccactgcgctcggcagtccctgtctttttataaggatattaatttatcataagggccccactctcaacggctaattttttttgttttattttgtttttgagatggagttttgctcttgttgcccaggctggagtgcagtggcgcgatcttggctcaccacaacctccgcctcccgggttcaagcgattcttctgcctcagcctcccgagtagctgggactacaggcatgtgccataatacccaggtaattttttatttttagtagagatagggtttctccatgttggtcaggctggtcttgaactcctgacctctggtgatctgcctgcctcggcctcccaaagtgctgggattacaggcgtgagccaccgtgcctggccagctaatctaatcttaaccttccagaggctccatctccaaatatcacattagggtaattagggcttaaacatatggattttggtgaggcgacacaaacattcagttcctaacaatgacatttagtgcattcacagtgccttgcagccacaacctctcttgtcccaagatactttcctcacctcacaacaaaactccatatccatcactccctccagcccctggcaaccaccaatctgctttctgattcttgggatttacctgttgtggatatttcatataaatggaatcatatatgactgtttatgactgacatctttcacttggcacaatatttttgagattcatccaccttgcagcatgtatcattacatcatccctttctgtgggagggggactttgaatttttttttttttttttttgagacagagtctgctcgtcacccaggctggagtgcagtggcgcaatcttgtctcactgcaacctctgcctctcagctttaagcgattctcctgtctcagcctcccaagtagctggggttaaaggtgcctgccaccacacctggctaatttttttgtatttttagtagagactgggtttcaccatgttggccaggctggtatggaactcctgacctcaagtgatctgcccacctcagcctcccaaagtgctgggattacaggtgtgagccactgcacccagccaggactttgaattttaagatatcagagtagaggataccatctcctctgaaatcaccaaaggtgagcaagaaaaccaaaacatacttgcccgctttcatctctaatcgctgactacagtacgtgaaggaagtctgtctaaagcagtgaagtccaaacaggaatgtgggaagaagccaaagatggatgctcacagctgcagatctcaaggcagagtgagaagcaatggttcttagatgtggaccagggactggcatgctgcacagggtggcaatgagtgctcccctggccggcgttggtaccaaggaggattgcgtgaggccaacacagaaatgaaatagacactgctgaggacagtaagggacaaggatgatgggattgtagaaaatgaagaaataaaatggacataaagtattagaaaaaaaaggatagaactgagtaatcattctaaatttataattgatgtgttaaagaaggaaactgaataatgggttagaaaaaattgttgactgactgtgatctccatagggatcagggcacagcttgttcttcagtgtgaaaagccgaatgctcacctttcactctgctttgagaaatcttgttagaatagaggactcatcagcacggttacaaggcaaagggaaggagggagagagacagagactcatggtccagaagagagggggttaattcctagggcaagctcatgggaagaagggaaaggatggagtaacagggaaggaaaggagtctggatggtgatgtagaactgctagataaggatcttttagaaacagtgtttggcgtggaggagaagatataaacagagaggttaggcaaagggggttttcgttgtgctcattaacaaggacacagaagcttagggagttctgggtttgggtttgtactacaaatttcaaatacattggtgagttttcctttgaaaagagtccgttgaaaatcttgagttttcatagttgctgtgttccttgtctgaagtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggtaagcaggcgagagtggagccacccggagttagtgtgcgatcaccccttttcagaattatccaagtgatctattcacgccatctttgtctttttacaattcagtagttttagtatattcccaaagttgtgcaaccatcgtccctaattccagaacattttcatcactccagctctttacccattaagcagctactccccatttctttctccctccagctcctatcattaattttactttctatctttctagatttacttattcaggacattttttataaatggaatcatcaatatatggacttttgtttctggctttcatttagcataatgttttcaaggttcatccacattgtaaaatgaatcagtcctttattcctgtttatggctgagtaatatttcgttatatgggtataccacattttttaattcattcagcagttgatggtcattgtggctattataaacaatgatgttatgaacattaatgtacaagtttttgatgatacaattttgtaacaaaccactgataccagtaaagtgtttttccagactgttttctctgtatacacctatataaaaatataaaggtttatatggcggagagtgtaagggctgtataattttttaaaaaccactgtaatagtatcataccaattacattgttctgcaatcttcttttttttttttttttttgtttgagacagagtctcgctctgtcacttccaggctggaatgcagtggcatgatctcagctcactgcaacctctgcctcctgggttcaagcgattctcctgcctcagtctcctgagtagctgggattacaggtgcccgccaccacgcccagctaatattttgtatttttagtagagatgaggtttcaccatgttggtcaggctgatctcgagctcctgacctcgggtgatccacccgcctcagcctcccaaagtgctgggattacaggcatgagccaccgcgcctggcccatgcaaccttctttttaaactcttttaaaaatatgtctgggacatcctccctatattctatggaaggcttcgtaaatttagcgccatacctggaaaggggctaagcaaatcttgtctctctttccaattttagtacattactgcagaagcaacacatggttctttcatgtgaatgaaagataaaaatgaggaatttttcgatgtaaaaaaatagcctgagtgctgtgcctcaagcctgtaatcccagcactttgggaggctaaggagggatgatcacttgaggccagtagttggaggccactgcattccagcctaggtgacagagcaagaacctgtctcaaaaaaagaaagaaacaaaacttatagccataactcctttttttttttttgagacagactctcgctctgttgcccaggctggagtgcagtggcacgatctcagttcactgcagccttcacctcctgggttcaagtgattcacctgcctcagcctccggagtagctgggattacaggcgtgagccaccatgcctggctgatttttgtatttttagtagagacagggtttcgccatgttgcccaggctggtctcgaactcctgacctcaggtgatccgcctgcctcggcctaccaaagtgctaggattacaagcgtgagccactgcgcccggccccgtaactcctttttgttcagacagacactaacaaaattttaattttcagaatgaacaaagataggcaaacttttcttcaacgtaccaaaaaaatgatattctagagtatttattcagaattatttaatagacatttaccatgtatcaggtgtagttggatgacccatgagtcagaggcaattcccatagactgtcagatgctctgatatgtactctatctagcagtcgtcagagccagtcgttggagggagcaaaagcttttgtggtaaaaaggaaatgaatgattaggaagtggggagtcgcagacttttaaaacgagttaagtaataatttctcttttggtggagtaaaatcaactcttgtttgtttttgttcaggggtgttttagtttgattttactacataaattttccttcttggcgtgtcagtaaataagaaggagcatttttagttagcacatcaagcattcttgaaggcataaagaatggaattctaatggggaaataatcctgtcatcttacgtaaatatagtattatgtaaatataatacccagttctgtgtattccctttattcccatagaaggaatactgtatttttatgtaattttttgttttctaatgtgatttcttgtaatgtttaatatttcatccctaaaaggaaagacttcctagatgccatttttgtgaaaagacattgtgtagtgtaagaactgaaaaattagtaatttgtctctgtaaatgtcacaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctagtgagtgaagtttggttatactttgaaaatatactaagatggaaccattaaaaacagtaataatttttattatctttcatttgttcaagaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggtgaggaaatatgcctcttaaaagctattatattaaactggcatccttttctctaattcatttcatttacttacttattcagtaaacattaagcaactgtcttgtactaggcactgggaagcaaaaatgaagtagacagggtccttgtgtgaaaagtagcctgtcaaggagacaaactcagcaaatatttactgagcactgcttcgggccaggtgcttttgcagtttctgaggctacagcagggacagacactctgtcttctgggagcttaccctctgtttgcaggaggaacagagactaacaaaataaagtgtgtactgtattagaagatgaaaagtgctatggagagtgagtagggaagggaatagagagtcctagggataggaaatgttgtgattttaactaaggtagccaagacaggtctttctggatggtgacatttgagcagagacttgaaattaatgacaggctaagccatgtgggtatctggcagagcaagatctaggcagggaaatagtgccaaagtcctgaggtcgtagcaggactctgagatgccagttacagcaaggagactactgggtagagcaggtgggagctggatcacacagaacctgtagtccaccaacaggactttggctttactgtggtaattacaataaataagtacacttaagtattttagggggtcatatgagagctatatgtatactaaatagttggagacatacagagcacttttagtagttctgtcttcattttaaagcctatccaaagttgttataatatcacctggtttggtatcaagtgctgaactacaggggcatcaaattcatgtaaatattgcctgtggatgatcatatttgcctgtgattcctttatgttaggctttttctcagcatgatgtttttgagatgtgtccatgttactgagtgaatgactcttttgtttcttttcatcactgagtagtgtttccttatgtgtccattcacctactggttgatattcaggttctttccagtgtggaacttttatgaataaaactgcagtgagcatttatgtacaagtctttatgtggaaatggtttatttctcttgggtaaacttttaggaatggaactactgtgtcatgtaagtgtatatttaaccccataagaaactgtcaggctgggcacagtgggtcacacctgtaaacccaatactttgagagggcaaggtaagaggattgcttgagctcaggagtttgagaccagcctgggaaacatagcaagaccccatctctaaaaaaaaaaaaaaaaaacttaaaaattagctggcatgggggcgttcacctgtagtacctgcctgaggcaggaagaccacttgagcccacgatatcgaggctgcagtgagctatgattgagccactgactgcctgggccacagaatgagaccctgttcaaaaaaaaaaaaaaaaagagagagaaaagagaaaggaaagaaagagaactgacaaactgcaaagagtttgtaccattttacattctgatcatttaatttgtatttccctgaaggctaatgatgttgggaatcatcttacatgtttattggcgagtattttttactgtgcatcttcgttgaagtgtctgaacaaatcttttgcccattttttattgggctgtttgtcttactatttacttgtaaaagttctttttatattcttaacaagtcctttgtcagatacgtgttttgcaaatattttctcccaatctggcttgggtttaatttttgttagtggtattttttaaagggcagaagttttaaattttgatgaagttcagtttaccgttttttttcttttggtgttcatgctttttatgttctatctgagaaatctttgactaccccatgactgcaaatattttattttcttctagaagtttttggggcttaaaaaaataatttttacaagtttttataaattgaaaaaaacttaaaattttaagtttcatagttgtatcttatatgtttaggtctatgagctatttcaagttgatttttgcagatagtataaggtaaaggttgaggtttatatttttacatactgatacacagttgttatagcaccatttattaaaaacactggcttttttcccattgagttaccttggtagcttgttgaaaatcagttgaacatatttgtaatggtctattctggactctattctgttcttttgatctgtctgtcctttaccagtacctcaccctgttgatacctaatttttgaagtcaagtgatacgaattctctgttattgttctttttagaattgtttttggttattccaggtccttaacatttccatgtacattttagaatcagcttatcagtttttacaaaaatgcttggaattttgttggaattccattgaatttataaatcaatttgggaagatttgacatctcagcaatagtaaatctatggcataaatctctattttggtagttataaatttctctcagcaatgttttgtagtttgcagtgtccaagtcttgtagatactttgtaaagtttatccctaagtattttgtggcttttgatgctattgtatattgcatatttttattttagtttccagttgtttggtgccagtatatggaaatagaatttatttttgtatattgaccttatatctgtgattgcttaactaacttcctttgtgtgtcttactttgttgaccagaacctcccatactatattggatagaagtgggaagagccttgttccctctcgatgaaggaaagctctctcaccatagagtatagtgttaaccagggttcttgtaaacaccttttatcaggttgatggacttctccttttgctgagggtttttatgatgaatgggtgttgaaatagatcatatgttttttccccgcatctattgagataagtatgtgttttttctttcttattttgttaatatgatgaagtacatggttgccatttgaatgttaaatcagccttccattcttgggataaaccactcttggtcatggtatattaccctttattaaaatatttcactacattccatttcccattattttattaaggatctttttaaatctgttgaattcaattcaacagagatattggtttttagtgttcttctaatattcttgtctagttttgatatcagggtaatgctggcctcagaaaatgagttggaaaatattccttcctcctctattttctaaaagtgtttgtgttgaaatagcatttcttctttaaattttggtggcattcaccagtgaaggcctctgggcctggagctttcttgaagacttaattataaaattcattatgcagatatagggctattctgattttcttcttctccttgaatctgttttgattatctgtcaatgaacttgtttatattatctaaattattaaatttacttgtataaagttgtttataatattctctttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctataatattctcttattgtatgtaagtctgtagtatctgtagtgatgtctcttctttctttactgatattggtaatttgtgtcctctcactctgtctccgtgcttccttctccttttccttcctaaccccttcttctctcctttctcctactctatctctcctccttcttcttttcttgatcagtctatctggagtttgtttatttttaaaaaataagttcttggctctattgatttttttttttttagtaagcccttggctttattgattttctctgtggtatgtctgttttctgctttatttttgttctttttctcttgtttcttccatttacttatttggggtttaattttcttttctcaagcttcataaggaggaagtttagataattgattttggacctttcatcatttttgatacaaacattttaagctttaaatgtccatctaaacactgacattgccatatcccacaaatttttaatatgttgcattttcatatttattcaattcaaaatcttttttaaattttctttgtaatttcttctaattctttcacctttattgagatttatggctcagcatatgctctgtcttggggaatattctatgggcgcttgaaaagaatgtgcatgctgttgtaattaggtagagtgttccctaaatatcagttagatcaagttgattcatggtggtcttcaagtctcctgtgtcttgactgattttgtgactacttttattagctactgagagtggaacactgaaatcctgatcattgtggatttgtatatcttcctttcatttctgttcaattattgtttcatgtactttgaagtcctaagaaactccttatacatttgaaatttgagatttgtaaaggaaaaagtaccagaagttgattgctggaaattattttaaaatattacaaaatgcatgcacctttttaaagtatatttttcttttcttttttttttgagacaaagtctcactgttgcccaggctagaatgcagtggtgcgatctcggctcactgcaacctctgcttcccgagttcgagtgattctcctgcctcagcctccccggtagcagggattacaggcaagcgccaccacgcctggctaatttttatattttttgcagagatggggtttcaccatgttggccagcctggtctcaaactcctgacctcaggtgatctgcccaccttggcctaagtgtatttttctatgtgttaactctctttatgtgtcttttgttaactcttgaggtaaagtttcataaaatattctcctggaaaatttagggatgaaggccatgtgtttattaaactaagtattatcacctaatactatatgaccaagtacaatttttattaaagattgatgtttagactgttcacttattgataatatgataaaaatcaagattcccaaaaatgtaatgaagtgaaaaataaaacattctttgaagaaagaaaagtatgtagtaggtaatcagatattggttccctttctgtacagggattagcagatacttgctttggagataagtcagatctgatttgtgtattctgttttatcaagatttttttttctggtatggattattcataggagaagatgcttctaaattctagctattgagttaactctttctaccatttagacatgcattacacagagatttattccacataagccagtctgtatctaaaggtggttattccaaaatggactggtttttagcttctgatgaaaaattttaattaaggcatttttagtttttcaaacaaaaagtcaatacatagagctcattttttatcaaggtaaaaataaaagtcaaatattctttattataacctaggaaggctgccattttactgaaacatgcagaaactatacaggatattttcggctaaatttaagcagatactgttcttggcaagttaaccacaaaaattccaaacagcctgtgcagtgtggcttaacttttttcttgtgtcagttaaaaaaatagttgcttcaaaacttttgtgtacctgtttaaaattccatccagtgtggtggaaaaatatatacagcagctaagattctagttgttaaaaatctttgatttctgtttctaacttcaggtatacggtaaacctaagttcagccttagtaagtatcaaagttcaggatagagtaatagggtagctcctatttagaccactgagttagtttacaaacagtaggatcactgcatttgcatttgatcccggtgccattggaagatcattgcttcaatttatctctgtggagtagtacttaatgtacattttttgaagcttataaatatccggtaagtcaacaaaaatataagaaatatcagggaagctataactgtgtagggaaaagcatttggcaaacagagttaatttcttggaaagaaagcaggagccacacctaattaataattaaatgcagcttcaccatgcaggatttgggaagagtctgagaaaactgacttaagctctgcctggatcttaatgtagatgtggtagccttccctgtcattcattactattttcctccttccttcccaggaatctcagcaaatgcttggaagacttattccagaaaaacagatactcaatgaccaattaaaacaagttcagcagaacagtttgcacagtaggtgttttatttttaaagttgaccttttctttattctttctttttttgacatggagtctcactctgtcccccaggctggagtgcagtggcgcaatctcggccaactgtaacctccgcctcccgggttcaagattctcttgcctcagcctcccaagtagctgggactacaggtgcatgccaccacagccagctagtttttgtatttttagtagagatggggtttcactatattggccaggctggtctcgaactcctgaccccaggtgatccatccactttggttccccaaagtgctgggattacaggtgtaggccaccgcacccagccttttcttattttttaaccagcaagaatttccttaagtgaaatgagaacattaaaaaacattttcctcactgcaaattaaagtttttcttatctttgcgacgtttttctaaaataggagattcacttgttacacttaaaagagccttagaagcaaaagaactagctcggcagcacctacgagaccaactggatgaagtggagaaagaaactagatcaaaactacaggagattgatattttcaataatcagctgaaggtaactcttctatgtgtgcctgcatgtgtgtcctacctttaatttttttaactgtccaaatgattagttgctatttaatcacaggcagaaaaatttattatgccattgtgagacaatctaaattgcacttttctccttgaaaatataagaatgaatttggcatctataaattagggctgaatgagtggccccagcatgacatctatttttaacctgaatcatattttgacacatctccattcttttgtctgtttatagtcacatcaagttgattccaaaagctttatctttcttatgttctttgaatactactaaaagggattgttttcttttttaaaactaagaatttttctgccacttcttatcttcattgcgcttaaatgtagatctttattttgttacctcatttttaaatcttactgttttagtggagtaattgcttttgtctcttgtggcagaagtggtgtatggttttgtcacatttgcacagtaaaattgggaaaatgccaaaactctgaggaaatgtaaaatggttagatcacagcctttttcagatttggtgtttctgatttaactttacaactgtatcatcttaagaatgttaattcttggccgggcgtggtggctcatgcctgtaatcccagccctttgggaggccgaggcaggcggatcatgaggtcaggagatcgagaccatcctggctaacacggtgaaaccccgtctctactaaaaatacaaaaaattagccgggcatggtggtgggcgcctgtagtcccagctacttgggaggctgaggcaggagaatgatgtgaacccaggaggcggagcttgcagtaagccaagatcacgccactgcactccagcctgggtgacagagcaagactctgtctcaaaaaaaaaaggaatgttaattcttaaaatcagaacacaaacagtttatttcttataaacaatcatatactactttagatgtatgtagatattagcatttttgttattcttataagaaattggatgttatacttttttcccctccaaatatttgttttccttttctaacataaaattctttttaagccaattcagcttttgacagtgggaagaagtaaaactcctattctataattctaaaaacaaaattaaaaattagcatatttgaaacttttataatagttgacctttggattgagattctaggccaaattgtctagacatctgagtttgaggtatgtgtgctgttctttcagagtattaggtaatgatcttttctcaattgtacgattccaggaaagtgctcttaggggaaatattatttgagccaacttagtgtttttcttcactttgctttcatgcttacatggtgtgtgtttgtgtgtacactatatatgttctatattcatgcatatatgattatgtgtggtatgtcagtattggaagtacagctgtaaattaaccatctctagaataagtgcaattagaaacaaaaaaacaaaaaagaataagttcaattaaagtatgctcacattaactttcattgtcacttgtctcttttataagcaaaaaaaaaaaaaaaatagcactgttgcaaagcctatgttgctttttaatagtctcttgggatataaactgttaaatattaagctctcttctgaacccaggcagtagtccagatttgtgccttcacattgattctttttctagaaatttgactcccctaaaaaaggttcaggtattagaaaatgatactctagtgagaggcttttgataaatgtctagaagattaaataattttggtgattgaatttctgttgccattactaaagagaacacccttaatatgtggcgagtcacccctactttgtttaattgactatggctgctttcagtatcacagagtttcttacataaaggccaattttagcccccttttccactagccctttttccaaatatgcttatttttaaataagagtatttcttcttgttttttaattttaattttggctttctcttattaactttaattaatatgatgagtttaaaaaaaatcacaggtcaggtcgggtgtggtggcatgtgcctgtaatcccagcactttgggaggcaggtggatcacttgagcaagtggatcattcgagactagcctgggcaaaagggtgaagccctgtctctacaaaacacacacacacacacacacacacacacacacacacacacacactagtcaggtatggtggcatgtgcctgtagtcccagctacttgggaagctgaggtcagagaatcacttgagtctgggaggttggggctgcagtgagccatgattgtgtcactgcactcctgcctgggcaacagagtgagaccctgtctcaaaaaacaaacaaacaaaacagtaaacaaatcacaggtcagtataactatattgttttgttatttaacacgcatttggaggacttagtgaatatgttgtgttatggttattatctctagtattcctctcaaacctgataaagccaaaacaaacaattaaattggagaatcaaaagatttatagaatttgattgagacaactcagagatggatttatcatttagtctcttaagtgtcacttgcccacttttctttgttgtagccacactggaaaatgaaatactttttttgtaactttagagcatgtgtccattagcaaccatgttttcttggatgaagagataggccaggaggagccagtctcctgactcttggggtttcttcagtgcccctcttgatcggcagtgcctttagagcatccacgctgttgatgcaaaaattacttctgccttcctgggatgtgtcatttcacacatctaacctgatagtgtgaatttgttgtatcctaaaccttcctttccctaaaggaagccagctggagagtacagaaaagaaattagggcttcctgttcttttgtatttcatgttcacgtagattgttcacctggaagaaggaaatgcagttccctcattataggttagtactgtaacactggaggaataccttacagagtacagaattttaaaattagttgatcaggatactaaatctatattaagtggctggctccacaaatgaggataacatttaacaaaaattgattctcactattttgggtaaattgcaataagtcattcacctactttgatgcatgctcagagttatgtccagtttcttaggtataaaggtaatacagggaataatcgtaccctggttcagcccagattctgagttataagacagtgattaggaagtataggaagcgtatttagtcaaaaaactaaatacacttatactttccttttcttttaacatacaatctgatttagttctttctctagaatgtcttgctcagattaatttgtcttttgtgggtttctcccattttcttcagttcaggaagaattccttccttccctacccaaaatctgataagcaaagatagaaattctcaaagcattaattaaagaggaaaaagttacaggttaacaggtatttgtctcgtataggaagcaacctgttgaaaacataaggcatacttataatcgtgatcttctgttaaatggctccatattcaaagtcgtgggcctttaagtttctacctaatccatggaaattgaaggctcattttttgttttccaaaaaaggctgtttttccatgcgttttaatagatatttaccttttaggtgtcatatttatatattcaaaaaaagatcctaagatgtaaatatctttctatttaccacccaaaccaataattacttgagaaaggaaacaggaatcttactgtagcaaataaactttgcttttgggttttaaataagtctgtaaaaacagggagggtgggagaagaggagaaacgatagcaccctgaaatattgaagctcttatcctacaaattccccaattggcagcctttgtacttatgctgcccttgctatgcatgataaattttaggtttttgattatcaaatgaaatatttgaacagtgaattaaccaggaataattaattttgttgtgattattgctagcatgaattagtacatcttaaaatagttttaattcagtgggtaaaatttatttaccattaatttctgcttttaaaatgtgttctgtatgtaacaaataccttattaagaaatcggtagtcttctcagatccacgttctagaaacaacaatttaaaattattatctatgacttctacttcagtttacatgaaaattaaaactcccaacttttttggagactctgtgtaccaaaagggtagtttttcttacacacagtgcttacctataggcataaaattatgattcaaacaagtgttaaataacattactgctaggactttttggacagtagcacctgactttaccttgaccttggcgatgtcagtagttactgtagcagttttccttggcactgacagcctaatgttccatattttaatgtcttagctctaagatggagcagcagcacaaagtacagcttgtagttttccaggctcctttaagaggtcaaataaggagaatccaacacccaacggagctagattttatgtttcatgttgaaaagttgagtccttgttggttcctgtctagtcagtgtgtactggacaagtcctaatgtgaatggccgtttacatttgagcatttctttcttccagtcagtggcaatggaggaggcagtgttgcagtgcctggcagttctcctgggctgcgtcatccacttagacttctttctaaaggtctccatgccctactcaggcaatgcacatctttctcagactaagaatgatgaaccatctccagctctgtgcttcagtttcccctgcgcagatgagtgctcagtgtctaagatagcatttaccatgaagtactaagccttctttataaaagttaattactagttattattaatcgtggagtatgattgattctttcctattgacgagttgcgtgtgtgtatggtggtgtaaactgaattacaggctggacaaggtactgtatactgtagtcttgtctttttaacaagcattttagatcattgaatttgagcttgtctgcaaaaatgtgaaagcgctcagttgttatttgggtcatgtgcatgtttccatcatgggagacatactgtgatcagtatactattccaaatgtgtatagcattttattttctagcaaagtttgaatatttaagactaattcacaattatgatttaattccttagtatacttgggaaatccaggcttctaaaattagacacaagaggctgttagaaatataaattctccccataatgctacctgttctaaaaattgctcttagaaccgaatcgatgttgaaatgagaaggccagttgtagtaaatgaggttgtttgcttaactaaagcctttatactcttggtttcagacactagctttcatgggaggctcattcattatgaaggcagtgaaaggcaaaatgtttagcaaccagaggaaaaaagaaaagagctggagaaagaactgcagaacagagtaagaagtcagggaaaaaaatgcttgtgaagggaaacaatgaaggaaggagaaagactcagaaagaggaggcacagagacagtgagagaaatcagtatgaattcaaatagccatgttgctttgtcataattagtagaataatgtttggttctttcattctgttcaagctaaaattttatttttacctatatgatcctttggaaaagacctcttatgcacagaagtaataaagtgctctaactctcattctgtcagattctgtgccataccagtaggctgcttggttgagttttttagttacagcatgggttttttttctttttaaggttgtaaaaatttaataaaagataatttgggaaagggttaagaagaactcagtcttttgaaaaaatactttcttctcttaatggaatattgctttgtgactgaagcagacactttgagggaaattcagattttcaggacaaaatggaatcagttttctctttctggtaatgcttcccaagggtacttcccaaagcctcatggcagagggtgtctgattacctattactattgcagagaggacaagagcttctagctcttctgcccacctccttccacacacacaccttgctccaatctcccttagcacttgtgacacattgactaccattttgtgccatgggaaatagtcttattattttgttaaatactgacttcaaatttaaatttttgaacatgttttcaaacagtatatcccatttcagaatttaaataaccagtcaggccaggtgcagtggctcatgcctataatcctaacactttgggagttcgaggcgagtggatcacttgaggtcaggagtttgagaccagcctggccaacatggcaaaatcctgtctctactaaaaatacaaaaattggctgggtgtggtggcatgcacctgtaatcccagctgctcgggaggctgaggcaggagaatcacttgaacttcatcacggcagaggatgcagagagccaagatcatgccactgcatcccagcctgggcaacagagcaagactccatctcaaataaataaataaatgaataaccaatcagtatatatttttctgtatagtcctctcagttttaatgcatcgagaatgaataaatgtagcctggtacagtgacatatatctcaggaggctgaggtgggaggatcacatgaagccagacgttcaaggctatgatcgtgcctgtgagtagccgctgtactccagcctggacaacacatgtctctaaataaataaattttttaaatgaatgaataaatttataattttatgataaatgggctatcagtttaccttgatttgggtatagtttctgtgttctgaaatcgttatttttcaaaattttccatacaggcacaagttctcacctcatggggtttgttaactggccttctttaatagctcttcatttgtttcacaaccacttaatttgaaaaagttaatgtattttaaaactccaaaggccttctataaattttgataccgtatactacatattatccctaggtgagaaataatgtttatttacagaaaagcacttctactttggactttttatggatgtgatattatagataaacacctgaaatttctgatgctggtagctacatcattttttaatgaggtcaatttaatattaacagtatgaagattattataaatgttatatgtgagctaaataattttatcttgatttatggttttgagttcatgaaatttaagtaattaagttatgtttgtttttgtctctcatttccaagagacatcctgaggcgaaccaaaagcaaaatccttcaaaaaagttaaatatctaaatcagtaaatacatttccattaactgctggtctcctttcatagacccctgttgctatttttttctcttcatatacattatgcaaagtaatgtttgtgaaaaggaatcctatatattgttcaggcgcatgctactttatatttcaagtaatattgtttcacataatacatgtatttttgagtgtctctaagaccagatgaaggagaaacagtcacagttattaaatcaagtgattctgtgccttttagcttagcaatagaacaaacttcttcagtaaacctgagccacatttctcaggggaaaaatagttggattttcttgggtattcaatttgtcaaacagattgcttttgaaatactttggctctgtgccataggatgtccaaagatgttttatggttcaaatatcttagttctttaggggaaataagtgacttttccctctttggtctagggaagaaaattaaaagcaagttgattttcgtttatcttaactaatacaaaacagaatcttgatatgccagtaatttgttattgtggttcatgagctgtgcttgatcaaagaccccttgagactaataaaagctgtgagctttctccaccagaaaaatgcccatataccccaagtctgcatgcaacatagtatccacagggctgaagcttattcatggaacctggttaagaaactctgtattttcatgattctgcataaattgtgattttttaaaaaaaacttattttaatatttaatattaatatttaatatatgtgtgtagtatatatactacacattttatagttttattttttctgcataagtatttgttacatgcagctacaatttcttgactacttaataatttcttatttaagaaagtactgtaattatgttttattggaagataatatcaaattattacatactctacctagtgtaaaacatgtcatacacttgaatagaattcataaaagaaaaatcaacaaagttgtacactccgtactatattgctagattaatatccatccaagaaacaagtttttgtagaattactggttttagaaaaaaaaatcacttaactttaggaagaaccgagtgagatactgacttttgattcgtggtaatttgtttgttttctttctgttataatagcaaaataactgtgacaaattccatgtggatttaatagaatttgcagggtcatttaaatcaagttgcctaccaggaaatgttgatactttcagtgtggtgaaattttccttagccatttcccccaataatttgctcatttcctagatatgtaatttaatggcactagatttgtttgtcactttgaatttttttctttctgaaggagttaaaaggatacttcttaataactgtaactgtacttgagtctctttaatagtatggagaagaatgagagaatagtgtagccatctgctcccctatgtgaaaggactgggtattctacaaggactttgttctggcaaaggaaggagagtcattcactcatttttttaagagtatatatttcttcattctatagattgccttctcggaagttcaactttttaaaaagcttatcaacttagaaatcatccatgttctgcttatgttgattcatgccatagtaaactctttaagtccaagaaaagagaagacccagaatgcctgcctctgggcagcatgttgatttccttacaactgtgtatctcagcagtgtttgacttggatgaaggaaatgatagaaaaactttgccatcttgaaatctggatcataaggtgccagagccttctgttagcttatttgtcgtctgttattttatggttcctgcaagctccattccttggaggtgcttgaaactgcaacttacataatcagttcctaagatcggttcaaatactgctatactcaaaaacaagtgtgtttaaaaaatttaagtatcttttttcatgtatttgatacatttaaaaattatttttgaaactgtgtcataggtaggttttttttctgtagattcttcaaaatcactttttcttacaagcttttcaattttatagtctctcctaatgtattactagctttacttaaatccggtaatcaatgatctataaatccatatccagttacaagagcctagtatagaaaggaaatgtgcggtataattcttggggaaaaatgaaaaatcttcatttgtgcctatgggctatctattatagtatgttgatacatcatggccagtgtccattctggttgtgcagtacctgttgttgaatattttgaatatcactcatgaatacattttttcctggatgaaataaggacttttctttatttaatatataatcagattcctgaacatcaagctgaaatgttatttctcttccggcatttcttactcctttgtagggtttaatttcagctcagggttattttgcttatgcttttttcacttattcttgcagttaagaataaaattctaaataaaacagatactgaaataaataaatactttatttgtttgttagacattgtgatgaacaatgtctaagatttatcagatcccaaaactagaagaacacctaaagatcatccattctgattcatctgccagctcatatcagggacctgagattagaatcctggtttcttgattcccagttctgtaccttttttattttttatttttttgagaccgattcttgccttgtcacccaggctagagtgcagtggcgcgatcttggctcactgcaagctccgcctcctgggttctcgccattctcctgcctcagcctcccgagtagctgggactgcaggcgcctgccaccatgcccggctaattttttgtatttttagtagagacggggtttctccgtgttagccatggtggcgtaacttttaagtatagtcttttgctgtaaattattttttctgaacctatttaagaatttgatggtcttgaaaatgaaattttcattcatattattactgattatttattcttgattccaggttactatgaaaaccagtactactgattttttaacacattaaaattaagttttacatcccttggtatggcagtgagaaagatgatgaaaaatggacttctttctccctagggttgattttctgatctcagcactttaaacagtcagtgtgaggctgcatcattgctttccagtcttagccttcttttccccttccctctgttccacatgtcaggtctgctgccatagggaacagtccaatttgtgccttacaaaggtaccttttcctgctgtgtcctgcctggatgttcccagtgtcatctgctaggttccctactgaagccccttcttcctttctttttcctccttcccccttccttcctttccttttttccttcttcccttcttctccattttccccttccccttttcctccagtaccttcctcttcctaagtacctccccccagacccctatctccagttaaactttttcttttatctcattgttcttttaaagcctctcagcgtcacttacagtttataaaacatttgtgtatggattttaactttaaccttagcaaaattagtaggaaaaggttagcctaacccttaggatttttttccaataacaagtgcattttaatactgactttctacagacaaaccgtctacctttgttgttcaatctctgaatgaatctaaaggtaggaattttagggcctggaagaaacctacctgcccatctagtcttgccagtgagaaaggtgatagaagacgacagggcaaatcttagtccttaactctccccatagagatccctgggccatgtactgggaggaccagccctggttagatcaagaaatcagctggaaagataccttggctctactgggcactttgactcatctgatttatcgctggcccacataagacgagtttcagtgactcaatctattggtgaccatttgatttctatggaatcagggagtttcttcctcagcagacgtttccttattcttcctattttcaggtgtctaaacttgtgacttgagtactttaaatatcatagaatgcattttattttcagtagcctgctaaggaaattactgctattcctgcagctagtagtatcaagtgaggaaattggatccaaggtattcatcatcaaattatagctttttacttttaacctgattgctggtttagtttggggcagttagcgacttgaaggatagatttagtaagaaaagatgctctggaagaggagcaacttgaagaaaaatagaccctggggggaagaattgaggtcaaagaattgaggagcaaagagatgtccatttgttctaaggcagcttagtgaaaggtggaggtgaggtttgaatggaggtagtcagtgaagaagaggcatctgtattttcaaagccagtaaaggttggtgttgattgataatcaaaagaagcttaagttttattcatgatcatcgtcatatcttggaactggttacgttccattatgattgctgagcctttagcagcagagctcacctcctgcccttcgctagcaggtttcttctagagcagatcatggaaaatggtataatgtgtatggctcattagaatgtaatcttaagtggcctttggaaatcagtcatgtcaaaatgtggtgtgattctagctttccaagttgactttttccaactctgaaacgttatctcctaagtgtcctaggcttcccactatgaaatgttgcatgctgataaatagttgatgtacctgtcactcatgtcgctacatgaactgtttctcggttaattataggaactaagagaaatacacaataagcaacaactccagaagcaaaagtccatggaggctgaacgactgaaacagaaagaacaagaacgaaagatcatagaattagaaaaacaaaaagaagaagcccaaaggtgagtcttctttggattgtggactcatctggaaggaactttgaggatttactattctttgcttggcttctccaagtagttactgcaccagaaagagccttcagtctttagtgtgcatgtgaagtgtgagtgcaaacacaaacacgtgtatatatgaatctttgcatgtatcagtaccctctgaagtttttggttggttcccagagctctctcaagctactactatgtagataaatggaattatacaaggaaattgggacacttggtgtgctcatttgcatgctaatggccagttcacagccttttactaacagctaacaggggttggagtgcctggtttaaaatccaagccactgagctagtgccccacacagggcttctccagcagggtcagggtgggcctcttctgtttttcaactgcaaattaaactttagtacaaaagggggaaatttgccaccgctgcttagtgtgtaggatacagacatgtttttatctgtttttgtttgaagatttatttgtgatatttttatttttacttgtaacttactgtagtaaattgtagaaatttgtgtctgattttgttactgggtatttgccttttaaatgtcagttaattttagactccacgaaacaaaaatgaccaaatgtcccaatgacagccccgtaaattataaaagttggtaattgaaattagattaaggccaggcatggtggctcacacctgtaatcccagcactttgggaggccgaggtgggcggatcacgaggtcaagatattaggaccatcctggccaacatggtgaaaccctgttctattaaaaatgcaaaaaattagctgggcacggtggcacgcgcctgtagtcccagctacttgggaggctgaggcaggaggatcacttgaacccgggaggcggaggttgcagtgagctgagatcatgccactgcactccagcctggcaacagagcaagactctgtctcaagaaattagattaaaaaggcgaagaaacggatacttgaggcaagtcattgactttagtgggctgagttcagttaacctgccaagagctgtgcatactttcttatgggtatatagagtcttctgtttgtttttcagtgccagtggggaggtatctggggtcccagaccaatttacaggattgttttatggttttcttgggggtcagactaaggatctcctccttggatgttgattaactccatccttttcttacccccagagtttataaaatgcttttattattcacactataccacactgaactgttaaattcctacagtgtagaaataaacataaaatacagaaaaatacataaaatagcataatacagaaaatagcataaaaatataatatggaatatgtattccaattatatagataaaaactgcaaattaacgtcagaaattagatggttatacagtatatatggtgaccttcattggtagaaaatataaagtaattcttttttttttttttttaattttttattttttgagacggagtctcgctctgtcacccaggctggagtgcagtggcacgatctcggctcactgcaacctccgcctcccaggttcaaccgactctcctgcctcagcttcccaagtagctgggactacaggtgtgtgctaccacgcccagctaatttttatattattagtagagatggggtttcaccatgttggtctagaactcctggctggtctagaactcctgacctcgtgatctgccctcctcagcctcccaaagtgctgggattacaggcatgagccaccgcgcctggccactgtttttattatggtttttttgttgtcatgaataaccatatccttacccctccaaaaaatgtttttatactttcttaaaagacattttaaaaattgtaaataaaatgtttaagatttaagtttaaagacttctgcattaaaatatcacattcatacagagtagaaataaatgtaattttttgacaatggagaataaaagtataatttgtttcaattatgttcccgtggcagattcctaattctagccgatgacctgtgtgcgttagccatgtcacaggatggcagttcagggtggagactctgggaccaggctgcctgggattgaagcccatgcatgtatggctgtgtgacgtggacaagtcatttaatatctctgccccagcttcctcatttgtaaaataggagtaatactaggactaccaacctgattcgcagtttaaaggagttaatatatggggagctagttattattatgtcatttgttattacatattagtttcatttaaagtattttctgactttataaagtattatggaatgagaaaaatcattctcagtcttttactgtgggtttcaggttgaggccatcaaaaatttcaaggcctagatttaattacaattatctatttgtggtagctactttgaaaaacaaaatcaaagtagttgaagtcaataaaacaatcccttgctttcaacttcaggtttggggagcaatgtgtgtgcatgtaaatgtgttgttccctttgctggggggaaatttttacagtgttgggtgtattttatttttatagaagttatgttctctgtgttttatggctttgtttgtttgttttgtcagtttaataccagctttattattaagaagtatttttcttattcttgtaaccactttgtaaaatacatcagaaattttctgtgttttcctaaatcatgtgatttcttctcattcagaactggagccctgattcagttgccccatctgaacaacaatgttcccttgatgttcccatcccatttactggatggagctttttttgtgaaaagaggcaacagtagtgttaacttagagttgctttcttgctgtaatcaagcgtgtttgttggcagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcaggtattagaagccaaaaataattatagaaaataagtcatcttctctcccagagcctcctgaaaaatgcccctatctcatcagtacctgtcttggctacattaacagatgagaacgtcagtctcttattttgagcatggccagctcttctttccccagggtcatttgagatctgtgtaattctcccaccaccatgccagcctctggcccacgttacactggcatccacgagtcctctacggagctaacaagtggcgtgaagttccagtggtcttatatgctgcaaaagaacctgctgtttctctggtttgttatttccctccctggaatttctgagctgtttctgcaacagaaagtggcacctttcacccttgcctccactgatggggcattcgctgtcttcggtctgcattgcataaaactgcttttactttttgaaaaatgtaaaagcataatttgccttttctttacttctcttttctttcttctctttccttttcttttttctttgagacagtgtctcactctgtcgcctaggctagagtgcagtggcacactcatagttaaatgcagcttcaaactcttgggttcaagcaatcctcctgtcttagcctctcaaggagctgagactataggcatgcaccaccatgcccagctaattttttttttttttgtagagatggggggtctcactttgttgtccaggttggtcttgaactcctggcctcaggcgatcctcccaccttggcctttcagagtactgaaattacaagcatgagccaccatgcctagcctaatttgccttttttttttaaaaaagggataaatgaaagactgaacaaaaagataaatgaaagaccaatctaatcggaatagctagaaaaagctatcctttataatatctgatgtgagctagaatgtatttaagattcttgtgtggttgtgtgattgtacagttttgcaaataatgttcagtggaagcaagtcattgctttttctttgtgtggtaaattataccagttttgcttggtcatccatgtgcttctttagtgcttcagtatacagaaagaaaagaaagaaaaaacactttcaagctattctgtaaaggtttactggtccccagctacatagtgggcagagatgggcgtgaggtatggagttgcattaggcacctacctgccttcagatgcatgcagtccaggggaaagactggcaggtcatcagacctacagagtagcaaccatgtcataggaggggcaaattaattttttgatagttttttttttaatctgaaaataatttcaccattgatcttaggaagttagtttaagttcttcatgcgtcctcctagtataagatgaggatttatttttccccttcagtcagtaggaaatcttgcatgtcatacagttcaaaatcatgtggagataatacttccccctcgttgcttttcagataagataggtatatgtcaaaatacttgtagctcttgagtaaaaatgcccaaaggtctgttactagtttttgctaaccagaatccaaaatatcctccgctcatgtgcatttttaaacattttatttcatgtaaaatctaaattattttcatctaggtttcatccttaggctaattatttcccaaagaaatgtagaggaagagtgtcttcatcggggattatcagtataaccaaaatcagcacttagtttttatatgaccaggttaaagagcctaaaacatctgcattttcatgtttcagtatggaaactggtgcctctgttccctcccaaacaagttgactccttggctgattcagactttgggtcatatcctaactgctacattgtactcaacacactgggtagggaggagggcgggtattgatgctttacagatctgcactgctggagcccaaggaaagaggcagagacaagggacctttaggcagcctcgccgcacccaggcttggagtgacctttgtttagagagagtcactaatgaactctctcatgggtttttgttgctgacgtcagatttggctgtgctttggcattcagtatgtgtttcagaaattccttgaatggagggaaatagttcagaggttaagataggcaatagaggagaggttagttgtttggcttgttgtcatacatttgtgttctctgtaattatttatttttgtcccccccacctttttttgtaaacagaaaaaggtccacttaccatttctgcacaggaaaatgtaaaagtggtgtattaccgggcactgtacccctttgaatccagaagccatgatgaaatcactatccagccaggagacatagtcatggtaagaaagactccagtgagagggtcatttctgttgaagattagcctctgtcctctttttttcactttattcaacaattgtgagattgtcagtgagtatgaaacccaataatccagcatctagatttttaaagtataagctcaatcttctttcttttctattaaaatgaaagatggcatttaaaaaaatgtatcctaacatcattttaaaattgagttgataaagacagtgtgttcttatttttaaatctataaatgtctgataatttcagagtttagattactacttatatactatgagtatacatatatatgtaatacatatattttatatatgatgtatagacaatatatatactagtgtgcgtgtgtatatatatgtgtatgtataatatatactagtgtgcgtgtgtgtatatatgtacacatatatatacacacacaaaaggatcctccaaggtggaaggaggccaggagtctttaagaaatagttataagtgcaaaacactctatcaaatcattctcataattgcaataacttttgtatctttgcatcaaagcatcttttttccctttaattatgtgaacttttaattatgtaaaaagagtaatgaattatacagttaatctgctttcctactttgtaacagaaaatagtttagaattttgctttgttattgtttctttccttgaactaataatcattttatgatgtgactaaaactataggaaccagtttaagaaagaaaatcagacatggttgatctaaatcattttctaaaagaaaatagtagttccttgttctagttactctctttagagtcttagaagtagtcaactctgcattactcttaacattttttttttttttaaagataatttagattttttttttgttgtggttgacacaagttctcactctgttgcccaggctggagtgcagtggtgtgatattggctcactgcaacctctgcctccctgcaacctctgcctccctgcaacctctgcctccctgcaacctctgcctcccgggctcaagcaaagcgattctcccacctcatcctcccaactagctggaaccacaggcgtgcaccaccatgcccagctaatttttgtaatttttatagagatagggtttctccgtgttgcccaggctggtcttgaattgcctgggctcaaacgatcctcccaggtcagcctcccaaagtgctgaaattacaggcatgagccaccatgcctggcctagaatttgtaaagaactgtgaaagttaacaattgaaacaaacatgtttcttacccaaggactgtatgtctttgaagtataaagggtggtgtacaggtgattttactattactcatgcattcatcttgccatatacacatcatatctgtggatctttaataggctaaaatacctagaaataacaatatgtttggcacttagagaaatgaattcctgtgtccccttttttcctaatagctgctttctctgtaattaccatgggctagaagaagcaaggccaaacatcccaaattattttttcttttttttgagacagggtctcactctgtcacctaggccagagtgcagtggcatgatcttggctcactgcagtttccacctcccaggctcaagtgatcctcctgcctcagcctcctgagtagctcagaggcgtgtgccaccacaccgagctaatttttatttttttacattttgtagagacagagtctccctatgttgcccaggctccagatctttaaaagttaaaatcaccttaacagtagcaaaaacctcttcaagtatactccatggcttcattcagcacacagttattgactgaaacatgctgggtgccagccttactcatcctttacagaaagaactgttggtttgggcatgccactctgtacacacaaatggtaacttgagccagcggggtgtgtttctgtcagctttcctctgacttcaccacctgctgtttcctacaccgtggtttctgatagcctgaagctactttactcatactgcctcatatttgaagtagtgtatcctgtaaagcagattaattgtaaaatatgtaaacaccatataataggaatctaaaatttctgaaaatacaatgtcacatcagtgaggacctcattacaattttttttttaatgttaaacaaaccagcctaatatttttgaaactggattttgttgcaacacaaggtgcagagaagcagctcgctctcatcctaaagtaagggaatgttatgaaatgtgatgatgaggaaatgttgcaggtgatctgtatcttaatgagaaagtgttgctctttttcgggaacatatctgggcttcacttgtaatcctaggcctgttgaaaccttttcctcgaattggctagttaaccaccagcttgatgagatgcgtagagtttagatatgctgtaagaataaagcatgtcattaaacatatattttgccttgctttcaaacctttgctttcctggtggaggttaaaggggaatgggtaagtgttgcctaactgtcaggaagtctgcatcttattcaatgttttgtccttttaagtcacttgaattctgtgtaagtacacgtatctctgggtgttgttgcggcagtaaaaatgtgtttgagtctgtgtagtaggttgtgctttttaaaaaaaaagtaagtcgtaagtcttctcagtttgtgtactgggtttctttttgttagattccttttaaggactaacttgaatgctctgtgtttggcaagggattaggtcaagtctccatctcaggccatagacaaaaaggagttccaagtagattaaacataaaagataaaattctgggaaaaaaatttttttaagcagactattggaataattttctggctaagaaaggccttttgaagctataaaaaccagaagtcgttaagaggcaaaaatggacagtcaacaatatgcaaaaattaaaatgtctatgtttcaaaatatatgagaccaagggttacataaagggttacccctgttacataaagattccgaacagttcactttgaaagacacccacaagccttaaacaattggcagagggtgggaagggacattcacagatgaagtaaaaagtcagttatttaaaaaatacatgaaaagatgcttagcttcttgggtgatcagaaaaatgcaagttataaaacaaaatagcattgttcctctgtcaaatgagcaagtttaaaagtctggtaatatccagctttgtcaagagtataggacagtggatataatatacattgttagcatggttgtataaattggttaagcgatttggaaggcaatttggcagtgcctgtttagatttaaaattctcgttccctctgccccagaaattctatttttctccttcctctcattcttctccttcctcttttgggcacatgcacaaatatgtgtgtacatggatgttcactgcagtggtgttggtaaaagcaaataaacagcccaatgtccatcagtaaagggatggcttaaataaattatgatacagctaaaaaatacaatgaagattaaaacttatgtagatcacatatacacataagatttccatcaaaaaagcagaatatgtgcagcataattgcattttggttcgaaataaaactatatatgtattcatgtgtttatgtatagttaacagttttgaaatatatatatcaaactgttaacaatggttaccactgggcagtaaagaaggggctttcgtgttgaattttatagacttctatgttattttcatttttataaatgtatctaatttgtaatttttaataaaacaaaataaattcaaggacaagtatattagagagtatctactcaggactgtaataatgtttattatatctcagacctcccaaatatgtaatgaaatgtagaatgtactactaggcataattcgttggcttgcagaagggacagcagtgtttcgattttgtactacaaaatgcattgtgatactccaggtgccattcagctgtgttatctttgtgaggataacagtcaatgcaaaaagatagatattgacatctaatagcaacaggtttgtatttttttaatttcatgaattttgcagttaacaaatgatgagcatgagacatgtagtacaacattactgtcagtctccctaggttgaaaaatccggggttcacttatacttttgtgggcacagtcatcagattctcagattcctcaaacgtctttgggacatagcttactataatatgttcgatttttagaagtctaacattgtgacagtgttttttaatgtaggcagtcttagccttaaaaatattttgtttttagaaaaacttagcctggttttatccaaaactataatttttcatgtttaacaaaaatttaatgtggtaccttgtatatagcactattctcagcactgtagataatagaaaattatcaagtctgccattcatatgtttaaaatctttttagaaaaatctagagaaacacatgaaaaggccaacatgtgatgaagttctcaataaacattcactaactctgctaggaatttaaaagaggagaggaatcagtgtaaagtgatgtgctcagggaagaccaaatgctttcaattgagtctgaccttgatggctaaggcttagatgcgtagaaaatacatggcctctcttgatctggaactcccaatacttggagggtgaattaaatcaaatttgacatccgtaacatgttagtagaacataagaaatgagaagacctatgctcactgctgttttgttgaagtttatcttgagaacacaggctgagtgtctaaatcagtacaatcttttggctttcatgggccacattgcaagaattgtcttaggctgcacataaaatacactaacactaataatagctgatgaacttcaaaaaaaagcttgcaaaaaaaactcataatgttttaagaaagcttacgaatttgtgttgggcctcattaaaagctgtcctgggccacatgcagccagtgggttgcgggttggacaagcttggtttaaatgcttatccttggactggtacaggcctgaatgcatccagattgctgagggagcttccaaaaaataaccatgccagggctcatccccagagattctgagaactctactgcatatacagccttcagaagtctgaccaggtggttctgttaggtagtcaatttcaggaaccgctgatctaacctaatctctttttcacgtcaggactaatcctaaatcatttctagaaaatatcctcttaaaaatatccaaagaagaatggacttctttagtagttatcagtcattagccagtcagttcattctggaaattgtttgtcttagtgttactcttataacaatttttaactcattcttttccttttcttctcctgacagacatttttttaaatgtagccaacaatacctttttcctctaccttccatagatttccatagattaaacatcagaaagtatctcatttagtaacaactggccataatatcactgcagttttgagggaccagtatacacgattacagggttggctcaaatctggcccaatcactgcctgttttataataaagttttattggaacacagccaggctccttcattcacatattgtgtgctacagtggcggatttgagtagttgcaacagaggtgaaatttgccagcctccaggttggagctttagaaagagtttttttgtttgtttattttttgtttttgagacggagtctctctctgtcgcccaggctggagtgcagtggcgcgatctcggttccctgcaagctccgcctcccgggttcacgccattctcctgcctcagcctcccgagtagctaggactacaggcacccgccaccacgcccggctaatttttttgtatttttagtagagatggggtttcaccgtgttagccaggatggtctcaatctcctgacctcagaaagagttttaaggccgggcgcggtggctcacgcctgtaatcccagcactttgggaggccgatgtgggcggatcacaaggtcaggagattgagaccatcctggctaacacggtgaaaccccgtctctactaaaaatacaaaaaaaaaaaaaattagccgggcatagtggcgggcgcctgtagtcccagctactcgggaggctgaggcaggagaatggcatgaacccgggaggcggagcttgcagtgagccgagatcgcgccactgcactccagcctgggcaacagagtgagaatccttccaaaaaacaaagacttttaatatcctcatctaggaatttggggagaaaccttatatttcaaaaccggcaaatccatggaaaatgttttactacctgcactcctcaacacatcccatgcagccactgtcagctggtctgaatacacaggctaaacctgtttgctacacttgtttatcatgttctatgaggggaaaaaggaatttctgcttcccccctttgtgacaaggtcagagattttagaaatattaatcttacctaatgaagatggcagccatggagcatataaaaattgagaaaagaggtgtaatatcatcggcctttgccaaacggacttgaagctgaagtggctgctgtgtatatttgactgttgcatcagcgagctacaatatgcagtgtgtaattactaacatttagtagagcagctctgtaacatagtcccagaaatgtgagcaatatctggtgtttgtacttcgcttaaatgatgtttcactagaattacccccaaatacgttggggtgttacagtgtgcctgataaatgaaattgtattgagaccaaaattgttaataataacatctcccttatagcccccagtaggtaaatgtacattgtgtaaaagtccacgttggaaccagtcatattacaaagcagtttgtgttcctatttcttggtctgccataatcttatgttttccaaaattggattggcattttgggtagttttccaaatccaagaagaaatatttttcattttcatatgttgacctttgtgccctttctaagtggttaatttaatttaggtgttaagaatgaaagtctcttacagcccctgaaccttaaaatgtaataatttattaaaattgatgtatacttgtaagagtaaattaagctaattgagactattgtttggggggctgttgagaccaacagatttctttgcttaaaagtgaaatgctgatttcactgttatccttagggatgggagaagctcttgcttaaggggataagaggctgatatggccccctccttcactcctaggtgtacactgcaccagcaggctttctatcacatctgaggacaggctgggtgttatcagtttactggagggggaggacatttccccagggcttcaggtcgcattccagatgtccaccagtgtctcgctctgttactcaggctgagtgcagtggtgtgattttggctcactgcaacctccgcctcccgggttcaagcagttgtcctgcctcagcctcccaagtagctggaattacaggcatgtgccaccacgcccggctaatttttgtattttttgtagagatggggtttcaccagcctgaaactcctgacctcaagtgttccatccaccttggcttccagaagtgctgggattacaggagtgagccactgcacctggcctaaaagtcttattaaccagtcaataccctgtgtttcaagggagtaacaatagatcatgggacataattaagcaaagcagctgacctttgaggaggtccaaaatgagcagacgagtaggagttcccgtcgatcaagggatccacttgagcccctaaaggattgcttatggcaagaaggtaaacctagagggagcagaggaccaggcagttagagcagggaactcctgaacagagaagcagattgttacctagagtgaaggtaaagtcaagaccaggcttttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcatgaacccgggaagcggagcttgcagtgagccgagattgcgccactgcagtccgcagtcccacctgggcgacagagcgagactccgtctcaaaaaaaaaaaaagaccaggcttttagaataggacagaagcccaagtaggagaactacagcgcaacatcagagctggacagcagaagagagaatttaaaaaaaatatctggcctggcacggtggctcacgcctgtaatcccagaactttgggaggcctaggcgggcagatcacctgaggtcaggagttcgagaccagcctggccaatatggtgaaaccccatgtctactaaaaatacagaaattagccaggcgtggtggtgggcacctgtaatcccagctactcaggaggctgaggcaggagaattgcttgaacccaggaggcagaggttgcagtgagctgagattgtgccagtgtactctagcctgggtgacaagagtgagactccatctcaaaaaaaaaaaaaagctaacacttttagtatgccaggcattggtgtaaatatttgtcagtcctcacagtgagcattataataagacaggtatttttattatccccattttacagatgaagaaacaggtgccacgagattaaacttgcccaaagtcaaccagttaatagattgtagaactagctcctaaattgagacggtctaactgcagagccctattcttgatcattacactttgcagtcttgacactaagttattgtgtgtttggctcaagctcctaacccactcctgcctgacatcacctttggtcctagaaccaaggtggctgatcttgactattgaacctactgagaagtctggcaggacctggcttggatagagacagctatgtttccagtgtggagcaaagttataatgtgtcaccatatcaccaaaatgtaaacaaggaaggaaagacatctagccatttgagttcagcataaaagaagatccaaatgggggaaaatttatcttaaatcctcatctagagaaacagttggggctgcccagaaaaagaacagtaagaacaaaacaatgactgcaaagtggctagtgtgttcatgtgggtgtaagtgtgagcagaaatgatagaactgtgaagccaaaaattcaacctttggaagtgttattgcattttatacaagggaactccttttttggttgtttggagaattctcagctttaaaaattgcttttatctgtgacaataaagattccctaaagtggagcagcaagcaggcatcccctacttgctgaatatattgtaaataacaggtagaaatcagaagtaagccttgccttgcattctgttttctccacctctaccccaaacatttgttaattcaaataagctaataagtattgaaccctattactcactgtccactgagtacatacagatagatgtttggtttgtttaatgtaatcattttttgctttatttttaattaatttttactgaatacttgaatggattagataactggtatttttgtcagatttttccaaaatcattgttaagaccctgcctactcatgtctgatttctaagaagcaactttaatttccagtgaagtgtttgatgttttactccttaggcagcataggaaggggtaaaaataagatataaggtttcataagataagacccttataagaattatagtaatgaaaataaaattttttttttgagacggagtttcactcctgttgcccaggctggagtgcaatggcatcatctcagctcactgcaacctccgtctcctgggttcaagcgattcttctgcctcagcctcccgagtagctgggattacaggcatgcgccaccatgcctggctagttttgtatttgtagtagagacgaggtttcactgtgttggtcaggctggtctcaaacttccgacctctggtaatcccccgcctcagcctcccaaagtgctgggattacaggcatgagccaccgtgcccagcccaaaaataaatttcccaatagcaaatgtgattgtcctccaaagtcattctcctgttgctcataaaatagtagggacaactcgtaaagaaaagtagaatcgttttggccattttggatgatccatttgagtcagaattaaaatgcaaaccttaaaagcatttggcgtaataaatggcctctgtgaaatttttaaacagtataatcctggattttcctgtgcactgaatatgcaagttaaatttatacaaaagaaaactacaggaccttaatacaattgattattgctgtaaataatgacttccttaattttctcatcatgtgtctgtggagcttttaaatgcctaaacacagcagcagtcagctttgcttctcgtggaaaccatttaaggccatggtttttttttttaaatcttccttgtccttatactgaataaatactacttagttattggaggttttcagagtactgaatttatattgattgcaccctttgctttcaactttaagtaataaactcaagtcaaattatttttaataatgacatgactttctgatgaagcctgttaagtcacttcccaaatcaaaatatttaaattacatgcctcaggactccaggcactttgtctcaactgccattattaggacagttatggggtaaggcttttttaaaaagtgcagagaataagagcttgaattatagtgcattttttttttcagcattactgcttagactcttttcccagacacttggactaagatgaagagattcctatgccatatgtcaatctaaagagggcagaggcttgggacttcactgtagttgggtgctgggtctattcaggggttaatttagttctacttaaagctgtgactttttccacaggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtacgtgttggtgggctctttctgatgatttttgaaatcccaatttgatcatttcccccccacccccttaagtattttcatagtcttggattgtccttctatgtgagggagctggctcattttcagtactcctttctctagctggcgaattggagattacagtccctgaactggatttaatgatatcattgtctaacagtgacttaccatggtacaaaatgaagcctgttatcttgttttgttcaataatgtatttgtatctatcattcttgtggaagaagtggagaaatacagtttcctaataatctattttgacatccatgtcagtcagcaaattttcagagttatttcctgcatgcaaatagcacttttttttgccaggcagaagcaaaaattgaattcagtcatgtggttctgaataagatagaaagctgtttcctttaaagctttccactttcattaatcttatacaaatgtacagtagaatgaagaggtgtttgcacttggccagttagttctgtgccctggttcatcaggaaatggcattttaaaaactgtgtgtaagcagaggtttgaaatgatagatgaaatggttgttcagacttccagttatagggccatgacctagatgagcaattgtctaaaaatattttatactaggatacaagtatgagtgatttgaataagaagtgtttaaattttttttcaagtctaatcatctttcagaagaaacaaattgaaggcaaggaatccagatgtattgctggagaaggatcagatggaacaaatagagggaagaaagaataattactcagggcgggaggaagtggagggaaggatgtaaggaatagcaagtttttcatactttattttcacataaaaggctgaaggcgctaaagaaggtcccctcatctaatctctgctttaagaaaaaaaagccttccattagcttgacttccaagttgaaacttttccttactcttttggtcttgactgaaaagttctgagtttttaaactaaagcttaggctaaaatagaagactaataccatattttccaggatttgttttgctggggatcaaatcagtatgcctcttcttcaatatatgtatggtgtgcagttctcttgctataattatgggcaccttattttccaaatgaaaaatcaggaattattttgattttcagatttgtttgtatatcttataaggatgtaaaaagtaaattgcctttagatctgcagtcacacagacatgtttatctaaaattattttttattatttattattattttgagacagggtctcacttcatcacccaggctggagtgcagtggcatgaccatggctcacagcacccttgacctcctgggctcaagcaatactcctgcctcagcctcctaagtagctgggcctacaggtgcatgccaccatgcccagctaatttttaagttttttgtagagatgaggtctcactatgttgcccaggctgatcttgaactcccgaactcaagtgatcctcctgccttggcctcccaaagcgctgggattagaggtatcagccaccatgcccagcctgtttatctaaaattattaaaatcacaaaactagaactgtccctgggacccaggacaactggttgctgtcaggatgccacttgtaattgctgtggcatctaggcatactaccaggtacttgctgtagagtgcatgggtctgagaaatggtgttgagaagctccagctccataggtggcatgtagcttttttttttctcatttaactattgttattacaaatgataatgatcatgtgaggatgtttctccggggctttgcagttacagagtatttccctagcctgtatttcatgtaccctcacaactaaccttaagtggcacagtattgttcccattttatcaatgaggaaatcaaatgccttttcctctcctccttgttcttttatttatttttctttttgagacagagtcttgctctgtcacccaggctggagtgcagtggcgtgatctcagcagctcactgcaacttccacctcccaggttcaagcaattcttgtgtctcagcctcccaagtagctgggattacagactcaatgccaccacacccagctaacttttttttttttctttttgagacagagtctcactctgtcatccagtccagagtacagtgatgcgatcctggctcactgcaacctctgcctccgaggttgaagcatttctccttcctcagcctccttagtagcttggattacaggggtgcgccaccacacccagctaatttttgtatttttagtagagatggggtttcaccatgttggtcagactggtctcgaactcttgacctcaggttatccagccacctcggcctcccacagtgctgggattacaggcatgagccactgtgcccagcctcctccttgttctttcactgtagaaagccacattaagtatactaggtttgtgttgcacaggctcattggttgccatctttttcttttttctttttttcctcttttatttatttatttatttttttggtactttactgtgggtaaaaagctggcatattagggagtgcttgcttttttttttttttggtactttactgtgggtaaaaagctggtatattagggagtgcttgttattcatggtgttgtgcttttccctccaggtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccaggtaaaggcagccagtgagagtgtgaagacttagcatgctatctagtgccaaaaacttcagcaaatgctttttggcaatgtcattttgaagcaagccttgttatgtgtgtcttggttggctggcagtatgggaatccagtgcaggagccagaaatctgctgtgaatagttgggagttgggggtgggggtgggacacagtcaacttctcctgcctgggttgatgaaggaagcttcattgcagaagtggcacttgagctgcatcttgaccagtgggtaagatcttactagaaaatggagagagcctgcctgtcagacagaaactgctgggaaggctcgaaggcagacagtcagaatgtatttaaggaaaatcacatacccctccatttgtctagaccattgagttttttttggaaaaggtagaccaattaaaggttaatgggaggctctgaaatgccctgctcggaaagaataatgtctgaaaggataaaggtggttattctgaatagttctcttttgcttaatacaataatgataaaatactcaaatttctatcaataatcatgccaaacagcaagtgcccatctgggaggcactggaggttccagcatcatttctgatctgagaacacccagatggaacacagggtctaggcagatccatctggaggagcggtgtgcaggaagattagagtggagggccggcagggcggtgccaccagtcagggggctgttggtgtcacccagctgagacctagggcaggcctggacccagctgagttcatgttcaccaagtagggaggtgccggtggaagcagaagaggcgagcacgtgggagagactgcagaggagagtgaagaggttggagtcacaatgcctatgggagccgaaggaaaggaaagagggctgggattgagaataagggcccaccttaaagcgggaagggagaaaggcagaaaatgaaatgaatgcgcagttaaagggaagagttgtgttttagttgtgttgagttgaaggtgaacgtgggaccctgtctggcaggctgtcggaatatagatctggaggatggaagagagcacgagactgggattatagattggagccattcccatagagaacattatcggatatcaggaaatgtgtgaggtcatccaaggagagggaatacagggagaaaatagcaaatccacaggcacgtgtgtgttctgtggtctggaagaagaagaggagctactcagcaggaaatggtactttcctttgcatctgtcctagctcagcatttagcacgtgtcacatgctcagttaacagtaactcagtgatggggtgggggtttgttccagagagtggaggtgggggatgggaggttgcttatgttactaagtaccgtggtcagggcaaagaagagaccattcattgtgacaggtagagctttgtaacctgggaaggagaaggatgaaaccacactgcaggggcgtaaaaggaaatgagcagcaagaaagtggaaagatctgcaaaaggaaagagaaggaccagagtgaggggcctcgggaaagcaagaaccagccatgttgccagtggagatgggaatggaaaagtgaagtgtcagaggatatagttggtataaggcagaaaacattaaaagcacagaaaagacaggagtctttttcttctggatgaggaagagtgaagagattggagaagataaagccaagaaaaatgttcaagttgggctgcatgatattgttctcagtgaggagggagcctggaggggctgcggagtgtagaagaggtttgggagcaggcgaatgagggatccgacaaagaagaatgaagaattgggccggcgcggtggctcatgcctgttatcgcagcactttgggaggcaggcaggtcacctgaaatcaggagttcgtgtccagcctggccaacgtggtgaaacctcatctctactaaaaaaaataaataaatacaaaaatcagccaggcatgacggtgggcgcctgtaatcccagctacttgggaggctgaggcaggagtatcacttgaacctgggaagtggaggttgtggtgagctgagatcacaccactgcacttcagcctgggcgacagagcaagactgagttctcaaaaaaaaaaaaagaattgcctggcttaatttaacctgagtccgtaatagatcattgcacattgcctcagctttctctagcaatgcttcacagcttgggactaggaataataatagttatatagctcaccactgttatttctatcatagcaatactgtgcatggatcttactaaacttccttccccctccccacctacacacatcttgcattaccatgggattgctaaactttaatagccttttggagaaagtatcatctctactttacagatgtggaaatcgagattcagagagattaaacagttgccaaagccagaaaattagtaagtgacagacctgggattcaaacccagagtccacatccagcccaggctggggtcattagggcccatcaatgtgaaaaggttgacaaagcagacacggggaagatttctcagggggagagattctgaaataccagtgagggcacagttgaaaggccaaccctggggtccatacgtagagaaatcagtgaagtggcggagaggattagacagtgcagaagggctgtgggatgaggagctacgcgggcagcaggtccactgcaagagggggaaaatggaaggtcgagaatatacaatcttaggggtgttcgaaatccagggaaaccccctcagctctgagggacttgaaggagtgaatgtacagctaagtggaaggaaataggatagggatgttgtgggtttaagaaggcaagaacccatgaagaccaggaattagaggttatcaacatagatgctgaaactatttgacctgttgtaaattctctgctcatcagacataatcataacttaatgtcagtataatataaatgacttctaaaggcatgtacaaattggttctgaagtaactctctctaggcattatcttttgttcttgtccattcatatatatgattgaaagttggtgtttcattttttactaaatgctttaagatactgtaatggtttaatgctatagcttaaaagataataaatgcctcaccctgcctttccagcctgacttcctcctccacccctccatgagactaggccacatgcagccccggattgtgcttctcttcccggaccccctgcagtgttccacctcgaggcttttgcccatgctgcgccctcggcctggagtgcccttcctccgaagccctagctgtcaaagtccttctcatccttcaaggcccatctcagatgctgccccctctgtgaaatttacgctgatgcccccaggcagaattcatccctgttttctctttattcctgcagtgaatagtaggaactcctttttagtatatttcattctgccaggtggtacacttggttgtttttatctctgtcttccccattacttgtgaattacctgctagtaatactgcccatctttatagtgctttgtggttaataaagtgcttttccctaaattatctgggggaggcagagactgtttttttcatctgtaatctcatggggcagtgcatgtagatgtacaataaatggtaattacaatgaatttatgctaaccaaatccctgttttctctgaaaaggaactaaaacaagcataatccagatagggcctatttccctgggtctacctaatctaaaatgccagttaatgatctcatgatagttcataaaatgtctgctccactgttaatcctccactaaaaatgccagtcaaattggaaatggggaggtgtcccgggcaacttgagagtgaaaatagaaccaaaatataaagggcacacagccagatgcaacagaataattgtgacctcctggctttttgaaatagagagttctagatggtcagacaatgactttgtgaagaggctggaaggctttggcctccacttttggaaataaacaattgttgggaaacagtgaagcatccagccctcctgctgtgctgcctcagggccctttgtggctgtgtgtgcttgtctggcctgtgcttgttggagaggtgccatgctcacgtctgccctaattgataacaaagcgcaacataacgagaggtcctttatgttattccacacaagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaaggtatttttgtatttatctgcttgtatttgatgaaaacaatattaggcgttatattactgtttgcactagttaagattcacagacaggagttgcgggattagtttgtcttctagatcttttaactgcaaaagttatagtatatagagtaccaaaagggagcctcttatagataagtgcattctttcttctctcatgaaaacctatgtgccttgtttttcattgccttatgcaagaaggaattcagctctgagacctggaacactcttgtgcattagttggagattatgactctctttatgcttattacccagtgctgtaccagatatatgtgaatacttggaaacccaaaggatctggggaaatgatcagaaggacttaattgtctttttcattagggtcttatagcatggaacctaaggttgttaattcctccaaccatattgatgttcaaaacaaattatgagctttaaaaggatgaaaatagcaaaaatattcaatgagcatctctcagtcagtcatgccttgaaataaactagtacataagccatgtgtccagtatagcaaagtgctgaaaaataagaatgcgagcttagagtcatgcctctgtagtaccttattatgtgtttttaacctagctaagtacaactatttcagctgtgggtcgtttaaagttttaaaagttaagcagttttaacagaaaaatcagtgtcattgtacgattttctttgaagataaaaattaaaatactctcttcttccattattgcagcatggattctggttcttcagagagtcctgctagtctaaagcgagtagcctctccagcagccaagccggtcgtttcgggagaaggtgagggcctgagttgtattatgttcttcagaagggtcaaggacattgtgtaaatgtttgaaatgagattgaatttcatcttaagatagactgcatttatgatcagtatattaaactacagtaaaatgtaagtttagctctttacagaatcggagtacttcatggaaaatactgtcaggtatattaatcatcaaaaactgaattttctaattatattttattataagccctttgacttttaaaagagacccattcagttcactaagaatcgagttttccgagcatctctatagctaaactatggtcattgcttcacctaacatagtctagtctcatctgacttcatagataagtatttcgttttaaaagtaactacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaataaaataaaataaaataaaagtaactacacagaccactagagttctcatagtaacatgaatgccatctgtaccatcccaaatgaaactgaaactcaatttctgtgctccatgaaaacaatcaaaccagacaatttaggactaaaaaaaaaaaaatcattttgagtatttattatgcaaataattgccttctttctcaatctccacttggtgacataatcctaaatattgtatggatgccaactgaataaaacttaggtaattcaggccctcatggtaaaaatctcacatcttttttacattcaatacagccatcatcacatcctaactggagagtgctccctgagttagatgggttttctgtgtagacatctgagcagtgttgtagttaacagatgccataactaaccaattctatagtaattctttatgggttccttgaatacattacaggagaatagaatgttttatttagtttgtctgccataatgagattgttaacattccttagaaaccttgcccagtgaaaaacagaattattaaaacagctgttttaggtggagacagcaaggattaaggtataatggtatttcagactcacagtaacaatgttcttttttcaagaggttttttaaagtaagaattttttttagttcatagtatagctataaaaccttatcactaaacaaatccagcatctaatttttgctattaccatgaaaatgattaacagagttccctttatacattctcattatcttaatgactttttatccactgttagggtaacaaggcaaaaagctcctttaaataccacatgcagtcagtttagtaaaaagcaacttatgcacctcaccaaaagataaagaaaaaaactttggtgtgttacatccaatcaaggctcactggagggctggagtttgtatcttgactcacccatctagtaacagtattattttgtttatgccttagcttctttgtctgtaaattggccgtgataactaccccttgaggtaggaaattattacaaggataatgagataacatgcagaaggcttttagaacaaagctcagtaaatgtctgctacttttatgtcgtttttgcttcattccctggattagtgataaagccacataaagtatgagcatcctcatccaatagcagtatggaggagtgtttgtttgttttgagacatgtactgaggactcaataaataggtcacaagtgaaccatgcatgtacttaaaattgggcaacataatagagttaaattctgatcttagtttgtatttattacagccaattttgaaatgacttagttattagaaatatttggaaaggttgctggctttgtgaaggggtgggaggacattagaaattctgagaaaagctatttacatatattaatgagccttttgtaaataccacattgaacataatcaaatttaaagtaaactgtaaaccagataaaatagatgattggcttgggttgcttttaaaatatttaaaatattggcttggggatggccagtgccctctgtggaatgtttcctgagaaggggtagctaaagaggaacctctgcctatccatcatcatgtctctgggtttcattgtcaccctaaagccactctcagatgtctttgtgcaaggcaggcagggcaaggccagcctcagtcttcccagtctcctttatattttatactgcaataccaagttcagccagagttcatgtttctgaagtttcttaagcatttggaaagttacttcaaaatttggatcaattttaaagaaagtaactttgaagttgaggaatcactggggaaagtattgatggccaaggatcctgtcttaaatggccaaatatgatctaaagaacagtaacagggagcaaaatgaaaagggaagggtgagagtatggagaagtcagaaaaatgagtctgttaatgaagaaagaatgaccctattaaagccaccaaactttgatttccttgtgtgggaaatcatttttccaattttcactgtggaggtatgtgttaccagcgcctcagggctaaagacagagagtcttctgttttccctgggacgtttgaatgacctgtgtctgccatggggcccagtgctctccaccagcaattgctgctggcctcggcgctgacaggtcaacactggcgctgaaggaggcccttgttgctccaggggctgcccacgtgagcacaagagttagaggtttttgtgtttttgtctgtttgttttagttttcattagtacctcctgcagaggctctgataatcaaccgaaggagttctccataaaaaattcctacctcttactcaacacgaggctcgacattaaaggaacatcatctgaggtttagagagaaacatacattgtccatcataaaaatgaactttttgggtaaatggtgatttttctgttgctttaaaaaaatacatacaaaagcctaggataaaatggagaaaaaggggaaataagaaacctgtgcatctttctgtaaatcttttatcctgtacctagaacctccatccaggattttgtgtctggtgatctttctgagagtgtgatttggttctaagccttaataaaatccaccaagagtgatgcaaagttctacatctaattaaaaaggaaagtttcttctgtaatgcacacccttcaaattcaagacacaaaggaacattagttcttatcctttaagactaaattacatgaataataaaatgtgataaactgtgatttgtctttttaacttgttgaaaggctttctgggattgggttagacattccttttatcatcagtcctctctacctgtttgtgctcttgaatgacaactagatgcccatttttaactaaacaatatgtgtaactcattttgtgttctaacagcttcctatcatattgtgtatatggcacaataggacataagttttcaggcacttcaataaggaaaagtatgtcttatttaatttatgcgaaggatatatgctatctaacaattttttaaaaacctgtgacgtagtaccctcaaaactgaaatacacatatttaatatgcttaccaagagcctgcatatgaatgcatctgacccagtgctcagcacagagtaggtattgtgtaactcttagttaaaaataaatgtaaaaaccattttcattcaaaaagaaatcatgatgctaaatggtagatcactcttaaatactcaagtgtcggtaaacatgcagttgggttttttattcctgtgtctgggtcttcccaggaattgtctccctgtctgcagctactgaacttttatgtgcactgggggaatgtggagcccagggcattctgcagctctgtattttatctgtgactagcctttctcttgaatggatcttgtcctaacttccttattcgtaaacttgcttttgcaaagctgtctgggatttctttaaacaatcaagctctctccgtatctcaatatttctccccaccagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagaggtaaacccacattaactgtttcctctccctttctgtgcggtgattctctttgtggggagtcacgatgtttgacagcggaactttgttgggttttgctaagttctggaatgtgacagtaaatccagtgtgacctgtcattgtttgatcttgtcatttggcactgcgcagtaagcactggcttcccccaagcagaatgccatcagggctaagtggaggctgagtgtgatggggctggtccgcatcagctgggaggataatgttcagtattaagctctcttcctgcctgtaactgacttacgctttggagtaaactttcttgattagatcattatggtcattgatttttaaatgcccaagaatggtagcaatattttgcctgtataaacagaagtattctggtgataatcgccccagaatattggatattattagaaagtttttagaatttctggttttgcccacacagtagaaagacacaagatctaagggatgggtacacttttggctaggccttagaatctccgttgatcaggactgaatttaagtgctgttatccgtatgaattggaagtgctctcactgttgttaaatagagccctaaaaatttgatcacataaactgtggtcttaagatagtgcaagttgaatggaatggtggggtggacctaccacagagcatgggagtcagtcttgtaggagccacttgcacgttagtggagagtttcagggtataaatggagtcatttaacagatccaatgcacatttaaaaaaaccaacaagaattaactccttttttttttaagtgttgacagtcaattcacagttattttctttttctcctcatacctcctaggtactgagagagaaaaggctggcagggagcctgtaggggccgctttctcaggagtgagcaagtggacaaagttctctctctctttcaaatgccagtagtagagtgtatactgggctcttacatgtgcggctccgtgtactcggagctgctctgggagcgaggctgggcctggtgccctgctctaggagtcctgcccttggcctgctcacctctcctgcagctcccagaaatgattttatttgcttgggttttgtttttttaaggggtggcattgttttgctttttggtttttcttgctgcggtcttgagagcagctaagtggaattcccatggatggatttacataagtctgcccacccttggagaatctggcagaagcccggaagaaagtaattttgccctgcgagacagctggcatattggacttttcagacctggaaacagagaattcaattcttctccaggccagcaagtcgagtccaatgagagtcatacagatgatatttcaggggaattgggtaaaacactaaaagccaaactcaatttctactaccgtgcatgaaaactcttaaagtgactttaccttttggatcagttaaaatacgaaagccattacttgtaatgtattttaataagttacagttttctactttaataaaaccatccgaaataaattttaggaaaacacacagtgacttttttttttaaggtaagtggagttgtaaggtactttcttaaccacagtcttaaattattagccacagaagaactagcagtactagaaatttttagatatacatctagctatactattcaataataatgaaaaaaaaacctgaaaactcagctctttcgtcctacttgaatacagaattcagtgtaaaagcaaaatatccgacccaacctaacaccagacccagcttcagataccagaactgacgtctgggcatggggagagtcgtcccatcctgcttcccttctctgtatgggcaggtctggggcacagtctgggggactttataggtgcagggaggacagaacatggccttctgaatccatctcagcttatggggctggctgtggtttttcaaagggagcacattgaaactacttgaactctagggtactgccaattgccttgttctttttatggagtatagggagtagattctaagcctgtactaggaaagttaactggtcactggagtcttgtttcattggtattcctttttttgatatgcagcctattgaaaaatagtgagagattgcttttgtataactttgttcgttaataaagcagaatcagagtaaaaatttaacccgaacttttcctggtaaatgtttcttaaatttcaataagcaaaataaagagactgtaagttgtgttcctggtagataaatggcatatttttattctttcagtaactcatgttttgtttattaagccttttgttttgttttaattggaatgcttaatttactgcaagatagactcaagcataaattaatttagaataaagtactttgtaacaacagattccgttctggctcctgtcctgcctctcgtggtctctgttgttggcttacttggctggtttaaaattccatgagtatcccagagaggaattcaaccccagagcactttttaaacacttgatagttgggaagaaatatgctctgcctctatgcattgatagagaaatttcaatgtataaactctgtgaaattgggtggaaaggccacacaggacagccactgcctctttggatagagaggggtgaataggatgggggaagagaggttccagttgtccctgttagttttttaaaaaagaaagctcctgaagcaaatgtgcaaaatattaatattttaatgtgttaaaaccgggtagtaggctcgtgagttatattccctgtactttttatgtgtgaaatatttcataattagccatgtgaaaataagtccgagcttagtgtttaggatgtaaactaacagtcttcctagcctggaacctcctcttagatttgaccaggtccgagaagtgcctgtgcttggagccctctgggctcttacaggcgccatactctgctgtttttttctcttatagaaatgagtaaaagccacatgttttaattatttttttccatgttttcctgatctatatccttgtgtcaggtgatacagtgctatgttttcccagaatgaaaagtggggctttggggctcaagcgggtttgtatcatcattaatcgtttttaaagttgcatgatcaaaacttcagcatgcaaatgagaccttttgctctgttttaagggctctggaactgctgggaaaacagggagtttaggaaaaaaacctggtaagttacaaaccctgatgcttacttttcaatgttttgaatgtaattgatagttgctccccatctttgtgtattagggccagaagcctaaaataaaaagaatctttcctaagagtggtgagagtaagtcctttccttggaatccattaataattttacttggttatgagatttgtctgttgcttcacacatgaagagtggagacgttacctaacagaatgttctcttgggttgtcgagaaataattcaggtgaggccaggcacggtggctcatgcctgtaatcccagcagttttggagaccgaggcaggtggatcatttgaggtcaggagtttaagaccagcctggccaacaggggaatcccggtctgtaccaaaaaatagaaaaattagccaggcatagtggcatacacctgtaatcccagctactcgagaggctgaggcaggggaatcacttgaacccgggaggccaaggtggcagtgagccgaggttgctccacttcactccagcctgggcgatagaacaagactctatctcaaaaaataaaataaaataaaataaaataaatatatagataaataattcaggcaagatgctgggaagttataatacatggagctgtaggattatgggctcagctgcttctccgtcttcctcttaggcttggttagccctttttcatttcataacaatgcattcccaggacacaaacaatggagaagattagagtgtaggtcccattaatgtagaagccataggatggttttcctcggtacacattgaaggtacaaaattgtagtcatgcctctgaatccaaagtgttttagtttatttcagtaaaatcacatgtgctataaatagcacgaaaaagaaaagaaagaagcggatgtgaaataatacggtttctgtggcacgtcttcctggtctaggtcatttgaactttttggctatcatattcttagaaaattataggttgaaacagtcactgaattgccaagagacggatttgcttgtctgtctggtgcccagctccaactgggcttacatggctagggaaaagaagggaaatttcacgtagtctaggattttattttagtcagataaatactggatggagtatttagtcagataaatacagtggatggagatacattggaccaccccaccaaatctccgttttaagtgtaagttttctaagttttgtacacttgtcattccagagggtccagatatttcatagatgaagcccaggtgggctttgctttgcactgaaactagcaagaaaggacacaaaagactgcagagaatgttggggcagattgctggctgcgtatgccaggtcccttgaggagcaagaacatccagtgccaaataggacactagtttggtctttctccaaaccataaactcttggaaccaagagctggtctttggtgtgttgcaggagagtcctcatcccagcgtagacatcccagctggagctcccagtcagagcctaggctgggccagtagaccatgctgtggcctttcttgcttgccccaagctctgcaaagcatcaggcagggccaggcctgcaccatgaccgccaggtgcttctatcctggtggccgacccctgatagcatgcagaacagaatgagagcggcttgcttaagggccagagtcttacttgttccctggagtgagtagaaaagtaggaaatctcgtcagaacatgagacctttttgcgttcttcctttccattcttctttacttcattccctctttcttcttttttttctgtccttctttccttcttttctcctttcgttcacaaaccacacttggagagcaagggtagaggagcagaacagtttgttctctattgcttctagaagttcagaaagcagtagttgcagatgagccagaactcaggcagagaagggttctgtctcttcatactcagtctcctgggcccgtggaaatggtgtgtttcagagcctggtctgtggtaccgctggagtttttcccatgggacttttcacattcaggaaaagtacagaactgttcacatttttttccctgtgctgaattgtttttgcataaagttcccttcttaactccaggtccctcctgtaacgtgaaataaaaagaaagaaatttgccctgccatgatttgcacctgatattcagggatcactctcaaaatgtgagccataaagaagaaggctgtgtcgttgggagtgagaatctgcagcaacaacatagaaataagcccctgccgggctcccagtggtttctgaggaaaatgggcttctctttctactgtacttggcagctagaaaagctattgagtcctttagtcacttcaaagtagcactttagccattgggtgctactgtgctggggtgggtggtgaatgaggccccacccttggcctcagggcattctgggtaattatgggaggggtgtgacagaaggtgccaggagtgggcaaggagcggacttcgtggagggaagttggtaagtaagtttcacgggatgacaagggagtctgcagcccactgagggctcaaggatcagccaggcccttgaatgccgtgtctgcctggtagctctgggaacgggcgattcagggagccttactcgttgggtagaaatccagctcaatacattggttttgatgtgttcatctgtgaacctgggaggcgcctgcatcttcttggccttttctcctgctgactcttaacagtgcactgccgtgtttgatcttgtttttcagaaattgcccaggttattgcctcatacaccgccaccggccccgagcagctcactctcgcccctggtcagctgattttgatccgaaaaaagaacccaggtggatggtgggaaggagagctgcaagtcagtgtcttttttgtttatttacaattctccatccaagtttcaatacacaaaatctcaaagggacgctattttattgtaaagtacaaaccacccctcaccacctaaattctgtatttggatagtgagagatgccaaattttctgtgtttgtttggttcctaagtttcagacagccggtaacagatttctgagagctaggagcgcatacgaaaacatatctttcccattcctgaattcagatagagtcggcatagtgagaactcatatgacgagggatgcctgcatatccttatgtgccttggcattagagagtggagcttttcatcagtggtattagaaggtgtggcacaagagcagatttctttgcattcaaagccacatccatacatcacagtatttttagttcccgtgtgtgtgcgcgcacgtgtgtgtgtgtgtattgttaatcatatcatcttgtttacacattttaccattccagatacttcctataagtctcatttccagagacaaagatgctttaaaaagattactgttacgcagttctcatggtaaaacttcttagaatcattggtggatgcccaatctgcaagaaaattttcagtaggagcagaaaatgtgcatggtcttgaagtgacccccacagatcactcatgatctgcaggggaaaacacaataattatagagtggggaactaggacaagacctgaatgaggtgatcagaatgatgagcagtggggagaccagaggacatggtgtgtgtacagctgtgccgggagggaggagggagggagtgactggtcttcaaaaccgtcaggatcataaaagacaaaacctgtcgaaagggggctaaagaggcgtgaggactggctgcagtatctagactcagtgcagtatctagaccctgtgtgaaagaaaaccacgctgtcaaggacatttttgggataatggacaaaattgggttatggacactacattagacaaaattactgtaccagtgtaaaatttacagaaagcaataactgtactgtggttatataagagaatattcttatttttaggagatacgtgttgaagtatttaggggtagagttaagatgtaagcaacttgcaatcagatgaatcaaaaaaagaacttgcagagaagagggtggggggggagggagggagaacgcgcacaaatgagggagcagctgctgccaagtgttgacagtaggtgaattcgggtaaagggcctatgggtgttctgtgtgcttttcttattcttgccaattttcctgagtttgaaatcatttctaaataaaaagttgcctttaaaaagttactactatagcagttacttgagaggtaagccagctgacttttcatacagaaagtgtgtctccctccccgcatcctcccccatccaaagtgaagatcagcctcagactgccaggcgggcacctggccacctgcttcatagcttagtgaaggacagggcttgctccctggcttgcccacatggggcctatggaaggactgaattttccagcagccgtccgtctctctggcgtttgttgaacgtgggcctctgcgtaacacaggggggcctcagtaaggcttgaacggatataggaaggaatggtttctggaatgctttgtgaggaaggggcccatgggaaccctttggtggctattagtgggcctgtagactgacttacccaatctgctggtatttgtctgcccatgagcaggacggtatggaactacgtaagtttgagggggaagagggaggcaggaaacctttgccatgcagtggactagccacggaagacagaccctcaggtgctcctgaggaatggaggttggaacagcaggagcaggaaggaagaaggccttgctggggaaggcctcgggtctcacacagtcccgtctaccactctgtggaagtgagcctgaggccaggacaggaagagccacactggagagctgaatatataagaaacgcatcttggccagaatagaaggcacaacctggagtgtaactaaagatgaaactttccctggagagtttgctgatggacacccataaatgtccagatactactcactggttaaggaatctgacctctggaggcctggaaatccactcctttttgtcagcatgccttctcctgtgctggggagggagaggcctccttagaccctcgggtcccactccctgcttagagttgtgctgtatcacccattggtccttccagcatcatgcccctgtcctgttctggagacgtgggagactcccatcgcctgtcctccttgcctgccaggggaaggcttcctgcggggcccctctccccggtgcagcctcacgtcttaccgctgagcaatggcgtctccactccagcctctttgaaacaccagcaccccctgctctcctgccttgctgcctttgttcatgacatttctcaccagcggccaaccagctccaacctctccactttcgcaagagctgggagatcccacttctggaagctctctgtgaccatcccaaccagaagcaccgtgtccctcccctgagctccagcactggccccgtgccggcaccactctttagtattttatattactttgctttctgtgcacatttcttacttccacatgtagctgactagcaccttggaggcagcagccgtatttttcagtccccacacctctagcactgtgcttaagtgagtgtttgagtggttcttaggattctcaataaagtggctgagttgccatgacccaggagagctcctggcgctgtcaccagagtgactctcagcgtggatccacaaatgaggaaacaccagtgagttctgtgctgtgctgcagaggtgtgggaaagagtggtgtcattgcgagcagaatggtggtatactcggtagataaacgtggaaatttgtaaccagatggcttcagtcatcggcaggttcactgtaaacataaaagctttagtccttgagccaaggggatggaatctatcagacctcaaggaaagggaaacctgctctgtgttctgaaaatgacctagaggtatccctcttgataaactggcaggtgggagggcagaggtaatgtggtggaagttttcttttcttttagttttatttccttattttgggaataggtaattatagtcacatggtttaaaattcaaaagttacaaggggatataaatgtctccctcccaccttgtccccagaggtggctgtttcgatcagagccttgtttctagacgtgtgtgtgtgtatgtgtacgcatgtgtgtgtatgcacaagtagttttgggttctcttttcttggtggtgtacagaagggtagtcaaagcccgactcatgatccctaactcgagtcttttaatgggattgtgtcctaactgcaaaacccgcctcaccaactttgttataaactccccgggtttatagggacagtcatctactgtcccttcctaacagcatggtgcagaaacactccataaatgagtcttgtgttgaatcagattgaattaagtgagaaaggaatggcggtgaaaaatgtggctttagtcatcacatgggcctacgggtttgtgaaagtaacattgagtctccttgtgttctgtgtgtactgcatgtatgtcatcttgcatctaaggatgtatattacccataaaggagcatgcagacacatgagtgcatcttggcttgccactaactgcctgtggccttggggctgtcactcaacttttcatctggaaattgagaataataatactattatccttctggaattgtgtgcataaatgcacagggcctggctcataaaaagtactcagtgagggccgggcgcggtggcgcacgcctgtaatcccagcactttgggaggccgaggggtgcagattacgaggtcaagagatcgagaccatcctggctaacacggtgaaaccctgtctctactaaaaatacaaaaacaaaattagccgggcatggttgcggtgtgcctgtagtcccagctactcaggaggctgaggcaggagaatggcctgaacctgggaggtggagcttgcagtgagccgagatcgtgccactgcactccagccggggtgacagagcgagactccgtctcaaaaaaaaaaaaaaaaaagaagtactcagtgtgtattggtggccattattattattattattattattcctaaaacccatatacagtgttggcattaaccataatgtctacattacctgaaattaacagctgagtgctagcattacatgagtagaatttcctgtcccaggcaatccatggtatatcttaattttgtgatccacacagtctagccgaagcaaaaacattctgggctttgctgaccagtgattgccacaatttgaatttttagctatggtgttttacttttgtgacatagtaatccatagattttaccgttaatgtcatttgtttttcagttatatgtaagctttacataagtgctctgttataaagtgagctgtattataaaagatgcgcctttaaaaatgtttgatgtaattattttcttactaggcacgtgggaaaaagcgccagataggctggttcccagctaattatgtaaagcttctaagccctgggacgagcaaaatcactccaacagagccacctaagtcaacagcattagcggcaggtaaggagtttcgcatctctaactggaagatggtctgcatgccacttgagtttttccacttgattttctcattaaatatcttaggttgtttttcacatgtgctttaaagcacttcctgtacttgctgggactgacacccaactaatgtgatatggaatatgtctttcaaaaggaccagatatctaagtggcttttctgtgctggatacaacagaacccttgttggaatgctcttcttgcaggagtcatgaatgctgtggcattaaggccacattttcctcttgatttccttccagccatttaaattggggtttaggctagggggtgaggtgacagaaagggacacccaaaaataaacggctggggtctcagtaggtcatgagatggagctgggggccacgggggttggggggctataatgtggtgttcactgaagaccaaaatagctcccctgtgacattcactgtgggcagagggggcttcgctgggcaggcaggatgttgtactcactttcctggaggactggaaaagaacagagcacagcagttggcccagttggctattttctgattgaagggaccaaatgagatgcttcagcaagatctgagagaggtgaggtcagggggagcagatttctgctttaggtctttaagccatcattcttggttggcttttgtggaaagtgtagaatttttgttccaataccttgtggttaaatatctgtgctgtatgtacccagtgagataagattaaaaactggcagccttctcaagaaattaaaggatgggcaaactttgtgatgagccgcagtccccactgggcctctttgcttgagctgtggccttgtgtaggctgaggaatgtggttcccgcagggtttgctgtcccctggagagatgtgtcagtatccctccacttccatgtacagccccttcctcaggcccgctgaaattagttgctgaagtgattgaattagctggagaatttaaaaagcctaaacctatttattaataggttggttaagaaagattcatagggactgtgacctgttggtgcagactcatctgaagtagaagtgccaaagaatgagaacaattttacctcctgtaagcttgagagaaaatgagaaaagaaaaattgttcttgagggtggagatttctttcaggacaacattttgagatgcaaagatacagcagcagaaaaatcttttgaaacactgattttaggcctggcatggtggctcgcgcctgtaatcccagcactttgggaggccgaggcgggcggatctcttgaggccaggagttcgagaccagcctggccaacatggtgaaaccccgtctctactaaaaatagaaaaattagccaggcgtagtggtgcatgcctgtaatcccagctactcaagaggctgaggtaggagaatcggttgaaccctggaggtggaggttgcagtgagctgagatcgtgccactgcactccagcgtgggcaacagagcgaggctctgtctcaaataaataaataataaataaataaatcactggttttagttttccctaagatttggaattcttggaggtcaaatgatgattaccttccactttaaaccaaaaaggaaaaatgatagtaaagtccccatgatacatagctgtcctgtgcagcagaagataggatggggttgggctggtctttccagagtcagcagtaggaaggagttccgctgcactcaaaacgaaagccctcgattagcactgtacattttctgctgacaagtaaacatgaaaaagaggacgatatcataaaaactaaagacttagtgtgaaaattttgttgttgtcttagtttttaattcttcacctttattgcccacactgtaaaaagcccaacagaacagttccacctactgtcaccctcttctgaaaggacagaaatagtagctgggaatgttgaatggctgcgcggtacccgttgtgcattctccggcgggtgtgcagccgctcacccagccctgtctcctgcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgtaagtgccctggtggctctgtcgcctcgcctctctggtatcttcccgtaaaacatgcagcattgctctgattctgctgagctttgtttgcagaacttaaagctagaccattgctgcattcgcagtcgtctctttgaagaccttctgtaatgcaagagtttatctcatggggttttatttctctttaattttcattccttctgtagcatgtcccctccctcccctccctcctttttcctttttttttttaaatcattttggcaccatgctgtttacatgcctgactcattttcctagcttgaattttgctcattgttttgttttgcttatgtgttgttttcctcctttttctaggaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagttagatggaaatgtctctgtgttcttgatgttggaacctggcagtggtggtgaggaaccaagcagactagatgtcagcaatgggcctgctgcccacgtgtcaaccatgacctgtgctctttgaaatacagacattatcagaggctcgccgagtctttgttgaacagccctccctctccccgtgctctccaccttccctgatcaatatgcaaatgatcattccttataataccagtttcgaaacatagaactctaccacccagtttagcagttcagtctcaccgggcttttgatataagttgtcgacacattgagggtgtgtgatttggctcagggtacaaaccatttgtccaaaagatgtatcgtaatgtactggtgaacacccccaaaattatgtgggtaaagacagaaacttgcacatgccccacgttgtctgggatcggcttctgcctggcacactttgcagaaataaaccagcgtccacattgatgccactgtttgctacaatgaccacatgcttgattccatcctcatgagcttcacttattggacctctcctgccattcagtggaaaagtggtttccttcctcaattcagcagatatttggtgggggggatgtctaccatgagttgggtgccccattggcttctgggaggagtgtggtactccgtggaaacagagtccctgtcttcatggagttcatattgtaatggaaggaacaaacagaaaaccaaactcctgcaatccatataaatatgcacggtatgtgtgtgacaaggtgacaagttctgcactagaagtttggatatgaggcaccactgagcagactggcagggccaggggagggtggctgcagggcaaggatcagagaaccttcagggggtggggcggggagtgccatttgagctgagacctgaagagtaaggagggaggagccagatggagtgggggaagaggtgtggctattgtagatggagctgtcaggacaagcaaaggcccaggggtgggcggggagatccttctcactgtcccccaggccacccccgtgtggagcagtggttgagtctgcaagtcccatctcttccccaggatcccttcagctgtgtaagccagtgttgcttctccagtcttgagtttggctggaagggatgcagttgtcaaggtgggtactactccataacactctacctaattcactccagatgccccacgccctcactgtaggccatttccccaggcttgcctccagctttgtgaagttgacatgggttgttccccaggaagctgtgctttcccctacaaatcattgagtttgcatttggttgtatccattggaccccatgattctcagccagtgggagtgctgctggtgtctcatggttagagtcagggatgctgctcctcatcctgcagtgcacaggacagtcccccgcaacaaagaatgatctggccccagatgtcaccagagctgaggttgagaagcgcaggtctcaccccactggccactgtggttaatgttcacctggttattcaccaccagaaaggctgccccggtaactcctgttgaataaatttaatcacctaagctcatgtcgtgtatctgcagcatcaaacgtatctcagaaccttggttttatatttcaaaatcttattcttgtttattatcccccatactctgcactttggtactagattaaactacttcagtcatattcacaagagaatctggttaacagaaaattgagtacaagggaaagaaagcatctttcttctaataaattagtgaagggatactaggtatctcctatggcctcagagtttaaaggtgtcaggttttggtttgtttgttctttagctatttgttttttgttttttaatttttttttttgagacagtcttactctgtcacccaggctggagtgcagtgtcgtgatctcggctcactgcaacctccacctcccggatacaggcgattctcctgcctcagcctcctgagtagctgggattacaggcatgcacgtgggtctggctgcattttgtatttttggtagagacagggtttcaccatgttggccaggctggtctccaactcctgacctcaagtgatccacccgcctcagcctcccaaagcactgggattacaggtgtgagccaccgtgcctggcttactttttgtatttttagtagagatggggtttcaccatgttggccaggctggtcttgaactcctgacttcaggtgatccacccacctcggcctcccaaagtgctgagattacaggcgtgagccactgtgcccagtctgttttgttttgttttttaaactgattattaaatcatttaatttcatattggtctgtgtaaatatatttgcaagtgaactttgggtacagttttgctccagtagcattagacaagatgagtccaaatgagattgtcttcattgtgcacttacgaatcactctcctctggccggctgcctctccacactgcagagcaggcctgcagagttggggagccatggtggttgagttccccaagtggcccaggcctcagactgcctctgcataaaagggtgtctgggagaagccgatctaaagcagtaactcggccctatgttaagtcacaaaatatctaaccattacatgcatggtagaaactggtatcttccctgtttctggaaaggaatctgggcagacccaggccgcaaatagtaacgattgggttatctatgctttcagcgatgccatcagaagaaatagtaacactagcttaggaaaaccctctaaatattaggtttaaccatatgaaattgtcaattcttacctataaaaacagcaatctataattcaacctagtacaatatatcatcacctggcacatggtaggttaggttaaaaaaaaatgcctattgaatgagtgaatgaaatcaaccggtgactatagaaaacaccagtctcagcttttgacacagaccacatcaccctcagagaggagaccatgctgtctctccagtttccttttcctttagatgtgagcttcccaaaaacaacagtggccttggaaggggctgctcctggagtctcttgctcatttggtctaagaaggaggctgaggaccagggaccgttgtctgagccaagtctccactccagcacagggcgggggcaacaccccacccaggtaacagttgggcaacgggcacagcaaatcgcagtcctgcttcattaatcctattcattctctttagttccaaaaatacccaagagaatttttatggaaatgacattggatgccaatggtcccaaaaatgcaaggaaaaatagctccttctttgaaatgtctggtattcggggtctggtaggatagggagacgtagtgaagtccaagatcacagtagccttaatgtgaatgttccgcttcagccagagttctcttgggcacttttttttttttttttttgagacggttcacccaggttggagtacagtggtgcaatctcggctcactgcaagctctgcctcagcctccccagtagctgggactacaggtgcccgccaccatgcctcgctaatttttttgtactagagatggggtttcactgtgttagccaggatggtctcgatctcctgaccttgtgatccgcctgcctcggcctcccaaagtgctgggattacaggcgtgagccaccgcgcccggccactcttgggcacttctttacgaaaaccccacataggaaaaaccaggcttccagagtgtctcctgacgtctagttagctattccatttcagagggctccatagcctctcaggaagaatctattctttaaattaaaagctccccaggcatttttaagttgtatgacctgattctcaaaaatgtttcatttataaaaaatgagcatcagctataagatatatatagtgtccgtgcaacttaatgttgggcataccacctcttagaagctaccagctaccatgctgttgttttatgatgtcaacggtgtgtgtgtgtgtgtgtgtgtgtgtgtgtgtgtgacaggcagtgagcagcaactttcaggtgacttaactgcctacatctgtagcttggtgacagtaggtcaaacggtgagttcagggtacagccagaaggcagataaataccgctgtatagaagattctggcagaggctgacagctgctatttccacatctgcttggcacgtcgcttctgagtgatgttgcaagcctcaaaagagatgttccttattttgactcagactatcatgtctttaaaagctgaacagttccttctcttgatgccgtttctctgaactctgacccaggagaggggagaacacttttgatctgccagttttcatcaaggacgctgtttccctcagtgagaggatgaaacccctgacgcccctgctttcccctcccatttcctatgctgtcctgtccccttctgatacctgtccccacacactcatgcacgctgatccactgcgttgcttcccaggccccacccagaaagtgaggaaaggcctgggctgcggtggagcgcaggatgttctctgcggattattcagtgaagtcgagatcttagagaacattgagcataaggcctgcacctatacagctgagggcactgagggtctcgggaaacacagtgatgttctcaagtcagcttttcaaattccgacaagtcctcgttctaggcgtaccatttgatgcacagatctatggacatgtgtgtccataatagccccagagctcctgcctccacagaactggtggctgcatctttggaaagatcgggaaggggcccctcttgcctcatgtgatttcctcactggtggggttaccatgggagtttggagccattggtaaggattccaacacattttcaacgcacaagcttcatgctgacccgccccagccctttgtccttctctcctccactgggcgagtttgccaggcgctcaggcttacttaagacaccctcagtctgagccaaatgtaagaacatgtgctgctgtagcttcccaattttcattcctggcctccagaaaaacatggtgctgtatataacaacacggcttctctgcaagttcagcctaatattttactccatttctctcatcattttggaacattctatttccctgtagaccacctgcctataggaagatagtgattcagacggagcatccacataactgcatctggggaccttatagaggctaaggagcaatccaggatggtggctcagagcacgggttcaaatcccagctctgctacttactagtggtgtgatcttgggcaagttatgtaacctctttgtgcttcagtttcctcatttacatatggagagataatgatgacatctagcagaaaataagcagagaataatagctttgttgctgttgtttttattggagagaaaaggcatttgtgcctggtcagtgagcatcatggaatccaatcaagtgccttctttcattaaaccaaaacagcaggtaggttgtgtgcatttttaagaccttttagaaagtatgcttttatagattaggaatttcagagagaaaagattggacagcttccctaaaaactttgagctatctcattgcaagatttgccctaccaatccgtgcacgaaccctggcccccttcctgatagcaggaggcccaccggtggaagcaagcagctttttaaacgccttcgctgcactcctgcaatgtgcagagacctctggaccaaagaccagagcctactcagcagactcttggttgatgtggacaagctgcctgtgtttcacacggtcgacggtggggaggccaccagggaaaatggaatgtgcagggcttttaaatgtcacgtctggactgtgttggcaggcccatgcagcgctccacaataaacctgtcacaaatgcattgagtcactgggtcctttatttctcatcacggcattctgtggccttgtgttctcttgccagcaaagaatggaacgttcagccccctagacatgccggctgctggattttttaagcaatcatccagcttagataaggggcgtgggctgctggggaatgctgccccaaagcgctgtctccagagcagctgccccaggcatgcttaattccctccctgcccactgtgtgcacccccaagatgcctctcaatatccagacctgcagttccactctgtttgttaggccccccaggagagcgagcctgcagtccgccccagcagaggggaccaggccagggatgcctctttcctctctggagtgttaccttggagtcctgaggccccgtgacaagaccccacacggccgaatcctcagtaacagccctccactgacttggtatccagtgggattcctccctccatcccattctctagggggcagaagcacatctgcccgtcctgtccgcctccccttccatcctgcatcctgtcttctcctctccccgcctcctgctgtgtggcccatgagcccaggagggacccagtctactctgtttacctctcccgctgcccactgagagtcatggctgaggtacatggaaccggcctggtcatagggccgtgctcagcagaacacaagcagaggagatgcctagaactttcaggagcaggtgacaagcagcagagaaatgagtgggggttccagctagtgaaggatggggtggcacagagcatgactgggggccagggatccagccgagaggatggcccgagaaagctctctgaagaggggggatggagacctggctgcgggggaggcacgtccaaagatcaagggggaggagctttctcggcccaagggacagcaagtgcaaaggccagggctgaaggagctgctcctgcccctcacagaaggatgactgagtcttcgacctggtctctctgcacccactctctccttccagcttcccccacgctgcaggcagagagctattctaaaaacatcacttcttatgcttaaaatcatccaggggattcccggtcctccgagataaaagacccgaatctacttggtctgcaaaccctgcctgatctgcccccttctccagccctctaaccttccctctcctcatttattcctatttgtgctgaattttagcacggctcagtcgtcacctcctcgaggaagccttccctaacccatgcattcttctgtgcttgcagaggggaaactgggctgactggttacggagctgctctacaggagcctgctcagtgttctttcttctgccacctttgagtccccgtcatgacccgtcacgaaagtccaggcttttgttgcccccatggctttccaaatggccctgttgaaaacatcccctttgaccctccaaaccactttatggaaaggtccattttcatcatgggagtccctcctcagagagagtcagaacccacatctggtgcccactgtggcatcgtgggcccacgtcagcaggaagggatgggggtgcaggcaggcagtgtgggcaaggagcctcccccagccttagagactgaatgactcaaccccccttgtctacctcccagggatcttgtgtgcccacatgtccaatagggaggtggtgcttgggtccagggacttccttcatcatctagcctcactctgctgtccagtctcacccaacccagaaccttccctccatcatgtcagcctccaccaccaccccagaattcttgagtctcatttaagccactggtaggccccagctgcaaatgcctttgccccacctcccctgcctttcctgcccacctgccttcacctctcccgatttcgctgccacctctcctgctccattaacttgtaacaactcagctcttttctgaattccttatcacacagaaagatgactagatagaaaggctgatacagaaatacatagatactcttacctccccagttagactgtgagctccttggaggcagggcccaaatcttgtggtttgttacatccccattaagacctccatggtaacaacactaatgaacagcgatggtaccttgccttgtgtagttgtcttattgcagggcaccctgcctccctgctgattacaaaccagagggcagggcctacctcccacacgtgcatatccccatggcgcctcactcttgccagttgctcaggaagtgctgtggcagacagtcctgggctgcccttctacctgcctgttgttccacaggcttggtccttcctccccagctaggctgtgaggggcaggacacgtcacagtgttcattctccctgctgcgtgtagcctggaacccagcacaaaacctgtgcttgagtttccctccccaggaggaaaggaaattgtaaacgaggcaccatcgtttacaaaataagttctcatgaaaagaccccaaaacaggaagtgagcttatgaagcataaggattgttcttcatcgttcttataaccaccttcagtactgtctatttatgtatgtatttggttttctgtctcccctaccaaaatggaagccccacaaaagtaggggcccctgcggatctatgcagccgctgtgaatgagcaggaaatgtcatggctcaggttgcctcttgggttcctatgggatcagtttgttaagttaggagagaccgaccccagggagcaggctatgggtgcttagacccttctgaagaaagttccattgagatgagaagtccacctgcccctctggacagctcagagctggtctggcctccagagcttcctgtgggctggggctgtccaggaaccggtcagccaagggtcattttcagagaaggcctggctgccttggcctagactggccactgccatcccccaccagtccccaccagccctgcgctccaaggacaagcacaacctctcagcctgatcttgcaggcatctgctgagagagaaaagcttaaggaccaccctcaggcctgccctttgaaaagccggtggtttcctcctgattccatttcctgacatatcaccagcataggttttattcttgatagggaaggtcaccgtacatcgctgggatctgctgttccattcataagatgagggcgttgagcagagagagtagcctttgaagccatagcccatggctgggggtcagtggtggcagcgtggcctgaggtgcagcttcagagggcccgaagagtggagtgtcagatggtctctgggctcagagagatggcgttctgtggttacagccattgagcctcttggacaatggcttgagtgacctgccatgggctggattcagctcagcagttgtggcagctctcatgatccctgggcctggacggatcagtttccaaatcccacccgcttttcgcgccaggtgtcttgatttccaggccatctttcctctgatctcctggctgtacatgggaaccacacgggagctttgccgataacagatgcctggaccccactccagccagtccggtttagttggtctggggtacagcaggggcactgggatttttaaaaactccttgcgtgaccccagtgtgtggccaaactccagggccacagccccgtccatgccacacacagctgccgcactgatcccctgaaacacagccaagaccttcccagctccgcagccagcgcctcctcgactggacttccccacctgttagggctgaactgtgtccctcagattcacacgttgaagcccaggacatcagaatatgacttcgtttggagataaattctttaaagaggtgatgaagtgaacacgaggctgttagggtgagccctaattccatctgatgggtgctcttaataagagggggaaatgtggacacacagacgctggagatgtgcatgcacagaggaaagaccctgccgaggagagaggcctcaggaggaaccagccctgttgtcaccttgatcttggactttgtatctttagaaccatgaggaagtatatgttgtttaagcggctgggtctgtggcctttgttatggtcgcctgagcagattagcgcaccagcgaggaggaagaggcctccggggaagagcatgagctctagggtcagactccctctgccatttatcaactgacttacccgccctgtgcctcagtttccctgtctgttcagtgggggataacaacagtatagctaccgcataggattcctggtgaggattcaatgagtttgcacatgtgcagcacccggcattgtgagctctgagtggcgttccacctgaacgcccatgactcaccatcacgcagagactgcttccctcctctgcacctgcccccagggctccacgcccccgactccaatttctatttactcccattcttcctccctccatttgaatccctcaccgctgcctgccccctcaccaccgatattagcctgctgaagtccaactcaaattcctcctcccctgctaaatattttcaaatccttctcatcaaaacaacaggcccccttgaattagacctagtatttggccgagtgtggtggctcacgcctgtaatcccagcactttgggaggccgaggcgggcggatcacctgaagtcaggagtttgagaccagcccggccaacatggtgaaaccccgtctctactaaaaatacaaaaattagctgggcgtggtggcatgtgcttgtcccagctacttgggaggctgaggcaggagaatcacttgaactcaggaggcggaggttgcagtgagctgagattgcgccactgcactccagcctgggtaacagagcaagactctgtctaaataacaaaaacaagaacaacaacaacaagaaaaaccctagtatttggctgggcacagtggctcatgcctgtaatcccaacactttgggaggccaaggcagacggatcacttgaggccaggagttgaagaccagcctggccaacatggtgaaaccctgtctctattaaaaatagaaatattagctgggcgtggtggcgcatgcctgtaatcccagctactcgggaggctgaggcacgagaattgcttgatcctgggaggtggaaactgcagtgagccaagattgcaccattgcactctagcctgggcaacagagcaagactctgtctcaaaaaaaaaaaaaaaaaaagacctagtatttgataccacaacagagcaactacaatagtaatttaattgtacatttaaaaataactaaaacagtgtaattggattgtttgtaacacaaaggataaatgcttgaggggacggataccccattcttatgatgtgattattacacattgcatccctgtaccaaaatagctcaggtgcgccataaatatatacacctacaatgtacccacaaaacttaaaaataaaacaaaaaccaacaggctcctccttcatattccaataaaaatgcatttgtactttcattataacatgccagtctgcctttgtacccaaaaaacttattaacaggagctactcatactacaggagagggcacagtgagagcaggaagtcaggggtgggacatagaaggggcctggaatgagctgaagcatacctaccacagaggatgtaaagctgtgccaggaattccagtgcccattatgaagctatgaatgatacaccctttcactctctgaaatgtgcatatttatggaaaattaagagatgatttatccctgagaagaatttgatcttcaccacttctcagcagtaattaaactgcctggcaacccctgtggactggattcccctccttgggagaaaacaaagcttatttggagttacattggcacttttaagcatctgggttacatctgaatggaagcctcccgaggacccagctacatggggcaagatgtgtcaccaggacaggctgggtgggatacctgagctctgctggacccacgagggtctctggtgcctttgggggcattccttcccctctcacctctgtgcccaccggcttctccagaccccattaaaaatcgcatcttgaggatttgcaactccgaggtctcaaggactgataaccgcttggagtgatgccctgtgcaaagtgcctgcaactcagcaaggatccaagttggcctgggactcccaggtctagcaaccagcaggctcccaaaggacaaggacccggactgcctccttctcactgaaccccggggccgagcgtggatgctgcttcacagcaggagtacacaacttcatggcttggagaacgctggggtttcagacatcagctgcagggtaaagggacatagtgtttggccagagaactttcttcacgtcatatccatgtggcttcatctgcttttcctacacgacaggccaccccacacctaccaggagaggcccagggtgttgaagggagtgcagttagattaatttgcccaggagaagccagtgcagctctggggtgcatgggctcacctggcaggagagacttggtccatggggagaagcctgcagtatagatgggacctccaggagcccaagtagcatagaccctgctgatccggggccattgagccagaggatttgggctgaatgtccccagagacaaaagggaaaggtagatcctttcccttaaagatgaaagccatcgcccgggcttgcttattgctctctctcctggtccttccacatgttgtttctgaacatttgttctggcatcacaatccccgtcaccctgtcatctggcccttcccacctttccaccttatctcttgcagtgtctccgcgtcgacctggcacctgggtgaaggcttgctcttgctggtgcccatagcccccagtgtatggtcttgacctccccagccatatggagacccagcctcaggagggcccctcgaggaagcctccccttagcacgaggagttgctcccttctgaggtcctactgtctccaccatcagcacagcacacgggctcttttttcttttcttttttttcttttttttttgagacagagtctcgctctgtcacccaggctggagtgcagtggtgcgacctcagctcactgcaacctccacctcctgggttcaagcgattctcctgcctcagcctcccgagtagctgggattacaggtgcctgtcaccatgcccagctaatttttgtatttttagtagagatgaggtttcaccatgttggccaggctggtcttgaactcctgacctcaagtgatccacctgcctcagcctcccaaagtgctgggattacaggtgtgagccactgcacccggcctgggctctttttttaatgcttgctattttaatttcttttttttttttctcgttttttttcttttcttttcttttctttccttttttttttttttttttttcctgagacaggtgctcgctctgttgcccaggctggagtgcagtggtgcgatcatagctcactgcagcctctatttcctgggctcaggtaatcctcctgcctcagcctcccaagtagctgggattacaggcatgtaccaccatgcatggataattttttaaattttttgtagatatgggtgtctctcactatgttgcccaggctggtcatgaactcctgggctcaggcaatccacccacctctgccttccaaagtactgggattacagacataagccaccaagcccagctgcttgctattaatatttttaatttaattttcctgttgtgtctctcccaagattgtgagtttccctgaggacaaggacagtatcttgcttatttctgcgtctcttggacttcagaggaacttaataaatatttatggaccaccttattgcatattttggcccctttcatacaggaacaaggtctgtttatttgctttgctcaatgggcaacttgctgtgggggctggcttcgttttcaaaattctgcttctcattgggaaaggtagaataattggaggtgtggagatgggtgaggtgcactttttaccctgaatgctctgtagcccttgaaattttaataatcagcatgtgtttatgtattacttttgtaataaaacaagttcttgaaatgatgctgttcatacaaatatcagttgagggaagcaagatgaccttttattggtaaggtttttttttccccgtgattttctccagggcctagactcaaaaaatccttccagaaggccatcacatctctctccatttcgtaaatgtgtctaactaggcaacatctaagggacggcacacagattaggaattttatgtgggctataataggggatcatttgtaaccgcctggagtcatttgcaatattatttcagctgtgtgtggatttcagttagttttgagaatccttctgtcacaccaagatgttcatggaaaaccatttgatgtgttttctcctctcgtttttccctgggaaagggggccagaaaccatgtttatcctaggacccaaaagaggaaaaggccacgtccctccacccctaaagaaaacgcttttatttgaaatgtcttttccatttaccctactttgaataatggagtttttaaactcacttgtttttctaaatattaaattttcaaaggaagaatatttttgagttcaaaatgcctatttcaaatctttaatggttctcttggtctggcattcaccagcaagttttaaagcagcctcccatgggtcaatttgatggctaaaaagatgattccaagccaacatcattggcacataatgtaaagaagactctccccacaaaacttttgcttttcattgtgttctgcagtggccatcagggccatccccctgtctccaggcagggtggtaggtggacctgcgagaggtggaatttggtgggggcaagcagcccagacttgcccagcgcttcccctgacctccaagctccatcagctctgacttgggccttgcaaagtgtttggaccagaggccaacgctacctggagcaggaggccacgcagcagccctccagcttgtccccaactggccccaggctcctgggattcttggacaaatggcccaaatttaccctgaaccttctgctgttgctctggctctgagcttcttcacaacctgcaccgtgtaaaacttgaagactcagaagagcttctgaaatccaaagcaagccaggacttttccccataggtccttctttccgattcctcatcattctacgcgtgtctgctggtccctcgcacctccatgctgcagactggaactctggtcgggttgtcagtttcaagtaacactagtgtttctcaacagggtgctcgtctattggcatttggggtgggcagttctgtgtcctgcatgttgtgggtcatttagcagccctggccagcctgccagattccactatgacaaccaagaacacactctcagccctgggactggagtgggatgcagggcaaacctcagcctttggggagtggggacagtactgacctcaacatggtggggaagagcaccaccttcagcggagggtggggcagtagcaccgcctgctgaggaccaccagtcccccaggttcttagctatgccctggagggcaggagtctctcctcttctgtcctgaatccccagcacccagagtggttagtcctagcctcatagtaggacatcagtaaatatttgcccagtgaatgaataagatctatgaacagtcttcaaaagggcctgtgaacccaatgaaagtgtgccctaaaggtgtgcattgtacacatgtattcgctgcagcaagaacccataacttccctcagattcttcaaggcaactgtggggcatccttaaagggacattcagaaaactggtccagccagtggccactacgggcctgatgtttctgtagctgcaaacatcaccgcaccgtgtttgtgcagtgacttttagagctaccactctgtgtcaatattctaatctccctgcagaagggaccatcctgaacgctccagggactctgcttccgtgagagggcatccaagttgcctaatgcaggggctgcattcagcccttcaacaagaaatggcctgaggcccgggccctttcactcactcacaggagagtggggtaaaaagagggcaggaacaagatatgtttccccccaaactcgagtgtttcttgggtgaccttcccaataaaagtcaaagaactcggagacatcactcagcttgccacaaacccaagctcacacagcagcttggctgaactgaatgagtgagccccgtggcctgcctccttcctgagagttcattgttggtgcagctgttttaataaaagacaatctatgccctgaggcaggaagaacagttgggccaaacccgtggctgagcagagggctcaagctcagacacatctgcagacctgtgcaaaagtgcgagctcaccttgcagccctggagaattctgcttgacctcagggcaggggactctgagtgaggtcgagggtgttgatataatgatgactcatttctgctgctttcccagcattctcctgctggtcttgggttgttcctgtcccagcaagagaagctacagcatccagaaaggacaattggcccagagaacggacaaaaccaagggctggaagcaccacaacccgagagttaacctctaaagcagcaaagcatttgccaagaaatctctgatatcatttggcccagagggatcatacaatttgcagaagctttcagcatataggctagatcagtcatgaccccagataactcccttgagagaagatggaaactcgaggaacccctgctaggccagagcaggcttcttgaacattagtgcgccaaaaaacaatcctctggagagcttgttacatcacagatacccagcccccaactccagagtcacttcagccggggcatctctagcaagctcctaggtgacgctgatgctgccagcctggggaccacgctttgacaaccactggtccccagcagggggttttgcactgtgctccattgtgcccccttgaggggaacagaagggatgggaagaacaagtaaaggggattcagcccggactctcccacctacattcgggacacctctgggtctgtcttccaagtctggcttctgtgattaaataaagaacctctgataaaaaagagaggtgggtccaggcctgcacatgggatgctcccaagaaccaagcctccctcctgctcattccagtgtgtctggggcaggaggctcaaatgttcaaacaaaaccccaaataacaagctaagtgggcagagtcatgagtgagccccacttccagtgcaggcaccatctcagggcagtggagtggcccttcccgtcgggcagccttggcctccatgatggtcttgtgccaggctctctgcagtgggaaggactaccctctctgtggcaagcatgctgctcagctgccccaggggccaggcagcagctttgtccaggagagtgtgcccagtgctgtctggaggcaccctgcatctgcctggtccccaggaccatcagagcctcagcacagccacctcatcctccacaaaccaacctcgacatggataacccatggcctcctggagctcggggatagagcacagcctctgcagcccaagtctcagggtttggctcttgccttcaccacttccaagctgagagacctggggccagtcaacctgtgtaaacctcggtgtcctcgtctgtgaaatggggataattctagtataatacttgagcattaaatgcagttcaccacctgacatggtgtgagccctccagagttttggccaatcgtcattgagtgttttgttttcacattattttcgtgtttctgatgaagcaggagtgtgccgcctgtatcagtttctagggtgccctaacaaacgaccacaaacggggggacttaaaacaataagaatttattgccatacattcctggaggccggaagtctaaaatggaagatgctggcaggtgccagcctcactctgagggctcggggtgtgtcttggtttggaaacacatcactccaggttctgcctgtctgtctctgtcttcttctcataaggacactgatcatatagggtcaggacccaaccctgagtatgactttatcttaatttgattatatatgaaaagactatttccaaataaggtaacgttcacaggtaccagggggtagggcttccacatattactggggaggacacatttcagcccatgaccccactggactggagcaagccctcaggacccagcagccacgaggatcttccgtgtgaagttgtgtgggcttccccagactgtgctaagttctcccaaatggttgtgttttccagggtgttcagacttacatctcttggatatgttgaccccaactgaaagaaagcgacaaggatacatccacgagctcattgtcaccgaggagaactatgtgaatgacctgcagctggtcacagaggtaagggagctggtggggcagggggcacggcagggggcgatgacggagggagaggggagggttccgtcaaggaggtctatgtcctgattctgagcccaagaaactttctgatgtttgaggagcatctggatggcaaatgctataggagattgcgaccgcagagacggttcgttgcttatccatggccaacattgagtcattcccacagagggacagagatcacttagccaagggcaagtgagtccctgagcagttgatggatggagtcatgtgaactgagagtctggagtccacgctctactcagagcagctgcagctcagccaccaaccaggaggtgccatggagccagccacgccgccctcctggcccgcagtgttggcatctggaaatggggggccatctggctgctgtctcgagtcattcctgccatatgttaccctgagacaaacctgtcactgagaatggcaacgtttcctcccaggcccccacaaaagcccctgacctgagtgatgcctcctcatcttgtcagtcctcccagaagggccctggccacctcatccagaactatggggagatgcggagcccggcgctcctgctgctcagcaggccttttgtccacgtccatgggaagatgccatattgggagacagggatttgcagagatggacctgcagtttggagagtgctgtggtagtctggcaaccaccacaccaaacgggtgtgaaaccatcttgtctgatagtcttaacatccaggaaagacgcagcagggctcgccgctgttggaggagtacagggtgggttgttagctgcaggaccaccattaatacttaggaagcattgatgcaaactcaaaaaggtgcccctttctcaaggtgtttgactgttattaaatatgcagttcaggatgtccagggtgcaagtgtcactccttagatatggctcctttttgcactctgcaaaacgcaccaccatatgtggttgccctggtacatgccgggttcaacgtcggcttaaggactcctgtggaataggactcccagggagcagccgcagcccagccaagtttatgtcgaagatgggctgtccccttccctaaagagccttcagaagcgcctcctgtgggagaaaatgacctccttgcaggcgggggcttgcaagtggaacacggggttccactgagatctgtgatttactgagagttgctcaaccacacagagcttggaggggctcattcattttccagagcccaggaggagggcagcactcacccccttgtagcgggcctgcaagtgctgggtctgtccagggtcagcccaggaggctgaggacacagcgatggagtcagtcaccgaggtggccactggcttattagaggagctgccgcctgggctgctcctctcagaaggccctcggtttacctatgcagatgaagggactgtccacagccaccggcacctttaagccccgcttttcacaccggtccagcccctcccagtgcgcaggtgagaccgcttagcctgcgtgcatgacttggtaccggcctccctgcttgtctggtggagttaagacctgtctcctggagacttcagctgccctccttcccctgtaaaacaatgcaggccctgctggggacccccctccggtttccagggcagaggaggggctctctgcttcagaaactgcaggaaagcaggcgttcacctctgggcctctcagccaaggtacagacacctgagccctttccctgctctcagcggatcggcgtgtgagtgtgtgagttttaagctaactgctttctgaactgcttcgttttctgcatctgtagatttttcaaaaacccctgatggagtctgagctgctgacagaaaaagaggttgctatgatttttgtgaactggaaggagctgattatgtgtaatatcaaactactaaagtaagcctctcctctaatccccagcctggcttggcctcctcggctctcatgcactcgcacctctgtgggtctgtgtgtccttcttgcatgctgccctgtgcttctttctggctttttttttttcttctcattgccactcacaaacaccatcacccttttgtgccttcgtgctttctggaaacgcactccgaatctctcattgcaagagtaggtttcctgggcaccccagagcctgctgttgggtgaattactgtggttgtgaatttccagggctagggcgacgctggctcctgatggtgctggctccatgctggggcgtggggctgccccctctacgctttccctcggacgcgggatcccatgggggattattggtcttttgaggcattcttggccctgcagatggaaaaatgtggaactgttcactgcctaacatcagcagttcctcaggatcactccgggaagctggccctaggctggtcgtattttcttccaactttagtttgcagaggcagctccagggccaggagtcaagagacctgggtttggattctgacttactcactgcctttcctttttgagccttagtttccccatctgtaaaatgaaagggttggattcgatcatcacaaagtctcttccaattcttagaaaaaaaaaaaagtcaaaaaccaaaatctgtatccaccacgctctcattgtaacatcacttgctagaacacagattaagtcacagcctgcagggcgcgtgatattccctgctgggaggaagggccacccacttcctgggcccgaggatggagggcaggctccagagccttgcgtccattcctgatcttcatccgtgtcattgggaagtccccatttcctaaatgtggtctctgcattgttcttataaggtaatttcaggtccccactttcctgagcgtgtgtttgggagtggatggagggatggagaggaggtgtggagaggtggacatgaagaaagatacataatgtctgctggcttggtgctctagaagacgaatgatccaaggtgacatcaggcaggcttttagagaaggtctggactccgttgcccgcgccccctgccacccgatgccgtggaagcctttcgaacttaggtctggtgtcacacccttgggctcacatccgctattgcctctggctgtgtgtcttctggcaggtcactttggtccctgggcctcagtgttctcgtctacatagacgatagctgggcacagtggctcatgcctgtaatcccagtgctttgggaggccaaggtgggtggatcacttgaggtcaggagtttgagaccagcctgggcaacatggtgaaaccccatctgtaccaaaaatacaaaaagtagccgggtgtggttgtgggtgcctgtaatcccagctactagggaggctgaggcagaagaatcgcttgaacccgggaggcagaggttgtagtaagccaagatcgcaccactgcactccagcctgggccacgggagtgaaaccctgtctcaaaaaaagaaaaaaaaaaaaaaaaagaaaagaaaatatacctgtaagttaaaacctttttccttgggcagctatcagtgggggctgggggaggcgggagatgtttctgagcttcccaagtagcccttagagagggcttcccccacttcagggttggcctgagggaaactggtgctggcctcagctccccatacctctctgttgtcttttaacccccatctgggaagaagcagcctctttcttgagctgtgtggggggccaggcctgcgtgcttcttcctcctgtcggctctgacttgctccacagttgtggaggtgggaactgacagccctgttacggctgaagcagcaaagctcagagaggctgagtgacttccctaaagtcacacagtagggtggctgctctgtggatgatgcctaggtcccggaatagagactccgcccagtcctgcccccgtggaaaaaaacatgggcccagaagtcagacatcccaagtttttgtctgggctccggccccttctaactagttttgggcattaaggtggcagtcatggtgcttgtcctgcctaccatgcacggtcattctgagagcaagggaatcaggtgtcccaggggcacgccgtccatcagggggctgatgtgtacaggggctgctggcttccctccatcccaaggttctctatccccgttcctctgattcccggattagcttgtttggactaactggctcatgtcttcatcctccagataaaatcttatgttgaaccgtagccttctggggacctgatttctttttcttcttttctgcattttactagaaaaaatctcaaacatacagaaaatttgaaagaattgtagagtgaacacccacatcataaactggacaaaaaacattgtgctgtatttgggtggctgcatagacataatttcttcatgccaaggaataactgtgatgaggggagatcgagggctcctagcagccgagagagggaggcatttgaggataagaagttaaggcagcaatccctggagtgccaccagtgagcggccatatgtctgctactcctgatcctacagtccttgtatttggggggtggggcagggggtagggcagttatcaaacaagtcaacaataaataaataacatgaaaataaaaagggctaactggaacacatggacttcctactaatgatgcctcattgagggttagagcaaatggctggctctcttgcgaggaagctgagacctgagaaatgtgcctttcatagacaaggtagggccagacaggtctagaacctttttatatccagagcctggagcaggaccctcaggacagctgtcagaaatgatggcagaagggccgggtgcggtggctcatgcctgttatcccagcactttgggaggccgaggcgggtggatcatgaggtcaggagattgagaccatcctggataacacggtgaaaccccacatctactaaaaatacaaaaaaatagccaggcgtggtggcgggcgcctgtagtcccagctactcgggaggctgaggcaggagaatggtgtgaacctgggaggtggagtttgcagtgagctgagatcgcaccactgcactccagcctgggcgacagagtgagactccgtctcaaaaaataaataaataaataaataaaaaagaaacgtcatctctactaaaaaaaaaaaaaaaaaaaaaaagagctgtgcgtggtggcgcatgcctgtaatacaaactactcaggagtctgaggcagaagaattgcttgaacccggtgggggcagaggctgcagtaaaccaagatcgtgccactgcacttcagcctgggcaacagagtgagactgtgtcacaaaaaaaaaaaaaaaaaaaaaaaatgatagcagaagggaagcagaagtgaggtggggtgaccaacccaggtttggggaactgttttttatcaagaggctttcctgtcccctcgatggaaaaagaaaagaaaaaaaaaataagagcttgtcccaaaacagtgtttttcttaaatatctgactcatcttctttttaacttaagaagaatggattccattttatcttgtttaagcagaaaatgaaggaaaaataaaaaataaaaatcagtttggggtaatgacagatggtgagaaagaagaagaaaaggatgtggggttgggagaaggagaagagggaaggagagagggcatggagcagatggtgggaagtccagcagggcgggaagtgcagaggctgaggctgggaccagcagggaaaggcttgagggcgagatggcgggagcagggcagccgcgtctgggaagatgggcaggtgcccagagcagcttggaggcagtcgtggcgggaggtgggttggggcctctgaggctgtggtcccaaccatgggctctggagtcagacctgggttccagggttacctctgtcacctattagctctgagacttgggtcaagtcactgaatttctgcatgcctgagtttccccaataggaaatggggataataatatatgtaaaactctgtttgacacataggaagcattaataaatgctagttccatgactgtccacttggtctgcagacttcagagggttacagacactcatgtgttcagcaatcattgagcgctctttgaaacatttgttagccagttaattgccttttgcagttcaagtcctctcatctgtaaacctttctaggagactgccgatcagctcaccgcaagcagagtactcttagggctgtggctgcagcagccgagtcacatgatccctgggcctggtaacaccttgcggtcttcataagtctttgcctatacagtagaccatcctggacgaagacccatgactgaatctaataggtgcctagtccatagtaaatcaggctttaattttaggcctgtctgctggttgggtaactctgttctacaagtgtgggtctgcagaacccaggaactaattcctcaagacaatcactgtctgcagatgctctttcttcttttcttttcttcttgtctccttcatcctttaataaaaaacaggccagcggccggggccgggcacggtggctcatgcctataatcccagcactttgggaggccaaggtgggtggatcacttgaggtcagcagttcgagaccagcctggccaacatggcgaaaccccatctctactaaaaaaataaaaattagctgggcatggtggcgggtgcctgtagtcccagccactcgggagactgaggtggaggttgtagagctgggattgcaccactgcactccagcctgggctacagagtgagactctgtctcaaacaaaacaaaacaaaataggagaaggaaagggtgaaagtactttttattcacttgttaaaaaaactactcctcataggaaaatgatggaatgatggaatttcttcctgtttccattcattgcaagtttataacgtggctatccagggctctcatccccccaaattattggtgtcatcacccttgagcacatttttgctcgttgtggtatttcacaccaacccctcaatggggcagtggcctttgggccatcctgaggacaccaagctgccactgctccccacaccccagaggcagccagtgctgatctccccatgagggcatccacttcaggtggaatcgctgactgctcacaccacatcatttatggtccctaagtttttctccttggcttgcccggtccaagggactttattttagccaaaaatgtgggagaaagaaaagaaagtgatctgaagtttttaaagcctaatataaatattgcagagcttccttggaattcaatagcccgccccgtacctcaaaggcttctccaacatgaccatgaaagcagccaaaggcattcaatagggacatcctcccagccttgtgttaaagtcataggttataccattttgttccatctacccatccatccacccatgatcactaactaggatagctgaacacacccatggcttcatgttgtggtcctgccatgtagtaccttgctgtccttaccgtgtataagctcagtgccatgcccttcttccagatgctggtgttaagggttcacatgttgaagttgggagaggggaagcacagtcctagttaccatagctctgagcactcacactgcaggcagaccccagaacacacacttcccagtcccatcaacacctctcctgaattccaggatatacattttttgggttcattggcccattatcatagtaatagacctcttttccgaactcctcttaatttagttaactcagctctagcaatgaagcagcgaatcacagagatacttcaaacagtcatttatacctggcttttgctgaatctcatgggattattttgccaaggcatttgttttgccatcttaattatgttctttttagccaaaaatcatccttccccatcctctggcaatagcaacttcccttgggcagaagtgtctcctggaaataggatcagtgctcaggccacatcaacctggggctttcaccaccgataatctgtgtagtgaggcatcgacacaggggacccatttgagttgttcaagaaaaaaactccatatttctgcacaagaaaaacaaattgtaacaaacagccactctgccaaagaaaaatgctctggtgctacctctctgtagccctagactcatttctttctccattccttgtctcccaaatagatcctttagtggcccttaaggctgtgcccctcacacacattctgtttctgtgcaacctaagtgtgctgtggtgctgtcagatagcgtgaaagcagggggctcacctcccgtgtttccgtgcagagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggatgaggccccagacttcaaggagttcgtcaaagtaaggagccaggctgtgcagagactgggccccagagtggcgatctttgggcagctggatgtgtgaggggctaattcaaaagtctgcaagagtgttcccactagaggccaacagggcctagggtcttggctaagccttaggggactggcactcactggcaagtgtggctgtcaccaaaggggtgggcttggagaggaggggtgaaccctgggcttggaagctttgaaagtgtctttagggatctgttttccagatgctattggtgttatttggatgcatgtttaaatctttcatttcatttgcaaggcccaggcaggtcttagatttcctcttgtgtttaatcgccacatcctcagttctttgctggtctctgcccttcacttgcagagggaatggccaggactcccagtggccccttcattcctttcgcagttggttctgcttgatgtgctcccgccttagacagcctgtgggagtcagtgtgggatgccaggacctcttccttggaggtagcagggatctggagagttgggagtccaccaggggatgtttggggaggtaatgcggatactgctggaagacctgcagctctgggacttggccttggccagtgtgggtctctgctggccgtgctgggccattcaaacagcccccacatctcctggagaaaaaaaggaggaagagaataaaatagcttctgtgaaacaggtatcttttgatgaataaacaacaaaataataataacaggcatatctttggatctcatgcattttggagacaggccatcctcacctgtcctagagtggtgcttgtggaatcactgtggtgaggcacaagcgcagcctcttcttggtcagagcctcatgtgagcttgttgtttctgcctctcatggtgtttctcagcctagacttgccagccaaggcatggggcactctgaggtcattccaaggggagaaagattgctaagaaggaggccttgggtggatggagacgagagagcagatgctgagctgctgggcgccatggaccacctagggtttcagccaagggctgggctcttcctaggcccgagcaagatgagttcattgttggatgcacttgaacttcaggaaagtgctgacaccagcccagagcaggggcctcattgtccctccccgcccctctcctcttcacctctccccacctcctctcagtgggaatgtggcacgtcgttgccagctgcgaggtgttcctggaatgatggtgtccacagctggagcaggtcccggtccctggagacagttatcaggtctcagggctccagtcaatgcagctgcccgtttctaaggcattaaaccagaccacagcctttgacagctaagtggccagaccctgaaactggagtcttgacccccgttgtctgagctcctctttctcagccctgcctggagttcccagaggcacgtgcaggctccactcaaaactagacaatgagatttagcccttccagcagttctggggtgtaaggggaatttttcctctaaccgtatagtcttgtgactcttgttcctgggaatgttataaagtttctgcagacatccagacgaaatattctgtgtaaagccagaatctcatctctgtgcataaggaaccatgcatgccatggagggtatgctgaatccagagtgcagggcttaaccctgctggctgagtcacatctgtgggtctccattctccatctggaaagtgtgtcatcctggacagggtaactagtcaggcccttccaaccccaggtctctcagttgtcatccagataaatgagataatgggtggagagtcctcactgacattagtattgatgtcactaactttggattttgcaagtttcttaagtacatttaaaaacatctcatttcagagattggcaatggatcctcggtgtaaagggatgccactctctagttttatactgaagcctatgcaacgggtaacaagatacccactgatcattaaaaatgtaagtacctgtcttgccttttcaagcaggggacggctttctctgcattggagagggctggggtcatggacaagattcccagtgaacatatctggtaactgttgtgtagaaagcacgagacaacaaggtgtcacagaggtctgcttggtaactcagaaagaaaagctggtttatcacgcaaagagctggctgggcacggtggcccgcgcctgtaatcccagcactttgggaggccgaggtgggcagatcgcttgagcccagaagttcaagcccagcctgggcagcataatgagaccctatctctattaaaaaaaaaaaaaaaaaagagagctaatactgtgtccggaattggtgggttcttggtctcactgacttcaagaatgaagccgcagaccctcgcggtgagtgttacagctcttaaggtggcgcgtctggagtttgttccttctgatgttcagatgtgttcggagtttcttccttctggtgggttcgtggtctcgctggctcaagagtgaagctgcagaccttcgcggtgagtgttacagctcttaaggcagcgcgtctggagttgttcgttcctcccggtgggctcgtggtctcgctagctcaggagtgaagctgcagactttcgcggtgttacagctcataaaagcagtgtggacccaaagagtgagcagcagcaagatttattgcaaagagtgaaagaacaaagcttccacggtgtggaaagggaccgagccggttgccactgctggctcgggcagcctgcttttattctcttatctggccccacccacatcctgctgattggtagagcccagtggcctgttttgacagggggctgattggtgcctttacaatccctgagctagacataaagattctccacgtccccaccagactcaggagcctagctggcttcacccagtggatcccacaccggggctgcagctggagctgcctgccagtctcgcgccatgcactcgcactcctcaggccttgggtggtcgatgggactgggcgccgtggagcagggggcggcgctcgtcggggaggctcgggctgcacaggaacccacggaggcaggggaaggctcaggcatggcgggctgcagtcccgagccctgccccgcgggaaggcagctaaggcccgctgagaaatcgagcgcagcgccggtgggctggcactgctgggggacccagtacaccctccgcagccgctggcccgggtgctaagtccctcattgcccggagccagcagggccggccggctgctccgagtgcggggcacgccaagcccacgcccacccggaactccagctggcccgcaagcgccgcacgcagccccggttcctgctcgcgcctctccctccacacctccctgcaagctgagggagggggcttcggccttggccagcccagaagggggctcccagagtgcagtggtgggctgaagggctcctcaagtgctgccaaagtgggagcccaggcagaggaggcaccgagagcgagcgagggctgtgaggactgccagcacgctgtcacctctcaatactgcacagccttcagatgtgtgaccaagtggcttctaccttgtaagtcagaaaatgagagcttagtcgttgattctttttttaatttttttttttctagaagaaaataacatggaatcacagaaacagtctgtggtctgtgcctttctcccttgactctttcttaaagacaggcccagtgcctctaggccttgattttcttagcagaaaagagaaagaaacgtaatgctacgacctgtcttcagaaggccattgtgaaacactgtattagtccattctcacactgttgtaaaggactgcccaagactgggtaattaataaggaaagaggtttaattgactcagttccacatggctggggaggactcaggaaacttacaatcatggtggaaggggaagcaaacacatccttcttcacataatggcaagaaggagaagaatgggagcccagcgaagggggaaaccccttacaaaaccatcagatattgtgagaactcactcactctcactagaacaggatgggggaagccaccccaacgattcaattatctccacctggtctctcccacaacatgtgggaattatgggaactacaattcaagatgagatttgggtggaggcgcagccaaaccatgtcagacactgtgtgttgatattagatgattgttcttctcctgtcactttgagaaagccgataccaaaagaaaaaagaaagaacaaaattagggtttcagtgtccccacctgtaaaatgagtgaacagatttagatgtcctctgagcctatgtttgtaaaaccacagggagtatagctcctggaaagaggttttagatctggttccttttaatggaaaatggtgtttagaaactcagatgtgggcactggcgtgctcattgctactggggtgattttgttttgtgttcctctcggtggcagagctgggaaatatatgaatgtcttttcatgcacacatatttacatatgccaatgtatatacacatatatttatatttatttctagatccatctatccatgtatattagaactcatgaattcacaccagtacctcctattctaatccaatactgcagaattttttccagcctttccccttctgcctttgtaactccctactctgtgaagagcctggctctcattatcctcaatgtgtttccttatttgctcagtcttcttacatgtgacaaaactccctcccacataagccatctcctcagtccagccccagctcaactccacaaaatacactgtggatctttggctgagttaaatacttagttttgaagtaagttttcaacttactgttttctctcttccaacaccacagttactatttaattagctcagtacttctcttttttctcccaatgtttaattgcaaattgaagttgaaaacaagcttttaaaataggtgttctatatctagccaatgggagaaaaactaaaacaagaaaaggactgcatggcccaaatatttaaaagggggaaaaaaactcattatttgcagaaacacgattgatttcttccagagcacccacaaaaatgaactgaaaaccagctgaactaagaagagaattgaaaacagtggtcagctatgagatacatatgaaatctgctaaagtactaatactaaatatttttatgatactgatgtggagaaattcttagcatggtctcaaagacatgctaatcctaaacttaaaggatttagatcatagcaacctaaaaaatacccaaactttcatctgggcatagtggctcacacccataataccagcactttggaagaccaagacgggtagatcacttgaggtcaggagttcaagactagcctggccaacagggtgagaccctgtctctactaaaaacacagaaaaaattagccgggagtgatggtgtgtcaggtttgaggcccagctgaggtctgaggggagtgggtgaacgtggggcagggagctggaagaacacttgagagacagcaggtagatgggacatggcacagaattgtgcacctgcactctaatccccctgagtcatgcaggctgtttacatctgcgtatgcctgcctggttgcagcacagccatgttccctacatgatgtgtatctgtaatcccagctgctcgagaggctgaggcaggagaatatcttgaacctggcaggcagaggttgcagtgagccaagatcacaccacagcactccagcctgggtgacagagtgggactctgtctcaaaaaaaaaacaaaaaacaaaaacccaaattttattctggggaacaacgtatatgttcattaatgggaatggttaaataattatggtagatctgtactatgaaaatatttaaaaagatacagagcaacttctactcatgtattagtgtggaaagacactgagaaaatgctgttatgtgaaaaagcaacactaaactcactgagcaatcctatggtatgatgcattttgcaagaagaggggaaagagctatgattgagtcactgcactccagcctgggtgacagagtgaaactctgtctcaaaaaaacaaaaaaaaaaacaaaaaacaaaaaggccggatgtggtggctcacacttgtaatcccagcactttgggaggccgaggcaggcagatcccgaggtcaagagatcaagatcatcctggccaacatggtgaagcccgtctctactaaaaatacaaaaattagctgggcatggtggtgcatgcctgtagtcccagctactcaggaggctgaggcaggagaattgcttaaacccacgaggtgaaagttgcagtgagccgagatcgcgccactgcactccagcctggcgacagagcgagactcagtctcaaaaaaaaaaaaagaaaagatagaatatagaacttgaagttgctgagaggcagtaggcagtatggaatagcagtgaagagcacatagcctggagccaggctggctggggtttgaatcttgctacttaaccactgtgtgctcttgggcaagttgggcctcagtttcttgtctgtaaaatagggacactgatagtacctactgcatagtgatgtgggaattaactgagttaatgtatgcaaagtggctcatactaggcagtatataaatgttagttttatcattgagaacacttatgcgctaaatgtacaaaaagttcacactcacaggtaataaaagaaaatacataacaaaacaagaaaatactttgattttggcttgccagatgagcgtatattgaaaagattataggtcccagtgttggcaaagatctgggtggaagttaaattgatacagccttttttggaaggcgattatagatcaaactataattcctctttggctcagcaattccacctctaggaatttattctaaggaaataatttaagaaatattgaaaagttggaagcaacataaagttttatgggaaggtaactatttagacgcattgtgctcaataacgtgctcaatgaatattggggtctaccccaataatgatatattataaaaccctcaaaatgataatatgtatgaaatggacatggaacattgtactataaagcaatgtatgaaatagtacagtataaaatggtagtttttgtaaaatggtagtatgatccaatttttatttttatttttatttacttttttttgagacagagtctcgctctgtcacccagtctggagtgcagtggcacgatctcagctcactgcaatgtccgcctcctgggttcaagtgattctcctgcctcacccttctgagtagctgaaaccacaggcaggtacaatcacgcccggctaatttttgtgtttttagtggagacggggtttgaccatgttggccaggcttgtctcaaactcctgacttcaagtgatcatcctgcttcggcctcccaaagcaatttttattcttgaaataatggggagattattagtgatttttaggttctttataactttttgaattttctaaattttgtacattgtacaatattacttttgtcattagaaaaattgataaacctgtttgaattttgaaactaaacaaaacaaatgaatttactcaagccagctgggtgggttcctagcctgtagtagtggttctcagatttgactgcatgttagaacatctggaaacctctagaaaacccctaagcctgagtttcaccctccagggattttgatttagtcatggatgaggcctcagattttccaaaaggattctaacgtacagtcaggattggcccagaggttggggttgttgcttggaattgatttgtggactcacaagacatagaaaacagtgtgtgtttttctccatttgagcatctacttaggactttaaaccacggtatgcctttgggataagatattcagagtcagggccatttacattgtttgtatgtggacaaggcctgggcaaatatgccctcggcattctcctggtacacttcaaaggtggcttagggtctttcttcattctccagcacagggtgataattgtttttaggggcctggaagtcctttgaggatctgatggtaatcactgttgcttattgagcactttctaagggccaggtgctttgccaagaggtccacgtgtctcatttagttctccacacaccatataaaggaggctattaacctctccatttctcatgcgaggaacctgagactcagaacatttatgtgggccaggcgtggtggctcacgcctgtaatccccgcactttgggaggctgaggcaggcagatcacttgaggccaggagtttgagatcagtctggccaacatggcgagacccccgtctccactaaaaatacaaaaattagctgggcatggtggcgcacacctgttgtcccagctactcaggaagctgtggcaggaggattgcttcaacctgggaggcagaggttgcagtgagatgagatcgtgccactgttctccagcctgggtgacagaacgagacaaaaagaacatttatggctgggtgcggtggctcgcgcctgtaatcccagcactttgggaggccgaggcaggcagaacatctgaggtcaggagttcaagaccagcctggccagcatggtgaaacccccatctctactaaaaatacaaaaattagccaggcgtggtggctgtagtcccagctactcgggaggctgaggcagaagaattgcttgaaacccgggaggcagaggttgcagtgagccgagatagcgccactgcattccagcctgggcaacaagagcaaaactccgtctcaaaaaaaaaaaaaaaaaaaaaagaacatttatataaccaacccaaatcatgggtggtctgtggtggggcagggatttaaattcaggaggtccagctccggagctggcattcttagccaccaccccaaatggtctgcttagaaaagcgcacacttgctctgatgcacccgtctgcatgtggttccagaggcgcgtggacccaggaaggagccacccttgctgcagccaccgctcctcttatgccccaggctgcatgctaagcatagactgcgctgtccctgccctgccctccaagggcacctgttggctcttagaccctcatcagtgggttgatggaacactgcacatcaaatgccagaattgcattgtatgttccccaagtgagtgaacaggtgggaaaatagcacggaactgggcctgggatgcctgggctctgctcctggtctcagggactagtttattcctctgtgaaacagggtgaatattttctttttctttctttttttttttttgagacggagcctctctccgttgctgggctggagtgcagtggcgcaatcttggctcactacaacctctgcctcctgggttcaagcgattcttctgcctcagccccccgagtagctgggacgacaggcatgcgccaccacgcccagctaatttttgtatttttaatagagatggggtttcaccatgttggccaggatggtctcgatctcttgaccttgtgatctgcccaccttggcctcccgaagtgctgggattacaggcgtgagccactgtgcccggccaagggtaaatattttcaaagagaaactctaagggccccatggttatatgtacacactgtgatcctgtgagtctgcatgtgtggcttggggtccaccctgcgatgttaacattttgccggacagatcacatagcttgccctggacattcagggtgtggggctggactgagacctcaaggatgggaccattcactgcttcccgcaatgccacccactggagccatcaaggagtggccgtcatctgctacgtgattgccatgtgggtgctcagagctgcgattgctcaagtgggcgccgtccatgaaaggatggtgccctgccccgctgggcctggtcctgcaggaccctggatcacaggcccgcccacattgcctaaaaggaggtggttgtttttattctcctgtgtagatcctggaaaacacccctgaaaaccacccggaccacagccacttgaagcacgccctggagaaggcggaagagctctgttcccaggtgaacgaaggggtgcgggagaaggagaactctgaccggctggagtggatccaggcccacgtgcagtgtgaaggcctgtctgaggtagccaaccttggggctgggccctggtctcccccggcagagcctcgcctgccagcctggaggaggacaaagaaaagcatgaaccattctcctccccagccgatagcatcctcatttccatccagctgcttctcatctgctgtttcatccacccactgagtatttatttatttatttgagatagagtctcactctgttgcccaggttggagtgcagtggcaccatctcagctcactgcaacctccgcctccccggttccagtgattctcctgcctcagcctcctgaatagctgggactacaggcacacgccactacacccggctaatttttgtatttttagtagagatggggtttcccgtgttggccaggctggtcttgaactcctggcctcaggtgatctgcccacctcggcctcccaaagtgctgggattacaggcatgagccaccgcgcctggccatccactgagtttctaatttaaattatatcatttcccattgccagaagttctatttattttctcctgtctgctgatttctttctttctctttctccctttttctttcctctttctttctttccttctttctttctttctttctttctttctttctttctttctttctttctttctctctctccctctttctttctttccttccttccttctctctttctccttccttcctctcttctttttctctttctttccttctctctctctttcttctccttccttcctctcttctttttctctctttctttccttctctctctctttctttctccttccttccttccttccttctttccttccttcctttctccttctcttctcttcttttttcttttctttctttcaacaggatcttgctctgtcacccaggctgctggaatgcagtggcacaatcccagttcaatgcagcctggaccacctgagctcaagtgatcttcccacttcagcatcccaagtagctgggaccacaggtgcatgccaccatgcccagctatgctggtttctttcttgtatcttgttttttgctcaaatgttaatccttcttatttatttcttaacacattttaaacatagatattcctggccaggtgccgtgactcacgcctgtaatcccagtgctttgggaagtggaggcaggaggctagtttgtgttcaagatcagcctggaaacagagtgagaccctgtctatacaaaaaaataaaaagtaaattagctgggtgcagtggttcacacttgaggtgggaggattgcttgagcccaggagttcaagggtaaggtgagctatgatcacgctactatactccagcctgggcaacagagcagaatgtgtctcaaaacaacaaacagatatagatatagatgtagatatagatatagatatagaacccataacctgaagttatgggtgttattgttttgtctgttgtttctgccagctcttgctaaacttactaccttgtttcttgtattacgatttttgactgtgaactaaatgttccttagaactttacctgtgggcaccttttttttttttgaaatggagtctcgctctgtcacccagggtggagtgcagtggtgtgatctcggctccccgcaacctctgcctcccaggttcaagcagttctcctgcctcagcctcaaaagtagctgggattacaggtgcgcaccaccatgcctggctaatttttatatttttaggagagacagggtttcaccatgttgaccagtctggtctcgaactcctggcctcagaagatccacctgcctcagcctcccaaagtgctgggattacaggcgtgattaccgcacctggcccacctgcaggcatctttattgtctgaagttgtattccttctggaaggactgttattgtgattatccaaaactatgtttagaggggtttgggcatcacagcccttgtgtgaatcgtggttgtaaacttgcgtgagagctacctgataaagcacacattctcagggcacgttttccttcactacaccaaggtcaaaaacagaaatgttttattgctcatcccctctgagcttgagtttacctgtcactcctcctctgggttcatctttttgtgaagatctcctagtagacccctcacgttggctctggatgcacctgtttctgcaccctatgtagtgagtaaaatgcaaggtcagcgtcagcagattcaagagagaccctcaaagctatagtggcactggctttcggtgatcttccaaggttcctattttcattctgttttcagcctctgcaaatttcttactttgtttctattttgtgtgtgtgtgtgtgtgtgtgtgtgtgtgtgtgtgccagttttcttggagttaaaaagtggatttttgcatttttctgtttttttaaagtttttgttgggtgagtcattctgagtatctagtccactctacttccagcaacagaagtctctctctgtctctctttctctttctctctctctttgtgtgtgtgtgtgtgtgtgtgtgtgtgtgtgtgtgtgtttgttttagtcagggtctcactctgttgcccaggctggagtgcagtggcacaaactcagctcactgcagcctcaacctcctcgagtgattctcccatctcagctttccaagtagctgggactacaggcattggccaccatgcccagctaatgattctattttttttgtagagacaaggactcaccatgttgcccaggctggtctcaaactcctgagctcaagcgatctgcccgccttaacctcccaaagtgctgggattacaggtgtgagccaccacgcctggccagaagcctctcatttggtttctaattttcttcttttcacttaacctttcctttggtctcattcattctttttgcccattttttctctctgtttctgtatacacatgtgcttgtgcctgtacacacatacatacatgcatgtatgcacacacatacaccattcactagggtttcccaaaatgaccagcgagaatgtgtctccctcatccactcctcctgtggtttcttccctctcataagctgcaaaggccatcaccacctgagggagtcaccatgactggttcctccacggccccatctcctgtccaccttcagtgttggtgtgggatgagcaaaggtgtggaagcagccccgtggaagccgagaggacagctgtgggctcccattttgggattttgtgttgctctgctgtcagtgggtggctcatttattcgctcatcatcattcattcaataagcacttagtgagtaaccacccatgtgccacggctcagtactaaaccctgggacataaaaacaaataagatgtgactcccactctcgaggagcttatggtccaggaggaagctgggggttaaaccaacatttacaacaagatgtgaggggtaaggaggcagagctaggtgccaagtgctgtggcgacatgtgacaggagcaagggacagttgtacgggggactctcgggccctggaggtgatgcttgactgcgtgttgcaggatgaagcattggaggcaggccaagcaccgtgtctcaggcctgtaatcccagcactttgagaggccaaggcaggaggatcccttgaggccagaagttcaagaccagcctgggcaacatagtgagaccctgtctctacaaaaaatgtttagaaaactaaccaggtgtggtggcatgcacctgtagtctcagctacttgggaggctgaggcaggaggatcgcttgagcccaggagtttgaggctgcagtgagccatgatcgcaccactatactccaacgtgggcaacagagcaagaccctgtctcagaaaaaaaagaaagattgaggcagggcattaggagtggaggaccattctgagattctgagcagggcattggtgaggattgcagaggaatgatgggccacagggctgcagggcaggctgaggcccagccgaggaaggcctgtgtataatgcaaaggaacattaacttgatcctgaagacaagggactcaagcagcccctgcactgccacgcagaaatgccgacacacagtcatgtgcactttagaaagggcccttccccgactctgacagctgccatcagagggacacagtgaggccgggatctgaagatgttaaagtaaaatcagttgtcatccttctttttttttgagacagagtctcactctcttacccaagctggagtgcagaggtgcgatctcggctcactgcaacctccacctcatgggttcaagagattctcctgcctcagcttcccgagtagctggaactataggggcccagaaccacacccagctaatttttgtatttttagtagagacggggtttcgccatgttggccaggctggtctccaactcctgaactcaggtgatctgcccacctcggcctcccaaagtgttgggattacaggtgtgatccactgcatccagcctagttcttgtgctttgattttttcagcttacatcccccctttgccatcagatggctgtccttcttggtcagtcttcctggctatcatgcacagcgtcgttgttgtcttgatgatgttcatggtgatgggaaggggatgtgttgacttctgtctcctgacctaggatcacggtgtggaccatgcgtggcccaggtctggacacacaccagtgattaagtttcaaacagatgctgtttttggcattcctgtctgaagatagagaagtttaaatactgttcccagttcatgcatattcagtgttatcttggccaattagaggctttgagtatgaatgaacgagagcacctttatgtcattggatccaatgacacttgccttctctggattatttgcgcccacgtggcttgaaccctgtcttggcaagcaggaagggctggttggtctccaggctcctgcctggagtgcagaggtgaagaatgttctttgaaggttcctgttgtggcaccaccttcggtctttcttgggctctcagaccctccacaggaggtcagaggtcatctttcctcctcgtggctgacagcagagtgcagtggcccctttccagctgcctttagctctccactcacagaagtgccactgtttctcctgtattggagatggacaggtggccatcagcttcttttgggggacacatgttacgaacctatcactccttcacaaatactctcttcagagaggggtccatagggctcgtagctcaggacagagctccggagcgccccccaggccaattgtgtgggcagatggggagcgtgaggggctggcctcggactgggtcatcttactcctggcgcgcagccatggccttgctatccttggcctctccccttgctgtcaaaaagggggcctctgtgggatcatctccacctcagtgccctctgccccttcagaacctagtggaggtgatggacccccgagaggtgttagagccgcgtttcagcgcccaccgtgtctctaagggtcagtggagggagggagctgttcccttcctgtttgctgagcgggtgagtcgggtgaggtttcatgtgcgcagtacagtgtctgttctgtttggcactggagggtcgctcaacaccactgatttacagctgggtatggtggctcacgccggtaatcccagcactttgggaggccaaggcaggtggatcacgaggtcaggagattgagaccatcctggctaacatggtgaaaccccgtctctactaaaaatacaaaaaattagccgggcgtggtcgcgagcacctgtagtcccagctacccgggaggctgaggcaggagaatggcgtcaacccgggaggcggagcttgcagtgagcagagattgtgccactgcactccagcctgggcgacagagtgagactctgtctcaaaaaaaaaaaaaaaaaaaaaattaacaccactgatttgtgcagtcacacacatgccaggggcccggactgcagttgtgccttggaaggcagcatttgtccatggaattggagagagacgggggctgctgctttccagaagctcaaaggactgtctgaatctgtgtggggttttctccctggagctgtttcatgcacagaccctgcatagagcagggagtccccaaggtgggagccaggtgggcacttttctttctgctgccccatttccccagtaaataaaaaagagaaatggccaagcccagtggctcacacctgtaatcccagtattttgggagcttgaggtggaacgatcgcttgaagtcagaagttcaagaccagcctgggcaaagtagggagaccccatctctacaaaagtttttttcacatgtgttggggggctgagatgggagaattgcttgaacctgggaggtcaaggctacctgaactatgatcacaccactgcactccagcctgggcaacatagtgagaccctgtctcaaaaaaaaaaaaaaaaaagaaaagaaaaaacacaccagttgcaccataagacactggcatgctcctagaggaaaagccttagaaattaccattgagactcttcttgatacttggaatcccctgaactgtgcctttgtctgactttgatctcttggctccaaagtcttcaaagctatccttgacttttgcctgagatccgagtctgctggggcctggcctctgattctgatggagcccatgctttcagatgcggagaaacaaaaatgctacactttgggttttgttttcctttctcagcaacttgtgttcaattcagtgaccaattgcttggggccgcgcaaatttctgcacagtgggaagctctacaaggccaagagcaacaaggagctgtatggcttccttttcaacgacttcctcctgctgactcagatcacgaagcctttggggtcttctggcaccgacaaagtcttcagccccaaatcaaacctgcagtataaaatgtataaaacagtaagttggattctagattttgcattatcagggttgacgtgtttggggaggaagaagtttccaaaaaggaggtagagttttagcagggtcaggggctgtggcatgcaggagaaggccaggagttgaaatgcgatttagggtgtccggagtggaggacgatccatatcccgccgcagtgtcagtgacactcagtgctatcggtggaacatattggctgccaaatggctgctgtggtcccctgggatgtgacagaggcatgctttagcctgtaggagcgaagtctagggtacagatgaggcaggtgtgaaaaagctcgggagaagaggtgcaaaacagcacccagggcccaccgtcgcctccaaacagtcctaagtcccctgccagacttctccaggtagcttgaaacatccgagccccctcctttctagcaaagtctctctaaacagttgatacgtggagaatttccctcagctgtttatatggtctgctcatacgtgcatggctgtgtttgtgtgtctttgtgtcacgggacgttgtttttctaaatttgtctgcatgggggtgtttttacagaagaattttctctgaggcagcagttagctttattatgggaaaaaaaagagctatgtagttatatagttactagaaacttcatgtgaaaatctttggagggaattgcttgatgtaaagtggatgaaaactgctgtttagaatacaccaggaaaagcgacaccagccagatcttattctgaaagacttaaaacatacccgcaaaatcgtgggcgggggaacccatatttatcatatttataatttgtaatatgtaaaagttgatgctaacccaaaattattattctgggattctttactggaaaacacacacgcccttagtctggtttactggaacacacccagaaacacacacacatgctcagtctaggttactgaaacacacgcacgagtgtgcacacacgcgctgacttgcagtctcgtttactagaacacattggcataagtgtgctcacacactcacggtttaccggagcacacagacccccagcctcgctttgtaatgcctgtgtgttactttccagcctattttcctaaatgaggttctagtaaaattacccaccgacccttctggagacgagcccatcttccacatctcccacattgaccgcgtctatactctccgagcagaaagcataaatgaaaggtgagacctgccgcctccccagcatgggccccagggctccacggctctaggacacacaaggggcgggtgattaatcaggtgccaatgtttcccaagtggcaatgccatcacccctagctgggagtggggatggggctattacttttttctacagcctctcaaaaatctgtcacatggcatgccctttccaaaataacatggattcaaactaattttgcttgagtttttttttttttttttttttttaaggcagagtctcactctgtcacccaggctggagtgcagtagtgcagtcacagctcactgcagccttaacctcctgggctcaggtaatcctcccaccctagcctcccaggtatgtgggactacaggcatgtgctaccaagcctggctaattctttatatttttttgtagagatgggttcttgccatgttgcccaggctggtcttaaactcctgggctcaagggatccacccgccttggcctcccagaatgccagaattctgggattacaggggtgagccactgcacctggcattgttgttgttgttgttgttgttttattaagaaatgtttcgcattctttgaggtaaacagagcatctcaggtttcccctggcttcccaggtggcagaaaccaataggaaagtaatttcggggttaataggaccacgcaaacccaaacctctcctcaccttggctgacttaaatgggcattctggaacctagggctgtgggtattttgcttcaatctgtcttcaagacactgccctggagccaaatgaaatagatcattttctgaagggtgaacttgacacaaggccagcatcattccaaagagcatttgcaccaagcaagaaaattggctaaagcttttgtgcatatggttctcagaaaaaatgaaggagaaaaccgcggccacaaatgccttcccccaaggcgttttggtctttcgtgtgaagtggttcccaatctgggaagtggtttttgttctttctttgcgtgatttcataagcgagatccttctggctttgttggattaggcaaatatgtgctgctcttcggtaaggaaggaagaggagtcgtgtcccgatgttgcctccaagacagcatctatcacagattttcttccccggggacatcatcgcaggtcttgaggacatccatggaaatggccctcatgcctttcttatcgatggcaggaataagtattagcgtcacgtgacataaaatcagattttctttcccgagcctttgttgttaaaatcaaatgaacaaagaaacagagtcctggcaacagtgtttgaacagacctgaagcctttttcctgagtttctgtttggcaactttctgtctttttctgtccaaggactgcctgggtgcagaaaatcaaagctgcttctgaactctacatagagactgagaaaaagaagcgcgagaaagcgtacctgggtaatgcatggccccgcggggtgtcctgcacagctgggcaggagggagggccatttggctgggctgaaaatcctcagaatagaagaatcccctggacctagaggaggggcatggaatgagatggaagtgagcttggggtgggatgcagatggggatggagggcaaattccaggagcaaggaagcaagtgtttaaggagagggaagaattacttttgagtcgggagaggtacatgaaatgcattgtgaggctcacagagatgggaaaggtgtggcacgttcaaatgaagcattttgtgtttttcctgccgtcatagtccgttcccaaagggcaacaggcattggaaggttgatggtgaacgtggttgaaggcatcgagttgaaaccctgtcggtcacatggtaaggctgtgaggcgcccccggctcctgctttggggttgggagtagggtccgggttccccacacccccacctggctctagatcaaatgtgctatttccatactccctgatctccttccagaattggtttaactagcacttgttaaaaacctggaggttttgtgtttttttttccatcctttctaccattctgcttctccgagggatctgagtggctgcattcacagtggatgtgacacaagatcaggccaaagtaacgagacaggaagggcctagtttcaaagcccactcaattaagtatttgtttttagtttaaggatgaagctgacttctgggagtttccacccggattctccaccgaatgacacttattaagcatagcagttattaagagtggggagcggccgggcatggtggctcacacctgtaatcccagtgctttgggaggccaaagcaggtggatcacctgaggtcaggagtttgagaccagcctggccaacatggtgaaagcccgtctttactaaaaatataaaaaattagccaggcatgggggcagccacctgtaataccagctattcattcaggagactgaggcaggagaatcacttgagctcaggaggtggaggttgcaatgagctgagatcataccactgcactgcagcctgggcgacagagcaagaatccatctaaaaaaaaaaaaaaaaaagagtggagatcaaaatgaggtgtgagttccacctggcgaaggcttttgttccctccaggaaagagcaacccgtactgtgaggtgaccatgggttcccagtgccacatcaccaagacgatccaggacactctgaaccccaagtggaattccaactgccagttcttcatccgagacctggagcaggaagtcctctgcatcactgtgttcgagagggaccagttctcaccagatggtgagtggaacgcggccctgtggttattcctccttccctggcactcgtttgcgtgggttaatgttttcttacctggggacttggtgccaggattccttcggtttccctcctgagagatgaggctggctggcacaagacgaggctctgtctcccctggaggagtcttctggaggcgtctcattgcatgtggacagagcatgcttggtctagaattgtgccagctgccctgggcaaacacgtccatcttctgctttccaaagcaggtgactgtggagaggggtgtgtttaagagcctcagcatagttcttcagtccttggcaaaaagctgtgctggcaatggatgaaactggccaatggaacaaggatgttagcccacaacaggagccgcagaatgggccaggtccctttgggtggcatttttgtaccacttattaagtaggcaaagggatgcagtcatgttgaatgaatcatttcttcagccagccttctgtttctgcttgggcctggaaaagaatagtctcagcccaatgattccaagaaactacctgtctctccctcaacccaataaaaatcaccggtgggcatggtgctgcaggcctggaatcccaacactttgggaggctgaggcaggaggatcgcttaagcccaggagtctaagaccagcctgggcaacatagtgggaccttgtctctacaaaaaaatacaaaacttagccaggcatggtggcatgcacctgtagttccagctactcgggaggctgaggcaggaggattgcttgagcctgggaggtcgaggctgcagtgagccatgatggtaccactatattccagcctgggcaacagagcaagatcctgtctccaaaaaaaaaaaaatcacagagtaagttaaaagattatggtctcaacttaattataaccgaagaagtgagggtcaaatgctagcattatctgtacaaggtttaaatggctccatatggccttcatcttttagtactttttatatgaattatctcattgtgagttaggtactcgttgtggtagctggttaaatgtttgagtgtgactggaacagtttggctcccaagtctgggctcttaactactatgtgtactgtcaacttctaattcttttttctttttattttttttatttatttatcttttttcttgttgttctcgctctgtcactcaggctggagcacagtggtgcaatcacagctcactgcagcctccacctcccaggctcaagcaatcctcctgcctcagcctcctaagtagcagggatgacaggcatgaaccaccatgctaggctaatttttaaaaattttttgtagagacagggtctcactctattgcccaggctggtgtcaaactcctggactcaagtgatcctcctgcctcggcctcccaaagtgctgggattacagacgcgagccactgtgcccggccaccttctaattctgagagataaaggttggggttgggtttttttttttatttaagtaatgaaataccatgacacattggcaactccgctggggagcgagttggaaatcctagtgttggtttacatcagagcccagagaagaagggagagcataacagttcatcagggggtccccaatatgccagacatgtgcctcgaagagagggaatggtccctcttaggagggtctgtttgttctcttttcagattttttgggtcggacggagatccgtgtggcggacatcaagaaagaccagggctccaaaggtccagttacgaagtgtcttctgctgcacgaagtccccacgggagagattgtggtccgcttggacctgcagttgtttgatgagccgtaggcagcgggctcagggtgtgctcagcagggtcccagcccacggccacacatgctgtctggaaattgtattccttttctaagaaaccaccatttggtattcagtcacagggatatgggatggcaaagacaggcccctcaaagctcctaggaatcattctcgacaatcctccctgccccgaaacaatttcctgtttcatgaaacaaagctgtgttttcctttgtcctcactacaggtctcattatggcttctagggtcgctgaaatcccatagccctcaacagggtgcagctgggagtctagccccttcccgggcttgagggatgggtctggttactataaaatagatttataaatgcaatgtctatatttttggagaactcatgtaaccctcctgtttcttacatccaccagtccccaagtagacttcttggcctacaatgcccagtccttggtgtgagtttagaaacaattatgacggtcctgtcattgcttcagaatcccatctctcctgcagggaaatgctgcctagagctgatcactcggtgagacggtctgatcaggccctggcttagctctttgaagagctggtctatggaagtttccagcatgtgcaccgttatagccgttccttccccctctaggccttgtattaatatatgtcaatgaaaacacactggtgtattgttgcgtggattcagttctgattcccagcatgcttagaatatggtcacagaaagtcattatctagaaagtcacccctctgctggatcagatcactacaggtcactggaaaggcaactttacaatgttgggtcactgggtctcggttggcagccatgttggaaaaatctcttttggctcggaggcctgtgatatttcatagcagcagtcgttgctggtgacctgttctgtgcttgaatgtgctgaatcctgattgttgtaggacatttcaacagctctttttggtacgttccccaaaaagccatgtcctagatccccaaggcgt

SEQ ID NO: 2554 - DNA, 133282 bp, Homo sapiens
  source 1..133282: mol_type = genomic DNA
tgcatgtaaagtctttagtatatttatttgtataaagagtaaacaaagtgcatatagagtggccacaggtttgacacagagaccttggtgatgtaggctatgaacaaatttaaatggcaacttcattgctgccactgaaccaatcctgaatttgggctcaacaggtgaaaagtaacaatatcaaacgaatactaaacagcataacaaaaagattttcagactcttggtcataaagaccgtaatcgttcacattgaatcaatgactaaacatttttgattacccagctacctccaagcaaactgaaaactgtctagtggatcctgaagtccatagtgcctctagccgggtctttcaagtgttgcaccacagggtgatgattgatggtaaaaacagggatcaacccttgtagatcggtggtaagtatggaaaccctctaagaacagtgcagcgtatgtggtattcagactggttgcatacagcattcaaaaccagtgctggaatagcttgccccaaagtggtagagttataaaaggatatacattgacgtttcttaaaagcatgtgtaatagcatccaggttctgggaatgagttctgattaaaggtatactgcttaggaaagcactggcacaggcttagttcttgagaattaacatgcagcaaattatctattccacagctatccccccatgtagaaccagctttctcaaaaatgggtgctagtgatcacccaaaggaacaggagctaagccactggagaaacaaagtttaagtcctactggtgagagaatacagtcatttttgtacagaaacaatatatactacctggtatctaatattttaagaatgcatggtctagtactgtatagatactgaaatttgagggctaagtccatcaatctttctttatctatgattaatgtgccagcaaaacatttcagatcagctggcagcagggaaaagcaatcatcttcagatattattttggtcaactcctcgttttcaaaaatccccttttggtaatgcagttgtgatggtgaactagccagatgaaatggtggtatattctttccacaaggaggagtgcttaagtgctttcaaatattttggttgtcattatgtgtcactaagttactggtaccaaatttaaagaggaagtccttacacatattaagcactacagtgtgccttatacatgtatatgtactgaagtatgagttcagtgactttttggacagaacacaaacttctttcattagaaatttttaaaaaatgacttgggcatttgttgcaggagaaggacttgataatctgtggaatttaaatgttattcatgcttcttattttaaaagtgcttcaaatccttcaataaggttctgaaagcttgtccgattggatggttggaattcccagcatttcctcataagttgataaacctgtaaaaagaaagaagtaacaacagtaaaaatgttagatctgggaactttaaaaaataacagaaatatcaagagtaagaaaataattttggaaatgcaatgacttttccttaaagactagaaaaacaagagtatttgaatagtttaaaacacagaaaatgggatacaactctagttcataaataatattttaacatttgagaagctcaagggttgactggctgcaataaaatccaggtcattcctgtaaaccagttagagggtgaagcagaatctcagttcagacttgaactttccagactggctgcctcactctctgactcatactgttcagtgtgtcttacacagtctcaagagtttagtattaaaggctcaattcacttagaaaactgaattataaatgctaataagtgggataaacttacacacaaaaaatgcaattatatgtatttgtcacactaaggctacaccaaaacctgtccctctggggcaagcaagtggataaagaggggctggcttttggagggaatccttgctctgaacctaactggtggctatcatctagccccaaaggcgatttctcagttatcttatgtgaaattcagcttcagaaaactattttacaaggacttcactgcatcatttcctcgctctcccctctacccattgctggacaactcaagctgcgaaaacataatagaaatggagtgttattactgtgacgtggcccatagatacctcatctggacagttaggtgggcacggcaggcgttttccttcttttaacgtattcacaagtcttgtgactgtcatctggccatgggttgggcctatcattttcaggaacaactatataaaataaaatcaaacaaaacgtttaactttgcaagtatttacataaatgccaaacagattaaggtgaaatttctacaatcaactggaaatttaagtagcaataaaaaggcttttctccttagtaactttaaataaaaatccaaaatccttattagctttcaatgatctgtctctaaccagtgtcttagactctaccaaccactccttgtgcttgtgctggtcaaggagtctgttcccaagaaaatgatctgatttaggaatgaaggaggcacagacaaggctggtccctacccagtgctaccccacttaacttgctcattttcccataaaactgcccttcatctctacacagataagatccttgagagtcaaggtcatcctatagaactccgggctcgttgtgaaagcaagactttagagattcacaaataactgtcaagtagcaaaccaagttaatgggaaagtgacattttccattataatacattcattggattccatttaaaaacaaaagttaaccaagcagagggatggacacattttaaatgggtactggattcaaatgaagagaaaagtaggacttacagccatgggactagaatctgaatcacagtaagtcagcagctcatgcagagtgactccaaaagaccagacgtcagaggcaatataaaatttagattgcattaaacattctggagcataccttgaaaggaagcagaacacaaaacttcatttcctgggaggcacactccatccgacattacaggataactgaaaaatcacctcttcggtttttcttataatttaatacagcatctgactgtgtattatatattttacacataccatgtatacgctgctatggtgcacatctgacctatagtacggtatcctttacaggctctcggtagcacgtatctgccctaaaataacacgccaagtctgtgctcttcatttcactgagaacatgctctcagggtatgggaggaggtggccgtgtaatgatgagccccaggtctgatttgcctgcaggctctaaatgagacagcagtggcctcactgcacaatgtggcatcgctgtccaatcctcttccagcattgcctactttgctgaatgacacccacttgcccaagccaaaaatgaaggcattccaccgcacccaatctccttatatactccttgaacctactcacttctctcaaaccctactgtcactctcccagtccctgtcctaattcatgctgtcactagctctggcctgagctgttgaagcagccaaatcagactccctggctccagactccctggctccagactccctggctccaatcttgttcccttcattcagtggtggtctttttaaaacaaagtctccctccttaaactctccagcagcatcccattgttcttgagatgaagtcccagctccatgactcaagcttcctcctgcaaacctcctattccatgatctgacctcactgaggttcagttcctgggaaatcgactgctcttgtctcattcttcctagtcacgcatgctgtctagcaaccgtctgtctaaacccgcatgaatctttcaggtttcttctgaatactcacgacttccagaaaaccaagcccgaacccttctgtatgtttcctgctccatgccgttggctgcctagcctgttaaactctaaactcggcctacttgttcaccatatctccagtactggcacaaagcaggaccttgatgcattttcttaaatgaatgaatgagtaagtttaggctccataagtgggagaggtctatgtttgtgtccatgtaggatgcacctaggggagtgctgattggttatgtcgttatgtggttacgtggcagggtgcggtagagatgtaagcagcctctcccctggacagtgttcccggctgagacatggttgtagccagtgtgtggccttctaacctgggaacctctggtgattcatgagacagccaggtctcccgtaggttttgctctgctctgtccaggagttccctgaatctgcaatgcccactctgtcctacagcctccctctgcaggaatgtgtttaagaaaggaactagattctctccacctgctcacagttttaagaactgcatcagatgaatgccctctcctggaaagctaggaatgttgagctggtggttagatttctttcattccttggaagacggtgtcatatgaagctcagtcatttatataggctgctttcaatgaaacaggctgaaaggtgtgtttcttgaagataaatatcaatcaattccaaatgttctaaaccttctctaaccttgagtcaggccagaggaatgagacacattaatatagccagaaagggcctattaaaacagtgtaaactctatgaagcattgataaaacctagtggtttgattcagttaccaaaacacagggctgtcccggtcatccttgacggtgtaatactccttatcggtttcaattgctttggttaaaccgaagtctccaattttcacttggtgttcactctcaacaaggacatttcttgctgccaagtcccggtgaacgtattgccgagaacccaaatagtccatcccctgagagagagaagtaaaagtcaagcacattgctaaagtcactttagattgtattatctatcacttcatcagaaaaaatagaaatgtcatttcattcacatatcactgacaatttttttggttctgacttttatgcaagaatattaagaacaaactgattcaaataaatacacattaaaataaccatatttaaatccgtttactttcttagtagaagctaacttttcatctaaataatgcagagaaaaacaaacagtataattatcataaacttacccacttagagtcaaattacaaaccaattacccaggacagagtgcctgatgtcttaatctgtaacatgatgtctttattttttaccttacaaatctgaacggcatattttagctgctgtttgaggtttattttgttcttattctttggaagatattccttaaggcttcccgaaggcagaaattccatgatgagcttaataccatttcctcctgtttagaaaaaacatccatcagtctgaggctgccaaatgagggaaccatgggagaggcaagggcacaggatatgagacagaggccctgaggtgacgccagcttcgccccttcattacaggcatgttacttgacctcttatgcctcaagatcctcagcagtgaatggagatggtaacaatggtgtacctacctcacaggcataagcactcactgagataacagtcagagtgctctgtaaaccacaggcaaatgactgttttcaaaaattatcgggctgggcgcggtggctcacgcttgtaatcccagcactttgggaggccgaggcgggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccgggaggcggagcttgcagtgagccgagattgcgccactgcagtccagcctgggccacagagcgagactccgtctcaaaaaaaaaaaaaaaaaaaaaaaaattatcatcagctgtcaatttcactaccatgagtagatgctggcttgcaaataagatacaattattagtaaatattacttgccactttgatttagacaactagaaaatgaaataccctggctagtattggatcagaacaggaagtgggtggaggtagagtaggaatcagtttcataaggcataagtgcaagtgacgtggagagacagtgctggaaccagcccctggatggaggggcctgggtggcctcctcaggagccctgcagctgctgagggatttgacatatgacttggaagccttgagagtgtgtgggaaccaccagctagcatgtcagacgcccaggtaaggccacggagtgcctgttttgcactggcctttatgaccctagacagtcaccaaatctttaaaccggaccccagccttgcataacataccgtcttctgtgcagattcctttgtacttcacaatgttctcatgatagaggttccttaagatctcgatttcctttttcagatcagctatgtggttacctccactctcaggcttcagagatttaacagccacctgctcccctgtattgtccccttcggggtcatacctgcagagctcaaccttcccaaagtggccctggagggaaagatgcatgtgctgttatcagggaagccccatcgtaggccacggaacacacagaagtcttgctcctcacagccgttcccctgagggccaggggttctcgctgtctggccttgcaggcagaagcctctcacctggactgtacttgctcactacagccccctcgctctcttggcctcacaaactgtcccctcagttactgagccaagacaaagtagcaggtgacgatgaaccaactcatcaatcccaatttctatgaccacaggaaatgaaggttatttctgggcctgcaggacaactgccgttctctaaaagccctgggctcacgttacaggacaggccccacagcatggctgaaaagagcaaatgcatgaggagtctttagaagacgtgagatcaggttccagccaagccacctgacagcgacagtggtggccaagtccccaaatcggagctggctcctgatgcactcgctgcatacagaaactggcctcggggacggtggggggaactaaggatgccatgcttctgacaatgcctggcacagtggctggcacacagcagatcctggagatgtatcaagtctgtttcattaaccagactacagaaaatctgtataaagacacaaatctcagtagcttctctagtcacaattaactgtttggaaactcccatttaaggtccaaagaaacgctgacactctattttgggattctgtgcaataaacctatccctgctctaaagagccttacagggctgggtatggtggcttatgcctataatcccagcactttgggaggcctccttgcttgaggccaggagtctgagagcagcctagtcaacatagcaagaccccatttctacaataaaaaataaaaaatattagccagcatgggggcgtgtgcctgtagttccagctactcaggaggctgaggcaggaagattgcttgagcctgggaagttgaggctgcagtgagctatgatcacaccactcactccagcctgggacacagagcgagaccctgtctctcgggggcaaaagaaaaagagagaagcttacaggatatatatgcccgggaaagtcagaggcaaggattttcctattccaccatatctatacctactcccccatctctccctctttccattctcttctgtcctgtagagaaaactcaagtctctcaagggagctgcccagagtcccgtgtgcatacacagtcgtgcatgcaggcagggacgtgcattccgtccgtgccgtgtgtcacatggagaaagacacaatcccttgtgatgaaagtggcccccaaatgcagtaaggtgctttcgctcatggacctggccccagaatgaaaaagaatggagagcagctgtacgtgcagagagtggcgctgtggatggcggagggctctgccatcagcagcaagcagcacgggtgtaacttacctctcccaagtcacggatcctctttaggaagcgcttttcaaaatgtgtggggtccacttcagttgctggttttttttctgaaacaatatctggatctaacagaagagaaaagaaaacagagtgaaaggcagtcgattgccagggattgccacccaggctcctgtttctccccaagctgggttaaagcagcacatggcaggtcttactctgctcttcaagcttattaatgtctctcatgatggctcggaagaaaggcctctgattggggtcatagttcatgcagcgggtcatgaggtcagccagctccttacatgatggtgtcactggcctgcaccggctttcatagaatctctctttctgtaaacaagaggggcacatggaagaaaccaaaggaaccacctacaaacttctcagccccaggtcaggtggaattgccaattcctcattcgattctcaacatctccacttacaggtagatttcgtaagtgtttgttactgctgccttattcttgcaaggggaaatcacagtcctaatactgaatagtccaaattcaaggagactgggcactatagcccagtcccaaaaagcttcattcaagtaaaggcatgcagcctttctggaatacaattgggcaacatgtacaaaaatcttcagattcttcaaaccctctgatgcattaacttcaatgactgaatgactcagaaataaatcagatatgaacaaatatttatgtacaaggatgtttcctgcagaattagacagaacactggaaatttgaaaacttaaatgccaaatataaaattagtcaagtaaattaaacaaaacaattaactcttacattaaatttgtaaaaattatgatttaatctcacaggaaagcattctcagtattaaatgaaaaaactcagaattttatataactctatctagcatggccccaattttgtttaaaaaagagagatacaaacaggctggaagacaaaatgccaaagtgttaacagtggtcagggatgacaagaatgcagtgattgctgttttctttttttaatagtttcattttaaaaattttcttcaactgtttattactttaaattttagaaacaagaacttatgctacttttggaagatgaagtgaaaccactgcattccagtttctacttcatagctggactccaagggtactaagttcctctctggtccccgtgggccctggggtggggtggggtgggcaggccccagaggacagggaggagggaggactggaattaaggagctgagaattgctcttgtccttgagtgtcactcacacatccctgcgtcagtgcagcctgcagaaaagccatctaacccaaggggacttaggtggagagagacccctattttattaaagacacgggtccttccttacaccaccctgtatgctgttcagcccagggtacgcagcacgtgctcaataaatactgactgatgacaaagggtatgttgtttcatttccaaggatccaaggaagttaaaaataaatatgaatttcccaaaagcctaggctgaaaattccaaatagcagatctgtagatctgatggtttccctgcgggtttaagatcctttcccaagtcctgcaccatcattaactggcaagtcataaaggttctacctcttcaatatctcccaccctgcactctggacttccgctgccatttccggacatggggctcccattgctgagagactcggggcccctgtctccctccaggtctctcctctgtccatcccagctactgcatccagaagaacatcccaaggccgacctccaagcccctccctcctccacccaaatccttccttgtcccatgccacccccagtaaaatgtaggttctgcagcctggaatcagggactttaaaaatctgaacccaaatggcctttcccacctgatcactgttattcctttccccactccagacactcaaggccaggcacaccaaactacccaggctcccgacacagcactgaaaccaggctctcacagccgaaactgatgcctgccccctctaaacaacaggagcacattccaattgcagtcactgagatgaagggacaatggtctttcattgtgatttttactactttacccctttggagttagagtctccactttttccacaggtagatttggaggaggtccacacctcgcctgttttgcattctagctgaggaacccaggtaagtggggctacctgagtctcagttacctgatctgtcaaatgagggtaatgacaccatcctacctaatttgcagggctcttagggtgacactttcaggtattctttctggaattcttaccgttgttattttagcctaactccctaccataccctaaggccctcaagggaaggcaaggcctgtatcttattttatagtgaacctccagcttttcccaagcttgatgcctgatacacaataggaactccatacgtatttgtgtggtaattttgctgaataacaggcacttaaaatctcagataaataatactataacatctatcgagcttgtactgcatgcctgtcactctatatgcattatttaatcttcacaacaaccctacaagtagttactgattatccccattttatagatgatgaaactgaggctcacggaagttcagttacatttgtgaggtcacacacccagtaggcccgtgaagagattcaaacccatgcccatctcttcccacagtgccaggcttccgacaactcctgggaagcccacgagcacctgaaagccctcacttgcctcacgccccgggaaacacctgctcacctcaatcagcgtcttgtctttcaaggggatctcgccattgtagcagatttcccagagcgtggttccaaagctccacttgtcagcagccacactcaggttcttggagtcctcaacacactcaggagcaatccatgggattcgttcaatgcattctggaagacaacagacacactgatggagcagtttctgggatctcctagggattcaattactgtcactgcagccagaacagtgagccaatgaaggaactacttcaagcagtgtgcccaaacatggcccatggccacataggccctgtgcggggggcctgcaggcgtgcagccctccaagccaccaccagcacttctgatacatcagtctgggtcacagccagcagatgggtccctgcctccaagctccccaggagggtcgtgtgaagccaggcttctgaagccctggccttaggatcagcaaaacatcccagggtgggggccatcacccagggcaggaggacgaacgggggctcgttcaaggacttaagagaaggcaggagatcaagaccatcctggccaacatggtgaaaccccgtctctactaaaatacaaaaaaaaaatgactctctaaaaggagaccaaccccagcccagcccttctctctgctgacttgcccctgactcggggtggggccagagggaagagaggggagacacaccttgcctagacagcaccgtaatggggatgccggggtcactgagcttgatgaatgggccacactcactgtcgatgccctcacgggccaggaggaggtttttagtacacacatttccatggaccaggtctttatcctcctgcagagtaaaaaggtcaagtttagccaagctgctccttcccgcattctatttccaaccctggtccctcaggtcatctcttcctacccccagctacagccagatctggacagcctggccctgctgccaatcatctgtgtgacttaggcacatcacaggtgccccttggctccagctccctcatcactgaatgtggctaaatagtggcacgtatctcattgggcttcgtgagcatgatactgattagaatctgtgaaacgcctgaacagctgacccatggtgagcactccacacgtcagctactagatgctggcagttcactcattcactcaacacgtactgcactgctttcagccttgccatccatatgctgcagtatgcaagtcggccctctgacgtgctaacatttcccactaaacagaactcatgtgagcacagggaacggccccaaacgaccatcttcagtaagcaccaggcacacctttgttcaaccacagagccctggccccatggaacccaaggacaggcccctctagctgcttggctagcacctccttcctgccacccctcccaggacactctggtttctggtgggaccattatggacatcaggacattctcaccaagtagctcagggcactggccagctgtttggcaactttgaatttccatggtgtggtaaggacatcgcttttccggtgcatgaagagatccagaggacccccttccacaaactcttccaccatgatatctgtaggcataaaaatagccatgtctggaacctggtctgtggcacggtcctctccttcatccccttacgacagtccacttcagtggacactactcggcctcagagtacacagatatccttggggggtgcaatggtgcaggggcttcagagctggaaaggccaagttcaaccccaagctcttcttctaaacggtggcactgagcaagtgacacttctctgagcctcaattccctcatctgtaataacagatggcggctaaatgtcacaaggcctggaaagccttggcggagggcctgacacagagaacaagggctctgggaacaaccgccaccactgctgctgttctacaacacactgtgatgcagaggtcaggccgctcacacggcaaaacttccctctcaacaggactcctgtgtgagtacacggaacagctcacattgttggattccacagggaagaagtcacttggggttaaaaaaaaaatcgctcttcttccaaacttacatgtcaggaactcagaggccaaggccacccctccatctcagtgtgcagcagcagcccaagggcccaccggctcagtggcttgacaaccaagaaagggccaagcctgcctgtggttaaaatggaagccagtccattcgaggagccagcgtcttgctgcttgtggggtgcgctcacctcgctcacctgcccagagctccttgggcctgactcttgtggccttgacctcatttcactcacctcagcctcccaggtctagcacagtgtagggttcttggccagcgttgacaagaaaacattacacaaatgaatgaaaagcaattggttttagttccacctccactattaacttaagcaaatgacctgctcagtccctcaatctcctcaactgcaaaaagaaaggcaagaagcctgggcaacgtgagggtgggaagagcctccaccatctccacagcacccaagctccccagccaggccacccacccctttgaaagagaacacacttactctccacgtcgcggacacagacgccatagaggtacacgatgtgtttgtgggagacctgtctcatcatgctggctgcctcgaagaaggcctgtgggcgagcaggacataggaatgtctcaggccagcctccagggggctgctccccaggggctctgttgaggggaaagccagtggacccaggaaagctcaccactgtcgccaccccaggccctgaacatcaatcctctggccttggctgtccagaggcactgccaagccttgttctctgggccaacctggcagggatgtgaggtttatttagaaaacctaacaggatgcagagcagggctggtgggagaagctggctaagaattttcccactggatactcatgcccacctctctctcttcctttcagctctgggaaatacccatatttagcactatgctggaacaaaggggaaatgaaggcagccgatctctgctcaagatttgactgtgtcactctaatagtctgtagaatcctgggtgagtccttttactcctctgggctttcgttttccagactgtgtggtgagagccatggactgtatcaggaactttgaaccatttggccagagtcctagggctccacagcacagccacctggacctgtccttaggaaaggtgggggttgggggtggaagggagggcacaggctgagtgtgaggagctgttcaacccacctcacttactctacatgcagggtccactaagatcatatgtggagaaaaaaattctgagtaaaaggcaagtttgaaaaccactgggccacaagaagggcaagggttcttctcaacccattgtgttccactggctccagaaacgggagaggggaggggaggagttcagaggaagacacttgccagggaaatatccctgtggctggggtctaagactttgaggatcacttttatcttcttctcttcagaagttccttcgtcatccttgtaatccatcagggtcccagaatagatgtgtgttctcgtgcctctcccaaggtgctcgccctgagggaagaagcagaaggctgggtgacctctctgtgccctgaagtgatggaccgtctgggaatgggtcctcaatgggaacatggactatcaatgggatggggcaaaggcaagagggctccctgccccagctcgtggtccccaggcctccagagaaaacaacaagctatttggccaaacacagtggtgacatttgctgggccccaggagacagtcctcctactccctaaacggctccttgctttctacccctaggaacagcctttggccaaaacacagtcctaacatgtcaggacactgcaaacagggccatcaacagccagccacatgggtcccaccccaggcctccagagaagactcaagagaggagcccccaggcagctcctctactcacaggctgtgctaccctgtgaagaggcttgcaaatcccagctctactacccgctggccatgtgacatgggggcaatctctgcccactttctgcaaatggaggtaataatggtactgacctcatagggctgtggtaagaatcaaaccaggaaacagggatggaggctcctggtacagactcaggcacacggggggatgcgtagaaacccatctggtggatccatgtgttatctgaagccctctggcacaggtaggcacagtttctcacactggaaccatctgtttcccatccatttatccagtgtgtgtgctcatgtgtgtgcatgcacgctaggatttaaaattagtggtgcaaagtacacctgcatttgccctggcaacctcacagaggagatggcaatgtgaagatgaaggtggagcctggggtgatgtgtcctggatttcctgacatgtgaaagggaacaatacccccagatgagtggcaggaggactgaatgagatgatccgtgcaaagccctagccataccatgatctatttctgaggacccttccagttcaagttgcaataattctgcttttaaaattcttaatatttggaaatcgaaatgggattcacgaaacttaggcaatgtcaagttgttgacattagcaccacaaaacttgtaaactgaagatccattattctattatttgaggaccccctggaaatgcagaaaagggactgtcactgatacctagggaatcagtcttatcccccataggaacatacaccattgttaatcaggtatattaatttgcacaaatgccaccatttgttatctgtcagagccgaatggcgatgcatccaccctgtctgctgtatcctggcaaggtctttggctattcattaaagctgcatctgtcatgaagtgatccatcaaggttatgggaagctgtattcccagaacatcccgtaaaagccatatgctttcagaataattgctcttcccgtggccaagtcatgacaccatgctgtcaggattctgcagggacccacaaaggcccatatggcccacttcatcctcctctgatgctgttccctccaccttgcctagctacttgagttcatcctccaggaggagaccctgatttttttttttccccagacagggtctcgctctaacacctggcgggagtgcagcagcacaatcatagctcactgcaacctcaaactcctggccttatgcaatccttccaactcagcctcctgagtagctgggactacagctgcttaccactacacgcagctcattttttcatttgtatttttagtagagatgggatctcattgtgttgcccaggctggtcttgaactcctaggctcaagcgatcctcccgccttggcctctcaaagcgctgggacgacaggtgtgagccactgtgtgagccgctgtgcctggtctgggactctgctttgataccgcttcccccaggaagctatctccgtcctctcaagattaggtccacatcctgctgtacttccctactttggaacttgactcttgctaacgtgattaccccctcaaaatagacaggagcctgctgaagcagcaatcgtgcctcgcacgtgtaatgcttgatctctgttggctaagtggatgtggaaggcatggaggatggtggttacctgcttggaggctcgaggcaagggaaaagaggcaggccccacagactatgtcaagttctacacagaaaagaggctatgaaactgtggctctggtgactgtaatctcaggacacagctctcacaccacgagaggaatagagaacaatgatgggcctttggtgaagaaatgtaccacgagggaagtgaggcagtttagctgtggatttccactccctcaagccccatccaacaatctcggggactcactgaaaaaggtaaagtaacaaacccccgagtgccactctccccaggctccttcacagcaggcagcttccgcctcaccctccaacacctccaaggcgctgccatctcccgaggtggtgagtggccccgtgcttgcttctctccaaggctgccgcaccatctccctgataccccaacgcgtggccctatgcaacagggctggggagcggtggcagaacagaaagtgggctttccctgggcctcacaccaccagcaacagctccagggcagcccctggggagatcctgggctccccgctcagcctgtagattctgggcaaaaaggcctccaaagactgggatctgtttctcaagatagttctccttcaggcccagagtgtgcatgtcctcttgttccctccctgtgttctctcctcctgagctctgctccttctggaagcatcatcagaaagtgcaggactgaactctggaggtgctccatcacacagcctgctgcaggcagcgaggtgtgatggccatgctcccctgtggagagccacctcctgccctgccaccccttcagctcaccacagaaggtccctgctgttctaggtaaccccacaaagcctgaccaaaccacttacctcaaaacatgtctctgaggagcatcagcaagggtgaagaggatggaggcaatggttgtacggcttttgccatcaaaggaaagtctccctgttctttttctactaagatttccccaaacacagccttccttcccccagatccccaagctgctccatcgtggggaggcaggaccacagctggcccacaccctgcagccgtgactcacctgcaccagatccttcttgaggatccgatcgaaactcagctggctcatggggtagacgggctgccactcctgggctttcttagtagccaccagcaggttggagatttctgtggaagagattgggggagtctgagcacagcacccaagatccgagctctcagacagccaacgtctgctgagccggggccgtgggaccggtgtgcgggcgcttgctgcttcagtcattcgacaagtgcttattcaataggcatatggctcctaccctccaggagctcagagggtaacgacagagccaaaactcccaaataaacaattaaatggaaagctacaatttgttcagctcctctaaagaacaggtgtgtggtgctccaaggttggcatggcaagatctgttctggtaagaaaggtcagaaacagtttccctaatgaaattaaaatttaaaatgtaagactggaaactgaaagaagtcagagactgtctatcttattttcttctccacctccacagcccggtacatagtaggcactcaattattatttgttaaatgagtgaatgaatgactggcgtctttctaaaggatgagagctatggaaggaagaagcagtacccgggcccagggcatgatgggaaccagaggaggaggtgaacaaacgctggttttgagccagaagatcagggcaggagacccataacagtgccctgtctgaagctcgtggtaccagcagtgcctgacatggagaggcgcttaccaaatgccccctcaatatgcaggtttaagtagactatcccccagattctactgattcaaacagcaaacccaacacattacaaaatcctcgaggccaggaaatctacaatccatagaaatcacctttcccgctatggagctactgcaaggaacgaggttatcataaggcaagaaaggaccttccagattctgactagcagggaaagtattctgggaatctctgaagacttgtatgttttcatcaattttattaactgaagcaggaatattagcaaaatgacaacgaacatgcatttcccttcacttcctctttcctgcactagaagacaataacaagttaggggagaaaatgtagccattccagtcctgattcctggactgtaacagaaggaagttcctaaaagaacatctgtagaacagccaggcacaacccatggaggccaccacacacaccgctgggagacaatggctgctgagcgccgggtccctgcacagggccacgtctctaatccctgctatccctcaggacagggcattcttttcctttctaattttttaagctcacatattccgactgttttctccatgccagccggtgttctatgagcattatacacattaactcctttgtccttatgacaatcctgtggaatacacagtattcttatccccattttatagatgagaaaacagagattctgagagattaagtaattggcccaaggccaggcagttcgtaatcttaggattcacactgaagtcagagatgctctcgtctctacccttcccacaacatacctggccctaatcgggagaacaaatgtgggtgccagaaacagggctcagggagaggctccccttgttctcacaacctgggcactctttttccagaggctgctccctccataccattttcctgactccactctgttacctggggaaaatccgattcagaggcaactcaggctcaactcaactcaggagaaaaggcatcaagaaggggccccgtggctggtgtccacaggcaagaggccaggcagcagagccacttgggaaatgagaggcggatggaaccgaagccatttatggactattctttgcatgggcacttcagggaacatggcaccagggttaacaatgtgaatgggggaagccacagtgcctccatgaaggtgtttcctcactagaaaaatgggggccacagttgtgtccttcataggttaccgtgtggaagaatgggatgacgcaagggaacggctgccttcagtgcccggtatggagtaaaacgctccctgactggttgccgccgtgattatgactggcattacatcttagtcactgtcatcattcttcctgtatcatcagggttctggagtgggagatgggtagtggagctggacacaggacacaggactagagatgtgggacctgctgagccgtcacgcccactctgaatggcctcctgctttttcactttgctttttatttatcccatgaagagtttcttagttgcattttcaagtgagaaacccagatcagggtctggctatcaaaaccccgtggttaggagagcagaggagctgaagaacccaacacaatattctcatgtctaattttcacgatttccccacttctctaatttgcacatggcaaagggaagagagagagctttgggggacctatgtaaggaggcctcacacacaggccttattcttactctcccaaggtcaggagaattggtgcctgctctaaagtcctaggctgatggctgcacctttccaaagacagtgtgacctgggcagggtgggggcagtggtacagaaggaatcactggacttggagtcagacaacgtgagttcaaatccccactcatcctctacctaagtgatcttgggcatgtataattgggataacaacatattctgggttattttgaggactaaatgacttaaaacatgaaagatctccaaacaacgcctggcaaactgtaagccctgctcacatgatagcagccgttcttattaattattactactgttctacctactaccgatactactagctacatggccttgagcaagtcacttaccatctcaagtctcaatttcatcacctttgtaatatctacaaaaagctactgtgtagatgaaataaatgaggtaggtacataaactgcctgggccacagtaggcacccaccatccagcagctcctgctacctgttcacttgacaggcattattcacgctgactccgtgctgggcactgtcctccccacgagcccatagagtggtgagtgagactcaggtcctgtcttaagagttcacagtcaggtgggaaaggcaacaggaaacacattcagcactgagtttcaggagcctcaactggggttcgttccagtgtgttgctgtgaataaatagggctgttgggctttaaggtttgaacttactctgaggtctcacagccaagtggcagatgtgtttttacctttgcggaaaatcctcaagcatgaaaacaaaggctgcagttattctctgagcctggcaggaacccctatctgatcaagaacacaagtccctcctctttcaccaagttcagtgacaagccccttgctgagaccaaaaactgattcaaacatcaagaacccaggtccctttctatcctggtgctgcttcctctgcccactcctggtggtgtgagggtttatggacacgttcgcttggaagaacaagatgtgtcccagataaagactcctcagagggtcttcctctgacactcatggggcctcagtggcaatcgtgctgctccttctttgaggccttcctccttctaagggaagaacctgacgcatgaagggcagcatcttgaggtgaggagcagcaaaataaaccgttctcaagagctagggcactcaggttaggcctggcactcaagcccctctttgacgctgacctttgatgagacccacttcgctcttctgggcctcaattttctcatctataaaatgagacagttgactgtgtgacctctacgtgtctttccagtcctcacattctaagagacaaatccacctgcagaacatcagtgacgccattcaagaggcttaacaagaaacagctgagtggctcccccttggatccatttcactccctgatcctccctggcccctacagcctgcaggataaagacccagctccatggcatagcactcaaggcccccacaccctaagctcagcctcacctgcccctcccttccaccttcaccttccttccaccttcaccttcatggcagcccccgcccatgcctctgtttgcacgtgccgagatgccctgaccgcactggcaacctcccactcatcctcccacactcagttcaagagctgcctcctccaggcagccccctgtgccacggaactcagggattttgaccatccctttctgtttgactccagggtatgatatctatgttagttaaaacacccatcacaaactgcagtggcctcatttacctgtaacatcagcattaggctgggaaacccccagagagcagggactggaccttatgcatttctgattctttgcatctgatatagttcttggcccacaaaagatgtgccaggaatatctctcagataaataaaccagtgacaggagactcctcaaggcattttatcttaaggaagaaagaagtgattttctgcttactaatgctgagcatgcctctttctgcagcctaatgagatgctgagaaaggtatatgcctcttctacagaaaatgctcacactcaagggattggatgtgagttgggcacagaagtgtaattaaactcaataaaaaacacctagaaactgtggggagggtccactttgtttaagtcagtcagcgtgttttggtcgatctgggtctcagcacattactgatgggatacagcctggctctggcacagggagacgaacctcggggcttgggctggcagcagcgttttagcatgaagctgatgttatccgtgcgcaggatctgcttcttgaggtggctcatgaggtctcccaagctggggaagctgcggtccgaaccgtgcagactgtagcggcccttctgcacctcgatctgaaagttcttgaactgcttctgggcaccctgcacctgctattcgggaaatgaccagaaattacatgtttaaaatggggtcaggcatgggtatgtaagatattaacattaggggaagctgcatgaagagtaattttgcaccatctctgtaacatttctgtaaatctaaaattattcaaaaataaagtttattatcaataaataatccaaccaacaactaactaaataataaaacaaggtccaggagaaggcattgataaaagggagttaatactacagcagacacagtagctatttctacaaaagcgtcacttggtttttcacctgtaagataaagttcatgaaaatccaacctcataggattgttgctacaattatctaacatggtgtattgaaaaacttagtaagccctttataaagtccagcagatattatatatgaggtaataattatgatggcacaacttctcaaggaacagcctcaaactgagcccttccaggccatgtctccacttgaggaaaaccacactgggagctggtgttcagtgtctgacccaggtttgggacactgtggtgccagataggaggtataagcagttttccctcatgggctctttttgtacaaactaaactattttagtggtaaacaatgagggccagaaagacttacataagctgtaaactaggagatgatattcaaaatctcagttacttcatctgtacaatgggataatatcacctacctaatatggctattacaaggcttaaaaaagcacaagtaggtacaacgcttggcacagggtctggtgggccacagtgtgcggtggaagtaatcatttctatgactgctgttttccccgggtgatgtgacattgttagggagtcacggacactcttggtactgcacaggccaattccacttcaggaggaggctgggctgtctcatgcacccctccatcgtaaacacattaaacttcctccaatgactgatgaatagacggcaagcattctgggaaggcaatgaacctgacaggctctgagccacggagccccgaggcccagctgttcagcaagagcctgggcaggtggtggtgttcctgcattgcatcacccaggacacttggcagcgctggttccttctgccgtttcctcctcccactcttgactgagtccagccccaggggttcgccaataagctgtccttcctgcgtctaccctccgtgccaaaggcccctccgtgtcccaggtctccccatgcatgtggagcctaaccagtactgattaaagtgtactgatgtaaagtgttttgtaaaactcactgtctttgaaaatattccactttgtagtttttttaattacatgaataacaaaggcatttgtggtctagtgaggcaaagtcagtaattctggtgaatatcttagccctcagaatgtatctcacatcatccccagcttcagctacgcttcaatcactaaaagacatctctattcattgttctaagatggggtggcaatttgttaaagtgtctgaagctaccatttggaaaaaactgtgttaggccatgtggatgaagtggcatttgggcgctggtttgtaccagtgaatgctgtagacaggcatagctctgggtctgagatgatggtggcactgagtctaaataaaccactctaaataatgacactatactttccaagtgttgggtgtgaattggttttctggtcatgttctgtcttccagagccatggtggacccccaccatgggtcccatgaaggaagaagggccctacagggggaggatgcaggggtctggctactggggagcagtctccttttgagagcaggggcccttgcctgacctcccagggatcttctcagagacccaggcttttcagttccaccctgccaagggtggttctgtctgcagcagctcctgaaccaggctacactggacacctcatggctgtatggcctggtccaagccagtgtcctgactgacctcagacttctcaaagcaggtgacggtcatgaggatgttgtcaaagtcggtgcagctccacctcagcacgtacatcccctcctcgcttccttcttgccgcaatttattgatggcgtattctgtactagagggagaagtaggcaaagggagaaagagctcacaccaaacaggactttgaacctctgggctatccactctcctgagctgcctcaagtcttaacagccccatcacactatctgccctgcctgggatcctaaagtcccctctgatgccatccatgagcgtagcggaaataccgagtggcctcaggaccgatggagtctccaaggttgagaagaggactcagactcctgcccaaggcaatgagccctgcttgtccccgcattccctacagacatcatctccagctcaagacagaagagcctctctggaggctggtgatgagcatctgccacgcctcccctccacccctagccagcccagtggaagcacaaacctcatgggggtgggaactggaggccatgttgtttattgttgtatcaccatgggctcacactgagagaatacatcagtgaggactggacagatgttagtaggaacaggcctgtcttacatttctttgtatccccaggaccagtgagtcctggcatgtagagagcagtgaatactgactgaatacatccctgcatgaggtgagtgctgcttgctaagtgctggtgagagagggccgccatggttcgtgtgttttagagagacagggacattgtgtactttctaactgcgccatgcctttgcatgtgctgacctctcatctaggtaccctttccgtgctttaaggcctggcaagccatcattgattctttggtttaatcagatttgaatgccacctactctgagcaggctctttaggcaaggaatgtcagcatcccatcaaacatgaaatatccattcattcaacaaatactcactgagggcctacaatgtgtcagaccctgtgtgtgctaagaaagcagtgagcaatgcagccccagcctttgggaagctcatattctgggaggtgagggtagtcagaccaggaacaaatgttatgttatgtaaataaacatagtatctcaggaggtaacaactgccactgaaggaaaataaggtagagtgcagtggccaacatgtatgggatggagaagggaaagaggtatgattgtatataaggtggtcaaggaagacttcacggataaggtgatatctgactagcacctgaaggaagtggaggctgtgcagattctggaggaagggcattctgggccaagggaagagcgagtgcctgggccctgaagcacaaccatggctgggacattggcagaagacgcttttcaaatgctcaaccccttgctctgccattctttgtgtgtctgtttccctatgagtctgtgagcctctcaaggccagggccatgtgactactaagctacctgtccacaaggcagccggaagagggaagaaggtgagaagcacatcatgtgaaaggtggcagaagagatgcttccccagatattctgtggtctgaaaagagaggctcagaagaaacacagcagctggctgttttcctttgcctgaagggctgtcatatgtaagagaaagtcaaaagaatccctgttgtctcaaaaggcagaattcaagtgagtaggcagaagttacagagaagccaactacagctccatatcagaaaggtatgcacatctctcacagtcagagctccaatccatgggctgcctcacacattgcccatcaccagaggtacttcagcacaggctgccagttctgagatgcaggtgggacaaggcatcccacacagccccttctggccttaaggctgtattaccctcacggtccccactgttcacctggcaccttgggacaagctgactgacaattccatttattacactgtctgatgctgagatcatcatctgatctttctttttcttcttttatatattttagagatgggatattgctatgttgcccaggctagaattgaactcctgggctcaagtgatcctcccacctcagcctctcaaggagctgaaactacaggcacatggcagcacgctcagctgtgttcagtgtttcttgaattgcccacattgtttgacacagcaagaaatcagaaagtgtagtacttcttgatcagctatggagaggtgagggggttaaactatgaagagagatccaagtaaagaagcagcattgaggggctgctgcaaagaggatggtaggagattacaggaaggcctgaccagagcttggacagcagggaggaaaggaggacagccaacaagtaccaggcagcatggtcaactggcctgacctaaacaatgatgacatgccccatcactaaaacacgggctctctgcacaccaaaggcaactgataaggttctaggaccaaccagattggaccatgacagccattctgtatgttgtggacgatcaacgggggggccacgtcggtgcagaggtaatgatgggcatctgctgtgagccggaagtagccatctaccagggacacaaaggacaaggcctcctcgtgggaagagagcttcagttcctgttgagagagaagaaattcccacggttacatcatgtctctatcagcttaagtggctgactctgtagggaggtgcacagtgagaagatttttataacccaatgggaaccccaaagggaaaaccttttcatcaatactaaatataccccttgcatgcatttatttatttatttatttatttatttatttatttatttatttatttatttgagatggagtttcactctgtcgcccaggctggagtgcagtggtgagatctcggctcactgcaacctccgcctcctgggtccaagcgattcttctgcctcagcctcccaagtagctgggattacaggcacctgccatcacacctggctaatttttgtatttttagtagatacggggtttcaccatgttggccaggctggtcttgaactcctgacctcgagtgatctcccaccttggcctcccaaagtgctgggattacagccgtgagccactgtgcccgatcccccttgcatttatataggactttcactgttcaacacattttcccatctattatctcaaactatcagatgactctgtgtgtgtgtgtgtgtgtgtgtgtgtgtgtgtgttgggggtgacgcggtgggggaggctgtggcaggcagggagacatgcagagaagctgtcccctgggtccgtgtgtgtgtgtgtgtgtgtgtgtgtgtgtgtgtgtgtatgtgtgtgtgtgttgggggtgacgcggtgggggaggctgtggcaggcagggagacatgcagagaagctgtcccctgggtccagatgggagaagaggaagcctgaatcaaggtggcagaggcacaaaagtggaggtgggaaggggcaaagcatgcaccgtgatcttggcactcaacggtgaatggctaaatcggcattattcctgcttaggagaaaagaaacagaggcagtgtggttcatctcatagcagacttgctctagaaggtgaaactcccggattttaatctaggaataatcccaggcccagtgaagagtttgctagattaagcctagggagctctgagagttggagagagcagagtgtcttactcagagtgggaagaggcaaaggcacctgtggagaagaggagggaggggatttccatcaaggaaggtgttctgaaagacacctgtgttgtagatttggggtacttttgtcctgatcattgatccctgaagagactgcccatttgacaggaactatcaggtcaatcaagaacatttcctggcaagggaaggtatgcaaaagccatgatttggagctttgactcacaaaaaaacattaaaaagcatctgaggcttcaaaaaagggcaaaatgactctttcatagccctgtagaaaggagaggcaggtggcagaaatgagaggacagtgaagggaaaaaggagcaggggagacaagccactcggcaggagggaggtcaggggcctagtgcagctgtaatgccgaaggaagcatgcctggggctatgaggaaggaggcctggagagggcagggtcaccataggaatggcacttcagaaaaaagaaaccacactgagcacactgccttgcgggtgtgaccaggcacccacctgcggatatccctgaagagcaaattcaagatgctctgaacaaggggcaggctggcctgggcagcccctcacccagccacatgataagtaagaccacatctgcacttacatttcctgagaacaggagtctaaacagaaatgagggatgccaaggagatgtagagagaagtgatacatgaaggtctgacttgacaacatgctggtatcagggtttcttcaaagcactgcctgattaaagggcttgggaatcccatggctgggaggggacaacgagggcatgagattctaaactggcagcatggagcagtggtcaaccctcagctcaggctctagagccagctgctctgggttcaaatcgcagcctctccacctgctagtagggttatgcatatggaatcatcatttttataggtcaaaatggtcaaatattggcaatttcaaatgctttaacctaacagctctgtgaccttggacaggttacttaacctcttcgtgcctcagtttccccttatcatactcacccatagggttgacatgaaaattaaaataggtggtatttgtgaagtgctcagaataggaagtacctgacacacagtaagggctagcgtggtaaagaaaaacaaactaatggaggaatcaagtatttctttcttcctgccctcctcctgctccctccacagcactgtggcttggcatagagtcattggcccatgtggccagggtgagctctgacttagatgatgggtgcaccaacttgtgttggtgctagacttgactgtgtcaaccaggacaggacaggatggggcaggctcataaaatgtgcaccaggcatacaccacgttgaagagccagatcatggacatgtcagcctctccctcactcccttcggggtctctgggggatgataacgccttagaagccaaagcaacacaggcaaaatgcacaggcaggaaccagacagagctgggcaagtgcctgccactttctcactgagtgaccctgtgcaagatcccatgcctcttgattagtctcagattcctcatttcaagtagagctgatgctcagtcccctaaggttcttacaaggactaagacagaccaagatacaggcacagcatataacacggggcctaatatccaggatgcagcatgtgacacggggcctaatatccaggatgcagcatataacagggggcctaatacccaggatgcagcatataacacagggcctaatacccacgatgcagcatataacacggggcctaatacccaggatgcagcatataacacggggcctaatatccaggatgcagcatatgacacggggcctaatatccaggatgcagcatatgacagggggcctaatatccaggatgcagcatatgacacggggcctaaaatccaggatgcagcatatgacacggggcctaatatccaggatgcagcatatgacacggggcctaatatccaggatgcagcatatgacacggggcctaatatccaggatgcagcatataacacggggcctgatatccaggatgtgctccatcaacagcacttcttcttttctccctccatttcgcatctttccattaacatccatctgagctcttctacttctccctcttcactttgtttttactatatttttctaataaaattaatgtaagttttttgtttaaaaaaaaaggaggggagaataagaaaattaaaaccactcataatgccaccataaataagtagctgttaatatttatttttctaagagcatgtgtatatacatgcatacctattgatattttgaacaaaactggtcccattctataggtaaagttttatatcctgctttttcccctgaccttttttccaggtcattaaaaaattcagcaacctgattttctaatattctgcttctcaggcaaattgtgatttattttcctattctcctattattgtatatttaagttattttcagaattttgacactttaattactactggaatgaatattcttattcataaaccataacctgcctctcacattgtttctggaagatagattcattctctagattcctgaacagagggatatataaatattttcaaggcttttaacaggttaccaaactgttttccaaaaggttatatcagaaagacaagttattctgaatacaagagagtgactgtctgccctaaaccgtatcaccaggctcttcctcagcactgagcgttatcattgtgacacagtatctgccacattttggcagaatgtggcctttcctggtgttggctccactcaccttaagagtgctagctgtctcaccagccgctctctctgcatgttgttggctgtgacttcccctgacacaaacaggtttattttggcagagttcccacttcctgcttgtttagattatgtcctcaagtgataccaaaaaagaggaagtgagattaaacaccctttcctctgtccgagagtcactggggtgtgcctgacaccatatcgatgactgccactgtggccgaggctcgcctgagggcaacgtggggcttcctgctttgcacttcagctcagcagagaggccgtgccagaacccttgggaggaaacactgacattcgctggttttcttttccttcaaatccactagctttgtgaattaaatattgatgctgaggtgtatttgggagggaagcaaatcctaaggcagattcacatttctgagaccaaagaaaggcactggaatgtatcggtgtaactttaaaacactgagaatgccttggtaataggaactttttggcttcaataagaaaatcctgttttctctttaggacaggaactctgaaaatcatgtgctgcagaacggaactcagcaattctccctctcatcaccagatccagacttaagagcttctgggacaaacttaccattttcttgttgtcctgcttgttaatgctgaccacagactcctttattacaatgtgagtgatttcagggaagtaagaaaaattgttccactcttcccggatcttgtttttctcctcatccttcttgtgtttattttccagttttttccgcttcagtttatttttttccttttcaacagaaacaacctgataagatacataaaagggacagggttaagttgctttcttcattttctattggtaaaaggtcagtgctgctgggaaacctatgcagggcctaggtccaaggaagagaaagccagctcttctggacttgcaggattgggggagttggcacctgcagggttaggaccaaagaactgggttgtatcagggaatcctgggctttcatatctggaagagaccttaatgagcacactgtctaaactatataatacgcaatgtgcacggaaactcagaaagggaaatcactgctcactagacatgcatctacattcaggtctcctcacttccagactactacacatgctctgacacaaacagataacatactcttcccagttaccactgagctgaacatgagctttctcctatcaccaatcgtcttgactttgtaacagtactcaagtcgggattttccagagaagacacgaatttcatgcttgaaataatctacacactgaataatatatatctgcacaagtgaaaatattttgtgtcgcatgagccctggagaccagagatctaggttaagttcctgcctctgccaattacttaactagttacatcatctctttgagcctcattttccttattcatgaaatagcttacatcttcacagggttctctgagattagacaagtgctaactaacatagtataatacctattatacagaaaaccctcagtaagtatcaagcattattgttttagcatgagaataaaacaggaggagaaaatgagtctcatattttattcatttatttaattttttgagacagtgtcttgctgtcacccaggctggagcacagtggcaaggtcatggctcactgtagccttgacctcccaggctcaggcgatcctcccaactcagcctcccaagtagctaggaccacaggcacgtgccaccacatcctgctaattttggtatattttgtaaagatagggtttcaccatgttgcccaggctaggctcaaactcctcggctcaagtgatctgcctgcctcagcctcccaaagtgctggggttacaggtgtgagccactgcacccacccacatttactttaatattattaattacagtaataataattgtaacggctataataatttattcaacatttattgtattgccaggctttgtgctaaatgccgtttagtttcttcacaaccttatgagttagacagtaggtacctccatttaacagaggagtaatttttagctgctgataaaggtgaaataactctcctaaggccatataagtcatgaagctaggatctgaaccccgtcgacgtgggtctaaaacccatgctcttaagccactctgctctatttcttcatccaataaatatctcataaagaagctcccataaagcaaaatcaattagtcaatttcacggagccagaggcctaagttcaattcttggcacaaatgcttattagttatgaccttgggcaaatttcttaacttctctgtgcctctttgtattcatccgtaaaatggagataatagcaatacttccctcaaaggtttttttatttttagaaataaatgagttaatacttataaaatacttagaaaagtacttggcacatggtaaacactcaggaactatctgctattattattatactactacgtattatacatgttgttatatttctctacataactcaataaatacttatttagaccttgtgctacagggatgaaataaaatatgaatgatacatggtctcctaaataaactcagcctatgggagtgatggacatgcagacagatgactccagaaggataaacagcatacgctatgtgacacgggaatgttctctttgatcgactgccaacagccacttacatttggtttatgcctccactggattccaagattcccagtcaccatcacttcgtagtagagaacgtttccaccgtcattcgaatgaaaccaattcatctcattttctgatgaaatcagtaacatggaagtctcaaatatttcagcaccgtaatgttttgtcaaagtttccaaggtagccaagtatttcaccttcaggtcatgcgtggacacgctgctgtcacaaatggtcttgttgttaaattcctttaggaaatccttgaaaacattatttatccgcatcctggtgagaaggttcctctgtctgatggacttattcaatgtttctggaatatatcgcttgtagctaaaagacagtagaaaagtacatctccttttcatgtacaggttaggagaaaatagtttagaaacaaatctaagtccatgaatccacatgttgccaaatgggaaagggagatctattcccagaggacgttagatggagttagcactgaagatgaccatcataaggagatgcaggtgaatagaaactgggaaagaaaagcaaagcacatgctccacagatttcactgaaatgggaattgctacaagtattgcccaattttctgggtcaccaaggcagggcatctacatttttgcttgctagcttcaccattcttgtgcacattagtactcacatctacacactgttactaggattgagcatcagttagaaaatggtctgcaaggtgttaggagcaattgtcattttgtgtgatgagaaatgctttgtatgttctatttgcatgtctgatttataacttttctaaacagatcacattttttattttaaaaatgagaaagaaaggctgggggcggtggctcacgcctgtaatcccagcactttgggaggccgaggcgggcggatcatctgaggtcgggagtgagagaccagcttgaccaacatggagaaaccccatctgtactaaaaatataaaagtagccaggtatggtggcacatgcctgtaatcccagctactcaggaggctgaggcaggagaatcgcttgaacctgggaggccaaagttgcggtgagccaagatcatgccattgtacttcagcctgggcaacaacagcaaaactccgtccccccaagcacccccacaaaaaagagagagagagagagagtgagagagagagagagaaagacatactaaagctaattaatacaaaagacttagtgtttgccatgtgaatatgaatcagatatattatttaaaagatcaacaggtaagctgaaagattagttacctatccaggtgctagtgggcgagtatctacaacaaacagaatctaaacaagctgatatactgctagaacgggagtcaatgttaagaagaacgttgagtacccctgaaacaaagaacaagtccactgggggccaaatgcggagactgatctgcttgttactcccaggactgagacagcacctggccccgggtcatccctgccgcatggagtggcttcagaacagtagaaaattgtgaagtttgggattcatcctcaacaaatgttatttttcttttagattaatgtaatataacagaattagagaagaactgtcatttttcaatttagcttatgaaaaaataaagaggaagtacccaaagtgaaggccacagaaaaaagagaaagcagcagttgagcagtatcgactcaatccctgcatcactgaggagcaagctgtgatctgctctagactctggtcaagcgcaaggagaaacaagcagcaacctaatgagaagacgcacgccgcctatcacaaacaatgcagctacgaaatcccttcttcaaaatgagactgtcttcatttatgaccatcctaatagcccactggtgaaaaaaaactattggatgtcatagatggacagaacttaaatattccttcacagagacttgatctcaaacgatatttttaagtaaatgcaattttcttgagatatttaatagtagttgatcaattctcacattagaattaacagctctgtagtgaactactgtaacgtgttcagagttcaggcttgggatggtagtagctgcttacagaactgtactgagaaggatttttaagatgggtccaaaacaaaaggaaaaaatgcagtgatagacgacagtgtccaccatgggcaaggaggggacggagaaggcctgggggccactaattttattggcatcctcagctcagaaatttcacccaagcacaaatttctgagattagcagccaacatccaaaatcaagacacaattataattaggctacgtgtatgtagtaaacattctaaggaagatctgggtttcatagagagcaaaggtcagccaaaccctggcagtaattaagctgaaatgtgtaagaacatgtagaaacaccaccatcctcacaatcaattcttcagccagtgggaagctttacctgatgtccttgggcagttctggcaactgcatcttcttcatcatggcatagtgtgagatggccaggacagccatccctagacactcgttctcaatatcatgtccatcctgctcggtcttggggtctcgaataggagccaggcatttcaccaaatcatactgtccctaggagcaagggggagaaaccatgagagcccacccgtttttgatcttgacaagaaggctactacacagggaggggccgcctagaaacgcagcacagcaacgagacgaatcagattggcagtttctctagcatcagagctcttttaaacagagttgggtgtgaaggggctcaggagatgttctcccccgctcattcatttaacaaaacattgactgagcactatgccaggcactggggaacagtacagacatacgaagtcccttcgccatagaagtgacgctgacaaacactgtgtactaggcctggactgcgccagagcaagggaaggtgacactgggctgaggtctgatcatgcatgaattccacaaacatgcttagatggccttgtctaggagctgggtgtacagagttgatggggctctccctccattctggtgtagctctagggaaaggggaacgttccgcagtgcatcatcaccacatgtacattttcccacatctaccgttcgagtttcccatagtgaaatgtgtcaccaaaatatacccccccactgatggaggtgcacagcattctaagaactaacgggaactttaaacacaaaaactaaaacaaggctaaccagcagtgcccagcccagctttgtacagagtgaaaacgataattccagtgccggctcccactgattaaaccctgcctcagtgctgccacacagtgcttggctcctttatttagtcctcataacaccttacaacgtggatgttaacatcgtcatctccaacagatgaggaatctaaggcacaaaacagtaaacagcccctattcagtcactccttcatttggtaattattgagaactaattatgggctagatgttattctaggtgctagggaaacagcaataaactaaaccacgttcctgatctcctggagattccactctaaggagaaagaaaagaataaatgactaggagtatctaacgtcaggcagttataaaaccccaagtcaagtagaagaattgagtaccctgggggcccagggcttagcaagtggtaggctgggattaaatctagacctggccaggaccactgttcaatgccgtgctacagccacattcggttttcatcaaatgacttaaagtacatagaacactaaagtgtgaactcttaagcctttctccagcttggagcagggcaggcacaaagcctgggagaagtgttcctgcatatgtgagatgctctctttccctgaagaacttcagattaatggtttttggatggagggctcccactgctcccgtttctcttcttttcaccatgggatatcttgtttctctcaggtgaggaaaggtcactgacattccaaaaacttctgaggaacaatgatctatgccagtaatgtgtgaagagcaaaggaaaacctgaaactgtcctgttggcctgtggtttttttgtaaacattcactgtacagctacctcaagtcacttattcctgagcctccaaaaggtcaatctaacgccatgcttattcttcaagtatggcacactcttcctttacacctctgctcccgggaaaggtaaagaataaatctcagctatggatacacaaaactgggaagctgaatccaaaaagaccatctaaaaatggccagttcattttctttttttccacacagtatctgcctggggctgtgcactgtcccctttctctgttgtctctatggcagttctaaggcatagatggaatggagataatggacaattagtaactaaagccctacagtgggacataactctgacacagatatactgatacgtgtgtgatctcacacataatggtatactctaaggtaataataaacagaacgtgtacaggaccacctacgtatgcagttgttcacaacagactataaagtaatagcataaaagggaaaacgagaaaaacagaaaatgtccaggaacgggtgactaagttaaataaatgacggcttttcctctggactccagcctcattactcaatttcctacttgaaatctccacttgtatgtttcacaggcatctccgaaaaaggactcctgatttctgccccttccccaccctcttcccccaagaccttccctgtgtggggaatgactccattatccatccgacatcacccaaaacagaaacccagtcatcatctttgattcctcaaattctctcagcttccacatccaactcaacagcaaatcctatcaattctatcttcaagatgaacagcagatctactcattttgctccactgccactgttgctacactaggccaaaccagcattttctctcccaggatcattgctgcagactctcagcttgtatgtttcgagtgtactcttggacccagcacaatctgctttccacgtgtaacaagaatcatcgacttgaaacatacataaaatgaagccttccaaatggcttcccaccacactcagggttaaagcataaccccttgccagctcctacaaggctctgtgtatgcaatctgcccccacctgcctctccagcctcgttccccatcaccctcctctggtctgcagccacatggtctctccttgcagctctactggccctcagggccttcccccattctgttccctctacatcagatcttttcaactgaggctgagaggagagtcggcaatattgaagacatttttggtcatcactgctaaggagagagtgctactggcatctactgggtggaggcagggatgctggtaaataccctacaatgcatagggcaggccatcacagcaaagaatcatctgggccaaaaggtcagtagtgctgctgctgagacactctacatggaagaaatagtcccccacccctctcttagaattgcagattcctttttattcttcaggattcattataaatgttacctccttagagagaccttctctgatcatatgatttaaattaggtcttcccattcaaacccccctgtccatattctctattgcaagcttctgctttcacagtactttccataatttcttacgtattatctatgtatcattttatttgcttgttttctaacttgatgtacatctgatgcatgcagaggccatgtctgtcttgttcactccagcatctccagcatcttagcaggtacaagtgcctgaggcaaatagtacgcagacatccagtcaatatttgttgaataaatgaattgttacaaagtcattaaaacaacgaagatcaatattttaattgacatttgaaggacaaacaataaaaaaaatcagatgaataaaaaagcagtttacaaaacaaaatgaaccataaaatattttcaaaatctatacagtatctaaatttgcatgttaaaatcaggaagcatactactaaaaatcttagcaatctcagagtaaatgtaatttcaggtgattctaccttctcttttgttttttttctagcgtctaatctttctatcctaccaccagtgacagagtggccatctccttcctccccagacattactacggctgctgagaagtgccttcttcagccctgttgaattacatcttctaacaagcagagcttccctctgacctctgcacataaggctattaatacggatgaaaaataaaatggtaggaggtggggaaaaggaaaggaataggaaagaaaggaagccccaaagcccacaagctggataaccagcctcttggaaagctgaaatgctgccttttttctcctcacttggggcaagtccaggtgtggcaagaacttacccagaacaggccttaaagcactctagcaccaccaagttcagctgcagcagggggtctgagctctacaatgcctctcccatcccacaaactccagcttctcctgggcccaaacttcctacctgagcaaacagatactccagtgagctggcatcaaggagaggggttgcatctggaatcttttttttctcgtagccatttttctgcttctttggagaatgacgccacactgactgctcattgtcgttggttccatgccaattggtgaaatagaacctggaaggcaggaaaatgaatgccaattgtggcaaaggggacccagatgtgggcagggcgtcctggctcaccaacagtggtcagtgccggaggctgaagtgccctgagaagcaggcagacaaccctgccccttgtagcccctcaccatctctttccttcttactagcgctgcgtgagaagtgtcccatcagcacctcctctatgactcagggagctaaagtgacttcccgaagatcacaaagacagctcctctgacttctcactatgcttccagaatagggaaacacctgctgactggaactccatgctgaccacagctccctgcacgcttaccatcagccacactgctaagcccattctacctcgaatccaagaccaatttgattgacattttaacattcctgcaacttagtttcatcacgcaatcaagatatacagcttacgtggcagtgtttcctacttcccagattgctgctattcaactgatggtgtatcttacatgatgaataggattttaaaagagagctacccaaacaccactacaggcatcatgaaacgagttaacaagcactttatatatattatgttatttaatcttcacagcaactctacaaggaaggtttcattcattttacagatgaggaaaactgagattccaagaggctaggtgacctaaaactacaaaagcctgttctcttaactactacagttgccccttgaacagcatgggtttgaaccacagaagtccattcatacacagatttttttttcaataagtatattgaaaatttttttggagatttgcaacagtttgaaaaaactgacgaactgtgtagcacagaaattttttttttttaatttcagaaaaaggtacatcatgaatacataagatatatacaggttactagtctgtttatgttattggtaaggcttccagtcaacagtgggctattattattagctatgttttggagggtcaaagttatgcatggattgtcaattgcacagggggttggtgcccctaaccctaccttccatatataacttcctctgtcacctgtaagaaaaacacaatttctggaatgtgtggaagtgactaagggaagtgactgagccaagccagcccaggccatctgtaggctacagactcagctgctacctaggtctctttcccttgacttgcccatgaactaatgagaaaagaaccatgtcatggagaagcaataaatacaactccctctttccctgcaaaaagctgctgctacacttcaacaactgtcactgtgctatgtttgcagagcctaagacaagccaggccctgagttagggcctgagatgtggagggctctcaggcatgtttctcgtactctgtgagttcctgtctctgggagcaaccggtcaggtccagcagcaactatccagcaacacacaatggggcacgtatcacaagcaggactacactgtgacttccataggccctaaacacttttcccttcctccataaaaaatattacaagttatatttctcaactatgttttctgattttaagtgaaattagacattttatgggcccctaacaagtgtgtgctctaggcactgtgcttaaaggataagttgtccttggacatatgacagtctctggcgaggtgccgaggagacaggtcgccctccattgccaggggaggtggcaggaggggaaaaagcaccaaggaagggaagctggaacagaataattaaatgccaggctacagagcctggaccatgcaaagcaggcagagcaaagaacgaaagccaggcacatatgaggcacgctctcctgggagggaagccccatggaagatagaaacggaagcggcagagagaagcagatgcctgtggcatcattcgagcaatgccgtgagctgtgcacggaagcaaaggctgcagctgtcctgctcaccactgaatcccagtgcctggtacctaacagctactgaacacatgcttgatagataaacaaaagatgaataaactcagggagtagcaattaacatggaaaggataaacaaagaagttactttaaaggtaaaaaccaacatttttataatcttcaatgattctatacagcccatcttccttgtaatttacgaaagtgactgagaatttgactgtgggctttggtgtctctctcacacacagaaagaatcacacatctgcagagccacgggcagcatgagccacgtcaggcctctgaagctgctggactgttcccttaccctccgctggtgacagtggaaagctagggctatcagctggcagggaggctgccactcatgctgtacccaggcctggcactgctcttcaagggtagaacagaacacgtgcccaggagaacttagccacgatcctctccctgggacaagcaggaaggaaggagtgaaccagctacagaggttcaaagaggggttctgacagaatggccaacaggaggggtaaatgctgtttgatggcggaggaaggcagtaataagagaatgagaagtaggtacaatatggaaggtttcccgagataaggaaagaaaagggttccgaggatggagggtgttgtccaagagagaagaatctctgatgaggtgccaaggagagagacaggtcaccctccactgccaggggaggtggcaggaggggaaaaggcagatgttccctgagccaacggagccacggccttcttcttccacatcctactgagtctctgtgagaaacagtccttggatctggtagagatgagggcccaacaaactccctctgggcagaacacaatcttcaatctggtctgaacaacgatattcttccaggctgctgagagccctgtgggaccatctttgtcttggaagcctttaggtcagatactcagacagcatcaggctgaggagaccaaacataatgtgtagcttctccactggaacaaaggctaaaggtaaacagaagatgagggagcctaaaataaggccggcagctttctccttaataagatgtcaaaaatattaacaaaattttaaatccatgactaccagaatcagtaccctccctatcacccataagaccaagcttgaagacacactgaagacagacattccacacacctttttaaaattaattataaaggtgctcatcaaacctggtacacaaaaattccagatactatagcatgccaatggaaaaaaaattaaaaatgacatcaataaatgtagaatgatacctgcctatattccttttcaaaatgacgtggaggaacaaagcaggaagaaaggagaaagaaaaaaaagacaaatagacatcaatcagagctacgcactgcaagtttttgagaaaattatgtacagataactgcatattttaagtttatatgcagatattatacacaacaaactctctttaggcttctataaaatgttttaatggactgtgaaattcaattgtttaaaaaagcaagaaaatattttttgaaaaggaatacagaatatggttgtcttatgctaagatatatatataagagcttggtgttctcatcatacggggcaaagaggttgtgacaaagaggagagatacctgaggataactatgattacccaacaactatcaaaagcattatctaaaaacagaaaacgataattgaaatacaagaatatttcccaaagtaaaactggtactccactgaaatcatcaccaacatttattttcatttacgcctcctttagtggtgagattatgaggtttcaaaatctttgtagtttgtcatcaggcaaatgttttagcttagggtggtattttttttttccaagttcaaagggcctgtggtaacaaagcaatatcctgttgaagcaccatgtcaggtacagagtcaaggtgctaaaagtgaagcaaccctgcacttccaggcagctaacagaaagagggaacaggcaaagacagcctttaatagccaggcactcagacaaccaagactaatgcctcaaagagctctacaatgcctcaattgtaaagctaatcagacaattcactagatgtaatttttgggttaactctcttcccttttctgggtattagtttttccactgaaaaaaaaatgaaagagttgaattaggtaactttggtcttttccaatcctaaaagctaccattctagactctgagctgagtacagaaacctagagggaaagaattagaacccagggacataccccttccagacttcaaactgcaacaacccatttcaatgctgatcacacagccaatccccaggccacaaaaagcaagattacatgtggaaaaacaaagccaatagccagaaggctcagctgggacctgaaatctccacggcacacagctttcctctccaggtgagactttggttaagcatagaaagaagaggaaaaagtcagccctaggatgattatcaaagaaagttagatctggttcagtgtccactgagaaaaacatcccagtcattgtgtaatggtgacaactccaccaaattctcccaaaaatagtagctatgatactgtgaagtctccgagatttcagagggcttttctagcaaatccctgcattctattagcatctgagcttatctactgttttaatacctctgtaagttaacctgcttttcaaaaaggatccaccctatttataatctccactgctaaacacacattaacttctgcttagcaagtatgtaactaacatattttccattctagttactgaacaaatatgtttacaaactcaggagactgcagctattgaagtactgactgtctgtgtcacctgtgacatttctcaaagtctgcaatatgggagaaaaggcaggtgcccatcagaagaaaaattacagctccacagccaaaaatcctcaaggagtagtcaaaacatccactcccagagagcaaggccaacctagaatttctagttaacacttcaggcaatgtttctcgagctttttagttgcaacttttagtaagaaaaatattttatatcatgacctttatatatatagtgtgtatatatatatatatatatatatatatatatatatatatatatatctcaaaagtttaaaaaatatacttaggttatgtatatatgctgatagtatcgtctcctgtttctttttcttaaattcactaaattaaattgaattcataactgtgaatccactaaattaaattcataactatgattacccatttgaaaaactctgctgtaggacactaattctattcaaaatatcctctgccttatcaagatttcttttctaaaatgtggcagaggaaggtgatcaaactcatcttgaattgtattccaaatactgaagaagtcctttctcacatcaagcaaatacaaaagttacaaattacaaaaatgactacaatacttcttggtaagtgactcagggctccaggctgaccactgtccctcagtgcagagggagccaggcaggtaccaggtcagtacttcccatacctcatccggtagtggagccggagggacatcttgtcatcaacggtgatggtgcgatttggagcataccagagcttggtgttctcgtcatacagggcaaagaggttgtgacaaagaggagagatacctgaggaaaagtaaaaaaacacatcagaaaatcaaggcggatacatttggccatctgtttctaaacccaatatatgcaaagataaggaactctctcatccacaaagaatctgggtcactcatatcctcttagggcaaacagacttccgaccaggttcggtcaggctgttttgatcataatcatcaagaactatgactccccagaaatatgcactgtagctcctggcaaaccaaatttagatcatttaaaaataaaactctgatgatatttctcattacaggtatccgtcacagagccttatcaaatccagcttcaaaaaaacccctatctgagaggttcacagatcctgcctgatgtgcactttgctaatcggaaacactctgggagttggggaaatcttccatctgtttcctacagaaagcacttaaacaattctaacacgctcgtgattatacatcagacatgcaaacaaattcctggcagtagtatgcaaaatgcatattagaataaataataaccaaagtgatttttgtcagtgattaaaatctattaccattaataataaatatacttcttaagtactctgtatgattatcacaaatattttttatttagtaaccaactagcaagaagatatatggcttcacaaagctggcccaacagtgctcccctgcctctccactccaccagttgcctccgtcaataagagaatgatgggaaagaccagggagattatgaagtcactcacttctacgcccatgattaaaattttatgaacctgaaacataggcaggttggggggagaatgactgccaataatcagctattactgatattttcataagcagccaggcctcaaactaagatgaggtaaacttaaatgacaaaaaacctgggagaatatgaggtaataggcacttgtttcccaaatcggacatctgcagtgagactgacactgacagggccccctccctggcccagcacacccaggcggggactctctccaacgcagacactgagttaagaagctacagataccttggcagctatctagtgctctcctgaacacctcaatccatgcttctcaagcaatatgaacagttacccttcagaagttatagtctttcttataaaccgagaatatggagttaaactgtaaagggaagttttccttgggaacataggcaaatggcttttggattcagtattattaggacaaataattcaaatatgctatagattttcattcataaagtggcttttgtggactgggctggaaacccagcctttctttatgcatatccacatttgaatgtgcaccaacacttacatatctgaagtgtaacttattttaaccatggaactgtctgtaattctaacacaggtctgattctaacagtattactacccataaacagaaagatcaaagacatatctctttatataaaagtactgagtagtaaaacaataatactaacatttactgagggctaagtgtcaggcatcaggcaaacagactctaaatttattatcttggccgggcaaagtggctcaggcctataatattctcagcactgtgggaggcccaggcaggcagatcgcttgaagtcaggagttcaagaccagcctggccaacatggtgaaaccccacagccaggcgtggtggtgtgcacctgtaatcccagctattcgggaggctaaggcaggagaatcgcttgaacctgggaggtggaggtagtagtgagccaagatcatgccactgcactcctaggtgacagagaaagactctgtctcaaacaaacaaacaaacaaataaataaataaataaataattttttggctgagtttggtggctcacacctgtaatcccaaaacttcaggaggctaaagcaggaggatcacttgaggtcaagagttcgacaccagcctgggcaacatatcaagacctccataaataataaaaatgagccaggcatggtggcacatgcctgtagtcatagttacttgggaggctaagactggaggaccttttgagcccaggaggtcacagttatagtgagctatgatggaaccactgcactccagtctaggggacagagcaagaccccatctctaaaaaatattaaaattttaaatttaaaaaaaagtattaccctttaatcctcctaatatctaatgaggtaaatactattttgaccatcttgcagacaaagaatctgtggtctcctgagatttagtatgattcaaggttactcatctagtaaaatgcagagctgagaatcaaaccaagacacagctactgagggggtgaatcaatgagaactaaacaaaactttaccccacagaggtgaaaaacaggaaagaaaacaatactgccctcaaacatcactttctgtagtaacagtgagagctacaagaacctgtggcattcagtatgtatttctgaaattgatgagtttctgcaatattctgttgagccagttacagaagagacaccactcattttctataaggtaggctagaaaccgacaccccaaactggctgaccctaagcccagagttataggaggtccagcgactgtgtccatcctcagactcacaggctctctcctctcatctctttcccagcagctccttggtccctcattaacagcagcccaatgactctgcaacaatgacctttgcttacaaactgagtgaggtttatacctgctgtgctgatggcaagaagcttggcgaagagaataaacaatataaaccaaatctcaaggggaaagggagaaaacaaaaaaacaaagccttaaaaaaaactttagaaccactgatttacatctaggtgttctgataattacaaacacacttaaagctgctgtctaaagatggttatttgtacacattgcggcctagtcaaaataacttgacaatattactggatttttcccactaataatctatacacctcagcccattttattctgtgtcaggtttagtcagtaagagcctactacgctcttccccataccataagcctctccccttttcctgaaactctggtgtgtgaagattttaggcagaaagacaaatatcagaaagaaggtaggttttctaaacaagctgtactactaacaagataagcaattcttaaaataaccaacctatcccctcagagttgttctgagggttaaaggtgggataagtaaagtagggatcaggctgtacggcatcataaatggctacttcatcatcataaaacgagttgatagaacctttttaaaacagctttgagatataatttacatattataaaattcaccaatttttaagtgtacaattcaacagattctagtgtatttactcagttgtacaaccatcatcacaatccaagtggattagatctgtgatttaacttaatttctatgatttaacttgtcatttaaaatcaggcaagcaaaaactgccaatgtcctcaagttcaaaggatgaaagggactttggtttcccaccttctgagggcaacaggctaactttaagacaactctcacttgaaaggagaaaaaaaagcttgtgttgttgagagcctcgtccttttcacaacttgggaacttgactaagccacaaagcaacactcagcttctcacttcaactcagcaccatgcatgggagggcagtcacggcagcagaaggaggggtcaaactttttaggagaagtttcgaataattattaagatattgagatacgctacttgctgagcagggacttagtcccaggtgttttacgtagcacctcatctagtgctgatattattccaattgtacagatgtggggaaatgagaactgagcctggatccacagaagtcaagcgtcatcccctggtatcttatagttcattagtgacggagcagaaagaagccactctgcagatgaagaaagtgaaaagcgaaaccctcagaattagaatcactggcctaaggtcacgtgcaagtggcagtggcagaggcagggaggaacctgactccagagtccacaactctttctgcccagcagcgctacaaggggcagagacccccagatcttctgaactagtgtgttggtgaaacccccagccctgggcagctgccagtactcacggcatgcctgtgcagccctgatgcacagttcctctgctgtgtactctccactgcccagccggaggggctccctgtccgacagatagaagatcacttccacccctggctcaggggcctccaggttcacctcagtcttcttggagctcctcattttagcacagaaagccatggcattgcagtcctcttttatatttagatactgttgtggaaggaaaacaagactatgtggtcactctatgtgctaaaagttcttatggcaaaagggagtgttctgaaggtaaaaaagcagaaacatttggtgttggtattggatacgtacctctcccctgccccttcccttcctggaaaccaaacatgtcagatctcataagagatgaaaccatggaaaataattatgcatactaattaatgaattgtaatttattaattatgtatttttgaaaatatggtcagaccatattttcaaaaatcagaataattttagacatggcctgaatttattttctccatttgcacccaagttgtaattgaaaaatgtagcccattctggaaccaacaatgttaaaggactgattattagttacaaattctgctgctgtttctactggaatcacataagctttgaacagacttatggcaagaatcagcattttaatttcatgtccatctcccactaaaaagcaagcatggtgagggcatgaaccgtatcttatctctcttcacatccccacctgagacactgcacacaaaatgatgaccaattcatgttcataagtcacatggaagggccataacaattaatgaatggagcctggttcctaccaccccaggaggagcggcaggactttgacgcagcaccaggagggcaggaggaggccttactttggaacagttagaaaaccctggtgaaaagtgcgtaagtaagtaattcacataagcaccctccaaagggagagcacctagggccaaagaaccaacctcagcaacttagccttgggcaaggccagaaaggaggaaagaaatgagggaaagccctacacattctttcttcttcttgcccaataccaatgggctacaaactaattcgctgaccccacactcctactactttcttcctgtctgccaagccaaccttcacttaaacccctaaagtaatttctccataacacataccagatcctccaagggcttcccattaatctacagagcaattctgagactctgaaacagagccctgctccatcatctggccggccagccttcctcaccttatcttctatcactctgagcttcttgcttcatgcttgaaacccacaaggctgtcagtgttactgtatcctcccctacccaatgctacttctcaccctcctgccttcactcacactgattcctctataggaatatctttctaccttatcccttgcatggcaaacttcaactttctttagaattcagctcagatatcgcctcctgcaggaagccatctctgaacctccatcccattccctaaggccctcgcttcttgctcctaaacttatcccactgcactagccacaggaaatttaagcatcttatgcacatgctgtgagttccttgagataagaactgagtcatttttctctatatccgtaagaagcacagaggcttacacataatgggtgcttgcagaatgacccaaggaggctcccccaaacaagaaaagtcatacagggcagacagcagtcacagttctcttcaccaaattcatttgcttggtctattagctcccctggtgaggagagattctgaaaagagggacattaaccagatatgcctcaatgctacaaactgagaggtattcaattttaactgtttaatttccaaataaatctgaagaccagaatcttctggaaaccagcctgaaacagttagttcataattaaccttgaaattcagatcaacaagcaagaccacttgaaaacccagcactgaacccctaaccccatcccacattgaaaaactgtgatggaaaacagagtagctaaaagcctgcttcataatgtaagataaacctttgtccttgagagtctttatagacgtgacaggggaagaatccaaagacagtgttgcaccctctaactctaaggaaataaacaggcaaatgcatgtaattatatatttacaggatgtcacattgtttgaaatatgaaaaaatcggctgggtgtggtggctcatgcctgtaatcccagcactttgggaggccaaggcgggcggatcacgaggtcacgagattgagaccagcctgaccaacatggtgaaacccctgtctccactaaaaatagaaaaattagctgggcgtggtggcatgcgcctgtaatcccacctactcgggaggctgagacaggagaattgcttgaacctgggaaagcggaggttgccgcgagccgagatcacaccactgcactccagcctggtgacagagcaagagtccgactcaaaaaaaaaaaagaaataagaaaaaaatccaactgacaatgtccagtaggagaggactcactaaacaaaacaggcaggactactatgtggctgtcaaaaaggataacataaagctgcatatgaatcaacacagaaagatgcacaggacattctgcaaaatgaaaaaagcataatatggatagtatgatcatgcatatgcacaacatgtataatatgattatgcacatgcatattaaaatctagaagaacgtacaataaattcttaatagtggtgaacatctaggagagattacaagggaagtttaacttttactctgtacctcctatacttttgtatttgaggttttttttaaccagcatactcaacattgggaatgaataaatacatcaatttcaaaaaattaaaggcaatagcaccaatagccctacagcctcaagaacacggtttcatcaatttttttaaagccagatattttccttttttaaaaatatgcaaatctacatacctgcatttattcagctgtccagtgttctccaagaagcaaactggattttcttctctactttccaaagctacttcagagaagcgctaaagacaaaaataaataaataaatcagtggcagaggtaattgcatctgaaaataagagggcattttcattaaggaagcagcccaaaccataagcaggcaagaaaaagcatttgagaggaagaaggaaaaaaacaaaacaaaacaaaaaaatggcctaggacatcgagaggacagagagacatcttagggtgcaaacatcaaagaggatactaacttcaccgcatcaagaaaggaagccagggatttttgcttcccgatatggagtgtcctgtccaatgtaaatgaagattgtgtgctttttccatcaacagcccctctcctgattgtgtgaacaatagtttaagacacccaaaaacgcgcactttaatttctcattccttctagaattaccccgccccaaccttgtctacacacacacacacacacacacacacacacacacacacacagagctttgtattattttaacagctttccttgttgcttctcacaaattctttaacagtagaatccaattatttttgcaaataataagctaccaaccttggtgattcaaaattggttctcaaattaacagtgattatcacctcagttttctgtctggccactcaacacattttatcagaatccagttttaggaagagcatagtcccaggcattacagggcagcagcgaagggggagagggagatgggttacctctgaggccacgaggccagcatccccacagggccttacaatagaaggttggagacagcacaaatggaaacacaaaagcaacctaaaatcaatagtgtgagtgcgtcaggatgttgttagctctggtgactgacactggcaagggctggcttgggaaggctttctgcagtgggtaagacttaagtaaaagtaatgatggaaagcccggcaggggagacaagtatgaatttgattgtgatgactttgatttggctattttggtatggccaattttaacaagattaaaatcactgcacaaaagttttttaaaaattaatataatcaattgttttaattatgtgaataaacaccctgccctgcctcagaacagcacttagaaactagctacatgctaatgccttgcttctgctcataagcaggacttcagatgctatacttgttgaagagattcactctttcaacaagtattttcaaacagctctgcagaaactaagctaattcaaaggacaagggcaatacggtccctgcctacgtggagcttacagtcaatgggaagaatggaatcaaactaagatgtacagaaagaggtcattacaaagagctaaaatgctatgaaggaaaagtagagaacataaaatagagggaatgtgatctggtctggggctcaggagggaagggacattgagttaagatgcaatggatgtccatggaggtggggcatgaagccaaaacggagatagcagtctcagcaaaaggatcagcatgtgtggggaaaaaggtcctatagcagaaaggagctaggcttgtctctcccgttgcttgaacaggaaaacctcacaatactcctttttacacttgggcacccaacagcactagccagtccataggcagtgcttgctaactgcatgtctggagcctgtctaccccaggtttcctcacagcataccgttaccagctgccaaggatcagtgaaaactgaccagaggggagtactgaaaagcatgcctcaaacccggaaagggtcacaactcagccttttaggacaggaagagaactgtaagttccaccaggcccaggctccattcagaagggctaccatataaacctttttagaacttacaaaggtgtttttctgttgttgttttgttttgttttgtttgagcctaagtctcactctgtcgccaggctggagtgcagtggcatgatctcagctcactgcaacctctgcctcccagattcaagtgattctcatgcctcagcctcccgagtagctgggactacaggcatgcgccactacgtccagctattttttgtatttttagtagagacagggtttcaccatgttggccaggatggtctcgatctcttgacctcgtgatccgcccgcctcagcctcccaaagtgctgggattacaggcgtgagccaccacacctggccagaacttaaaaagttttttaatatgcactatcagaccatgtgttacttcaacttaggagtcatggaacttctcttagcctcatgtaagattcaaggatctgactaaaatcactaagattcttttagaactagaattctacaaaaaccagtaatcaaggggagtttggttttccaatcattctgtctcttctgcaagcaatactacattgcaatcacattatacctaatcttcaaactgacctccagtattattgaacacaacagtaaaatggtatagatttgtgatgcttagcctagagattaaactcttcgagaaaacaagaacagcaacagaatttcaagacaatatgcattaactgtgatgcttttgaatgccgattcaataacaacaaaatctctactctcagggaattgccattctgatgataaaaatagaaaacacccacatagcacttagaagacatgggaggcactgttctaagcactttaaacctaaggctgctgatccactttatatgaaatgacaactgtcctcattcaggatgacaagcggtttttttgtgtgtgtgctacagcatttgtgtaatggcttcatccaaataatatttcttctaaaataaaccagacaatgtgatctagctgattatttttagagcaagtagaaaaggagcaagatcagtttatattaataaacactttggataattccaagaaataaattcaagtttcttgctgcaatatacaaaaggaaaaatcatcaatgctagaaagattcaccaggagcaatcacaaaataccctttaaaaagaacatgattcactgggttcaattcccaactcaaatgaatataaagacacttagaaaacaggaaggaccaggaagagtaatcagaaggtttttggtgatagcagtgaattcttccacccgaatttatttataaaattgtcaaggatttgaaagaaaatacctttcttttggtgacagaggattacttttgtagctcaattttgtaggtgctgttttacatgaaaaaaaaatcagggaaattttgtgggttactcaaattgcttcagtttaccacagtcttataaaaaagacaagtatatctgacactttctcaacaagggaaaaaataaaagaaacaagacacaattctgtgggttggaacaaagcctcactgcaatagataaaatgtcagaaatttttccaagatgcaaaattccagaaatctatctgaaaaaactggaactctcttaaattttcaagggcatcttttgaaagactggtatctgcgcaagggaagaacacacattttggatagtggacaaggaaataaaaatagactattttaatgttcataaatatgatcatcagaatgagaccactttggccaagggccactgccagatttttaccgttaaaaacagactggttgacagtgaaactcaatgacaagaattaaaatactatggatataaaagaaaccatcacacctacaatgaattactttgtgtttgccttaaaggaatcaaaccttttgatttctgaagtagaaaatacaactaaaatgtttatgaattaaggtatgaactcagaaaaactgaaagaaaaatatgtaatttagaaaatgccctgaaatcagcttcttaatatcttaagaaattttaagactaaaaatcttaagccttaatcaactatttcagcaggcagcagtcttaacgttggtaaggaaacctaacacaacaatgaaaactacaggaagatcaggattttttttttttgtcttgtatttagtgctttatcctcagcacaaattaggtgatcaagaagtatgttcggtaacagctgtaaatgaaagatgaaggtacaaagtaagcaacattatgcaatgaaaaaaagcacagtaatccaaggtgtgtaggttcccactaactctatactagcaagtgtgaccatgagcaagtcattttcatctaagccagtttccctacccattaacctaagaggaaacatcctgcctagagggttggtacaaggattaaaaatatctttcagtgagaagttgaggcaggagaactgcttaagccccaggagtttgagtccagcctgggcaatatggcaagatgttgtctctttttaaaaacaaacaactttcaaaaactcttcatcaagtacctacaatgccctttttgcaagaggctatagatgtgtaagtgtacaaaaaggtattgacgcaatataaaatagtctttatggcacaggactaaagtgggctatgaatctgcttcgaagagcaaagtctaaatagggattctgagcaaaagcctagatacaaatcaaaaccccatttcataaagctcagatgacacagcaaagcagttaagagcacgggctggagtcattgcaacctgggtttgaattctggcgtctccaccgactagctattgtaatcttaggcaagttagttaatatccctaaccttcaatgttcttggtgtaagtggggagataaaaatagcatttatctcactgggctattaagagttaagtcagtcaatgcatgtaaaatgcccaacagagtttagcatgcagtaagcactcatattttgaccataatttgttaaactgattacagcttgatgaaatatacagttccagtcaaggaaaaaaaaaacaatatctactaagcatttcaatatcttgagcctggagttaggcactcgcacttaattctcataaaaagcatgagaggttttacgctaatcagcgagagtgccaggagtcaaacacgtgactactgattctaaggaccctgctcgttccacagtggggaagaactgctctaaactgtccccatcagcaacaccactgtcttctctggttttttagtacttttcatagtctaacaaccacccaggagactgatcttactccaacactcttccttctgtagactgaaaggactgtcatttaaaaaatcactgcatggccccagccttccctgtgttcctgcccactactaatgctctgccctggcaccactgccacagtgtgagaggaaagtcctagcaacatgtgaacaggaagcctcctaacagcctaacctacacaacaagccagggaaactgccagtggcttcacacccatagagccaccgaaaatgacttgtatctattgctactgggaccccactgctatgctgagacgtggaataacagttctgatgaaagcatcacaagatactgtaaagctgatggattccagccaaaaggacgacatcatataaatacaaaatctgctatttttcctgtcaggaagtcagaactatggcttttctatatgccactcctgccacacagaataactcacttctaactatagcagcaattccaggaataccccagaaccgtaagtgctgcttcatttacaataaactagggatgattaaataatcaatgccagctcaatggttcggtgcttcgcactgctcccaaggagcctgcattcagtgagagacagtttttgataaaagtaaatacagtactttgcttaaagtcagtaagtgtctttctaaaagccacattgtaccaagagactttgttacttttccttttctaaaaaactttttcttcttttaaactaattaccactaacacatccataatcttattaaagagcaatgaatataagatttagtgaagccatccatatccttaccccagggtcaaagacttggtggcacaaatggacactcaaaacatggcggggtggggagaatggcttgtcttcatagtatgtgcttttttgggggggatggagggggatggaatctcgctctgtcacccacgctggaatatagtggcacaatcatggctcactgcagccttgacctcctgggttcaagtgaacctcctgcctcagcctcccaagaaggtgggataacaggtgcacactaccacattcagttaatttttgttgttgttgtttttgggaaaggggtctcactatggtgcccaaggtggtctcatactcctgggctcaagcaatcctcccatctcagcctcccaaattgttaaggttacaggcatgaaccaactcacccaggcacaatatgtgctttttaatcatttatcccaaaaatacttctgaagcacttgtgccatcacaataaaaccttgcatttatatagcactttatggcttaaaaagggctttcacatctaaaccacattcgagtttcacagccccttcagatgggaagactcggctaaggcgttcccacagtcaactggccagtgagaggtgagataggtctcaaacacatttctcagctgtagcctcactcccctttccatttaccactctgccttgggcaaggtgtgggacttcaggggaatccaaagaagtaacacaaatacatctgagcatgccaaaaatcttacaatctactgacagctggcaagactaacatatacacgggaaccccagggaagaggctgtgagggcatgctgagagacagacactgagaaccatgggagtcaaaaacagaggacacaagggccatgctttgggctgagaggggattaaggagagaggaatctgctctcagttttcagaaatggagaagactgaaaaagagagaggaaaggtacagctgttctttaaaaaaaataaaaataaaggccaggaagaaggaaaatcacaagcacaattgtgcaggaaagagtatgcagacaggaagaatcttgcaggaaaaaggcagacagcaaggaaaggaggggagggtgcaagaggaacagagcttgtgcgagagcttcttcccaccagtcagaaagaggcccatgttccagcccagatccactaggacctgcctggtgttgagcaagcctcttaacctctctgagctcaaaccctgcataatgaaaaagtattggatgccctccaaagttccttatagaagcagttaaaagcctgctcttggagtcaccctaacctgggtccagatcccagctctaacacccactgtctgagaccttaggccagtttcttaacctctgttgagtttgtttcctcagaataatagaagtatctactttacagggttgttgtgatgatgattcaagatttccctaaatctcttaatgctaaaataaaatgctcacacccattaggaaatcagttttctgtgagtatgcgcaaggcttttaaaaagcttaaaactgaaaaaagaaacaaataaaacaaaccctaacttataaaagtttgaaaccattttgtactgcacctaacatagctcattttttattaacatgtatttccaaaatgtcacaatgtaaagacatagaatctcctgctgataagtcatctgacaaagcttgaaggtacccataatttaaaggaatacaaaggaaaacaaccctgaatccttccaccccttgctaaattttactatttgtgtctaccaagcattcacctacttcttctcacctgtcacatactaagttcatttagggcagacacaaatctaacatgcttcctatatccactcagtgttcttgggtacaatcaacagaaaccagctctgcttacctaagggtaaaatgagtttaagggaaagacagaaggacagaggaacagcctgataaggacaccactgctcgcacagcctccaccggtcaccagccatcaccaggactggactcccaactctgctgcttccatgaatgatctcaagccacctctgtatgtttgcaccactccctccagattcaaagtcctgacgaggaggaatcgaagaggttgaacctagtttgccctcagttatgtgtctgcacctccttcagcttccacagcaacaatgggagaccactctagaaacaaagggggttccaatgctagacaaccccccaaatggcaaatgtccatttcagtctatgcaccaaaggtactcagctattgcctcaaaatgtaagttaggagagaaaacaaaacaaaacgaggcggggcacaatggctcacgcctgtaatcccagcactttgggacgccaaggtgggcggatcacttgaggtcaggagttcgaaaccagcctggccaatatggtgaaaccccgtctctactaaaaaaaacaaaaaacaaaaaacaaaaaaggttagccgggcgtggtggtgggtgcctgtaatcccagctactcaggaggctgaggcaggagaatcgcttgaacccgggaggcagagggtgcagagagcaaagatcatgctgctgcactctagcctaggtgtcagagcaagactacgtctcaaaaaacaaacaaaaaaaaaccaggaaatctcaagaaaaatctttctctacatggcccccctacacttggccccctcaaccaaaaaactgtaaccagtttttatgttcagctttgaaactgccctgccaacaaagactccaatcttaaactgctggcagagctctcagcgaaccctatccatataatgagtaatgcacttagtcttcaccaaggcggcagcagcatcagggcagagcaggatcggcaggtcaccacagcgcctctggagccactgtgccacctctcactcctccccagtctgccccagtttcccctagcattcagccaagaatccagctagggttacacatcattgtctgatatcctaggaacctatgctgacagccatgcttaaaacagctttgcagtcttttttgaccatgatccaccgtaaaaaatatattttgtagtacacatgtgtgtatatgacatacaagtttcacaaaaagatattgatccttactatgtgccattccctctaccttctattctacattttcttatatttaatacatttttaaatgctaaacaagacccacaaaacagatttcacagcccagtaaagattaacagactacagtttgaaaaacactgttttaaaggacccaacaaggttactactaatcaaatttaccttatttttgtttttatttcagcaaatataagaaagtgaatataaaacagtgagacattccccagctgaatatgaaacagtgagacatatttcacctcaaacttctttggttaccacaagattacttctcttttctcacaatgtatagcctatgatgtttcaatacaaacagctggactgagacccatacaacgcatatgcacagtcttcatttcacaataagcttctcctcccagaaagctcttcagttggttacctcctacagccatataatggtaccacaaagatctagaatatgtagaaactatacccacaaagcatggaaggtctatttttaaaattctgccaaaccactcttcttacacatgacttattttctcacagtcccaggtgtctaacttcatgatcacatctagggatgcttcgtacaaccaaaagaattcaaaatccattctgtgtaccttgcaactgtgcaaaattttcagtgtatttcatggaaacaacggttatcgtaaatgaagagttcagtgcatgcctgtcaatggggaactactcgggaacggggaagctatccaagtcttggagatttagatggtagatgggtatcctgaaataggttaggaatctttaattgtatttccctatcaatgaattgaaaacggtgatcagatgcagttattctttctcaagataaatgctccttttcccactctgcacataggaaggcagtctcaatgacacttttttgcatccttgaagcacagtccagagcatgcttacattcacaattcttttacgaatagcccttgtctaacagacaacacttgaatttagccaaactggcatccatttcaaagtatcaaactatttagtggcaatgcctggtcattccacttaatttttctgttggtttctttgcaggggatgggatacactacagactccagccacggagcttcttttgtctttccttcccaggaataaaagcatagaaaaagaagactgaaggataatttgcaagactacttagcaattagtggaggcaaatattatggtaggatgtaaataactaattgggctaaatataactaggagaaataactcacttgttccaggacatcattaattaagtaaaatcaacaaaaacgcattgtgtaaagcctgcgatgcacagctcagtaagaagaaaagaaaacaacaaaagatatatcgccaaagaagaattagcaacccaagcacatagcaaggtaataatacatgactgattgccaaacacaggacacacccgaccaagcgaaaagagcacgtctggagaaggtctaagagtggggctggtgtagtgagtttgatcggatccagaggacggcagggaaaaccagcatggtggggttgaatgttcaggctcaggaaaacctcagccctgccacttagtagctggctttgaataatttttaactttctatgactgttttctcatttgcaaataaggataatcataattattttacaggcttattttaaactcttggaaaaatatatacataaacacagtaggaaaactggctcacagcaggcatgcaatactactactatcactacgaagaaggtgggatacaaacaggatgaaaacaggagctgagtgaggacaacattccaaataagggaaacatgaagaaatagcaaaagaaggaaagtggggttgggcacgatggctcacgcctgcaatctcagccctttggaaggccgaggcgggtggatcacttgaggtcaggactttgagaccagcctggccaacatggtgaaaccctgtccctactaaaaatacaaaaattagccaggtgtggtggtgagcacctgtagtcccagctacttgggaggctgaggcaggagaatcgcttaaaccagaaggtggaggttgcagtgagctgtgccactgcactccagcctgggcaacagagcaagactgcatcccaaaagaaaaagagaaaaaaaaagaagaggagcaggaggacgagggaggaggagggggggagggggagggggggaggaggaggggggagggggagggggagggggagggaggaggaggaggaggaggaggaggaggaggaggaggaggaggaggaggaggaggaggaggaaagccggagggtaaggcacttgactgaagactaaacaggtttgtgtagaaccaaaaaagatgaggtaaggaggaaaactgggcccaggctacaaatgccccctaaggagtctggattttcttctgaggggatactacccaaggagaatgcagatccccagattcatgtgaattcctcaagtggaaagtccccagtatgtgaaggtgtgctacgtggggtgggggttctcacacataggaaatgatgggaaaggcatgggcataggacacctgaaattcaactgtgtaaaaataatgtccttctttttaaagattcttaatgaatctgctactctttgatggatatataggcactgtacattgagaaaggacaataaaatttaactgagcaaacagttcaaatactgctatgggtaagagctaatttgaatattcatttgagggatccatacctttgccccacctcgctatacacacatacaaaaaggaaacttctttaaaaaataaaataaaatgagaagctagaggttttcttgtgtaaatcatgatgttaatgagtcagaaagaactttcccaaagcttgtcttcctggttgtcgcgtctggctgggacatccactaatagcactgggagagtcaacattctgctgctggtgactcatcctcctctgctagcacagtcggagggaccagcaagttcacggggctgcccttgggagtcactctgaattatttttgtaacatcttgtccttggataaaagggaatacagagtcagaaaccagaggccaggaggccatctattactcagcagagttgtttacacagccctgttcctctattatccagaattcagtgttctggataactgataaaattaaggcacctatgtttccagggagctgaatacagcaaatgcacaaaagtcatgttggatgaaattctaccttcccttgatgattcagaagaccatatcagaccttctcaggcatgactgcagatgacaaagagattattagaacctgattttgacccatttccatctcacaagcctgtgaaatgtggactcaagggtgtgggagaacttcagttagcaaaatttgcataaatagtttccttctactgtcatccagttaaacagtctccaggagcttgcatgaatgctttatcaggtcaccaagctctctgatgtatgtccagccaggtgctccctgaacatttctgggcctggccaaaactgtgcttgttcagtgcatttcagctgtatatatagctaataattagcagcagaaatgtggcacaaacccaaatctcatggatcccacattgcaccaaaataaatattaatgaaggcacctctgcctttttagtctttctccaaatgaatttttaaaaaagcaaagttggcttaactgctcatgaccattgactaatataaaaatcaataaaaaatcaataattatatactttttacaatttacaaagcactttcaatacttgatctcaatcctcacaataatttgaagtatcattcctcttattctactcataagcaaactaaagcttagaaacactaagtgacttgtgaaagatcacatgtatttattacctaggactcaaatctaagtcattagacagcaaaggaaatggaaacaactaatggaaaaaggacctataatcatggtgaaaaggtgaaatttcagtaaattaaaattgtttatctatctagtcagtaaagttggtgttatacttctttttaaatgtaaatataagcctggattaggtagaagtataaattactgtcacctataaactatgggtgacaactctaaaaatcatttagactcatcataaatgcacacattcaacattatagaaagatatcactgaaaagccaaagttcccctccctcctcccagagatagtcactattcagtttttggtaaggctgagcaacccaaatcaaaaaatctgaagtctgaaatgctccaaaatatgactttttgactaccacatttcttgaaggaaatgctcattggaggattttgaattttcagatttgggatgctcaatgggtaagcatagtgctaatattataaaatcccaaaaatctgaaatctgaaaattgtctggtctcaagcatttcagataggggatactcatctgtacaactctccctgagaacaatttagctccactttcaatttggacttgaagattctcctatgttttgacacaagaatcttacaatatggtaatgaaaaaatcaaattgaaaaacagcatgtataggatgatcctagctatgatgcatagacgcacacatgtaatcctaaagaaacggtgacaaaatggatggggaggacattacaagaataattacctgtgagtattccaaggtgtttgtgatagtagttacttcattttgcacacttttagagattttctaagtgttctgcatcaaatatgtgttactacactaatgaggggagaaaagtcattccccctgggttatacaggaaattagggctgggagtaggaattcaggagagccaattcacctctctacctgctgcaatggctcaagattgactagcaattcaaagcaattaagagatgtgacaaggcaaaacataattatttgtcattgactgatagagatattaagtgctatgacttcagaggacaaagagatcattctagcatggaattattccaaaggattcataagtcagagatctaagaaggtaaagggaacagatgagctccattctaggtgaagataaaggtgtaatcaaaggtaacagacattaaatcaccaagcgagttctggggacagtaagcacaagacttaagcatttcatgaagagaagaaaacaagacttagaaggcaggctggggtcagactgacatgaagtgagacagcgaagtggacagagatcttggagtcctaggaactgcgaccatatccacttggggagcaagccctaatcgttctaactctgttgtctctgttctaactctgttgtctctacccacttatctcccaaattactgcaacaatctcctgaaagtttctgccttcattctcgtccgcttctattccaagtctctacaatgcagccagtcttatttctagactgctaatctggaagtatcatgctctaaaactcttttatttcttactctcttaggtgacatggcttacaaggctacttgtaatcaacttctcatggctcatccccatttgtgccctgaactccaaacgtactgagttacctgcagttcctgtaatccagcatgactttgtcctccaagcctttgctgtccccactcatccttcagttcctagctcaggaatcatctccatcaaggtttccctgacttctcccatttcccaagtgaggcgttcagagagtcctgtgcttacctttggagtagcacttacatcctgctccctaactgtctgtagaatcatctgtcttcgctgtctttgagcaccctgagggcagggactgcagctgttatctgggtacatacaacaccaaataacaatgcctaaggcatgccagatattcaataaatgtctgtgtaagaagcaaatgtttaaacatttccttccccagcatgccttctctgactatccccacctccttccagaagtactcacctaatccatgcagacaccatagaccaagtgcatttataaaactgttttataatattaaatgtgtagtttatatgcctaacagaattgcgaggaattatttaacttcttattttctattctctcccatcatggtacccacgaagaagcccacatgcttactcttctttctaatggaacaccatgccctgagatttcccagtgtgctgagagttgcgtaggcctggaaagataaagaaagtctaatacagtatgtcaagtaaggtcagccagcaggtgaaaaaactcaaaaaaccaaccagatgttggtttctgttacagaagaatcattgacaaactgtgaaccaaaacttagacacagttttaaaagtattctcttacttataattataatgccctataatgacatttaaatttttaacttattttttaggtgcacaattcagtggttcttagtgtaatctcaaaagagtgcaaccatcatcactatctacttccagaacatttcaccaccccaaaaagaaaccccatgtcactctccattctcccctatcgcatcccctagcaaccactggtctattagcctagtctagacatttcatagaaattgaatcatataatgtgtgtgtctggcttctttcacctacacaatgtcctcaggggatccatgctgtagcatgcaccagtgcttcattctttttgtgaccaaataatactctattgtatagggcatttacgtttttttaaatattattttagagaaataaaatagggatgatgatactccttaatcttaaaaatcaccataagaagccaaaataatattatcaggggtgtattctttatcacagttttctaatttaatcattgtgaggtcaatggagtcttcacttcctcaaatgaggaaactgaggctcaaagacattacataatttgccaaatgtcattgtagctagtaagcaacaaaaccagaactgatgtgtattttactccctttagtgctcttctcagcacgatacatttctagaactacttcatggtcccaaacagcctcctcagcactaaagggagtaaaatcatcagtcctgtcatttgtgccatagatgttaagacagacagcagcatctctctgtcaatccgaggataaaggatagagggaaatgtttcaacccttcactcacccacttgctctctcaacaaagagttgttgaaaaacccctatgtactatgccctgcacaaggatctgagtatataacatgagcactggggacatggtgcctttactcatgaatttgtgagagagagagagagagagagagagagagagagtgtgtgtgtgtgtgtgtgtgtgtgtgttatggcatgttaagatggaagagacttgagaacatttaaataataggaagaagggagttaaaggataaaggtaaggacagggaaaaggattagctactagccaaaagtcagaagaggggagtgaatgggcaccagaccccaatacgcagtggtggaagagacagctgattgtatgccattgtccttcctcttcttcaacagtaatttttagctgtgcacaagaatgctcacaatagtgactacaattgccagcttcctttgcggcaagatatgaccatgtgagtaagtttggccaacaggataaaagcaaaagtactgtgtggcagcttctaccctggagaccactgtaaggtctttgccccgttttcttaattccttctcctatctgcagcctagaatatggatgctgccaacatggttggtaaggacaaagagacagagttttgctcttgtcacccaggctggagtgcaatggcatgatctcagctcactgcaacctccacctcccaggttcaagcgattctcctgcctcagccttccgagtagctgggattacaggcatgcaccaccacgcctggttaatttttgcatttttagtagagacggggtttcaccatgttggccatgctggtctcgaactcctgacctcaggtgatccaccggcctcggcctcccaaagtgctgggactacaggtgtaagccaccgcatctggcccaaagtctgtaaactttttattacctgctccaaaactcaccctagctagcacatcagctgtaaagaaagcagccctcatggcatggggacagagggagcagagcagggacacaatgaagactggaaatgtgtaattctctgagcctgttcaaggtgagcttctaatacaaatgagacaatgaaagatactagtattggtgagaggacaggaagcctagtggataagtgcacaaggtttagaatcacatacctgggtcctaattctggcttttcagtcaggaggtatgtcaacttagacatgtctctaaatctctgagccttagctcttttatctactaaaatgggaataatactagctccaatctcttagtgctgatagcatcataaagtctttgccagggataaaacgactatgtggctgctgcagtgactattactgaaagacacttcttgtcatgaaagttatgttaacataacccagctgtgttgtaatccacacatctgacacagggtcagaaataatgtccaatctatctttgtcctatagattatcacaatcaagctctaatttgggacctctccatggcacattccatgctcttaggaaagttaatgacttgactacaagttccttgagagcaaaaacaagatcattctctctgcagcctcaagacatagctagttcagtgctctgaatctaacaggtatatatttgttcagtaacatttactgagacactactatgtgtcaggcactgtattagacactatggttctagtaaggaacaaaaaagacaaggttctttaatatagaaacagatataatttttaaatattgatttaacgaatcagaaccagaaaatgtcacagtcaggagtgacacagtaattgattaattcattcaacctgctcatactacatatgggaacacaaaccaacagaaatgaagtatcgcattcaatttgaaggtaagaattaaattagcattcccaaattatgttttctggaatcttgtacttctgtgcaatgatagtaactgttctatgtacatatccttctaaaaagagagagaaggaaaatgagggtccatagtgaaaaaattggagaaacactggttaaacatagttaaataatatttttaacagcaagagctcttaagcctttcatagttaataaatgcagtgagtctccaactcccaaaaaaatcatcagaccaaggcacttcttttttaatggaatatacatttggaaaagtccggatcagatgttctctatgctctctttcatttctcaaattctatagatttatctgacagcatcaatctcagaagacttttcttcttgggtagatgacttaatataccagattctctagaaaaggcattcattcacatatattcacattccccacacacatatatacacacacacacaccctataaaattggataaacacaagcatgggataaaatctaagatttcaatataataagattagactaaaacagtgttcataaaagtaggggagaatgagccatttttgcaattttaccttcaagcagatattccagaaggtaatgcccggaaaaagttatatttacctactactcaacaacccaaacacctgggaaaaatccttgcaattctgataaaacaggtaggcacaaagaaaataacccaaagagggagagaaaatatggtcacctagggaacagtggaggcccctttcctcaactccctcccaaatgatcctctgcctttatttgcctcggccttcttgttttttccccttcaacccacttgatcttcctgttctcatcccacatctttctgcaagtcttctctaggagctggctacagggtcttcccagaacagagcccacagttcaggaaaccctgcctcatctccagtgcgaggacggtgacagagaaggggcagagcagactgagatgaaacaagttcaaacagcttacgaaaacctgggaatccaagcagatatctgtccacaaaagcagacaacgtcaactgtatccgattcacatttagaatgcatacatgtttttataaatgtacatagctctacatatgtcaaatatcagtgttaaatttttttagtatgagaatcctgttaaaggtaatagctcatggatcctactgctatatatatttctggactaataaagaaagaaataatcgtattgaaagcagatattgtacagtaggccccctgtaaaatttcccaaataccctccctgtcttcactcccttaaatcccacatttacacatctacacattgggaacctctgccatataacaaatttgcacgcacctcacccaatcccataaaatagactttcagaagaaaaatcaagtgaaaaagtgatttatccatgtaacctcccttactcctatatttagtcatgcaattaagcactaagttgtttttgatgtgtgtttatgtgtacctatctcacatgatccctacaaacaacctaaatgaggaaaagaggtcaggttccagcattctcattctcagaggccagagggagctcccccacttctcagtctccaaatgtcggtggcccaaggactcaggcctcaatcttcactttttctctatctactgaagtgatctcaccctgttgcatggttcaaatgccacatgcatgccaacaatgtccaaatttctatctcagaactccgatctcaaatatccaactaccttgggaggccaaggtgagtggatcacttgaggtcaggagttcaagatcagcctgaccaacacagtgaaaccccatctctactaaaaatacaaaattagctgggcgtggtggtgcatgcctgtaatcccagttacttgggaggctgaggcagcagaattgtttgaacctgggaggcgggagctgcagtaagccaagactacaccattgctctccagcctgggcaacaaaagcaaaactccatctcaaaaaagaaaaaaaaaaaaaaatcccaactacctcttcagcatctctacttggaagttaacaggcatccaaaccatcatctatataaaaagcaacctggaattcccacaccatcaacacacacctcctccctcctccccagcattcactctctcagtaaatgccagtattcaccatgttgtagaagcaaaaccccccagcagtcagtcttgacacatctttctctcacatcccacatctaaaccatcaccaattctatcagctttagcttcaaaatatgtcccatatcccacgatttctcgccacctacactgctactacgccattctcagtcactatcattgtcttaacataagcatcaagaaggcagggctgtgacagttttgttgtatctgcagtgtatgacagacaaagctcaataagtggtgagtgaatacataaatattgacacagagaggtgatatgactcatagagcaagtaaatggcaaaagccaggtcttgaacccagatctttagaaatatagggaaggactgtttctgctattccacactacctcttaaagctttaaaggaaaaacggaggagtgtatactactacctttcatgccagtgcatgtttttctttttccttttaccactatctacccactaaatgcacatactcaaaactccttgtccagcagacttctcttaacagtgaggagaagcacaaaaaaaaaaaaaagaatatttatggatccaaagtacagtaaactttccagtaatgcctttataactgggtttgttttggtaaaactgtatttgtaaaaagagaaaagatgatagggaggggaacaattcagatgcttccacagcctaattccagttctgaaatgaaaataacagtacatggggttggaagtggaggtgtttctaagacatggagatgtatgcatacgttctatctaaatatacttacatattcctcctggcatcctttagggaggaatagctattagaaaatgaaaaggctgggttctgaaaggttttgattctgaaagagagaataacattgttctagcacaataaacttctgggcttttctcagacctacagcaaagtagaatttagaaaaagtgctggacccgttaaaggctctgccataataaatcctttcacctccctgagcccaggttcaataagacatacaaataagatatgtttggacacacagcggggaacatcacacactggggccaattggagggtgaagggtgggaggagggagaggatcaggaaaaataactaatgggtgctaggcttaatacctgggtgatgaaataatatgtacaacaaacatgcatggcacaagtttacctatataacaaacctgcacatgtacccctgaacttaaagttaaaaaaaacaagatgtgttatgagtgtaccctcagccctgacatgccaggatctccctaattttataggtggagcccctgaaaggacacagaagttacctccaagtgtaataaaacacatactactgaaacgcacatgtctctttactatcaagtaatatggactactaaaaagcaaagtagacccagctcacaccaaaactgtattcattaattgaaatacaattatgactcttaactctgttattctcactagcctaaacacttttaaatcatatttttcgaatatggaacttgagacatgctcacaagtgtatagagcattgtaccatctgtccaaaaatgaaactggtaaagaaaaaaaagtgacaaagtagactactgacctccttaacagacagaacatttcagacactttaggaatacccatttatctctaaatagtattggtaatataaagagaagtcaagtcagtactgctcaggttagaactttaatgcactaatcacaagtaattcttatcaaattcttaaacattaaacctctattaagccatatataaggcttataaggctagtttttctggtacttactctcacggcagtgaccctctcaaaatgatgcatctattcagctctatccttattcatctcaacatgatatggggctctctactgagccaccatttccacttgtgccattcctttttacatattctactgtgcagctttcaatatgttcaggcaagtcttccttctcatttgttccaattagtaaaagttttactacgtagattgaaaaatatatatattaattatgttttacttaaattagtgcttttgggagaaggtcccaaaaaccccagagcagaagcagatggttaagtcttctatcttgcctagtcttcaggtttttattccttttactagtaaaatagtatttgaataatcttaatcagatattcaaattgctgtatttcaagcttgttaaaatggaagcatatgcccacaatttttagaatatactgtgtgtatgttcatggcaaacatacacacacacacacacaccccttgttaaaataaagattcagtgtacactgtatttatgaatataacctctatgcataggagaaactgtataattagaggcagtctttctccagcccagaaagcaagcgaatactaaattcccaggccaggtcccaggtctcagaaagctctatcatcaaaaagcccagacccaagaaaacactactggcaatataacagacacagataagtggttgctgagtgaaagaatgaatgaatgaatgaacgaacgaacgagctaattacaaaaagacagaagaactgagattctactgctactgctatctagcattatgctagctatccgccacatttttatttctccttcctaccaaactatctggatgcaacgtaaggcattccaatcagatgtgatgttttcttttgtctccaaattactgcttggtatttaatggtgtatctcttttcctagttttcgggaagcttgttagcagcagttgctgctcacaagagctgctgacagggaagctggcacgtgcaccccatctgggccgtggtgaaagaggggctcagaggcaagcacagctgaaagcaggtgggggcgaaatagcgtttagtagaggggagcagatgatgtggaaaggaaactagcttgtgatcaaaggttttaggatggaggggagaagaggacaagacaaggaaaaaaggatagctgggaaaaatgacaaagaaacagaaagagatggagggagagacagtgtcacaagaattattcagagaaaagaaaacagatcttctaggccaggcacagtggctcccgcttgtaatcccagcactttggaaggatgaggcaagaggatctcttgaggccaggagttcaagaccagcctaggcaacatagtgaaaccccctctctccaaaaaaaaaaaaaaaatttagccaggtgtggtggcacatgcctgtagtcccagctacttgggaggctgaagtgggaggatcacctgagcctgggaggtcgaggctgcaatgagctgtgacagcacctctgcactccagcctggacaacagtgagaccatcacacaaaaaaataagacagggtctcaaaaaaataagacaggcgcttgctcttattcccacctgcatacactaagtgttaccaatcatttgtccaagaggttaataggcaacatatggaggtaatttgctctctttagccctgttctggtgggaggtgacctcctcagtgggatggtagaccagagtatattctttattgactctcaggcagtataggtctctgtaccacaaaagcttgtgccttctaaatttcaaacaatttcatgaaaataatgttgaaactatgataccatctttatattcgttatttatttaatctttaacttaacccacaagattccaaggcagtttataagaacacattgaataaaacagaaatacgtatttttaaaatccaggactaaggagattgtaatacgggacaaaaagtcaaggctagtggaaagttatttgtagtctactgctttccacatagacattaaggatgggctacgaatttggctttgagtttcctaggggtcaaaaaaaaagcaggggagaaacatgatcaaatgcattgctctcgttgtcaaaaaagggaaaagaaaatgttatttgaggaatgaaaagtttttctgatggtagttcttaaatttctccgggggaagagggagatttgaaatttcatctagagcttttgtggtcttcccaattactttgaagagttaacgctgtacttagaaatatcaacatatggccaggtgtggtggctcacgcctggaatcccagcactttgggaggctaaggcgggctgatcacttgaggtcaggagttcgtgaccagcctggccaacatggcgaaaccttgtctctactgaaaatacaaaaattagccaggcatggtggcgagcgcctgtagtcccagctactgagattacagtaggagactgacgcaggagaatagtttgaacctgggaggcagaggttgcactgagtcgagattgcgccactgcactccagcctggatgacaaagcaagactctgtctcaaaaaaaaaaaaaaaaaaaatcaacatagggcatttagattccaaaacaccaagtcagaacatcagcaaacaaactgtactcttcatttttagtgtacttccacaaagccatttcccgctggggttcctctgtcctctgcctgcacttcaaatttactttcttaagatgcaccaaccaaaatgggcaattagaatgtttaaaatgctaataccatgataaacaagaaaattattcaggagtgaaaaaaaaaaacaattattatctactgaccaatgtagttggagagatgaaattcacataaaattgaagaaaactaccagaaagcatctaagaaatacttatttggtgagggatttggggccacaggaatgaggccagaaaaccttcctacttcgaaagattaatagtaaacaatagatgggtgttatgaatacagggtgaccatataatttatcagccaaactgggatacctgagagttaaagagtgtgctatcaataattatacccaacaacaggtgtaaactggggctgccccaggcaaacagagacatatggtcactctctgtgttcatcacagctttacattcctatcacatacatgtcctcattacacccccaacaatatcatgccggatagaggccaataacattgtctccgttttacagatatgtaaatacatgccaaaaagatgactgaagtaactaactcaggttttgcaaagagaagtatctgagctgagactccacgcaggtctactgactcctaacccaatgcccttccattaaatcatctaagtaatgacctggacccagtcaagtatccatgatatgcacctagctaagttctttctcctttccagtaagagcaataaaagttgaaaacattttcaaatgtcaggagaaaatatctacctttcagttttaaatccaagcatagctaggttcatattttgattattttacatttctaacaggactttgttcctgatttcacaattttctgttatttcatttcaaatgatctaaatataggcaaggatcctagacaacaacaacacagattcatgacaggcttaaattcaaaactctcataaaatttaattccattaattcaggctctccaataatcttcctctgttttctgacccctatgtcatcatctgccttacattaaatagcaaatgatcaggaaatgctttacagaattattaggtaataaatggtcactccatcgagtaattctcaaacccagctgtgtatcagaattacctgggagctttttaaaaatatatgaattccaatccttaccctacatccatcagggtctccgaggctggaacccagagtagacaattttttgaactctccaggtgattctgaggcccatctgttctaatgtcaatccaaatctgacccacccaagatttccaaggtagacacagctagcccctgactcactagcaaccacagttatgtcattctactctctcctttgcaacccacacatgatttcttcttactgattttctttttccatcctctacagtgcagtagcatcctgcattgacaggcagttaagggcatacacattgcaatcagaaagctgtggggcagatcctagtcactcctttcaagaccataaccaacgtcttctaaactagtctatgtcaaaagatagtaatggtcacgatcataacaccaataataaaagctgatatttgctaagcacttactatgccactaacaatgctaatcactctacatgaatgatctcaattgccacattaaccctgtaaagcaggactactctcatccccattttacattccgggagaactttgccaaggtcatactgctgggaagcggcagaacaacaaaaaaaggtccatttctgaaaggtaaaccacttcttgtaaaagtacttctaaaaggaatcagcagtccttctggaacatgaaacatttaggctttgaagatgcatcaaaggtaattttttccagtgtgtgatttggggctttgctgattggctggctggaaagaaactggattcaatgtttcaaatgcaacctcataccccaaatatttattactctctagctgttccactggataaggtaaaatgagcttccacttagatctgtttaattggtagggtggccatatacatataaaaattatatataagtttttttgagacaggtctcactctgtcacccaagctggagtgcagtggcacaatcttggctcactgcaatcttggcctcccaggctcaatgctgaatcctcccacctcaacgtccagaatagccgagactacaggcgtgcacaccatcacgcctggctaatttttctatttttttgtagagacagggtctcgccttattgcccaggctggggtgtccatataatttactgtaccaactaggagatattaaaacatcaggaactattcataactatgctgggaaaataggaataggcatatactggaacatatgaccaccctactgacagcagaattcaaagacaataaatggcaagtgaactgccatggactcactcaacaccatggctcaatttcactcaataaataatttttgtgtgcctacaatgtgccagcctctgtgctagaaattggtcatacaatgataataattcctatgaaccagacactaatagaactgactaatcattcaatagttacaacatgataagcttcgtattaaggagaaaaatcaaactgcagaataatacatatggcaagattccatttgggagggagggagggaggaagggaggaaggaaggaaagaaggaaggaaggaaggaaggaaggaaggaaggaaggaaggaaggaaagaagggagggagggagggagggagggagggaggaattgaaaggaagtgtgtgggagcaaaaataatcttctaactccatataagggtggatcagacgaggtttcacagagaatgtcctggggctgggatttgcagaaaaatagatattaaataacagaaataggtgggactggagatagcacatttctggcagaaataagagcacaagtttgagagcatgtagtggtcctttcacaaagtgcacattggtgcactggagggtgcgttggggggtgagtggccagacatggggctacagcagtggacagaggcaggcgtggtcaaccctctagaccatgctgagtagccaagactctacaatgcaggttagaggaggccagtgattgttgattttgagaaagaccaatgtcaggtcattttgagagcagctgacagaaggcagagaccagcagtttggaagcaactgcaatggtccaaataaaagatgatgttgaaccaaacactatgaatcccctacctcagacaaggggccaggcactagggattcaaaaataaacacgatctactcgctgccttatggaaagtgaggttaaatgaagagggaacaattttaatataagagaatgaccatagatgcttcaaataaaaggtttaagttaaacaatggaatgcttctgactctaaacactttgagaactgctaaagaaaaagctaacacaaagtttagaggttgtaaagtcccaaaacaacgaaataaacagctgaggagaaaagaacctttctgagacagaactatccaaggctgacctcttttattaagtggttgtaaggataactgggaagtatctgggcaaatacatggttttgttttgtttttttgagacagagtctcatctgtcacccaggctggagcgcagtggcgtgatctcagctcactgcaacctctgcctctggggttcaagtgattctcctgcctcagtctcctgagtagctgggattacaggtgtgcaccaccatgcccggctaatttttgtatttttagtagagatggggtttcaccatgttggccaggctggtcttgaactcctgacctcaagtgatccacccatctctgcctcccaaagtgctaggattacaggcatgagccactgtgcccagccaaacacatggtatttaaaacacaactataactatagtattgcaacttggggaacgtgtgatgggtgggtctttcctcaatacaagataaggcacaacactatttaataaaaaaagctctctgattttttaagtctgatccaacttcaaatcccacttactagctatgtgaccttgagtcaattattttacctgcctctcttcactataaaatgagaataaccacatatataccttataggattgtgaaggtaaatgaggcaggattcccagctaaaatggcagattgaacagaaatacccaatttcactcccttctgaaactccactaaaatatagtacatatttttaaaatatataaagtagtataataaatacagcatggcttttctgtttaagaccaaattcacaaatatgtaaggggaaaagaagaggagaaaactacaactttggaaactggaaagtagttggatatgtaaaaaaaaaattgacttcgataatccacaaatactgaatcccaagctgacaatggcaaaagctgataaccaaattaacgtataccacagaagtctccaaagtcacaggaactggaaggaagcaccagtaactggggtgaagaaagagggccagagaaaggtgtttgagaaaaagaatcccgttggccactcctctgccccagcaaaagtctagaccagcactgtccagtaaaatggtccacaataatggaaacgttttgtatctgtgctgtgtccagtacggcagccagtcacatgtggctaccaggcatttaaaagatggctactgtaactgagaaaccgatttcttaattttattaaatgttaatttaaatttaagtggctaccatgtggctagtgactattttattataaggaaacacatatctagaggtttagtttctggaaaggataagacaaagggtcctgtaactagagatgtcaggtgaagcatgggaacctctgggcacgcagaaagacggcatctgcacacatgctgagtgctgggggccaggatgctacagccttcaccctcttccctgcagctccagaaatgctggcagccagtccctagccctccaggtgagagactggaatactgtcttctgaggaatgtgaccatctcaccaggactgacctaaagacacagaggctgggagttccccaatgaatggctcactcttagtgacgttcaaagttcacaagcccgaggcacatgctcagccttcctccaagtttaatcataaacaaacagccaaggtaaacatatgtctgaggaaagcctctaatgcagacatggagatagaaaaaagcaactcagagaaaacattacacagagagaaaactttaaaaattaatgtcttcagaaagataaaagaataccttttatttgtgaatcaagaataaaatgtttcttttttaaagtaacatttcagagaaaaaaggagctctcgaatattaaaaagataataacagaaatgaaaacacagctgggaaagggccctacggaacttctaggttgatagaaatgttctatattttgtttagggtggtaactgcacaagcctatatgattgtcaaaacagccaaaggaacacttagcattgataagctttgctgtaggtaaataatatcttaattttcaaaagctaaaaaggttggaagataatgtttaggaaaaggccaggcgcagtggctcatgactataatcccagcattttgggaggctgaggcagggggatctcttgaggtctggagttcaagatcaccctgaccaacatagtgaaaccctgtctctgctaaaaatacaaaaattagccaggtgtggtggcatgcatctgtagtcccagctactgaggaggctgaggtgggagaatcgcttgaaccgggaggcagaggttgcagtgagccgagattctgccgctgaactccatccagcctgggtgacagagtgagaccctttctcaaaaaaaaaaaaaaaagtttaggaaataggttagaaaagaacagtttgaaaataggagaaaagagataagaaaattaaagggggcaatccagacagtcacatgtctgaattcctaaagaaaagacaaagaaagtggaggggagaaaatcatcagcaaaaccatttgagaaagatttcccagaaccaaaggctaccagttgccaggttggaaaggcccatcaaaacaatggagaaaaagacctgtttggggcattcctgggaaatttcataacattggaaacaagggtctataaagcttccaaaagagaataaaacaggctacattcaaaagatcaaaaattgagaatattctcaggctttttaacagctgcaccaaggaaagagacaggcacccaatgcctgcaaaattctgaagggaaacaacttccaacccagaagtctataaccagccaaattatcaacgaagtatgaaggaagaatcaagatacagttagacatcaaagatctcaaaaaacaaactgctatgcatccttctgaaaataacaggagacaggctccaacacaggaaataaagattaaacaaagaggaagtgaagggaactcccaggagcacagaacagagcggtctcaacacaaaagctgtggccagcctcagaggatgaccaatccccatgtgagcagggcaacttgagggatacttatgttgagggcagtcactgccaagatccccgtagactgcattgagggtagaatgcctgggtgagcctggaccaaattcctaatggaatttggtttttcttaatcatgcactgatgaaattcctgttcccctgctgtgtcctgctgcctgaatcagcagaagactatttcaccccgcagaagtattccatttggcctattcctgagagctggacataagccagggtggagcagcacattcctcttgactccactcctcccaggctcccaacagctgggcccactgcagtcttctaggtacctccaactatgagaagccctgtttcccacaactcattcatgatcttttccactgactttcccaaaagggtccctgcaacctctcaactctggatccagacttgacccagagtttctgttcagacacaggggtaatgaattcaaccagagaccatgaagctcttctcctgggagccttcatctagagatggcatcactgccctttccttatacacctaggtttatgcttgctctggggacatatacactggtagaaagggcatgattaataccaaagtgggggtgactgttacctctgagggaagtgcagtggaggggactaccaggtgatttctaagataccagtaatgttctctttcttaacctgaatggtggatacataggtatttttctctaactatacacatactgtttacatagtcttctctatgttgatacatttttcaatttaaaaagttccctccatagaaaattaaatatatttagagaccctaagtagatactcattaattttcaattactttattctgagatactacttagtcaagggcctggcagctaagctagttctctccttttaaatcagatgcccttgctgaaaacatgctccaccaggtccttggtcaggccaaggaactgagtttgatccccctctttgtatttaatggagctagaggtaccagagcagcactgtatgtcttgcatctggcatttcaatccagatgttagttgggccagaaagaatgacccagggccctggaataaactgggttccaatgagcaatacaagttctactcagtgaatgtggattacagtaaactgaagaaagatggtccagatttctaaatgaaatgtttcactataaagctgcttagaatgaagatcttccagaagctagctgcactattttccacttaactaggaaatatttctcctttagatacatgaaatcatgttgatataatgtgttggagattacattaacaaataactgaaacttgaaaaaaaatcaattaccttatcctctccagtaatcaaatactacgcttctttaaagaccatcttgaatggcagcaacttttttttcgaagaagaaaaatttataagtatctcataaacaattctcatattgattacatgttgaaataggatattaatttcacctggctccttttacctttttttttattattatactttaagttctagggtacatgtgcacaacgtgcaggtttgttacataggtatatatgtgccatgttggtgtgctgcacctgttaacttgtcatttacattaagtatatctcctaacgctatccctccccacttcccccaccccacaacaggccctggtgtgtgatgttgctcttcctgtgtccaagtgttctcattgttcaattcccacctatgagtcagaacatgcggtgtttggttttttgtccttgcgacagtttgctgagagtgacggtttccagcttcatccatgtccctacaaaggacatgaactcatcgttttttatggttgcatagtattccatggtgtatatgtgccacagtttcttaatccagtctatcattgatggacatttgggttggttccaagtctttgctattgtgaatagtgccgctataaacatacgtgtgcatgtgtctttatagcagcatgatttatattcctttgggtatatacccagtaatgggatggctgggtcaaatgatatttctagttctagatccctgaggaatcgccacactgtcttccacaatggttgaactagtttagtctcaccaacagtgtaaaagtgttcctatttctccacatcatctttctaaaattctacctaggcaataatcccctggactttcatcatttgccaatttgtgccattatttacttgtaatatatgtctccttagctaggttgaaaacagaaatgaacaaaagcatgacttttcctaatgagtctttcaagtagctactataaaaacaataatggtcctaagtcaaatggggtggggcctgacggacaccctagatcctctcaggacagagtcgggttcttggatgaggtccttccatcacttagtgccttctcacctccagcacctgctaagcacagggcctggcacagagtaagaactcaaatgtttctcaataaataataaacgacatcaaaagaaaaaagtgctaagaatcaagtgacaaatatgacccaagtaattaatgaaaaagtagctccctattgaaagttaaaaatcactatgatcatttctggttaaagaatcaaacaaaatttttaagcataaagaggagatgtagtattaaggataatccttgaaaagtatttccaaatctgaaattgacggaaacagggaaaagtggcttacacaaaatgaactgtaatttaaatggaataaacaggacaagtgtggtggcacatgtgtcatcctagcactttgggaggccaaggcaggtggatcacttgagcccaggaattcaagaccagcctgggcaacatggcgagacctcatctctacataaaacataaaaattagctgggtgtggtggcacatacctgtagtcccagctacttgggaggctgagaactacacgagaattgcttaagcctaggaagcagagattggaaagagtcgagatcatgccactgcactcctgcctgggcgacacagcaagactctgtcttaaactaatccaagactagactacactagaccaaactaaaattaaattaaattaaattaatgctggcagtggaaaatttctcatccagcacatatacactggagacagcatggtgtggactgaatgagttctaaccctgcctctgccagaacctaaccttgggccttggataattcaaggaacccttctggccctcagttttccccactgtaaaacaggcaggcagaataaatgaccatgaagctccctgaaggccaatagggttataggagtccatatattcctgcttactgattcactgactgagttaagtatcaaggcagtacacaggaacaggtccagtgcaaaactgtccctaatatcctactgatagaaaaaataagagacacagtttccaattcaggtgcttttgtacagtctaagttctaaaagctttttataaatgctatgctttaagacagttaaatgtatccagtgacttttaacctgaaaactgctaaagccaaggaaaataatgtaagttgaactcatgcccatttctattataattccatttttcagagtaactcataagcgtgcatgactcacacatctgaatatgatgagatgttcctttatcatttcatcttctatgccagtaatcccacattacagagtgccaaacccctttaataagtgtagcatatgtttctaccacactccaaaatccagcacaagactgctgcattagggaaaaaatctaagtgaggatttctgggctttcgatcataggaccccaagttagttgtcaaaaatatgactccctcgcctctccctttctgcacagccacctagactactgataactgaaagcataacaactatccttcaggctcatacagacatttagacagccctttgaagtgtacaaagcactttcacatctattaacttaactgatttccagtgacctactagagtatatagtaggtcactggaaatcattttacagataaagaaacagagattcagagaatttaagtgccttgcataaggctatgcagctagcaagtggctgaactgagacaagcactcagctcatctaaaaccaaaaactgagctcttctcaccaaactgatgtgtaacctagggataagaaaataagtggttgaaataaaacctcttagaaattgttgtgattatactattgggagtggatcaaccttttataaacaaggcagcttctctattcccttcttagtccctttgtacagtgagtttctagagtgagatggcttacccatttggacttgactccagatatacctcctttccatttccaaccaagaagataattcttgaactctgtccttgtaatatgaaataccagctatagcatgacttcagtcaacaacagtaaagagagattaagtaactggctgcaaatcacaaagttgcacaagcagagtagatcggcatagggacttcaatcttctcccgacagatggacatttagacattccatcacccttcctgagacacagggcttgcagcagttctttcagtgacaaaaattccctaagcagcccacagtgctattagtttcctcatttgattgttcttatggaaaaaaaaaaccacaacaacaacactactaaatgccccccaccccccagttagttacttgagaacaactaatcagaccatccctgtaccctgtataaataaaaacaagggtttttttgcattgacctgataatttcattggtagctacaactaactacacaatagttggaggtagagagatgcattctgtatctttacctttaattatacagtaagggctggaatcccctgtcagttcattcagccaagcttacaagaagtcacaacgtgggaatttccaaagccagtcaaacatcaggagtataaatgtcatgtacctagacttctcagtttataaacacatttttttttaaagctgactagtaacaatataaaaatattccctcctgttcaccacttcaaacatttagtatgatttaggtttttggttaaccatgcttgttgaatgctttaaggtgctaaattactaactgggctggaactttctaaccatacctcatttaaattcaatcatagattacatatcaaaaacttaaatctccaagtctcggccaaatgagatctgctttataatctgaatagaaaatggttggtaagtaaacaagctaatcatgaacaccatctctagagcaaaaatatcaaaaagaccataaggagtggctttgacatcagtcaaacctgagtttaaatcctggctctgccacttatgagctctgtgtggtcctggacacttgagcttctaagccttacatttctgcatctctagtatcaattcgctctcacctaactgttgtcaaggaccaaccacagtggaaatcatacgttaggtactaaataaaaaagatacttattagctactataaagtaaatttggaatacaagccaatgtgactctgtggataataataacttggaaagttggggtaggaaacaattgcaggttctttccattaacattctacttactacccttcaaggcccatcccaatccaacctcctcctcctccaccacctagctccatcaattgcagcctacaatgactgacacgcaacataattagcacttcattaaatattgtattgtgtttctgggatcactatttgctggtcctaacacctatctgtttaaggataccttaagcagaaaggctctctgcgtctctaacttccagtctcactaccccttcattattctaactcattataaactacactgagaccacaagtgattacacaatgccatttaattagaattgtgcatgcttgaaaatacaaaaatcacccttggaacagttaacagataattttagcttattaaacacacattttttaacactccaaaaccactttggttcagatcacatggggacatttccattggttgctgtggtgactatgtcacaaattagagtccctctggctaagattctcaggcccagggtgctgtgactaaaccactgtaaccacttcacatctactcatacactcccattttctaaaacttcgaaaccaccagccaaaaacaactttattcaaacacagagtttagaatcaaggccacacatgccatgacttaaaacaaaatgaagcttaaactctttcccccacagatttctctgcactttgccaggtcttactgatatggttccagtgcatcagaccaacggttcccaacgcctcccaccccgactcctgctgctttttaaaacatttatgtcataatgctctccctttactaccctgaaatgaaaatcaaaaataatataaactatatacaatttcaacataatataatgtcctaactataaataaagaatttaaagatatctgtaagaatatatatttcaatagtaattgctctgtcacgagtacatcagaagacataatgaagtagtctaatacaacaacagaacaactctgaatgcaataactataaatgcagtcagatacttgcatattattcttgatgacacaaatacatgcacaccaacattggcaagtgatttataaaaatggtaaacagcttttggcaaagttacaaacaaaatagtgtagtatcttatatagtatatcgtatcaatttacaaagtagtggcattcctagaaaattaagggtatatcaaaacaatgcaaaaagtccgttacataaaatggaattacaggttctaggttcagaaaattatgaacaggctttttccctgcaagaatgtctggggagacatttgaaagtcatgcaggctatagaaaaattcttctatccacaggactattgctgtgcacattataggattcctagtattcctagccatgacctcctaaatgtcaaaggtacccagcccggcatcaaagagacaaacaacaagggtccactgccccagctgtgctctgctatgaggccaagtagggtcttgtctttgtatgtcatgcatcaaccttagaactatgtgtggctcctaagcaggtgctcagtaagtctgaggaagtgggtggtagttcttctaaaattcctctgtttgttctgaagtaacagaaaaacagaatcagtatcttcagcaaattgaaagatggcatctactggacaggactgtagaactgctgacattcacttaaagccacaaacacctttataggatgctatttttccaaccccataatgatgatctaaaaccaggacagcaaatacacatggtcagcaggggctgaacaggcaaagcacagaggatttttagggcagtgaaaatactctgtgtgatacaatgatgggtacatgtcatcatacatttgtccaaacccatagaatgcacaactccaagagtggaccctaatctaaactatggactttgggtgataatgatgtcagtgtaggttcatcaagtgcaacaaatgtaccattctggtgggaaatgttggttatgagggaggttatgcaagtgtgagatctgtaccttcctcttaattttgctctaggctgggcgcagtggctcatgcctgtaatcccagcactttgggaggctgaggcgggcggatcacctgaggtcaagagttcaagaccagcctgactaacacagtgaaacaccatctctactaaaaaaaaaaaaaaatacaaaaagttagcagggtgtggtggcgcacacctgtaatgccagctacttaggagtctgaggcagaggaatcgcttgaacccaggaagtgagccaagattgcaccattgcacaccagcctgggagacaagagggaaactctgtctcaaaaaaaaaaatttttgctctaaacctaaaactgctttaagaaaataaagccttaaggaaaaataaaacaagaagaagaaaactgtgtatacatcatggcctgatgtcccacagagcctgggaatgactttaaaatccatctcaatgtggctccaatgagtcctgccaactgattaggcttcctgacctcaaaaatatgggagaagacaattagtcggttcaaactgacttcctgtgggtaactgggccttccacaccatgcaatctagtaattccgactaacatcatctgagcacttaccatgttcttcaggcacatagtgtcatgcacttatttgacctttatataacaatgagacatggtataaatccctactttacagggaactaaatgaggcccaaacacaagacccaaggtcaaatgctgttaaagcccagattatacagcccagatctgtctagctccaagcctgtgccagttatttgcaatcacctataaaaccacctgtctggaggagtggggtcataaagcttcccactatagtggtacctctcctctgtatgaacccaggaggtgggcaggctcctttaggtagatgacagatagcatatcaaataaaagccaaaacaaaattcctctctgctgctcagccagagtcacagaaagctgagaagatacccaaattagatctttaaaccaagctgtggaccccaggaccacacattccctgatgcataaactgaaagcttcgcaatggcatcaagccccagtgagtgctggctctaacctatcttcactccagttcctgcctctctcctacggccagtgctattgtctccagaccccactttccaactctgagtacacactagatctttgctcacctgatggtgcagaggaaatgctcctcctacctgctccagtatatgtgactcctgcccatttttccagactcaacagcaggatcccctccccccacccccaagtggctccacactgcccaggtggaacaaactgacccacttcagagccatcgcagcactgttcatgcacacactttcctcagggcccttacccctgtcctccttacattaacgattatcagtatacacggcccttccctagagggttacttcctaatgcacccctgtattttcctacaatgctgaccacaaccaccaccaccactagatatacagtccacctgatgaatgcttatgacttgatgtggctgccattctatacacattttgtttaatccacatattagttccattttactgatgacgaaactgaggtctggcatgacccagccttcactggcactacagcatagcagatataagcacagtctggaaccagaacacgtgtgtttgaatcccagctctaccacgtgccagctgggaaatcctgggtaagttatttatcccatctgtgcctcaatttcttcatctgtaaaacaatgatcgtaacacatgctccgtagtattttggtcagcattagaagagttaatgtatgtgaaggcactcagcacagtgtctggacatagcaggaactaaacaagtgcttgctactgttatcatcatcactgtttccaaccttgtcttccattatgccccaagtccatatttttatgtcctcaaatataccaactacttcccacctttgtccaagctgactcttcagccctgactgctctctgcaggccaggtcctcaccattctttgggtctgcttatgtgctcacctctgatgggcgtaccctgacgaccctattaagaaagagctctgtctctctggcacggtctcccgtgtcccctccccccactccccaggtcctattcattttagcacatccttgtttcttttcctcagggcacttatgacagcctagaattgttatgtgttgatccatgtatttgttttgtgtccacatcctcactagagatgagggaaagaactgcgtctgtcttccttttttttccatcttcatccagccaagggaaatgctcaataaatatctgttgaataagtgggcaaatgaacgaataaatgaggctcagaaagtttaataatttgtcaaatattacacagacaatcaacagaaaagacaaacttcaaacccagatttgactccaaagatggtgctctttgtagcttggtaccctgtctccttttacattataggtatttaagaagtagctgttgaattaataaatgaatgaactatagaatccttaaggtaacaggttgctgatggttgctgctgctatggggacagcaggaaataaacatcctgcaaagtgccattctctctatttggtcaacgatgagtatcgatcaactcaaacgtctattaagcagccacaatgaacacatctgtataatgcaaaagaatacaaagcccctgtatttggctggaagatagcaggtagaatcaggactacagcatatggttgggcaggttgggcactgccaagaatgcccaactgaggtaagaaagtgatggctgaaatccaatctgccttttactagccaggccacactctctggtgcagggctaccccactcagacaagatgctgttttctaattttcacaaagacaatatatagactagcagcagccctatggagggtcagtcttatttcttaaggctgggtctctctaccatgggagtttaatggcacaaaaggcactgactattcaaaacacaatgcccctccaaacctgccagtgcccctgaaacagccgcttggggtgaaagcattctatgccatgaggtgcttatgataatacaaaaacagggaggggtagctggttccttcactgccaccttttaactcagactagtctatcatattggcctctagtacttgtcagagcagagaagcctgaaagttgggacctgaatagattaagtttccatgcaataaaaggtgatgagaaagattccagaacaaagaatactgcgagaaaaagtaggctcaggctggggaccccaaaatcacgcatttccctttctccctgaagccagctctcactgcacctagtaggtatacaagagtgcattcatgtgcctacacaaatatgcacacacaaaactaaagaaaggatgtcacttgagcacacagcttcctgccccctccaggagtcctaactgctcagcagagaaaaatagcttagaggagcataaagagacccaagaactcttcctcttggctttcccagtaacttctggaattacatttggaaagtcacttcacccccaagacctgaatctcatcatttataaaaggactgaggctgcaatatgtgaaagatcaggattttcaagctatgttctgagcaaccaaaaggttctgagtgctataaaactctgcaaaaaaaaaaaaaaaaaacaaaaaaaaaaaactctgcaaaaaaagtattcaattttatttttaaggtaatatattaatgattttagagattataataaactcccacagattcaaattttattggaaattttagcacactgatgatgacaaatgtgttcacattatcttcctgtagacctcagaataaagctgctcttgccaattctaagcttatattagtatcttgtaaatatgtcactgattctgaaggaaactggaattatctttttaaaaattcaggcctgtacttgtctggtgccttaaaactgttcaagcaagtatactgctatagcacacctgcagtatgttcagttaaatgccaggtaaatctcaggcacatctgctggcttatgctcttatcacaggggaatagtcagttatgcaaaagcaaatgaattcataacaggctgcattgtaataaaaagagtgaccatacattatcatctgtcttgcagtttgtaataaagaatgaaagtatttgttaaacagtgtgattctccttggagaccaaagttccccctattcatctttcaggcttctggatcaatttaattaaagagtatcctgaaattgcaaggtattagcaaactattcttatctgcaattacttatccatgcaaatcagacttttctatactgcaaacaaaattaaatccagatggaacctgggtaatgaaactggcatttgactgggactgccactcagaacccaagttaaaattcagtgctcactacagcagcttcattgttctcttgactttaccataagtaaatggatgattcttgtaagttatgatacctacaagtctgaacatataaaattaatctcttgtaaatccatttatttagggtaagtaaatggatgattcttataagttatgatacctacaagtctgaacttataagattaatctcttgcaaaaagaacaaagctggaggcatcacactacctgacttcaaactatactacaaggctacagtaaccaaaacggcatggtactattaccaaaacagacatatagacaagtggaacagaacaaaggcctcagaaataacaccacacatctacaaccatctgatctttgacgaatctgacctaaacaagcaatggggaaaggattccctatttaataaatggtgttgggaaaactggctagccatatgcagaaaactgaaactggacaccttccttacaccttatacaaaaattaactcaagacggattaaagacttaaacgttaagacctaaaaccataatcaggacacaggcatgggcaaagacttcatgattataacaccaaaagcaatggcaacaaaagccaaaattgacaaatgggatctaattaaactaaagagcttctgcacggcaaaagaaactatcatcagagtgaagaggcaatctacagaatgggagaaaaattttgcaatctatccatctgacaaagggctaatatccagaatctacaaaaaacttaaacaaatttataaggaaaaaacaaccccatcaaacagcgggcaaaggaaatgaacagacatttctcaaaagaagacatttatgtggccaacaaacataggggaaaaaagctcatcatcactgttcattagagaaacgcaaatcaaaaccacgatgagataccatctcatgccagtcagaatggcgatcattaaaaagtcaggaaacaacagatgctggaaaggatgtgagaaataggaacactttatgctgttggtgggagtataaattagttcaaccattgtggaagacagtgtggcaattcctcaaggatctagaactagaaataccatttgacccagcaatcccattactgggtatatacccaaatgattataaatcattctactataaagacacatgcacatatatgtttattgcagcactgttcaccatagcaaatacttggatccaacccaaatgcccatcaatgatagactggatatagaaaatgtggcacatatacaccatggaatactatgcagccataaaaaaggatgagttcatgtcttttgcagggacatggatgaagctggaaatcatcattctcagcaaactaacacaggaaccaaaaaccaaacaccacatgttctcactcataagtgggagttgaacaatgagaacacatggatgcagggaggggaacatcacacaccagggccagtcagggggtgggggactaggggtgggatggcattaggagaaatacctaatgtagatgacaggttgatgggtgcagcaaaccaccatggcacgtgtatacctatgtaacaaacctgcacgttctgcacatgtatcccagaacttaatgtataataaaaaaaataaactctttagtacactgagattccacatcggacttgatatgaaatagggttccttgattttcaaagagtcaaaaccaccatgctggattccctcaaagtcctcttcacgttctaatattcagaggaagcaaattctaagtacacctggattacctgctcatccttgttcaaccgcactccatgcagactacaactcccataagaagggagggccattcccatcgaaagtaaggtttcatctaccatgggcaggtggtagctgtccacgccgggtgtcactcatccaagtccccacctcccccagcaacagggtgaaaacattcagccctccccaaccatggcagtaggacacccagcatggtgggtgtcctaccatggtggcacaaggctgagtggttgtatcctaggcaattactacgctccaggggcatcatccctaggagctcagaccagcattcagaggcctcaacctttggggtaaaggaggcaatccttttgtgtacaggctactccctctctcctactctcccatctctgcctatcaaaactctgttctttaatggtaaattgttacaaaattacaaactatcgggaggcactctggtaagggaataaaaagagccaaaaaataggaacccatgtgactctcagaaatgtatcctaagaatacataatgtacacacacagagatctagctatacagctattaatcctattaatggaagtgttgttcataacagcaaaaaactgcaagaaacctaaatgtattttttaaatggattttggctctaaaaaaggagggggggggatattcaatcaacaaagtgcccacaatatctttaacaataataatacctacactttagactacttaccatataactggatcctctgatcaggttctttacatctcatttaacgctcataccaacactgtgaggtagacatcatggcactttataaataagaaatctgggccaggtgtggttgctcacgcctgtaatcccagaacgttggggggccgaggtggggggatcacgagttcaggagattgagaccagcctggccaacatggcgaaaccctgtctctactaaaattacaaaaattagctgggtgtggtggcacatgcctgtaatcccagctacttgggaggctgaggcaggagaatcgcttgaaccagggagtcggatgttgcagtgagccgagatcgcgccactgtactacagcctggcgacagagcgagactctgtctcaaaaaaataattaaataaataaataagaaatctgagattcataaaagcagtaattaaccaaaggtaatctagctaataagtgtcgaggttgggttcaaacctaactcactcactcactcttgcatccaacaaacgtttattaagcatttactagtgtcagcatggtgctacatcctgctttgttgctggggctttaattttcattttgaaataattttagatttactcaagacctgcaaagatagtacacagaattcccatatactttcactcagctactcctaacactaacgctatggtttgtttttttttattgacaaactgcaataatcatccattccaccatcaaataattgagagggcactagacagtcccagctggcacctgcctctgcctgggactgcccacaatctctgttccccactgacatctgactctgcactgccctcccaactccaccatcccaaaggtaagacaagggaattaagaaaattaccacaaatcaaaggttttttctcccagttagaattaagccactgctaacgggaagtaaagccatggaaagaattatacttttaaaacaagtacagaacctccgagaaatctcaaatagaaaagaacagtaacaatgagaaaaaataataaatataattaaacactacaccagtggtagctatacgtgccaggcatcatgccaaatgttttatattcattgaatcctgaacatcccataaggtgggtaccactgttatccccatttacagatgagcaaaacaaggtacaaagaagttaggttttactcgaagttccacagctcaaaaacacttccctttccagggaagaaaaaagaacacaaggctcctacccccgttttgaacttctaagctatttttaacaacaatggccaccatccagacatcagatgtgaccaatctccagctcagcgaaactattcatgagtgtagcatttttcagcccttgagtagtctctgcctaagtgacgtatccctgttgtacatgtttccaagggaagtgacaaaatttctgagggacttgcacaacactgccaaaaagcaggattccaaaaggcctttcacgcatgttttcacaatgccccaatactacctgcctctcgtctgcaccatcccctcagcaatctctgccatgggctgacgcctgctcttcaacagaagttattcaaatgacacatcgtatgcccttctcatgctgtactacactgactgtctctacaaaattgtggtgccagaattcacttcaaaggatctgcatgtctctgactacatgacaaagatgtagcgtataaaaagggaactgtctatttctggcaccacaaaatgcaatctatttgcctcaccaagcacgccgctgctctaaagaaagtttttgctttcaaagaatcctgggtttgcctttaaattcacactgtttcatactgaagtgactaactttgaatcattcaaaatcgctgtggtccttagaattttcaggcactacggaatatactacataaatatgagcattctcaagcaatacacactaaaagacatacagccaatggcctaacccaggtccacctctggaatttgggagctgacagaaagtgacccagaaccactagaagcacaaagcagaaggaaagataagtgctgaccaaaatgcaggaggggacagggtatcttaggaagctggaaaacatggagagatgtaaaggaccaaaagcaactcctgttcctggtcaccaattgggatcagtggaaaagagtttcagtggaatcccaggagacatctctcaaatgacctccggctccagtcctgggaaacttgctcaacaaatgatgcaataaataacacaaaggcaaaacatatgaagctgctttttatttttaaggctgtaagaacctcttgtcacagctctgagaaggggagactgaaggctggaggcagccacaccaaggaaccaggcagtgaagagcagggtcgtttcctaactgggagacgtggcatcactgcaagcagaggttgtcgtgactcatcaggatgaatccacagagcagtaaagaaaaacaacagtgaaggaagagcttggcagccattacgaaatgagaggggcgagaagctcgggttgtggacccacaagagtgccccctcaaccttgactgttcccaaggctctgtctgcctgcattctttgaaaaccttccatctactggacctacagagttctggttcatcctctcaaagtccaggtcagatgcctcatctttccggtgaagtcctgtggactccaaacgtagtcactctcttctctgtgctgccacagtactttgttaaacacattaattacaaccttagcttacattgtattgtaaatgtcacccaccagactatcctgggggctatgattatattttactcatttgtatttctcacagtcagtgcctagaacatagtaagtgctcatcagatgaatgatgagggtccactagtaggaccctccagagttcctaaggccacagcagttttcaggaagattcataatcaacttatcaaaccaatttacttgaggaccaatctatttctggctgtggggatatgcaccactactctccctgctccctctgaaataggaatgaggaagcttctcccttgattccattctagccatgggaacaagaacgcagatgcatcagacatccttggggatgaccctgccaaacaaattatattccaatctcacatccaccagaccaaaacctaaactaggtcaaaatcattcattcatactgagagggtattaaaagaaatatttctgaccctttccctcctctacccatcagcagatgaaatgagaaagaccagtcataactcttttttttgtttgtttgagacagagtttcactcttgttgcccaggctagagtgcaatggcgtgatcagggctcactgcaacctccgcctcccgggttcaagcgattctcctgcctcagcctcctgagtagctgggattacaggcgtgtgccaccacgcccagctaatttttgtattttttagtagagatggggtttcgccatgttggtcaggctggtctcgaactctcctgacctcgtgatctgcctgcctcggcctcccaaagtgctgagattacaggcgtgagccaccgcacccagcccataattcatctttaaaccaactctccaacaacctgtcctctttcctcctactcagactgaatgagaagtctggtcttggcagtcccttgatgtttatccagcctttcctgctgtgacagaatacttgatgtgctaccacagaactgcttgcaacgctgacgggtcatctctgatgctaagggagaagaaaagggaaagtccctggagagccaccatattgagtctttacaatttcatctagtggactgtggagccataaatggtgcacaataaatccaggaatgctggagggcgaactgacaggatccagtaggaacatcttagaacagaccggtgtgtgtctcaacacctaggacagctgccccacaaacagacggtccagggacacacccttgcccctccccatttcacaaagctcccatggggccttgtctcccagcctctagccttactccagtgtcaatatgggatccggcaggaagaggccaatgtgcaattactaaataaaactccttcattgactgagttgcctcctctccttccaggctcaagatcaaagattaagcaacagaggagaggtggaagtttatcagagaatcaggatttcaaggttggaatggactctacaaaacattcaccctcctcctccatggcaataactatccatactttcattattaggccaaataagcctctacatttaccctcaactccacaggcccatggatggactctaagagtatttggtatttaagataaaaatacaaatttgacacagtgcaccctccaatgcaaggtaggaattggtgggcaccttgaaagaagtatccttgttaaacctctaagactcttgtattgtggaagaattaattcattcttggggaaatccagttatttctcccatgaagacaaagagaggtaccttatgtcactcacccatcacctgtctagacacccaggactttcacaagtatgactggagaggtgaggccaaacacaagagctgagaaacagcacagccctgtgaccagtagccagggtgtaagcccagctccaccacttactagctctgtgatcctaaaaagcaggaaaacactaggacctacctacctcatttgcttgtaaaaagattaagttagttaatctacttagaacaccataagtgctatatttcttccataaatgaagaggctaagccaacgtttctttgaaacatggtatcccacgttggtgagaatttccaatgtgacagcagaaaacagtaggttgtaccatatgaaactgccaatatttgaccatttttatgtacaaaaatggcaattttatattaataaatcaaatatatgtgaaaaagaatacaaagcagtgcatttacaatcatcctaaatgcctaaagcttaggccttttacagaaaatatttcaaatgactgtttaaaaaaaaaaaaaaaaggatcaactatttgtatggggctaatcctccccacccccagtttggtctacaggacctcatgtagattgagcaactttggctatttgggtagctgatccactgccaagctggctcccagctaccacctgttactttgacaactctagcttcagggctaccaggaccatttgcaaaacttacacccacagaaaactcaaagtctccagaggcataagctccaacccccagagagctccacagcattcttctccttctagtagtacttttggtttccaggaaaatcatctcatgctcgggccacagtcacagtcctgaccagcaccatagaaatttcagccattattctagttgtatggagtcattcaaaatactaattccgaaagaagtttcaaaggtccaacgccgagcatcttttacctttgctaatttttccataaattgaaagcctttctagaaagaaaggagcgtatcactgttaaacttcaattatacaacacaggccctctgttacaacttcttgtcaatctataattatttcaaaataaagtttctaaataggcattagtggaacactgattagtaactgaaaaccaaagcagacttagtcgatcatagaatgacaaaaaaaaacctggaaaatgttgacctcattatttcagtttttcagacatatccttaaagcgaggtcaaactgatccatcaacaagtcaactgaacatttgatattctaccttggaacaaggaaacccaaccatcgatcactccaacattgtctgagatacactaaattactctcactgtaaaagtttcttgaacagagaatgtcaaaatcttcttttttttttgagagggagtctcactctgtcgcccaggctggagtgcagtggcgcgatctcggctcagtgcaacatctgcctcccgggttcatgccattctcctgcctcagcctcccaagtagctatgactacaggtgcccgccaccacacccagctaattttttgtatttttcagtagagacggggtttcactgtgttagccaggatggtctcgatctcctgacctcgtgatctgcccacctcggcctcccaaaggagaatgtcaaagtctttaaggctaagaaagaatgtaatttcatggctgaaaaaaaaaagttttttttaaaaaaaagttcaattatacaaagatataaaaaaatactctttcgtaaagaacaactttgatgaaaccttttagatgtactgtgtgattttatgtcttcagtccactataatagaaaggctcttttcaatgactgccccagtaataacaggatagtagcagaatctttctggcctataaactaagcctagttaggaaacaagacccagaagcatttatacttgtctgaactcttgattccatgttattacatgaactaagtgaagacctgaaccaagatcatcagccttctattaaggcacacagatgatctgattggcttgggcttaatggtcatgtttcagcttcattttattgctccgcttcccttgacaccagaactatttatctcctctacttctcaatactaaaaccatttataaatcccaagaacagtattcactgtaaatcaaactagtaagtaaactcgttctccaacaccaaaccatacactttcatgtttctcaactaaaagtagagttcattacaaaagaaactgagaaatgcctcctcatgaagtctctcttaatattttatgtctacataaggatatgatgtgggtagaggtagatggcagcaccagtgtctcaggaactgttttctagtgccccccaaaacagaatcacgggtctctatcctcccctggcattcttaatgttataattaatagttaataattaaaatacttaattaactgaactaaactgaagatccacctagcatttttttcttttcttttctcttgagacagggtctcactttgttgtccaggctggagtgcaatggcatgaccatggctcactgctgccttgaactcctgggctcaagcaatcttttcataggaactgttggagcaactgtttggagaactactatctgaaagacaataacatatttttccctaaagacattcttgcccccagggcacacttttctggctgccatcaaccctgctgcctagattcaacgaaatggggatgtcagatgattctgtgagcaacagatctaggcatgaacatatacatataagcacaactcatacctctaagggtgaccatacagctaggaacagcaaatggcagattaccatgcataacacaggacaaggaaagaagttcaaacgtctaatcagtgccaacttccatacattcacacaagttcacaatagtttcacagtttgcagaagtttggagtcactagtttgcagtaagcggaaagcatggcttactggtaaaatgcatgaactctgaagtcagaaaagacttactcatttataaaataaggtatttaatttatccaaatattggtttcttcatctttaaacagggataataccatgtaacacaaaagagttgttcaaggattaaattaggtatatactaggagctgggcacatagtagatacataatttataaggtcctagtcatgcatataattcctatataaggcctaaaaaatctcacagaaaaccacatggtttcattctgcactctgaaatccagctggtattatgccactactgtatgtgtgctatataagtcaataaaagtgggaaccagaaacaaaataagagaataactacttagactgtgtatcccccaactgggtggctcaatactatttctttataaataaagaccaggatgcaaatatactcctgtgttgtaatagtgctaagtttcattgttttgaagcacacataaaatatgagttccccaaagtaaatgctgctgaatttcatacaaatattcacgaacattacatattgccaagccttctcacttagagctgtgtataaaatacaagtaactagatgtcaacaaacctataaatcctatgagagcaggcactacacacaggcatactgatagcttcaaggagagaaaaccggtaagttgacagaaaaacaatagaaggcacaacaggaagtccaaagctagttactatggaacaaatacaccgtgtgtgtacatgtgcatgcaaatacacataactcaacagacctgcagggaatccctattgtaagagtcatcatttacagaagacctagcttataccaatttcaatttcttttttttttttttttgagatagtctcactctgttgcccaggctggagtgcagtggcacaatctccactcactgcaacctctgcctctcaggttcaaccgattcttttgcctcagcctcccgattagctgggattacaggtgtgtgccaccacacctggctaatttttgtatttttagtagagatggagtttcaccatgttggccaggctggtctccaattctggggctcaagtgatctgcccacctcggcctcccaaactgctggggttacaggcataagccactgcacctggctcaatttcaatttcttaaaaaatgaagaaaatgaggttaagacgggtttactgttcgtaggcaagagtcagtaggtggtgaaatttaaacccaggtctttctactccaatttatgctatgctccataaacacagtgctcaacacaaattacatttgtagctgaacatgattaataaagagaaaataaactgtattcagtcgcttcagttcaagaacagaaaaaatatattttcggattttttcattaaagtagttaaagttttggccaggcgcagtcagtcactcacgcttgtaatctcagcattttgggaggctgagatgggtggacaacctgaggtcaggagttcaagacacacctgagcaacatggcaaaaccctgtctctactaaaaatacaaaattagccaggcgtggtggcgcatacctgtaatcccagctacttggaaggctgaggcaggagaatcacctgaacatgcaaggcaggggttgcagtgagccaaagatcgtgccactgcactccagcctgggctatggactccaactcaaaaataataataataaaaataaaataaagtagttgaagttttgtggttattataagaataaattctcaccatctagaaaatggttaacccaaaatgattaatccctaatggttcaaaagggccaagaatttattgtaacttgcatccacatctgggaaaaaaaaaattcattccttaactctagagaaacacttttaaatataaaatgtgacaacatgactacaaattctttcagttggggctttcactgggacttatccagttattattctgataattatcagaaatgaaaaataaaacaaagatgatttatcttgaccaatcaaatattttagggaccaaaaaaaataagcaaaagaagtcaacaattatttcaaatttcccatggttagaataaaaaaactggcctcctttcagagtcctctgctctatcagagaaactggggatggaaagggaacctcagagctgtgatgttacattcaaactcccacaaacggcctacattttgaaaatgaagaaaccaaagctcagcacatgacatgactaaacctgggtctcaaagtcaactactatcagattttcaacatgaatccaggtacttgactctctaagtttagtggaaatgtctgaatctaaagaccaaaggaaaagcctgaggtcaggccagtgtcccctgggactttccagtgttctctaggagaagcagggaagattaggcaggtgtggtttacactacagatccccagagaaagccctagagaaagccctaccgactggagcccagtcggcctggagcgactgtgtcagcttggttgttcctgacaaatacaagaacgatccagaattatataaaaatccaaagagagagaaactactcctggatgaacataataacaatatgcaaagataaattaccaaattagaggaaaagatgatgtcttatgagaaacatttacatttgaatgatgaaattcgatatatcttggatggaagtaggtattttgacataaaagatatagaggacacatggatctgaattgccagggagaaaaagatatacatatacttcgtgtgggaatttatcatcatttcactctggatgaaaagtactatgcagagacaatctggccctttgctagataaccggtatgaaccactttgatactcaaggacaatacatgacacttttggcacaggcagcatagtggggctctctaaaggactaatacactatttgtaaaggtaataaacatgataactgatcagaaaatcattttatttttgtttttatatcgcagacttgatgctaggttatctttcctttgcaagattatttcatcagaatatttttaaaggaacaataaaactgatcttacatggaaaaaactgaaaatgtgtacaaatctctaattaaatcaagagtagtggtctggcatccctatgttagttcaagtattcaacattaactcaaatgtaacaatttagcatgttctatctggacaatattcttagacttcaagccaaacatcagcaaatgccatgcctgccttagcaaaaggtgtaatcgtagataacataattaaccaaatataagatacttttttctcctaaaattatattttaaggtgggaagtagaacgagggaagaacctctcatattacagggcacactctcagttgcttacaccactttcctgttctaaataaagtaactgtcttaatttttttaaaaaaagaaaaaggccaaatgaattgcgtcatgtgaaaagtacagcattacatttgctgtctatatttaatcattaaggaaattaaatactatatttaatccatgtcaagataaataattaaaacaggcccatttttattatttacaattaggccctatttggctaatgggaaataactcaaaagtcagagaagttatttctttagttttcctaattcttccaaaagacaataactaaactttattatatcaaattttgactatggttatagttcctcaggaatacctgggctctcctaattagtagcactataaagattacttcccatataatggttcagaattgatacctattacctcatcagatgaccataacaccctgattggtggtcaggtgtgaatccccagaagaaaccaagtctaagaagaggttagaccacctcttcaatgtctcactggcatcaactgcctgaaaacagtccagggataggaccttgtgactctaatgccctttttatagagttttagtgtaaattttcgaatgtgttaaaaaacaaaaaagcaatttgtaaaaacatggatttcaagttagtggggagatgatgattttttgtggtaggacaactggatagtcagagaaaataataaaattagaatccctcttacatcatagactaaaataaacatcctatcatttcaaatgacaaatataccaaatattaagtctaagagttaaatatttgtagaattagaggcatcaaaaggtctctcaaacatgacaccaaaagcagaagcctttataaagaaatgagtgattgatgtgagttcatgaaaatataaaacttctataacaaaaggttcttaatatataagtaaacttgaggaaaaatatttgtaccatatgtgacagaaaactaatatccttaacatatgtagctttaataaataaaaaaaaaaaagacaaacacgccagtaataaaatgagcaaagggcttgactaggcaatccacatcaaaaaaatgagttctcaaacttgaaaaaaaaaagtttaggccaggcgcagtggctcacgcctgtaatcccagcactttgggaggccgaggtaggcggatcacgaggtcaggagatcaagaccatgctggctaacacagtgaaatcccgtctctactaaaagtacaaaaaattagccgggtgtggtggcaggtgcctgtagtcccagctacttgggaggctgaggcaggagaatggcatgaacccaggaggcggagcttgcagtgagccgagatcgcaccattgcactccagcctgggcaacagtgcaagactctgtctcaaaaaaaaaaaaaaaaaaaaaagtttaaatgtaccagtaattaaatatctacagagtaaaagatagatttatcactttttactaataaattggaaatttttaaaaaattattatatccacaaattgagtatgatgacagtggtactctcatttaggaatataaataatatgtcacttttggagagcaatgtgtacatgtcttttgacctagaagttctaattcctgtatgttattattgtttgctaattctagaaatgtattctaagcaaacaataataacatacaagatttagccagaaggattttcatcgtagggttgttgactaacaagacaaacataaatgttcatccaggaacacagaatcacggtgaagccacccaatagaaatctacacaaaacatgtgcatgtgttgggggcaggggtatatcactactgaaagatgttacaatagtcatgatacactagcaaatggaaaaaaaggttatgaaacattatgcagtatataaccaccatttatgttggggatacacacacgattgagaggatattcgtgaaaatattaacaaaggttgtgagagtccaagtgatttttgtcttttctctggattctaagtcttcaataaataggaataacttttgtaaaaagttatgaaattaaaaaaacagaacaaaaacttccaaggaagggaggcagcagccaatactgctttaatgcacagagcaactgattctcccccgagaagcacttggcaccttgggctcacaacacactcagccattccatcctcaggtcctgagacgggaacaggagcacatcgggatgggcagaacccctagtcgcatatcacactacaatctcaaaccctggcacctgcttggaaagcactccaacagtccactagcccttacgaaacacaagaaggaatcgcctgcacttgccagttctctccatgttaacaagatggcagttcaaaagaaggtatacagcaaggggtgagaggtgtctgcaatgcacaaaaatatgtaaatttcaaggcatggaaaaaggtactaaccccatggggagcaattgagaatattaataaaaattattaatgcaattatcttttaacccagcaattccacttctgggaatttatctgaccttctacatacaaagttacacaaatagcactatttataacagcaaaagtgcagaagcaaacaaaatgtcccttacatggggactggttaaataagtcatggtctattcacacgagaaaatacttgatgtactaataaggaaagagaggaggatatatggtaaaatgaaaaaagcaaagggtggaatagtatatagtatatatttaccttatgtacaataaaaaaaagaatacgaatatatacttacattaataggtcctagagatgagaagagcacttaaggaaacagggaacgaagttgacggacaaacaaaaatgggagcaaaccttctcaatttgtaccctgttatactggtttgctttctttttttttttctttgacacagagtcttgctctgtcgcccaggctggagtgcagtggtgtgatctcagctcactacaacctccacctccagggttcaagccatcctctggcctcagcctcctgagtagctgggatactcctgagtacaggcgcctgccaccacgcccagctaatttttgtatttttagtagggataaggtttcaccatgttggccagctggtctttaactcctgacctcaagtgatccacccacctcggccttccagtgtgctgggattacaggcatgagccacggcacccggccctggtttgctttctgaaccatgtcaatacagtacctatgccaaacaaaatatcaataacaataataaaaaaataagaaaatgtaaagtttaaaaatgcttgccaagaaagccttgttaagagggagatctaccacccacagtaggaggagcatcagagctgaacaatacagagatcctcacacagtggtcgtcttctattcccctggaagaatacaggagagaggaaaccacttactgaccacctaccactggctatgtgttctgcacatgttatctcatttaatagtctaattaaccctagcaggtataaccaaccccctctctgcaaataagtaaatggtggctggcaaggctttaggtaacttccccaaagtcataggtctatgatcggacctcatgctcttgtctgctaaaacttgcaaaggtacatatttatgcatcatagtaaaaattaaaatcttctacgtcagccagctacccacaatcatacttacttccacagtgttctctaatgttctttgttttctagattttgagaaggtgtttgttgaataaagcaaacattttgctgttctgaattttccacttactgggcaccaaaaagagttaattacgggcagtttttaaggaaaaaaagatgaacatagtttcaaatgagagttatccaaaaaagtggcagttcacaaaacaactgaaagcagggtctcaacgagatatttgcaaacccatgttcatagaaatatcattcacaacagtcaaaaggtagaagccacccaagcatccaacaacatagatggataaacaaaatgttgtatatacatacaatggaatattattcagcctttaaaaggaaggaaattccatcatatgcaaaaacatggataaaccttgaggacattatgctaagtgaaacatgctagtgaaaaaggacattatggacaattccacttataagaagtagccagagtagtcaaatccatagatagaaaaagtagaatggtagttggcaggagctagcaggaaaaagcaatgggtagttattatctactgggtacagagtttcagttttgcaagatgaaaagagttctggagattagatgtaaaacaacgtgaatgtacttaacactactgaactgtaagcttaaaaatggctcacatggtaaattttatgttgtttattttccacaacttaaaaaaaattttttaactgccagttcaatatattacagctgacatctgtttttatctctctagaaacttctcataccaggtgattctgttaacactacagatcacagtgtcccacctgacccccatccatgcctgcactgtccaccttccagaccaagggtgacacaaacacaagtctttcagggagatttgataaacagacatcatcttggagcagccaactgttctctattcaaatcatgtggataaaacctcattgtggcagaacataagaccaatgaacaggaagcagaatagcaggattcttactgagaaggggaatgcctttatatccttggagtccatgaaccatgggtcctcccccaacccccttaagacataggccaataaatccttttttttttttaacttaaccaaaaaagaatacaggtacccaacagaaaagcagtttcactgaacaacaggtccctgaacaagaattttttcaccacagattgttttggaactttatctgcagtatcatatagctctactaaaacagtagtacacaagtccaaaatttaggtagtagaatttcaaatttaacataacatttccagctgggccagaatactcttatacctctgaagggaacaatgaatttttcaatttaaatctatactatataatatagagagggagagatatacaattcatagaaagtttatacagaaatagatttagaaatacaaatgtttccaaattacctgaggtataacatagaagagaatgcctaaatattagcctgaaattgaggttttgggtgaaacatttgaacaattaaatccaagaacaggagggtaatacatagagatcctttatctgtgccttatttgaagaactgagatcttcgatgcaatgctccatttactataggttgccttggtttggttcccactaattattggccaggcttaaatttattaaatccaaatctaatcaatgactgtttactgactgcctaggtatactgactctcgtatgaaccaagatacacagacaaagcagctcatatactgagcatagtgctaggctctgcagattttgtctgacttaatgcaagcaaagagtgtatctaaaaagctatcatgctaggtattaatgtcaaaccagtttcatatctagaatctgaaagacacagcataaagctgaacagaggtgcctgaggcaaaatcttaaatgtgaactgtgttccccaaggagtgtagctataagcttgtcacaagtttttgcaaagataaactagccttgttgatttcgcagatctcaccaataaaataactttcaaacacaaggaatactatccatgtgaaatcattataaccactaatcagcatgagatccatgttctgaaattgcttttgggcttctctcttcatcatgaaagattagcagccagtaatttaatcataacaggggaaaaaagaagactctattttttgtggaaggcttttcaacactcactgcaacacacctggtaaaaataaaatgataaagcttatctctcccacaggactatcttccagccatttaacatggcttccacctcacatctccagagtaaatcttgaaatgtggcagcccagaatgttaatggtacttggagggaaatctaacccttagaaatactgctcagaattcttgcagtctctaaggctgtatattcaccaaggaatctacagaacttactgtcctagaagtaagagagatcacaatatatttaagaaacaaaaacggtcagaagggctggagtgctgactgcaagaaagggaatggaaggaaaggaaggctgtgaccatgagaggctcttcataccatgctaaggagtttggatagacttaatcctaacagcaaagggcagctagtgaaagattttaagcaaggcagtgatgtgttcagatttgcattatagaattgtttatcctggcttcacagaaaatatccccactaagcagaaaaacaccagtcatcaaagtagaatacatttcccaactaacaaaaagttaagcaaagggcaatacatcactgtcttagggaaaccagcaaacaggtgattttaacctgactgatgtaaaagtcaaagccccgcccctactcctattagtcatgcaaaaatgtactgcatttactagggtatttcatcagcctagaagtgacataaagtttgtttcctttattataacccagttgtacaaaaataaaaataaaaatcctcactacaacttcacattcaagtgcacattgtgcacttacagaatatcatttcccagtgagaaaaggcatcaaaagcaaataaattattttcatgtcctttgaagaaaactgtatctgcctttatgataaggaattataatggtccgtatttgacatgttacttgccagtgggttgcctgtacaacagtcaggaaatcagcagcttcctgccaatgtttaaggccatttgtgacttaagtttctgtttaattttccagaattacatactaaaggtcataaaattggttataacctttgacacagtaaatctatgcattcatcctaataaagcaattagcagcagaaaaatgctaattgtgtgtttttaaaggttccctacaatattctgtaaaaacagaaatagcttattctatcatagattacttaagaaaaataaaataaattaacacaactaaatactacattcaaaaatgattattacaaagactctattaaaatagaataaaaaagtttaagaagacaggtatatgtatccagcaattaaaattacataatacagtacatatttatacattatcgataaagactagaaaagaataagtaaaaacataacagcttcgtgtaggagtaaaaaatgtcaacattaggccgggcgcagtggcttacacctgcaatcccagcactttggcgggccaaggcgggcggatcacaaggtcaggagatcgagaccatcctggccaacatggtgaaaccccgtctctactaaagatacaaaaattagcctggcgtggtggcgggcgcctgtagtcccagctactctggaggctgaggcagcagaatcacttcaacccggaggcagaggttgcagtgagccgagatcatgccactgcactccagcccgggagacagagcaagactctgtctcaaaaaaaaaaaaaagtcaacattaaagaaagcattcttcttaaatgcttacagaattattattacaatttaaaaaactagaacaaagttttatcattcttaggaacaaaccaatcgtaggctgattagtttgaacaaacatccacacaagttcagtgctagccatccggccagcccttggactgagcacctagaacatctcactcaccaagtaacttgatctctcttctctcataagacactgcccttcagaatccccacggtaaggggtggaccctagacaatcctaatttctcttaaataacctctaaatcttctacccatagatatatctcaacctcctgagaagtatttgaacaaatgagtattttatttcctaaattctctatgtgactaccttctgtaccattttatcgctcagtaacaaatccagcatgatgatggattaaaaaacaatccctaaagtggtggcccagacaggtcttaggcaagtcacttaaacactctgattcctttatttctccactgtaaaatcagaaggaggtattctcaggtgacttcaatttcttacacctcttaaaagtattacaagattttatgatcattgtgtgctaataacccttaaacagtatttactagacaatggctataaactcagaaccaaatattcaggttcatggtgggcctgttctccatgacttcttaaaaccattagaactatcaattctaacctgagaaaagtaaacaaaactccaagccaagaagaaattcgtttgactgctttgctttcttccaatattcaaagcaatatgtattctcataagtgtctggctcccaaatacctttcagagtctcaattcgacctagcataagcagtattttcatcagattggcaactgtgtggcaatattcctctttcaatgttgcctgatccttccttactccactgatttttttaaattgaaatatatcaagcatacagaaaagtataaagaaccattgatctttaaagaggactaaataagtctcttcacagggttcctactacgtgccaaacacaatggcagtggttcagtgtacaaaggtcagcaacagtgaggacaattaaccaaggaagtgcaataatgtatacattccagaatatgtcgcttcaggcatgacacagaagcccttaaagcataccaatgcaggtaacacactcaaataaatacaccagcagcccttagctataaacaagttctgcctttttttttttttttttttttttttttgagacggagtctcgctctgtcgcccaggctggagtgcagtggctcgatctctgctcactgcaagctccacctcccgggttcacgccattctcctgcctcagcctcccgagtagctgggactacaggcgcccgccaccacgcccagctaattttttgtatttttagtagagacagggtttcaccgtgttagctaggatggtctcgaatcctgacctcgtgatccgcccgcctcggcctcccaaagtgctgggattacaggcgtgagccaccgcgccaggcacaagttctgccttttaaagaattcattcccagttggttgtttgaaacttggcgcacatttcccccagacacactgcagtaaatgtggttaagtttccaagccaacacacaaaaggccaatttaacacataaagtatctgaaacgctatacatttgccctgccaaaatagcaggaaacattactgcagccaaaaagaaccataagtgattttgccatctcaaaagcaggagtgtgagggaaagcagagtgtaggttcataaggggtgcagatggagtcttgaggtggtgcctagaggccttattaaggcaagtgagcttagggattgtgaaaccaagggccaggttggtctggctttgatcaaatctaggttcctccacttaaaagccgggtacctttaaacatcaaccattctaaggctcagtttattgatctgaatttctggcataaacattcaataaacaattaggcattttatatagttttttcatttgcttgagactgtatagctttcattttccttgatataggagtatccttaacacctggctgggtttatgagtcattattagaaaatgttcagtttccacccaaaacaaaaacactttttcaaagtgtctaggcaagaaatgtatagggaagggatcaatgagaatgtattgcacactagaacaagatagcctcaattaaaatgaagcaactaacacgggaccaaagacagaagaaaaaggagtcttccagtaacagaagataagaaagagatactagggaacttccagataacttatggggctgtttacacagggaggaaaagagaagaggaacagtaaataatagtggtaaactccaatagggtattggtacaaatacagacaaacacacacatacataaacacacattctcatttaattttcacaatcccataaggtaggagccattattatcctattatccttttacagatgaggaaactgaggcacaaagcggttgaataacttgcccacgatcactcagctatgactgatcataagccaggattcaaacatacagactggtcgcagatttgggagtctaaaccactatcttattactgatgtttctgtagtgggaagccaaccatttgcataaggaggtttcctaaatcagaggttcataacttgaataatatttacctacaaagttaccacttataaaggtgtaaacattatgtaatcatttacagattttctggcaatattcagtatttggggtagcagtgggtaactttcgttaaatgctgctggatcccaggcactgtctgaagctattttgtaggttctacctcatttaagcttcacaaaacttcctctgtgacaggtctacacagtccatttacaattgagaaaaaaataaggctcaattatgagcccaaagtcacagagctagtaagtggcagaggacagcctcacatcggctcgtcctggttccaagtccagcacgcttttcataacaccacatctggtacgctcagacccacacaggtaaacacaggacgtgttatataacagtcaggtaatataaagcaacagtaaatctcgtctgacttaaaatgtcaaaaacagcaatacaacttttaaactaaatatttcacaaaaatataccaaacttactttaggacagctaaatgaacccaactgccctgccccaaaacctaaaaaacaaaaaatttttttttatttttttgagacagagtcttgctctgtcccccaggccagagtgaagtggcatcatctcagctcactgcaacctctgcctcccaggttcatgcaattctcccgcctcagcctcctgagtagctgggattacaggtgcgtgctgccacgcccagctaatttctttttttctttttttcgtatttttagaagagatggggtttcactgtgttggccaggctggtcttgaactcctgacctcaagtgatctgcctgccttggcctcccaatgtgctgggattataggcatgagcgaccgcactcggcctcaggtcttctttatatctaacaataccaaatactatattgtatagacacatcaaggcacatctccaaggacctaaaactgcttcaaaaacattaggttagaagaaacaagtttcctaggttctcattttaaataccaatgtcaggagagaaagagaaagaaaaggacaagtgacaatccaggagaaaaagtctctttgaagagtagaaacatgttttgttgttgttttcaatgccagagagcctcagatttgaattctagttctgccatttattagctctgctcatctggaaaatgatgccaataagatccaagtctctggctattacaaagattaaattaaatatcaaatgcaaaatacataacccaacaactgacacagtaaaagctaataaatagtctcatgcccgtgcccactctcctccccacgtgggatgatgtgctacaaatcccacagagctgggaggacatgacctaccccaagcacaccttaatcttcagactacaagatccttacaaggtgctttgctcgttttccaccaaacccacatcatgattcccatattgtcccaaagcctttttgcctgttttatataggataagtatctgttttattatcttgttgtcaccacaggttggggaaaccaaagggcaactatttattatttatatttctattaccactctccaaaaaaaggagagttgaggctacctatataaatataaaagatatatacaacagaaccatcaattaaaagaaggatttaacacatgtgacaagtaatccgatgaggagactgaggcagagagattattgtaagaaaactggatagcaactaaaaacaggcaaataacgtatctttgagctttctagcaaggaaacataatgagttacagatcacattttttctttttctttttctctttatataaaagaaaacacatcaatttttttctctgaggagagagatcaataacttgcccgaatttatttatctaagccactggcagagccaatgagtcttccaaaatacttgatgatcctttacaaaactgtaccacctatacaagaatcaaggatgtaatttgaccgaattcccttcagtaaaatgtttccactttgaatctcctgcaaattttgtacaatttgagcaagtgtacacaggatctgtgtttattcaataaacagccgtgtgcctactgggaaaggtgacattacgaagaaagagatggttcctgtcctcaagggcctcgtgactgcatagtggaggtgtgtctgcaaaagaacagaagcacagaccagaacacgacgtactggaacagaggatcacacaccaccaggggactatgtgtatacacaccgcttgttggggtagggaggggcagaggaagagaccagggacatttgaaggggccttgaaagctatggaattctgacagatggaaagcatgaagcacgggaaaagtgcattaaatgaacaagaacacagaaaagcatgggaaacattgaaagcaaaataatgaataatctattttgggacagtgtagaaggagagaaataggagagtatgctagaaagttaaactgaggttttagcataaggaacctttactatcagactaaggtggagtttggattgttttctataggcaataggggcttctaaaggcttgtgatcagtagtcagacacggaaagataaatacagcatgtgctcacttaaagtgggagctaaataatgtctgcacatggacatagagtgcgcaatgatagatcacccaggtaaagaaagccaaaggaaggctgcagcagtggggacagcgagtggcaaaggtgctgaatacgaataccagggagggagccctgaaagggcctagggaggaggtggggtggggcaaaagcaaagggagagatcagggttagtctaaggcagggggcagcagatcctggcctgtgagccaaatctggcctgccgctgcccattttgaacgccaataagctgacgcatttttaaatggttggaaaaaaaagaaaaatattttgttacaagtgaaaatagaaatgtcagtgtccatacataaagttgtattggagcacagccacactcattggtttacatactgtctatatctacattggtgctacaatagcagattcagtacttgtgacagactgtactgtgctcaaagctgaaaatgtttactgtctttcccctcacaaagttttcagactgctggcctagggttttcagggtggtggatagagacggtattaaccaaaacagagaaatcatccattattatgatgatgggtcagaaagaaagacggtatcaatcttggagcagttaaatgggaggtgtcaaaggacacacagcaaggcagcccagtgtgaaatggaaagctcatcccactgaaggggcgtggcactggctatcccctctgcctagtacatttttcttacagatcattgcactgcctggcttctactcattactcatccttcagggctgaatttaaatgtcactttctcagaccaggagcccttctcccaaccccccaacctaagcattcactacccataccttgctaactttctctattgcacttatcaccacctgaaattatcttgtttatcaatgtgtttaacatcttagactgttggctacttaaggacagggacctttcctctcttgttccccagtgtccccagtgccttgaatagtgtctgaaactgtgcaaccagtatttgggggaggtaaggagcagagaggaaggaaaataaataaaaagggacaactggagctcaggcaaaagtgggtcatctgcacagttttcgcaacatataaatctaccattcacagaacctttagaaacatcctcattgggggaggaggagaagtgagagaaagagacgatactcaaaaagagaacagagacatacagagaaaggaagtccttactgtgtctcagaagccaggcaccagtagggttgagggacatctgccaggaaggaggttttcagcagcatgaactgttttagataactagggcagaaaaaaggtgttaaaatgtgacagcaagaaggtcactggtgacctcaaggaagcagtctcatgagtgtagaggtggcagtcagtttgcaaagggttaaagaatgagtgggtgggaggaagtgaaggttttcaaggtatttggcagcagaatgaagggaaagaggaaagagaggagaggtgctctaggggcaacagtgagtggatgggatccttccgttttttcatgggacacaaatctcatcatgttactaccctgcttaaaaacttcaacttcccctaatgcattataaggcccaaaagtaataaagcacataaggccctgcttgaccaggttccttcctgcctcaccagcctccacctttgttctctctgcaccagctgcagggtgttggtcccaccataggtctttggcacatattcgtgcctctcactggaaatcctcctcattctcttggcacagctctttcacacttcagatttccatgtataaaagtgtactgcaggccgggtgcagtggctcatgcctgtaatcccagcactttgggaggctgaggcaggcggatcacgaggtcaggagatcgagaccatcctggctaacacggtgaaaccccgtctctactaaaaatacaaaaaattagccgggcgtggtggcgggagcctgtaatcccagcactttgggaggccgaggcaggcggatcacgaggtcaggagatcgagaccatcctggctaacatggtgaaaccccgtctctactaaaaatacaaaaaattagccgggcgcggtggcgggagcctgtaatcccagccacttgggaggctgaggcaggagaatggcgtgaacccgggaggcagaggttgcagtgagccgagatagcgccactgcagcccggcctgggcgaaagagcgagactccgtctcaaaaaaaaaaaaaagtgtactgcaaagactcccttttcttacaacccacctctgacatctctcccggtactcagcatcactgtaacaaacagtaatataattgctgaattgttttttcaactagcaaggaacttttctaagggcaggagccaagcccatcttgttctcacatacagtgagatctacagagagttgctgaataaaggaacaaacatgaaaacctaagagcatttgtatttcagccagcttgtagatggtaggtggcctgcttcctaaatcacatcaagtgggcttacaatttatgtttgggccaatatgacctcctctgacttcttcctacttccaaccaacccaagtgaatggtcgttctacacaagtaaaaacatgaggttccttggagttaccaccatacatcaaatgattttcccaaaaagataacccgtatactgtgattcgtggacttgccttaagttttacagaatggttttaactgaacaaaatcagtcagaatattaaattaagacattagcatattactttttagtctatgttatgtgaattagtgctaaaatgggtttgcaggtacacctggcaaaaagccattgtacttctttctttataatatatattgcatctgtccgcatccctgtgtgtgatccaccaaactagtttaataacaaaatttttatctggaaagacacatatttggcagattattttttccttgagttgttttctgttatcttttctcttagtacaatataaacattattttaaatcataattgaaaaaaactgttatatagccttactacaacctgatcaaattaactgtgcaagcaagcctccagataaaattgtgcttaactgaataaactgttgtcagttctaatacccttaagtccttaaaacaccattaaaaacaaataagagttgcattcattacaaatggttcttagctatttctactttatattcagaccagtctgagttaccaagtgtatgtgaaaataacagacctaaatttatgttttaaatacctacaggtcagccttttcagctgaagtggactttcctacccactccccctccatacaaatcaaattagggagctttcttgtctttctcattctagagtgggaagacaagggaagatacagctaactcctttgctgtcaaagcatatgggatgagaatgacatcaatagcgcttttccaatcacgtggcaacaactgttcttgagtataaataatgcccagacccaagaaaccagtccaacatatacatcaccaagaaggaaatacatttaaaatattttaaaacacacatctatgattaggaggaagggccaactctttgcacacttttacattttgggtaaatcttgctttaggaaagcaaaatatgtttatggaaacagaaactgtaaaagggcattccatagaaactgaatacatatttgagagtccctttaaactcttataattccttaccagcaaaactccctggagtattatctgatttacaagatatttaatttccacacaactctgaagacaccgttttacaaacaggtatacatggtgcctctgccaatagcccacaacttgctaagtaaactgaatcagtgaggtcaacacagtatcttcacattaactttcccagaaagtcaaatacattcctaccaaattatataccttggatggcactttaaattaaataaaagcacctttgttagtcatttttccttaaaaataagagtaaaacctaatttacctagcacctttggcactgtctacgtaataaacccttctagatttgagaaactgccttcttttttgatttactcattgctaactgaaatctaacatagaatatatctgttagtttttgttttgtatctactggtggcatcttccctactatgttaaacattctgaatataatttgagggttttttttaaaatacacatcctatttatcaatcattaaaataaaataagccaggcatggtggttcatgcctattatcccaaaactttgggaggccaaggcaggaggattgcttgagcccaggagttcgagaccagcctgaataacagaatgaaacctctctcaacaaaacaatttaaaaattagctgggtattgtggcacatgtctgtggttcctgctactcggaaggctgaggtggggaggattgcttgagcccagaaggtcaacgctgacttgagttatgaccacaccactgcacttcagcctgggtgacagcgcgagaccttgtctcaaaataaaataaaatgtaaaaatagctagcacattttcagctcatgctggcatcacttcaaaatcttaagcatagtcattcaaccctcaaaacaacctcagaggtaggtactgtctttattgtcattctatggataaggaaacaggcgtaacttgcttgcaaactcacagctaggatcaaatcatacagtgtagatccagagcctccaaaaacagactatcagaatcaaaaaacaaaacaaggctaaaagacaatcaatcagtctgttttctactcagaggtaccataaattgatgtgatttagtctcctacagccggcttcaagttattactatcttctatgcagacggccgcagctcctcttcctaggtttcacagtcaaccttctctcgcagctcactcttaagtaatcttccctgagttaaagcaaagattcctcactggtgtttcaccctgaagaaaacctcttctttgaatttgtctacagaaattctctgaaagcagcttcttatattgtcctcagaccttcttacatacctcctaacccctaaatgagacatctgaagttgcccttttctgctagagatgtgaactttcacttcatttatgctcaacaacttgacctcttcttcatggcttgatgatcattaccaataccaaacaccatactgtgctgtgattaacaatgcaacctcaaattgctagcttgttgacaatggtgtttgccctccactaaatgccccagattgtttcacttttgagttttggttctccttgtcataaaccagtagaaactccttattcacttctaagataaaaattaacactgcttgcctctgagaacatgtcttcctgtattcatccacttaacaactcttgcctcttaggtttcttgtatttaatttcctaatggcttaaaaaccagttagataaactgtcaaaaaaaagtctttataaattaaaagcaaatcaaagtaggttttattccactgtaagaaaagcatggatgaacttcatgacatcttgcttggctcgaagcctttcttgtttcctagtagtcttctggatagttgataaatggcagataataaaaggcgttttctgggatggggaggagagagttgcacaatggtcagatgaagctcacccttcatagaactctcagtgcttcaggtcttcatttgctaacgatgttattcttgagcttggaaacttcaaatggcttctcatcttccccactcattcgttcaacagaggcctcagtccctaacctaacactgctcacaaatttgtggaaagagctacggtcttcacaatctggatccaacctgcatgtcctgccctacctccttccgctccctcccaagcagtctttgctctaatctagtggccacttccaagtctgccactgacaccacgtacatgcccacttttatgtccttgctcacactgtatctctgcctagacttccttcccaccctaaaacaaaggaactcctactcactcctgaaggcccaactcaaatgaagcctcttcaaaaaagcatttgacaagggctccacgcaggaattagctctcttcagggtcctggagctcttaattctgactgctactacagcatcacccacaatgtgttacagccatgtataccaagtttatttccatataaactatgtcttatccttctgccaggcacttaataggtaccaaagagatgtctgtgcatacaaagaatgaattaatctgtaacattaaaaaaagaaagataacaaggggaagctacttcctagtcctcaaacttcaaaggagtgccatgaagggttctaggaaacattctacaatcacaaagatttactcttttacatgcatatagtctgcaactgtaaaactgaacatgccctcagggtcttccactagactgtaaattccacacgaggacagatttgtacctgttttgttgtctgtctattcactctctgagattcactgcaagagctcaacaagtatttgctaaatgaataaaagaatgtataaaatgctagtgtgaatagtactgttaaataaattcagttactgcagattaaaaatatcccaacaaacgccagctctatcttctggccagagtagacttaaaagaaattatccttttgcttctaaagcaggtcttgcctcgggactgggcagtttatccgcagagcaccaaggaagaatgtgtgcccactgccaactacaaagaatcatggatcataaaccctcagaagtggaggtatcacggaaatgagcttaatgttttatgctttcctgtcgccttaaactgccaagaaggctggtgcacctcagaggaaagaatactcacaggaattagtttccggtccctgaaacccagtcatttcaacatgacagctgtttgaaatcccatgtaaccagagggtttctgagacaggaagcaacagtggcacacctagctgagcacgggggagagtaagaagcagagaggaaacaagctgaatgagaacatggcttggaggcagcaaggaaagtataaaaacaatgaaccaggccaggcgcggtggctcacgcctgtaatcccagcactgtgggaggccaaggcaggcggatcacttgagatcagaagttctagaccagcctggccaacatggtgaaatcccatctctactaaaaaacaacacaaaaattacccaggcatggtggaacgtgcctgtaatcccagctactcgggaggctgaggcacgagaatcacttgaacctgggaggcagaggttgcagtgagcctagactgtgccactgcattccagactgggcgacagagtgagacaccatctcgaaaaataaaaataataataaaaacaatgaaccgatgtctctgatgcctactataatgtaatttacctttacatcgtaattattaaaaaagaaagaaatgaagggcacagaaacaaggaacaccttccttggtcaccagctactctctctcatcattctctgaatcctaactgctcttatagaaaagaaattggcaaggatgtgagtgtgcttaaatggacaagcgagtagagcatgaatgacttgttccctctattttctactttcctatattttctaatttttctatagtgaattctccttattgttatgatgggaaaaataacctttgcttaaagaaattatagagctaaaaagtacatgttctgacaataagaaaactaagtatactaaaaaaacctttaccccaaaaaatgaataacaaagaattcgataatatcaaaccatccacaggcggctttttactcaacatattgccttaaccctggttccctcaactaccggtaaatctaatgattcacttatgaaaaatactcttcatattagttatgatttgcatagcacgtcacagtttccatgcattatttacctgacttccccccaaaactctgcgagatgaccagggagaatatttttatctccattttgcaaatgaagaaaagaggtgccctgaagtgaaaaaatttgccacaagagcccagatcttcttgctccttactcagtattccaaagcaggacttcttaacctgggcactactgagatggataattctttgtttgggatggggggctgtcttgtgcgttataggatgtttagtagcatccctagcctctaaccactagatgcctaccagtagcaccgctcccttcccccaagttgtaacaaccaaaaatgtctccagaaactgcaaatatctcattgggtgcaaaatcatacccttactagtctaaaaaaatctgaaagttccttccaacactcctgttcaatgacaaggttccatataccactgagccacaataatcacagaacatccaatgttccttcttcagcgagattccattaataagccaattccccatccacttaaaataatggttttaaatgtgaaaatgaacaagaaaaatttatttgtatgaatattcacatctcagacaataaatcttctaacagcatgctattatcttatcaggacataaggacatacaaaatgggatgtgtctttgaggggaaaaaaacaccagaggaatctgagaattagaaaacacagatcatggtctttgctatgcagttataccttagtgttctcttgttctctctacacaaatgagtatcaacctacacgttctcaatgcttgtttcagtcggaagtatatggctttagccaagctcatgttaagatcctaaattacaacaactgaaatgtagttatattttaggaaatgtttgaattattttacctatatctaatttatgcattctctacaatcatttcccaatggtagtaaataattagtatagtatgaaatggaggaaaccatttaaactggctgtattcagtgtggagtatcacactgcaatcctagcagtaaaaaaacatagttttgtatctatttgcagaaactaagactcagtcaaagcacttagttaatatgatatacagaattaagaagaggttatgattattcctatttataatgtccaaagtcattccagtatgatgtcttcacatctttaaatgtgatctggatctatacaggggagacattttctccacattacaaagcatattgtaccagaaatgtctggaaccctggtggtctccattaatcttcaccacaaagtacaaaagaacacattgatccttcaatgaaaataatcccctggtcttggaaaacatcagagtcaccaaaagcaaaatcaagaaacaacacataatggggttttggaaagggaagaacaaagattcaatcaatacgaattgctcatcttaaacaaaatctactgtgcctatacccatatttaactcaaatcttttcttcaaaaaataaaaaaatagccaaaaccaaacacgccctgatttacatctctctctgcattattctcatcacttaactacccatgttttactccctgaaagaagtaatgacaattttataccactgtaaattcctgccagtgagagaaaaaccctatgacttggggggaaaagtgtcaatgacatgtatagcgatgtactcaaccaggggcagaaggcagctcacagccacgtagtaagaagagtggcaggaaggacggggtccccttccccaggaacacacaggaaatcatggagtgcaaaccctccaaaaaacgtgtgcacaaacacctggcaaacatcgcatcttttatctagaagttccgtggtaaacacacatccaaggagcccacatcccagggaccctggggagtgactttggaggagtgtctattagtcctccgatgctcccggtcgccgacgatgcgcggatggagttggagtgagggagccagagaccagccccagtttcggttaatcagtccctttccagtgggattcgcaattccccgggtagttctctcccactgttccccttccctggtcctctcgcccagggtctcctttcccacttctcgctggctacctgaggcctggttcctaacagaacctaagaggggagggggcgtttcccgagttcgcggacgcccaacacccagctccaaatcccagaaactttccctcgctgagaccgcaaggaaggaaaaaagctaagaccctcagcctccttcctggggccgaagaagaaaacctttctgcgctgccaccccggccgggagctggcggtcaagttcgcggtacaaggagctagggacgtcagccctccagcccgcgcctgtatctcggggtggtataaacaggatgtcagacagcgcgctccgggcttgtttatgaaaacttgccgtgcgcgctgggggagggggcggcctggcttaaccgctcttctcccggccgggggcccccgcccggcgacctcctcgccgcccgccggctccgcggggctggaaatccccgccttccccgcccgagccgcggggtcctgagctgcgctcaggagcagcccgggccgcgcagcctaaggaccgaccaagagcggtggccgcgcctccggccagtccgggctgcgcgcccctcgcctgccgaccgcggccgccccggctcctccacctcccccggtgacactcaccacttccgtgtgcgcctgggccaggcagcgccccgtcgctgcgctggctggggtcgaccggcaggctcgctaggcggccagccccgcggggccccagcgtgcgcgcgcccagggctgaggaggggtcgcggcgaggacagccgggactgggcgcaggcccgcactgtctgca

SEQ ID NO: 2555 - DNA, 239423 bp, Homo sapiens
  source 1..239423: mol_type = genomic DNA
gtgacacaattacaacaactttgtgctggtgccggggaagtttgtgtctccaacgaatcccctcagtgctccccagccccgcgcgctccggccgttcccgccgtccccgcctgtggctgccccctgcccaaccccgcgatgtgaccctacagccgaaagccgccgctgccgacccgggggctccgcagcccctgccgccgccgccgccgccttcaccgccgccgcgttgggatttttcgtcgccgccgcccgcggcggaggaggaggcggcgataaagttggtgtgctggtcccgcgcgcagattgggggcgtcactgcgggccccggtccgagggggggtgtcggcgttggagttgtgaattcgctgcgtttccatgaaatcctgcggagtgtcgctcgctaccgccgccgctgccgccgccgctttcggtgatgaggaaaagaaaatggcggcgggaaaagcgagcggcgagagcgaggaggcgtcccccagcctgacagccgaggagagggaggcgctcggcggactggacaggtacgggccgccgtcactcgcccggtcggctccggacgggcagtagccgctctcccgggaggaccgagcgcggcttgtctctggcggcggcggggcgggcacctcggtttggcgctcttcgcgccgcctccgctggggcctcgggctcgggcagggacgggtcggtggcgttccctgagcgttaacgagtaaactgtgtctgtctccacagccgcctctttgggttcgtgagatttcatgaagatggcgccaggacgaaggccctactgggcaaggtaaggcagctgcgagtcggagcgcggacaccgtctccctggccggcgccgcgctcgccccgggccccgcggccgggtctgtgctcattgtggccacggacgatggtcgaggggcttccggaaactatttcctgcctctgctctccccccacccccgggtaccctgcttgctcccttgcgaaatcgctcttttcctcttgtagctggaggaacagagacgggatcgctttggggccgggctcaactgggtcgacacaactgcctgctattttacagctttttgagggtaggccgatgatcttcgaggtgcctgtttagggtcaagggatcgtgagtgtgttcagattttcccaaatttcggacttaacttgcctctacgggtttaaaaaaattcttttccttcaagcaggctgttcgtgatgcctactgctaaccaaatgttttaggctttcttgtgtccccgctcccagaagggggaagtttcacggagtttaggtcggtgaagagtttgcattgggctgttgacatgtatctcgattgcagtgtgtgttacctgaagttaggtgacttgtttactttttgggtctttttggcatagaaataccgtagttatttgtaaacgtgttctcttcctggagcctcatttcctgtgtgtctgacaggggaggctggggaggattcggggtgtagtctttttttatttgtgtggaaagttgttggcactgtcatttagttaagtaatggctgctcctatcggcccaagatggcgggacagggtgggaggagaaagtgaaggggggggttagggggagggtgtagaggtaaacatggaaataaatagtagccgtgaataagcctttccttcggagtgtgtagctcagtggtgtttaaaaaaaattacccaagattatttgcatatagaattcttatacctttcataagcttggaagcagcatgcataagcctggtaaatgcttatcaacctgtagcacatttagttatccatctgtaagctattgaacaaaggctggagtctcaatctgtatgcatcagtttatatttcctgaccaaaatctgattgcaatggtatttgaatactttcttcgtaattgggaccgtgaaagttggagtgtgtgctatgggtgttgtatccgttagacattttcttttctagctgaaatcatagctttgcatttgacacctagctttattgttgcagttgagacgcaagtttgaaataagtctaacattttattcttaagttgatttttttgttgttctgaatttttgtctgtagcttggtttcgcagagtcatcaattcctttttatctgtaattacacatttgtttttatttcaaagtaattataaggtgttatattgcatataatcagaaaactaaatggaaataatgcttttcagtaagcccggcccctttgaccgatacagaaaacttgaattaaactttgactacgtaggtattaattggcttcattacaattattgctgtaaaaatgaacagtgactagctctggaaagatttaagcgtcagtaattgttggtctcctgccttaaagtttttttttttttttccaatttgagtatttaaagtattttatttaaaaatatttgactgctgtcaaagttgtcattataaaagattaaacatgatttaaattaaaagagcattattttgttttggagggattattgttggtctaacatgggttaataaaattgcttgcaaagataattcacgtggaaaagtttggccaaatcgattgcttttggttatggtgatgaaaaaataaatggaatctgatgttttatgttgagaatgtgtaaaatgctagttgattttatgtcttagaatgctcatattcatatagattcactgcgaatagtgcttaacattggatttcggattgtaatattaaaccctgcagttatgcactaacgagtttaaattttaaaaaagtaaccattttcaaatattcttggcaagttgtgcattacttgatgtttgaatacatcttaaaaatgaaaaactagtgaagcttcactatgtttggggccttcatgatatatggggtaatttgatgaacgattaagcagtttgttaaactaaagaaaaaaaaatcttcactgcttcagactcagtgcttgtgaggtgtcctacctgcttaggacaagattcatcagccttaacattaaaataaaaccttctgtaatatgtgcttgcaaccgcatatagttcttggttgcatctttgtgagcctgaacataccagtggggtgtgtaatgtaaagcctgacattatataacttcgcaccctctgtttgaattgggttctgaatgaagtgaatgagctggagtcctgctgtaggaagtcttgaattatttagtttcatccttcttttaacagtcctcgaagcagtatttttttgttttttatttttattttttgtggaatgttgagctatgttggtttcagaattcttattccctgaaagtcttaagagttggctttcctttactgggcaggtttaggctacttacctgagggcagataatggaattgaataactcccagaattccctttttagctttgatttttgtcctgccatgcccccccacccccaaccccccggccccaatttagtctgcactttgtataacgttttcctttctggcagaaatttagctattactacttgttttcaaaaattcttattcctatgtatattattggattttctttcaagtttttaaaattcacatttgtatgttaaaaaaaactcttgacctaaaagctttagaaagttgaaagcattaaatatgtctcttacttgtcccttaacatatgtacgtatacatatatacacacgtgtacatatacatatatacacacgtatacatatacgtatacacacatatacatatacgcatatacacacgtatacgtatatacgcacgtatatgaatacgtatatacacgtatacgcatacgtatatacacacgtatacgtgtatacatatatacatgtatatacatacgtatgtatatgcgtatacacatatatgtatatatatgcatatgcgtatgtatacgtatgtacatatctatatgtgtattccttttccaggtgtgcagtttattcaaaccactgatttctcatcgtctcccgaatgtttttgtcagattcagttatattagagtcattgaaagaattttttgtttgtaggatggccatttgatatacaatgcctggggttttggattaaaaaaataaggtagttaatacaatgtattattttttggtaatgtctttaaggttgtaaacagctagagcctgcgtaattagagttcttgtgatatagggtgatcttgaacagtgctcttgaatgctgacccttaatcttctggtaatgtaataattcaagattcttatttttaaaatttcagtggagttatcgaaaactaagcaaaatattttaacagaaattaacttgtgacttttttagtacatttttgaaaaccttttgggtttttttttttttaagtagggtaaggatttgagttaaagtagaatatatacgaatatataccataaatgtagtaagtttaaatatagtagtactaccaagtatagttatagtaataatgctaggggactggggaatcttatctgcgtcagggaactattgctaaaatacacagttttgaacaaagtatcttatttttaagtttttcttaaatactcttattggaaatttttttggtaattctattagtagaaagattatacaaaatacttagaagttatagattgtatatcacttaaaaatgtatgtgcttttttccgtaggacatattagcattaaaacagttggtgttttaaatttttttgataatagaagtagtttaagatccattgaaacatattttcttaaatttggtttgctggcgtgtttggtaggggaaattattaggtcagttctagaggtggcttttttaaattgtaatatttggatgttgattaaaaacattctcatttatgtgtgttttttgtttgctggcacttaaaggcatacaggttgagtatcctttatccaaaatgcttggaaccagatgtgttttggatttgggatttttttgggtttcagaatatttgcagaatacataccagttgagcatccctaatctgaaaatctgaattccaaaatgctccaatgagcatttcctttgagtgtcatgttggtacccaaaaagttttagattttggattttcagattagggatgctcaacctgtaaattcatttccagtgctaaagatggctagtgttttggttagaaaagtcatgagagcctgtctcaaaaaacaaaaacaaacaaaaaaagaaagtagccatggaaataatgtcatgctttgtgttttaaagagttttctagtttggaagattgtcttctgaacacttgcagtcttaattttttacgtggacaaagtcttatatacttggtatttcctaaagttttgatttgtgcctggtaataaagatatactaagattatagaacatatttgcatatttggtcacaaattagaactgcagcaatacataaacaggcacttttaaagttctggttttctttttcagtaaatagttctttctgtcgaatcaattacaaattgaaataactagagagcatttgactgccacctctagatactttttgtttttttttttaatttgagacagtctcacactatcccccaggctggagtgcagtagagtgatctcggctcactgcaacctcggtcttccaggttcaagtgattcttatgcctcagcctcttgcgtagctgggattacaggtgcctgccaccacacccggctaatttttgtgtttttattagaggtggggtttcaccgtgttggccagactggtctcaaactcctgacctcacgtgatcagcccaccatggcctcctaaagtgctggctttgcaggtgtgagccgccgcacctggccaatatcttaagctgttaagaaaaactgcctgagagatgaatttttgtgacttaggtgaagtgataggtcatgcactttaaaccaaaatgaaagttcattgcttggctagctgcagagtaagtctttttctgacttaaattatgtaacatttagtttttgtttacatagtaccaatattctgcatctttgaaaggatttctgttaagtttatttttactttgaaattcattgtgatgcgttgaactctttgaaattgatgttaatgactgctaacactgcattattaataatatttttgaaatgtgttatctagagagctaatttatgttaagaaaacactaccagcttgtctaagaattgaaatggtggttaggctgtttaggactcacatgtattatttgtagattagttaattaataaagtttatttaatgaatgcataattgacagtcttaagtactcatattgaaacttcacatataattttatcagttttccacattggtttgtaaattatcgtgacagtaaattaaaacagtatattaatgtacactatgtgcaagccttctatgtagatagtatgaagatagcatagatatttcttgcccgtgttgaacttaaattctttaagaggggtgagataagtttaagggtgactaacacaggaccatctttgggagaagaaaaatgtgaaatattctgaaagtttatgagaaaggtaaatttaacaattcacaagttagaatggctcttaaagatggggattgtttgttgattgtgtttcttggagatggtatttcttgatttagatgttagcaaggcatcttataattttgtttaggaaaacatgatttaaaaatcacattttaaggctgggtgtggtggctcacacctgtagtcccagcactttgggaggctgaggtgggcggatcacttgaggtcaggagtttgagaccagcctgaccaatatggtgaaaccacgtctctactaaaaatataaaaattagccgggcgtggtggcgtgcacctgtagtcccagctacttgggaggctgagacaggagaattgcttgaacctgggaggcagaggttgcagtgagctgagatggtgccactgcactccagcctgggcgacagagcgagacttcatctcaaaaaaaaaaaaaaaaaatcacattttagcttttagcagatgttcaaaggatgatctgctgtgtgttctgtccttctttgatttcattttgtagtaatatttaccttgttatgagttcttaacttgagattcttaaatgagtgttcatgggtcaatttaaattctctgacagagtttggaaggacactcaggatgacttaatggtcatcttggagtacaagacacttttggggtgagaaggaggggagattttaaactgttttatagatttctgtactgcttttttttttttttttaacaccgtagacatatattaccttaaaaataatacaataaggccaggcgtggtggctcgtgcctgtaatcccagcactttgggagactgaggcggatggatcaactgaggtcaggagttcgagaccagcctggccaaagtggcaaaacctcatctccactaaaaacacaaaaaattagccaggcgtggtggtgggcgcctgtaatcccagctacttgggaggctgaggcaggagaattgtttgaaccaaggaggcggaggttgcagtgagccgagatcgcgccactgcactccagcctgggcaacagagcatgtctccatctcaaacaaacaaacaaaaaaaagtactctgatagtacaccagaatgttatattttggttgactaaaaatgggtttaaactaccatgtctatagttagaagagatacttgtaaaggcctttcttgcattttaattacagtctgaagttgggatacttttgaacttgatgttccttcagtgagggtaggagtgaatggagtagagatgtacccaattaggtcctatttctttgtgttttagatggctttgtgacagtcactgcgctcattcttcattttgatctttagcatttcattgctgactttattttgagtctgatttggcacaggctgatacttgggacctgattaagaactgtaacctgggccgggcgcggtggcgcatgcctgtaatcccagcactttgggaggccgaggcgggcatcacgaggtcaggagctcgagaccagcctggctaacatggtgaaaccccgtctctactaaaaatacaaaaattatctgggtgtgatggcgcgtacctgtaatcccagctactcgagaggctgaggcaggagaatattgcttgaacccaggagatggagattgcagtgagccgagatcgtgccactgaactccagcctggcgacagagcaagacaccatctcaaaaacaaaaaacaacaaaaaaactgtcacctggaagggtgggagtaatcccttgttagacagttttaggtttctgagctaatttgtagactgcttgcaactttcttctataagcttttattattttttctcttacctatttcttccttatattccatcatttgtttacttctgtatattattaaaactgttggtggtgttccattgtgaatgtattcttgtatgctttttgtaattttctctgtggtactattttgtcttttttttttttttgagatggcatttcacttttgttgcccaggctgcagtgcaatgtcgcaatctcgactcactgcaacctccgtctccagggttcgagcgattctccttcctcagcctcctgagtagctgacattacaggtgtgcaccaccacgcctagctaatttttgtattattagtagagatggggtttcactgtgttcgccaggctggtctccaactcctgacctcagttgatccccccgcgtcggcctcctgaagtgctgggattacaagcgtgagccaccatgcctggctgagtattttgcctttgttagaataaatagaagatgctgctgctaagtttattctcaggaagaaagttggggttatacttaagggtattatataaggtcatctaattcattttagtttagaacagtggaagaaattgttttagacaaagggttatttttaaactacaaatttattacgtgttcattagatttttctctctttttgaaaaaaaagtttattaggaaaaattttcagtgttttcagaaagtattgcaaatcaaccatcacccagctttaatagtttgcaactcatgaccagtcctgtttcatctatatatattttgcccctcactcatgttattttgaagcacatctcagcaatcagtcacagcatttaatccatagatgtttgtttctgaaacataaccgtgatgcccttattacatgtaaaataatttcttaatctcaaatatctgtggaccttgttttttgctgtatggaagttaagaaataattgcttggaaaatgagtagaaaacatgtttagctgagtatgtgatgtgaattttgtttgtattttgatactgctatagtgttctgtgatagaatattacataatatgtgacacaagaggtaatttttcctgagaactttatgaatcatagttgcttgagtctggatagtttttatttttagggaaaatttgttttcaagatacagtagttaaataaatattttaggtttctgaatttcaaatatcagaatgagaactacaaaagcttttgctttgcttgattgattggtgaaacatttgttgagctgctgtgggtgagggattgtgtcaggttctggggcaaccaataagacctggcctctgtcctgcagtcagtctgttgggagaggctgacagactgagtgatcatatgatgtattaagtgtaataataaagatacatgcaaagtgctgtgagctctgaaatgatggagtaattaaaacatttaaaactttttattatgcatcatttaaagtatgtacaggtattgaaggtagtttaatgaactcctgttttcaacggttctccacattttggagcagttaagtttttttttttttttgaggcagggtctcactatgtcagctgtcacccaggctgagtgcagcgatgctatctcggctcactgcaacctctgcctcccaggctcaagcaattctcctgtctcagcctcttgagtagctgggactataagcgtgaaccaccaagcctggctacttttttgtatttttttgtagagacagggtttcattatgttgcccagactggtctctaactcctgggctcaaggtatctgcccgtgtcagcctccataggtcctgggattacaggtgtgagccactgtgctggctggagcagttagtttgttttttgagacagagtctcgctctgtcgtccaggctggagtgcagtggtgtgatcttggctcactgcaacctccacctcccaggttcaagtgatcctcctgcttcagcctcccgaatagctaggattacaagcgtgcgccaccatgcctagctaatttttttgatttttagtagagatggggtttcaccatgttggccaggctggtcttgaactcttggcctcaagtgatcctcccgtctttgtctcccaaagttctgggattacaagcgtgagccaccccgcctggcctggagcagttagttttgactggagaagtgactgagggaaactgcacaaagattcagcatttagccttggttatgaaacatgtagaaatttaccagacatgtagatgtagcaagaggaaaaagagggtaaagagttagaagtataaactgagcgtggaggctcacgcctgttgtaatcccagcactttgggaggccgaggctggtggatcacctgaggtcgggagttcgagaccagcctgaccaacatggataaaccccatctctactaaaaatacaaaattaaccgggtgtggtggcgcatgcctgtaattccagctacttgggaggctgaggcaggagaatagcttgaacccgggaggtggaggttgtggtgagccgagattgcaccactgcactccagcttgggcaacaagagtgaaactctatctcaaaaaaaaaaaaaaaaaaaaaaaaaagagttagaggtataaagttaaatggtgtttgaggaattgtgaatagtcaggtatgggtagagggtagcatgtttcagtgggattgggaaaagataactgaacatgtgagaagccccatcactataggccgtaggatgttttggggcattgttaaactgaactctctaatcaggtgaagtgacatgaccagaagtaggttttatgggaatattactggccactgtgagaaggatatggtgtaagggaaaggaacttcagtaccgatgggtagatagcaatgcatgaattttaggatagaattctgttcctaccacttactagatgtgtgatccttgggcaagcaagcatctttcagagcctcagttttcttatctgtaaagtagaagtagtaatacatttcccgcagactattgcattttgtgttaggggaaaaaatgtaaagtgtgtggcattgggcttggtgcatgaaaggtgctcagtataagataatatcttggataatggtaacgtcttggaagagacgagtttaaactaaggctgtggtttaggaatggggtgagatggaggcagacttaagagctcttgaaaaaggccttttcttggctttcataacatccttgctactttgactttgtatctgacaacatctcagtctttgcaaggatgctgtgttttaggtcctctttactcaccctgttcccaatttacatacatgtttgactgcctacttgactaccttggtatcttgaaggtatctcaaactgaacatatgcaaactgaatttataattgtctttaatattccttgtcttagtaaatgtcacttaccactacccatgccagaaaccttggaatagttgttgacatctctttttctcaattcctaatcacccgacctcatcatttctattttttttttttttttgagacaaagtctcactttgttacccatgctgagtgcattggcatgatcactgctcactacagcctgacctcccaggctcaagtggatcctcccactccagctacgtgggactataggcatgtgccagcacgtgcagctaatttttttttttttttgtagagatgaggtccttctttgttgcccaggctggtcttgaactctggaacacaagtgatcttctggccttggcctccaaagtgctgggattacaggcatgagccgttgtgcctggcctacatttcaaatctcaaatccgtttccctccatccccactgcccccatcctaattgcagccatgatattgtctttgacttttgaaataccttcatgcaattttttgaatataggtatacttgcacatagtacaaaattgaaaagtgacagaaaggatggtacagtgaaaatcaccctctgtgcttgctttggcagtacatatactaaaattggaacaatacagagaagagtagtatagccaaatattaaaaaaaaaaaattctggctgggcgtggtggctcacgcctgtgatcccagcactttcaggggccaaggcgggcagatcacatggtcaggagttcgagaccagcctggccaacatagtgaaaccccgtctctactaaaaatacaaaaaaaattagccgggcatggtggcgggcgcctgtagtcctggctacttgggaggctgaggcaggagaatcgcttgaacccagaggcagagttgcagtgagctgagatcacaccactgcattccagcctgggtgacagagtcagactctgtctcaaaaaaaaaattcctacgtcatctctcacttacttagttctttttttcagaggcagccactgataaaagtttattgggtagcttttcacttttaagcatattctgttagatatttttatcacacaaatgagatcatattgtatattgttaaaatgctttgttaattttacctcttgctatatgaaaatactggtagtttttttttttagatggagtcttgctctgttgcccagggtggagtgcagtggtgcaatcttggctcactgcagccttcatctcccgggttcaagcgattcttctgcctcagcctcccgagtagctgagattacaggaatgcgccaccctgcccggctaatttttttagtagagacggtttcactgtattggtcaggctggtctcgaacccctgaccttgtgatccgcccgccttggccccccaaagtgctgggattacaggcgtgagccactgcacctgacctactgtgagctcttgattggaagaattggcaaattttgccttcatattttggttttattgctctgactgattaccaggccccatgaatattaattcattccgtgaatgtgtatagaagtagccatagttatactacttactatcttttttttttttttttgagacagagtcttgctctgttgcctagactggagtgcagtggcaggatctcggctcactgcaaattctgcctcccgggttcaagcgattctcttgcctcagcctcccaagtagctgggattacaggcacctaccaccacgccctgctgattttgtgtatttttagtagagacagggtttcaccatgttggccaggctggtcttgaactcctgacctcagttgatccacccgcctctgcctcccaaagtgctgagattacaggcatgagacaccgcgcccggcctacttactatcttgtatttgtaagattcatttattttcattatttcttcttggtttttattatagaaaagagaaaataggtaaatttgggttcttgattagttcaaaaaagtatagcctttagtttgttaacttatagatgaatatcttttttttttttttttgtaggcagggtctcactgtcctccaggctgcagtgtagtagtgcaaccttggctcactgcagcctccgcctcccaggttcagcctcagcctcccgagtagctgggactacaggtgcatgccaccactcctggtttttgtattttttggtagagatggggttttatcatgtcggccaggctggtctcaaactcctaacctcaagtgatccacctgcctcggcctctgaaagttctgggattgcagacaagagtcaccatgcccagcccagaatatgtttatttttgttataaagatgaaaaatttggtgatagagctaggacagtagtgcttttttggagtcatttaccccttgagtgtcagtaaccctttagctacaaacattttatatatgatttcagagagtatagggaatcttccttgaagctcaactatggatattagttcaatattttcagctagtttagtttactaattcttgggtagaggtgtaaatgatgtgagtatgtcagggagaaagaaaagctttagaactactggcttggttagactaaaatggcatggattttgccacatagttttgtggtgttccgtggccacatcacatattctctcaaaatctctattaataataaggatgctaggggaagacaatttggattgatcctggagaacctatggctttaactggaaaaatatcctaagcacagtcgccattaacatagttaataggctttagtattgtttcttcagcctgagtgctcaaaatgctggtttgcttgggagggtaagtgttatacctaggaagaacaatagattggaaaactgaagacctgaggccaagagttcaggaccagactgagcaatatagagtgacccctggtctctagaaatttttaaatttagattagctgggcatggtggcattcgtttgtagttccagctacatgggaaaaccgctcgagcccaggaatttaaggctgtggtgagctgtgattgtgccagtgcactccagcctgggcaacacagtgagactccgtctctttaaaaaacaaacaaacaaacaaaaaactggcagagggcagtggctcacccctgtaatcccagcactttgggaggctgaggcgggtggatcatgaggttgggagttcaagaccagcctggccaagatggtgaaacctcgtctctactaaaaatacaaaaattaaccgggcgtggtggcgggcacctgtaatcccagctactcgggaggctgaggcagagaattgcttgaacccgggaggtggaggttggcggtgagccgagatcctgccactgcactccagcctaggcgacagagcgagactccctctcaaaaaagaaaagagaactggagacctgagttttaggacctgctgtgtatttcaatcacttaatttttatgtttcaccagttttgccgtttcttaaaatgaagggctaggaattaggaatttccaaaatgactgtatagcaccacaattttgtagctagtttttcatttgtatttttagggttgactcagttcttgaagattttgacctagaaggagggcacaattaaactttgttttagattataattttctttgattttagcctcaagcttttaagaccagaaactgaatgaatgcacataatgaaattgagatttgtatgcttttgttaatctaggttgcatgtttttgttaatataagattaaccatttagttagttttagactggtttgaaagtatttctttagtgttttgacttccccaaaccacttctttcttacagttgggattgttatttcttaggtcagatctgatgtttaaaattctaggcataatcactgtatattcctgcttgctagaactcatgtgatggcaaagttaagtgaattctcaggtatgaattgataagaaatatcacattgaataaatatatattaggtactgggcatgtagatattacaaagatgagtaaggatccttagtttgcctaagagtagcaagagtcgcttggcatcagctgagacactttctgatctattgaaagtaagcatttatttatttatttatttatgatggagtcttgctctgttgcccaggctggagtgcagtggcacaatcttggctcactacaacctctgcctcccggattcaagcgattctctcacttcagcctcccaggtagctggaattccaggtgctggacacatgcctggctaatttttgtaattttagtagagacagggtttcgccacgttggccaggctggtcttgaactcctgacctcaggtgatccacttaccttggcctcccaaagtactggaattgcaggtgtgagctaccgcaccctgccaaaagtaagcttttgttggattttgctgtgtgagtgtgtctgtgtgcatatgattatacttttattataaatctatcagttaaaaagatagatttggagtttgtaagttagattcagagtataactcataactcttaaggaaacacttaaaaaaaatttttttttaaaatcggcttttcaaagatgacaaatggatagaaaaaattaagcaagtcttctgtccttgaggttgcccaggtttgtgcattgaccctattggccaggatgttgtaaacagcattcagacattcagaggataacttttaataggctatataggttatctaatccttaaatagtcatgattctatgaaaagaggtgagtcctatctgaaggaaagttggagtccttaacaatctaacgtaagttttttggctctttgtcttgttggacttggttgtccttacttacagaaatggacatcacatgacagattggatatcatgcatatatttctgtaaatggcaacacttatgtattgacttactttaaaaatctgactttttattttgagagaattgtagatttatatgcatttttaagaaataatagagctagtgtgtgctttacccagtttcccccaactgtagcatcttgcaaaactgtggtacagtattacaaccaggatgctgatattgaaatatagtcaagggacagagaagttccacaccaaaatatatgtcttgttccccttttatagccatatctacttccttccttcatctcttcccacccgctggcaaccactaacccatttatccacaaatccatttgtataattctgtcatttcaggaatgttatataagtgggatcatacagtatatatccttttggaattccctttgatcattgagcagatatccttggagagttatctaagttgtattgtgtatcaacagtttgttcctttttgatgcatcacagtttctttaatcatttaccctttgaaagacatctgagttatttccggtttttggctgttgtgaataaaactgctatgaacatttgtgtacaggtttttgtgtgaacataagttttctctgggctacgtgcccaagagtacaattgctggtagttgcatatttagttttataaaaaccatcaaactgtttcccggagctgctctacctacatttctaccagcaatgtatcagtgttccagtttcactgcatccttgccagcatttggtgttcatgctgtttttatttttgacattcttgttaggatgtattgataggtcattatggttttaatgtgtatttccctaatggctagtgatgttgaactttttttttttttttttttttttttttgcgagatagagtttcgctcttgttgcccaggctggattgcagtggcgcgatctcggctcactgcaacctccgactcctggggttaagtgattttcctgcctctgcctcctgagtagctgggattacaggcgcccgccactacgcacatctaatatttgtatttttagtagagaggaggtttcaccatgttggccaggctggctcgaactcctgacctcaggtgatctgctttccaaagtgctgggattacaggcgtgagccactgcacctggcctgaacatctttcatgttcttattttccatctgtatattatctttggtaaaatgtctgttcgtgtcttttgcacattttctagttggattttttttttaactgttcagttttgagatttctttatattttctagagtgtagtccttgttaggtacgtggttggattttctcccgctcgctctataactttgaatgattttaacagtcttttgcagtgcaaaggtttttaatttattgtccaatgtattaatttttattttatggatcttgatgtgaagtataaaaacatgttgcctggccctagatccctaaggtttatttatttatttttctaaaagtttcatagttttttattcatgttttatatcaggtgtgaggttgaagttgagctttgtttttgctgtagatgttcaactgctccaccattatttgttgaaaaggtcattttttctccactgaattgcttttgaatctttgttaaaaaatagttgcgtatatatttgtaggggtttatttctgggttctctattatgttcgatttgtctacgtgcttattcctccaccagtatcacattatcttaattactgtcattgtatagtaggtcttgtttgaaatgcttgttttccggtgctgtaaagaaatagcacttgaatgtaaatttaaattccttagcaaggccatttttatactttctgcagaaagggtacacttgccagcagttttgctatgagactacacccacagaacaaaggaggcagggtcatttataacctgacgcgtccaccctactgccgtgtccagtttccattggctggaacgggacttcacattttttatttggcccgattggctagcaacttagaacttttttaaggaggcaaaggcagaggagaacaaaggaaggaggaagtaacctgtggaatgttgagaaaggtaaaaacacctttaaataaggaagaggaacaggctatgtcctaatgcttgcttagaccagtataagcatgccagggcaaataggcttaattgtgggagctaagaacataaagtacattgatttgtttattatggctagcagatatttaagaatgttcgcacaggtctttcaataaattttgcttctaagagaagttactatttattcctaattagatggggaggaaagtctttgaagaggaacctctacgttttacagccttaatatcaggtgtagtgagtctcaccactttattcttctttgtcaaggttgatttagctattctgagatctttgccttttcatatagattttagagtaagtttgtctatgtctacataaaagcttgctgggatttcgaggccgggtacggtggctcacgcctttaatcacaacactttgggaggctgaggcaggtggattacttagggtcaggagtttgagaccagcctggctaacagtggaaccctgtctctaccaaaaaaatacaaagctgggcgtggtggctcacgcctgtaatcccagtactttgggaggccgaggtgggtggatcacgaggtcaggagatcgagaccatcctggcaaaacatggtgaaaccccgtctccactaaaaaatacaaaaaaaattagctgggcttggttgccggcgcttgtagtcccagctactcaggaggctgaggcaggagaatggcgtgaacccgggaggtggagcttgcagtgagccgagatcgtgccactgcactctagcctgggcgactgagcgagactctgtctcaaacaaaaacaaaaacaaaaaacaaaagttgtctgggcatggtggctcatgcctgtaatcccagcactttgggaggccgagtgggtggatcagctgaggtcaggagtttgagagcagcctggacaatatggtgaaaccccgtctctactaaaaatacaaaagttagccaggcgtggtggcacacacctgtagtcgcagctacttgggaggctgaggcaggagaatcgcttggatctgggaggcagaggttgcagtgagctgagatcgtgccacagcactccagcctgggtgacagagtgagactccatctaaaaaaaaaaaaaaaaaaaaaaaatagccagatgttgtggtacacgcctgtaagtcccagctacttggtaggctgaggcaggagaattggttgaacctgggaagcagaggttgcagagagccgagatcgcaccactacactccttcagcctgggcgacagagcgagactgtctcaaaaatcaaaaacaaaaacaaaaaaaaccttgctgggattttgataggaattgcatcaaatcaacctgggcataattgatacatatatattttttgctatactgagctttccaattcatgaacatgagttgtctctttgtttacttaggtcttctttgatttgttccatgaacatttgttaagtttatacctatgaatctcattttcttttgagcaattgcaaatgatgatgcattttaaatgtaaatttccaggtctttattgttagtatgtaaatttttgtgtgttgatttttgtatcctgcaaccttagtgaattcatttgttgtgggaggttttttttttttttttttgatatgaagtcttgctctgttgcccaggctggagtgcagtggtgcaatctgggctcaccacaacctccgcctcctgggttcacgccattctcctgcctcagcctcctgagtagctgggactacaggtgcccgccaccatgcctggctaattttttgtatttttagtagagacggggtttcactgcattagccagtatggtctcctgggaaagcattcaatattttgtcctaaagttgtagatttttttgtagatgctatttattcagttgaggaagtccatctccaccccactccttcctaagatgctgagatttttaatcttgaatagaggttgggttttgttaaatgcttttttctggatcaactgatgtgattatatgatttttttgcttcagcctgttaatataacattgatttctgaatgctaaaccagctttgcatacctagagtaaaacccaattggtcatggcatatacttctttgtgtacattgttggattacatttgctaatattttgttgagaatttttgtgtataagatcatgacaagaatatggatgagtgtatctcatatgtaataatagagtatgagtatgctagtattttgttgaggatttctgcctctaagtatcatgagagatactggtttgtaggtaacattttttgtacagtatctggttttggtgtcaggataataccagcctccataaaatgagttcccttctatttctggatgagaatgtgtaaaataggtttaaattcatctttaaatgttcattagaattgtttggtaaaaccatttgagctttatctttttggagcttttgattagaaaatcaattttggtagtagttataggactcttcagattgtctttttgactgagttttggtagtttgtagttttgaggagttgatctgtttcttttaagttgaatttatgaactcagaattgttcatagtattattcccatgttattcttttaatgttagcaaaatctgtagtgttctctttgttttcattcctgacacgatgatttgtgttttcatgtctgtgagtcttaggtttgtcaacttaattaattaattaattaattttttttttttttgagacagtcttgttttgtcccccaggctggagtgcagtggcgtgatctcggctcactgcaacctccggctcctgggttcaagtgattctcctgcctcagcccccgagtagctgggattacaggcacccgtcttcatgcccggctagtttttgtatttttagttgagacggggctcaggctggagtgcagtggcgcgatctcggctcactgcaacctccggctcccgggttcaagtgattctcccgcctcagcccccgagtagctgggattacaggcacccgccatcatgcctggctagtttttgtatttttagtttagacggggtttcaccatgttggccaagctggtctcgaactcctgacctctggtgatccacccaccttggcttcccgaagtgctgggattacaggtgtgagccaccacgcccagcaacttttattttatttatttatttatttatttatttatttatttatttatttattttagagacagagtctcgctctgtcgcccaggctggagtgcagtggcacgatctcggctcattgcaaactccgcctcctgggtttgcgccattctcctgcctcaacctcccaagtagctgggactacaggtgcctgccaccacgcctggctaattttttttatttttgcatttttagtagagatggggtttcaccgcgttagccgggatggtctcatctcaatctcctgacctcgtgatctgcccgcctcggcctcccaaagtgctgggattacagaccatgagccaccgctctgggccaacttttatttttttaagaaccaactttttattgattgctttttttttttttttttattctgctgttctcctggcttcaattttattgatttcttctctatttccttctttctgcttgctttgggtttatttgctctttatattttctaggttcttgagcttggaagttggattattaatttgaatcatttccttttctctgatgtaacaatttggtgctataaatttacatttcagcactactttagctgtgtctcacatacttttgtatttgtattttcattttgattcagttctgtgcattttaaaatttctttgatccatggagtatttagtagtgtgttaagtttctaagtatttggagggttttctgttttctttctattattacttgcattttttgtgtgtttctcattcatctgctttttttttttaccttcttatgggttatcttaatatattttaggattccatcttgatttttaatgtttttgaatatatttctttgtatagatttcttagtggttgctctggatattgcagtattcatatgtaacttaccactgtctactggtattggtgttttaccactttcagttaagcacagaaacttttcttccacttaggtccttttgccctctttactttaaaaataaattttttttttttttttgagacagagtctggctcagtcacccaggctagagtgcagtggctggatttccgctcactgcaagctccgcctcctgggttcatgccattctcctgcttcagcctcccgagtagctgggactactggcacctgccaccacgcccagctaatttttttgtattttttttagtagagacggggtttcactgtgttaaccaggatggtcacgatctcctgacctcgtgatccgcccgcctcggcctcccaaagtgctgggattacaggcgtgagtcaccgcgcccggccaaaaataaattttcttaagtgtacttacattctctacatacattgaacaacacatcagatggtgtgataaattttgcttcaaccagcaaatatgatttaagaactcttccttagtaagcagaactaaaaaaagataaaaagaaactcatgcgtagtatgatagtctgttatatttacctctattttacctattccaaagttcttttttttttccctgaagtttcagcattcttccattatcatttcctttttttttttttttttcagacagcttctttagctgttctttcagggtaggtttgctagcaagaaattcttagtttttctgagactgtcttatttgccttcatttctgaagaatattttgctgtgtatagaattcacagtggacagttattttctttaagtacttgacaagtgttgtgctatttttttttttcctgtctggtttagatgagaaatttgctgtcatttgaattggtgttcccctataaagtaatgtatcatttctctctggctgttttcaagatttttttgtctttagttttcagaagtttaattgtgatgtattggtgtgggtgtcttttttatttggggtttactcacctttttgtatctttagcgtatttcaccaaatttgggaagttttcagccattatatctttgaatactttttcagtcctattctctctcatcttctgggactctgagaagagtcttagctttttcgatttttgtccataggtccctgaggctttgttctttttttttttttttttagtctgttttctctcttgtttagattgacataattctactgattggttcactgactctgtcgtctatcatttccactcttttattgagctcattcaaagagtttttattttaggttttttttttttttttggttttataatttccatttggttcttctaaaataacatttgctgagatttctgtttatttgttttaagagcagttgcaattgcttgttgaagcgttttgttgactgctttaaaatctttatttttgtcaggtaattaaaaaatctgatttacctcagtattgtgtctgttgattgtttctcctcattcataatatactttcctggtttctggtatggcatgagattttcatttgtactctggacattttggatatcatacatattttgagaactgtgcatcttgttccttttttcttttaagagacagggtcgtgatcagtcatccagactggagtgcagtgatgtgatcatagcttgctgtaacctcaaactcctgggctcaagtgattctcctaccttggcctgctgagtaactaggacaacaggtgtgtgccaccatgcctggctaattttgtttttttgttttttttgagatagggtcttgctctgttgcccaggttggtcttgaactctaggacttaagtaatccgctgcttcagcctcttgagtagcaggagtcacaggtgtgcaccacagcacctggcctattcttttttatactaggcagttcccttgttgaagtgtagtgcaagggttaggtgggtgtgttcattcagcttcttgctgggtcctgctgataattactgtggaaaaagtggggcactaagtcatatggccttaatgcagactggtgggatggaagttcaattcctcccttaccctcacatcttcctaacaaaagttgggcaccattttatgccaccttgttgcctctgagtaggggtataagatgaactttctgacgggccatgctgcctcagcaagagagaagtagggaggctatctcacactgcactgatgctgcagggtgaagaaaaagctccttacctcataccacttcccctgagttgatgccaggtggggaatggaagctcagccccctctgggtaccactggcatttgagaatggctgaaatggttgtcagctactctgtcttacactgcttcatttagccttgatactgggtgaatgtggaggttcagctcttcactggttaccactgataccaggggttggggcagggagtagaaagctgactgactctaactcacatctccttgttcagtcttgttgatggctgggtaggggtgcaggttcaggttcttgctgggtcctgttgacaccaggcctgtgtgtgcaggagggaggtgggagtggagtggtggtgaaaggtagtggtgactaactgcttcacgcagctttattaagcctccttgctaatgggtggtggtggaagcctagcttgcccctagaccccactgacactatcttaaatgggtgagtctgaacaccgcttgctcttactgggtggagtatggaagatcagctcctcttttaggcttgccactaacccaacaggggaactggagcacccctgtgtgggggatggaagatcaattccctgttttgtcttgccaacacaaccctggtaggggctccagtcccacagcctgcttttgctgggtggagggtgtaggagcacttatccactctgcccttccagtaccacctggtgcaaagcaccacctgcttcttctgcttggtggtggtggtgggggggtgttagattagctgtatgcttggctccactgaaactgcggagggagggagagggagggtgtgtgtgtgtgtgtgtgtgtgtgtgtgtgtgtttgtttgttttccattggtatttagcttgagtaagatgggttttgccagaaaggtttctttggtaagcttacccttttatctgcttctgctttgtggtggggtgtgtgtgtgtttagattagttgtatgcttggctccactgaaactgtggagggagggggaggaagggagggtgtgtgtgtatgcgtgtgtgtgtgtgtgtgtgtgtgtgtgtgtgtgtgtgtgttttccattggtatttagctcaagtaagatgggttttgccagaaaggtttcttttggtaagcttactcttttacctgcttctgctttgtggtggggggtgtatgtgttagattagctatatgcccggctccactgaaactggaggagggtgtgtgtgtatatgttttcttttggtacttagctggagtaggatgggttttgccagaagggtttcctttgttaagcttacccttttcccagccttttgactaggaggaacaggcttttcttggaattttttttttctctgtgacagttggtgatactgtattggggtcttctgaagcagcatcctgtcttggaaatatgggtggcaatacgaaaacccagggatctcattgccttattactcctcaaattatgaagtctttaggaaatctgctgctttctttccacttttcagatactttctatgcttgtttgttgtattatgttcagggttttttagttgttaagagggaggacctgggaagaatgaagctatggtactccattttggtggaactggaaggcttatagtaattcaattttgaattatgaaagttttgtctaaagatattatgtcgtgaacaaaataagtcaaatttaggagaatcttgtgacaaaatcacaacatatcctcattttaaagctgtttctattagggcgtgacccataactgttatttcggggatatggtttaaataactagaaggcttacttttgaatatcaaatgctttctgtcatattctttaaaggaagtagatatttacatgcaaagaaagaaactgaaagataaactggattatagcagaatgtcactgttatggtttgccatcaaacagcagttactctttagtttcctatgccaaatataccagtataacataacattctgctcctttcaacatattaaggccagccaaacaaaattttttccccaaaattcttaaaatgcttaaaataggcaaagtgattcagaagtttttaggagtaggaaggagaggcggtacgtacagatatgtttctgtatgaatttcaaatgaataagcaagggaaaacttaataggtaggaggcattagtcttccttaggcagggaataattattatttcagcaatgtacatgtagtaaagttctacaattttaattcattctagctctaaaaattctatgattttatccttttttctgttcttttaaacttgttcctgtacaatttatagactttttttctgagaaaaatcttcctggagaaaagattgttaggcccttcaataatagggagtttctcttaaaataagtttagccgttttgttatttaagaaatgatttggccgggcgtggtggctcacgcttgtaattgcagcactttgggaatccgaggcgggcggatcatgaggtcaggagtttgagaccagcctggccaacacagtgaaaccccatctctactaaaaatacaaaaattagctgggcgtggtggcaggagccggtaatcccagctactcgggcggctgaggcaggagaatcaccggaacctgggaggtggagatcgtgtcactgcactccagcctgggtgacagagctagacttcgtctcaaaaaaagaaagaaatggtttgtttattttctgtgtaatatgtttaataataatattctgcatttttctttgatccattagttattttggagtgtttaaagtttttcatatatttgtgaatttctccaatttgttcctgttactgatttctaatttcactacattttggtcagagagcatagcttttaaaattttaattcttttaaaattatgaggacggccaggtgcagtggctcacgcctgttatcccagcactttgggaggccatggcgggcagatcacttgagggtcaggagtttgagaccagcttggccaacatggtgaaaccccatttctactaaaatacaaaaattagccaggcgtagtggcaggcacctgtaatctcagctgctcgggaggctgaggcaggagaattgcttgaacctgagaggcagaggttgcagtgagccgaggtgacagagtgagactccatctcaaaaaaatatatatatatatatacggggacttgttttagtggcctaacgtggtttgtcacggatagtgttccatatacacttgagtagaatgtgtattctgctgttgttgcagggagtattctataggtggctattaagtcttgttttgtagagctcttggagtcttctattttcttgtgatctgctgtctgattattgaaagttaagtattgaagcctccaactaatgttgaattgtctgtttttcctcaattcagcttttgcttgtattttgagttgtttgtttttacctgttatatattcttgataaattgatcctttcatcattatagaatattctgtgtccctagtaacaatttttgtctcaaagtgtattttaaaaattaataatttttgtgactacatagtatgtgtatattcaaagttcattttgtatgatattagtatagccacccagctctattttggttattgtttgcatggtacatatgttttacatccttttagtttcaacctatttttgtccttgaatctaaagtatgtcctttttagaaagcatatagttgtgttatgcctttaaaaaaattcagactgggtgtggtggctcatgcctgtaatcccagcactttgggaggccgaggcaggcggatcacctgaggtcaggagtttgagaccagcctggccaacatggcaataccccttctctgctaaaaatacaaaaattagttgggtatggtggcgcacgcctgtagtcccagctactacttgggaggctgaggcaggagaatcacttgaacctgggaggcggaggttgcagtggccaaaattgtgccactgcactccagcctgggcagtggagtgagactccatctcaaaaaaacaaaaatgatttcattctgtcgatctttgtcttttaattgtaagtgtttatttgcattttatgtgatgattgataaagtaggatttacatctgccattttactgtttgttttcatcatatcatcatctgttgtttttgttctgtattcttccatttctacctttttttttttgagatgaagtcttgctctgtcgcccaggctggagtgcagtggcatgatctcagctcactgcaacctccgcctcctgggttcaagcgattctcctgcctcagcctccggagtagctgggattacaggcgtatgccaccacacctggttaatttttgtatttttaatgcagatgggatttcaccatgttggccaggctggtcttgaactcctgacctcaggtgatccacctgtcggcctcccaaagtgctgggattataggcgtgagccacagtgcccggcctatttacattatcttttatatttacctggtgtatcaatttgttctgctatgacagaatactacagactggataatttataaataatagaactttatttctcacagttctggggattgggaagtccaagatcaaggcactcccagatttagcatctagtgaaggctagctttctgtctccaagattgctgcatctttatgtgacaaaaagcagtagggcaaagggatgaatagctttctcagacctcttttaggttattaatcccattcatgagggctttgctttcataagttaatcacctcataaaggccttacctcttaatgctatcacattggcgattaagtttcaatatattaatcttgtagggacacattaagatcattgcacctgagaattacttttactggtactcttgttttttcttgtgaattttagttattgtctagcaccctttcaacctggatgactgccttttgtattttcctagtgacaaattcagtttttgtttatatagtaatgtcttaatttcccctttgtaattaaggatagttttgctgaatctagaattcttggttgactgttttttcctttcaacacttttaccacgtcatcccattgccttctggcctccacagtgtttgatgaggatcgcttgtatgtgatgagtcacttctttcgtgttttcaagattctgtcattgtcttttgacagtttgactataatgtgtctcagtgtagaactgtgagtttaatctgtttggaattcattgagctttttggacgtgagattaattttttttattacatttggaaaactttcagccattatttctttaaatgtttttcccctctccttcttctgtgacttcaattttgcatgttttggtaaacttcatggtgttgctcaggtttctgagactctgttaatttttctttcttattttctttctgttactggactagataatcccagttacctctcttcaagttcctggatacttcctgcctgttcaaatattcactagaatatttgaggctgtcgagcctctttagtgaattctttatttcagttatattttctattttgtcctattaaaatataatttctctttgttgatattctttattctttgatatattgaccttatactttagttcttgagacatattttactttatgtaaaagatgtttttcatatttttgtttacttgaggtcatgtttataatagctgacttttaaagttttgtctagtaagctcatctgggctttccctgggatggtttctgttgattgctttttgttctatggctggatcgttttatgtctcacaatttttggttgaaaactggacgttttattgtaatgtagaaactgaaagcagaaggttccccctttgcagtattggcttttgtttcttgtagttgtttctttgtttagtgacttctctgaattaatttttaaaagtctgtgttctttgttatgtattaccactgaattctctccttgtttattttagtgagtgacttcctcaactgtctgggaccactaagtctcccagtctttgctgaagggtgttctgtgcagtcagttgacaacattgccatagccattattttgattgtgcagagcctcatggtaaagcggaggtgagcacctggggacttctcagatttttctgggcgtgcacacagccccttatctgtgcttggctttcttgattattaggtttttcatatttttgttggagcttttaaaactcttacagacatctcagtctcctgcttttccttctgaagtttttggttggtcttttgtttgtctctgttgttatccactgctttagccagcctctaagctaaacaattccctggaattcttttcaacaaatggccttcaagtaaagggatttcacactggtgaactctatttatgtgaaatacctagctttgcaagagggatcttccagggaacatttatacaggtgaattttctgggaatgaggctttgatggagcttcagcctcattgtactccctctgctggcttttcaggctgctggattttaccagaaatctattatgctgtttgttttcaagtctactgcagagctgtatggagaaaatgggactagggcaaattaaaaagccacaaagctttctgtttttactaagatttggccatttttcttcactaaacgcttccaagattcctgcaagcctttgattcgtttccagagttattataaagttaattctgaaactatttgctcgttttctcatgggagaggaattgttagaggttcttaagccaccatttttgctgatgtcacgcttcatttctttctgaaggttttaaaattatgatttcacacagatctttcagttcaaattcaggactacaatgttttgttatcaattttaaatatgtcttttcttctatgttgaaaatttggttctcaaagacaacataatgactcagtttctttatcacatactacatacattaacagtgttggaataacagtaccagcactaccatgagctacagtcatctgccatgtaacaatattttggtcaatgatggtaaggttggttccgtaagattataataccatatttttactgtaccttttctatgtttagatatgtttagacacaaatatttaccactgtgttacattggtctgttgtattcagtacagtaacatgctgtgccagatttgtagcctaggtgtgtagtaggatataccatctaggtttgtgtaagtatactctattgtgtttgcagagggatgaaattgcctaatgttgcatttatcaggatatatcctggtcttaagggatgcatgactgtacgtggtttcgaattgtagcttgaggatttttttgtagttcttttatttttgtccctaaggtattttccactgggagtatttggttaaattgctgttttaaagttctttgaaataattgttctatgtctggttacgttatcagctggctacatagtaaggtttgtttgtttcattttgcttttggctttataaagattgcttttttaacttcataaagattgctttatttatagtgtaacatttaaaatacatatatgattgtgaaatatttacattgttccagaaccaaatctaccatcatattccctcctcaaccatttaaaaacaagtttatgactttttgttttaaaaattaaaggcaaatatatatatgcacacttgtgcctgtatatgtggctataattttttttccattctcttttactttgctcaggtagtacagtagctaatgcttcttgggtttggtctctacagacaatcattctttgtactcctctcagtgatagatttttactcaaaaatcttctcaaagaaaagtaaaatttgatgtccctcaacatttgggcctccatataacttttaaaccccatcctcaatacttctcctccatcttttctttttctttttggacacagtctttctctgtagctcaggctggagtgcagtggtgcggtcatggctgactgcagccacactctccccggattaagctatcttcctgcctcagcctcctgagtagctgagactacaggcatgtaccacgcctggctaattttttttaaatgtttagtaaaaatgaggtctcagtgtgttgcccaaggtggtcttgaactcctgagctcaagtgatgctcccacctcagcctcccaaattgctgagattacaggtgtgagataccgtgtatggccctccatcttttcttcttatttttatttcaagacccttaaatggcttcctttctctttttatgaagctttcccttaatcgtttagaggtagaaccaattcctctttgtgcttccagaataaaaaaaaaaattcattcatcttttcttttttaattttatttttaaatattgtgtgtgtatatatatatgtagagagagagactgtatgtgtatgtgtgtgtatgtgtgtgtatatagagagagagagcgagagagagagagatggggtttcgccatgttgctcaggctggtcttcaactcctgtcctcaagtgagcccacctcggcctcccagtgttgggattatcggcgtgagccactgtggtgctgggcccatcttttcttgttaggagcagcattattgatacataatttgcataaagtgtacagttctagttttactttttaacttctctttccacttcccattctttagcgctttcttctcttatttatcatcacatttcacattgccagtgctgacatttcttcatttttctattttagacattttcctactatggaaggtaacctttcccccccactctcttctccatttgcccctgcatttcccttcttgtccatagtgttgtatctttgtgttaagtcaacatttagattattaaaactacataaataagtgctgttcactatggttacttttcctttccgtgtactttttttgaggcattagttggctttttgttactgttttaattttctgtgttttctctcatatgtatgtaagccccaatatggtcagacacatcaggtaatttatcagttcctttttttgttgttgttgttgagatggagcttcgctcttattgcccaggctggagtgcagtggtgccatctcggctgactgcaacctctgcctcccgggttcaagtagttcccctgcctcagcctctcaagtagctgggattacaggcgtgtgccaccacgcccggctaattgtgtgtgtgtgtgtgtgtgtgtggttttttttttctttttttttttttttctgagacagcgtcttgttctgtcgcccaggctggagtgcagtggcgcgatcctggctcactgcaaccttcacttcccgtgttctcaagtgattctcctgtctcagcttctagagtagcatgtattttttttagtagagatggggtttcaccatgttgatcaggctggtctcgaactcctgacctcaagtgatccacccgtcttggcctcccaaagtgctgggattacaggtgtgagccactgcttctggcctccatttttttttttttttttttttttaaattacctgtatccttcaaaggtgactgttgttgtataggtcactgggcctgttggacagctggcattctgggactttcactcatcctggggctgcaagaagcataagcctggcagctagtgttttgatagccaaactgtggaagtggacttgggccattctgcaccctgacctgtgctcagtgtgtctgttttaatttaacatctctgttgagttaaatgtttaattttttattggggtaggggaaaaagtaatagaggagggacagttccctggtagtgttttctggaggagtaggtctagaggactaattagttcttattcagtttttttcattagtcttcagttcctgccatcatttctttccaggattctgctgcttgaaagggcttttgtcttggtagctgaaatctaagacacttggcatttcatgtactttttgtgtttcataatttatggacctgctttgtctgttgttgtcttctctccctttctggtctggttatcttgttgcataacaaaccaccaccaatgccaccattttatgatgttcacaggatttgtgggtcaggaatttggaaagggtacagcagggatatcttctttttgctgtacgtgtttggggcctcagttgtgatgactcatggcagagagagactgaaggatggcttcatcacatgtgtggcaccttggcaaggatgtgtagaagggtgggctcagctgtgttgtcaacccaagggcctgtatatggccttcccagcgtggctcgtttaaggtagttatatagaagctcagggatccaagagtgagtgtgtaagaggaccaagtagaaagctgcatgtccttttaagtgacctgtcgtcagaagtcacacagtgtcatttttgccctaacctgttggtcaaagcctacccagattttaggagaggggacagaaaccccatctcttgatgtggaagaggcaaggccacactgcagataaggatgtgacatgggggatattgtggccatttttaggaagtattggctgtacttctagggttgctgtcttttaattccttcactttcttttcagagatgttggaagggaacagagataactccattttcaaattgtcatgtttaaccagaagtcctttgcgtgatgatttttgtttttaaggaaacttgttgaagtgtaacatgaacccatttgagttcacatatcacaagtgtgccattcagtgaattatcacatagtaaacacatttggtaaatgctacctcaaatcaggaagtggaacagtagtagcaatttgaagcatctcttgccccttcatagttaatacctttatcttcctcctcaagggtaaccattacaccgacttctatcatcatagattaattttgtttattttagaattttatataatggaaccgtataataggtacccttgtgtttggctgcatttgctcaacaacacatttgagattcatccttcttattcatccttgagtttgcaaaaacagaaacatcatttgtttttattgctgaatagtattccggcgttcaaatacatgaatttatcccttttgctgttgatgtctcctatagtggttaaaggtctctggatcttcactcttatttgtattgtttacttgcatggtgggcactttaataactttcatttaatagcttatctttgactttgctgccacccttcacccccccacccaaatgattatattttgatcatgtcttctatactatatggaggacctttatttaccattctctgttttgaaatgtatagtcacctatagataactatacatttcaaaatactaataccgtagagtattagtcatctatacatttctgtaatgtactgtgaaataagaagtaggacaaaaaggaaaggtctttaagtcaaaatgtatctcacagtccagttactgagtttatttttatttcagatgctagtctaataaagatggctgcttatttggtttcctttcccgtagaagattagaacatgtggattaggagagaagttgttgcatgctagtatactgatgtcaagtagtgtagtagtgaaaaaaattaggtgactgtgtgaaaagaataaaggagataaaagcatagcactttgtggctgtttaggatcaattcttaatggtcttgtttttattaaaataacacagtataataacctttttttcttaatgattatttcgttaaattacacttaatttaactgaagaaatggttcagttgtgttttctatactctgtttaagaagacgaggaaatcttcaggaggtcatatttgtgatggcttgaagtagctataatggaagctttcagtcatctttgtcttcctaattagaatgtctcattctctaatataggaatgaaggttactcttatttttttcataaactttttttgagacgaagtctcgctcctgttacccaggctggagtgcagtggcgtgatcttggttcactgcaacctgcgcctcccgggttcaagcaattctcctgcctcagcctccgagtagctgggactcacagccgtatgacaccatgcccggctaatttttttgtatttttagtagaggcggagttttgtcatgttggccaggctggtctggaactcctgacctcaaatgatctgcccgatttggcctcatttttttaataaacttttttttttctttagcttatttatttttgcaagtagcttcattttttttttttttaattgttcattcttgggtgtttctcgcagagggggatttggcagggtcataggacagtagtggagggaaggtcagcagataaacaagtgagcaaaggtctctggttttcctaggcagaggaccctggggccttccacagtgtttgtgtccctgggtatttgagattagggagtggtgatgactcttaacgagcatgctgccttcaagcatctgtttaacaaagcacatcttgcaccgaccttaatccatttaaccctgagtggacacagcacatgtttcagagagcaccgggttgggggtaaggtcatagatcaacagcatcccaaggcagaagaatttttcttagtacagaacaaaatggagtctcctatgtctacttctttgtacacagacacagcaacaatctgatttttccatcctttccccacatttaccccttttctattcgacaaaaccgccatcgtcatcatggcccgttctcaatgagctgttgggtacacctcccagacggggtggcggccgggcagaggggctcctcacttcccagaaggggcagctgggcagaggcgcccccacctcccggacggggcggctggccgggcgggggctggcccccacctccctcccggacggggcggctggccgggcgggggctgccccccacctcccggacggggtggctgccgggcggagacactcctcacttcccggacggggcggctgccgggcggaggggctcctcacttctcagatggggtggctgctgggcggaggggctcctcacttctcagacggggcggctgccgggcggagggactcctcacttctcagacggggtggccgggcagagacgctcctcacctcccagacagggtcgcggccgggcagaggcgctcctcacatcccagacggggcggcagggcagagacgctccccacatctcagacgatgggcggccaggcagagacgctcctcacttcctggacgggatggcggccgggaagaggcgctcctgacttcccagactgggcagccgggcagaggggctcttcacatcccagacgatgggcggccagggagagacgctcctcacttcccagatggggtggcggctgggcagaggctgcaatctcggcactttgggaggccaaggcaggcggctgggaggtggaggttgtagcgagccgagatcacgccactgcactccagcctgggcaacattgagcactgagtgaacgagactccgtctgcaataccggcacctcgggaggccgaggctggcaggtcactccgggttaggagctggagaccagcccggccaacacagcgaaaccccgtctctaccaaaaaaatatgaaaaccagtcaggcgtggcggcgcgcgcctgcaatcgcaggcgcttggcaggttgaggcaggagaatcaggcagggaggttgcagtgagtagagatggtggcaatacagtccagctttggctcagcatcagagggagatcgtggaaaggagggagagggagagagggggagagggggagagggggagggagagggagaggttataaactttttttttgtttgtttgttttttgagacgaagccttgctctcgttgcccaggctggagtgcaatggcgagatcttggctcactgcaaccttcgcctcccaggttgaagtgattctgctgcctcagcctcccgagtagctgggactacaggccatgccaccatgcccagtcagtttttttgtatttttagtagagacgggtttctccatgttggtcaggctggtctcgaactctcgacctcaggtgatctgcccacctcggcctcccaaagtgctggaactacaggcatgagccactgttcctggccttttcataaacttttaaacagtgtttattagaattttcttttccaatcatgacagtgggaagaaatgcattttacatcatgatccactacacaacacacgtatgttttatagttggaaatcctttttccataaaacactacttgggaaaaacagtgcttcagagtgccaaggtaatctctgttcatttggattatcatgaattgcatatcattggaatctaaattaatgacctactgaacagagagggttgagcaagacatttgtggaaaggactgttgagaagaatatttatattaggtccaaaggccctcagtgaacctgagagagaatcagcttattttccttttaaaataggtactaaaatttcagagcagttgtctttcctaatagcttcgtctacttctgattgtcacacactctctctgcactcctgcatattgattattatattgtaacatttttaccatctacctggaggtgaattaatacatgattgtgctaagaataaatataccatgtgttatactcaaagtttgcaatgttatctgccctcattgcttttaagtaagccttttaatgctctaggccttactttcctcatctgtaaaataaggataatagtacagttgatctttggataacaagggtttgaactgcgtgggcccacttacatacggattttcttccacacatgctacccctgtaaacaggaagagtaacttctctttctgctcctcctcctcttcaaaatggagatgacgatgatgaagacctttatggtgatccacttccacttaagaatagaaaatgtattttatgttgcttatgattttcttaataatattttcttttctctagcttattgtaagaatacagtatataatacatataccaaatatgtgttaactgttttttttttttttttgagacggagttttgctgtttgttgcccaggctggagtgcagtggtgtgatcttggctcactgcgacctccgcctcctgggttcgagcgattctcctgtctcagcctcccgagtaaatgagattacaggcactcgccaccacgtctggctaattttttgtatttttttttgtagagactgggtttcaccatgttggccaggctggtctcgaactcctgacctcaggtgatctgcccgtcttggcctcccaaagtgctgggattacagacatgagccaccatgcccggctgtgttaactgtttatattattggtaagacttctggtcaacagtaggctattagtagtgtgagaaatgggaaagttcttcaaagactataaaaagtcacaatttcttactataagattgctatccactatttgtgtgtgtgcgtatatatatatatatgtatacgcacacacacatatattccatatcagctgtcctagcttgctccagcatgcctgggcagaactagacaagtcccagcccatagtgcatgccattccttatttgaagatgcgtccttaactatccctggacaacttccttttctttctttcttctgttccccttacccaattaaaaaagttttaaaccagtagccaattgggtaaagtgtaaaatgtgagatcctatttcagccaatggaaactggacacagcagtaggatcgatgtgtcaggttataaataaccctgtctcctttgtttggtgtgctctcctggctggacagcttatttagtagcaccctttctgcagaaagtaaagctcgcctttctgagagatcatttgttcccgcattaattctttttttgtgacaccaaaaactttattcccaacactagttatgttttgggggagtcaaaagttacatgtgaattttcagctgtgctgggggggtcagcacgcctatctgcctcgttatttaagggtcatttgtacttacctcataggtttctgtgaattaaatgagctaaggcatgtaaagtgcaccgtacttagcagtgagtaaatgttgttaataattaacaattctgataatctacttggtgaacaagaataggatatgttagaatgatgtctcatatatgttaatgcagaagttttttatgtctcagataagttttttaggtagataaaggaaatgaaggaaatgattccaggaagagcactgtgtcaggagtgaatcataagaaagatgttactattaggttgtggattctaggtattctttgggatgtttctttttcatatgttccctgaccctatccctagactttgccacttaccagctgtgagactgtggataggctaaactactcatcaaagtaccagtttttgtaagttatttacttttggaaaagaaccagatgtaattcaaagttttctctgtaataccacccttcttatttacatctagtatactttcttgagtggttggacaaagtgggtggcattagcaaagctagcttggaactgagcataatactggatactcttgtgagagtatgtctgaagtgagagcattctgtggccaaaaagtcatacagccactgtcttacactattttcttgggttaatttttgacccatagtggtaaacctagttatgagtctgtcctgctacatttacattctgtgttgatagaaacatttggagctggctaggcttttctagaatctagacaactgctttagtcagttgtacattgtggatgtttcctaagcattgaccctagctccaaggtttttttcttgccattagtcatctgcttagtatgaaaattctgtgagcggtgataatacggtgaatatgtagaaaaatggctatttattttaaccttttttaatgttgctggtcataagtttatgttgctacttctttttaaatgaacaagaacagaaagggcacaaactttagttttggaaaatgtaggtattgtagctaaaaatgacatccctctgttccaatgctggaaaaagtgacatttctccttttctgagacctagcccaatttattgcttgtgttcatcaccctctggtattgtacaccagtggctggccttggatctgtattctccctgttggagataagaaatatctgctgtcatgaaaaaaccttttatcgtagaagagcggtatagctaatctgctttgtaatagagtagtgtacgctcttatccacggtttcactttgtgtggtttcagttgacctgtggttaactgcagtcagaaaatattaaatggaaagttccagaaactcctaagttttagattgcacccttttccgagtagcatgatgaaatctcgcactgtcctgcctaggaggtgaattatccctttgtccagcttatctacactgtttacactgcccactgttagtccacttagtagccgtctgagttatcagattgaccgtggtggtatcaaagtgcttgtgttcaagtaacccttatttgacttgataatgaccccaaaacacaagagaagtgatgctgtcaatttggatatgacaaagataagccatgaagtgcttccttttaatgaacaggagaaagtacttaataaggaaagaaaaaaatcatatactgaagttcatcacaagaagaacggtgagtacagtgcaatacaatatttagagagaaagaccacattgacataacttttatcgtaatttattgttataatcgttctattttattagttattgttaatctattgtgcctagtttataagttaaatgttataggcatgtatgtataggaaaaaacataatatatatagggttctgtactatctaaggctttaggcattcactggggtcttggaacatttcctctgtgaataagggggactactgtattttttgatgccctttttcccataaaggactggggcatctttcataaacatatacttaatgttcattgttgaccaagcaggctagaaatagtaagtagtcttctgtggggaggaatacttgtgcccttatgactatattctgtcaaaaggatagatttcatagtaatgtttgagggaagaaagaaaggaaggaaggaaagaaggatctgtagcaatttacttatcaacactgaactttttgaattaaattttccccctatgctttggctgcctttactgtttaaaagaggaaagaatgagaaagttaaagaaaaatgcaacttttttcttgctaatgtgtgtttccttagactgcccatccctcactgctatatactttagtagtataccatattttctctgtagtgtcatgcatttttctattttttaaaaaattattttttttatttagagaccgggtctcactgtcacctaggctggagtgcagtggcgtgatcatggctcactgcaggctcgacctcctaggctcaagcaatcctcccacctcagccttcctagtagctgagactacaggtgcacactacaacacctgactaattttaaaattttttgtagggacagggtcccactgtgttgcccaggctgatcttgaactcttgggcacaagcgatcctcctgcctcagcctccccaaagtgttgggattacaggctcatgagctatggtgcccagcccatcttaccattttaaaattttgtctttcctgcatgattgctatttctgtgatgacacggtctgtctatatactcactttttttttttttttaatttaagtagagttgcgctctgttgccaggctagagtgctgtggcccgatcttggctcactgcaacctccacctcccaggttcaagcgattctcctgcctcagcctccctagtagctggaattaacaggcacgtgccaccatccccggctaatatttgtatttttagtagagatagggtttcaccatgtttgccaggctggtctcgaactcttgacctcaagtgatctgcctgccttggcctcccaaagtgctgggattacaagggtgagccacggagcccagccatattttcttgatcatatttgtgatagcacagtagaattgtctctttaagtgtccccacccctcaacacacacataccttgagagagcatgaatcttttatccctttatttcctcagtttgttgtaataacagatgtgttatatctgtgtagtaaatgttcaaacgtaggttaaattctttttcatttaaaaatgatgacaagattgttacattttggtctttttctgatgtgagctgtttatatgagttgaccttttctgtccagaaggaatagaaaacatactggcaatgtgggtaggttttattcctcctgcgcttccttatatgagataggcagaagaaatagtatagtattcttattttacatatgaggaaacaaaggttcagagtgttttaagtggctttactaagatctcacagttaccagatggtggagctggaacttaaaccaaggtttgttaagttttatttttaatctgagttttaaggctgttattggggttttatttttaatctgagttttaaagcttttagtttagttaataatgtctagttaagcaaaagtatcgcattcttgcaattcttaaaattaagtttgtctttaaaattacatgtaaagttacatttaaagttaaagatattaaagtgtgaaacctaaagcacaactggacatattcttgagtgaatgtaatggcttttctttgtgactttacagtgtcttataccaagggaaaggtaatggtaaaaagatttcttccagaaactgtgttggcttgttcaaacatctctgaataaattccttatgtgtattttttctactactagaaaacagatttataaatgtaatttataaattaaatataaactgaactaaacccagtacaaaaattgaaagtaacattaatatgatggggatgatattttgtcataataaatcacttgattaatgttagaattatgacagctcaagtttcttttggcatgcctttactactgtgtgctacttcattcacctatagatttttttccattataacttgtatgaaactcttctattttgcatattatctcttttggggaatgaacaatttgctactaaaagtggctttgcttggcatcagtatggttgtgaaggtaaatatgggtgttagcattgcttgtcagtattttgatatagggttatcaaaatatgagaagaataagaatgctttatcaggcatttctaaatgatagaaatttaaaaattaaaaatttttccatagtgaaaattctaggagaatacatgtggactccagtttgaaagacactgctttatataagtgaaatctcattttgattctattagtataacaatacagtttttgtgtggttgaagaattatcagtttgaactaataaactagaataatttgtaaggaaatacagttgaaaggtatctcagattcctgatttagccattaaatgttatttgcatattaggaaacaggctgtatatttaggtgaaagtgggagaggaaatggcagtttacatgcttacatttttcatgtttacaagttttacatgtttacaagtttacagtttgcatgtgtgattcatgatctttgccatgatgtaactcttaaaaatgtcaaagaggtacgtcataaacagtagaaataaatattctgacagatcataaaaagggagggaggattgaagttttcctaggtgtagtataatttttaaaatagactttacttttgcaacagtttcagatttatagaaaaattaaagacagagcattcctgcactcagtttaccttgttatcagtatcttagtatgatctatttgttactattaatgaaccaatattgatactttattattagcttaaagtccatagtttatttaggtttccttagtttttactgttccaggatctcatccaggatactacattacattgagttgtcatgtctctaggctcttcttggctgacattttctcagactttccttgtttttgatgaccttagttttgaggaatactggtcaggtgtattagatgctcctctactggtataggtctgatgttctgatgatgattagactggggttgcgagttttttggaggaagatcacagaagtcaggtaacagtttcatgtcatcaaaaattatactctccctccttcagggctagaataatacatacattatttgggagttttctgaacaggagatttgtcttttttccatttattaaagcactcctttagcttcattcacagattttgctatattgtgttttcatttacattcatttcaatatatatctttttttttttttttttgagatggggtcccgctctgttgcccaggctggagtgcagtggcacgatcttggctcattgcaacctccacttcccaggttcaagcaattctcctgtgtgcaccaccatgcccagctaatttatgtattttcagtagagacggggttttaccatgttgaccaggctggtcttgaactcctgacctcaagtgatccacccgcctgggcctcccaaagtgctgggattacaggcgtgagccaccacgcctggcccaatttgccttttgatttctgttttgactggtgggttttttagcagtacgttaggggattagtatccagatatttggggggatttccaaaatactattgttcaggaaacatactttgtatgatttgaatcttttcaaaaactttaaaagttactttatggtctagcatatggtctatgttggtgagtattttctgtgcacctgaaaagaatgtatattctcctgcaaaaatagcagttagttcaactttggttgattgtatttctcaagtcttctctatcctactgattgtatatctacttctagtctttctgtgctgtcagtttttgcttaatgtattttcaaactcatttattaggtagatgagtgtttaggatttattatagcctcttgatggattgattcgtttatagttaaaaaaatggccctctttatctctggttatattttttgctctgaaattcactgtgatattaatacagcttctctagttttcattaatgttagcataatatatctttttacttttattttatttttttttttttgagacggagtctcgctctgtcgcccaggctggagtgcagtggcgcagtctccgctcactgcaagctccgcctcccgggttcacgccattctcctgcctcagcctcccgagtagctgggactacaggcgcccgtcaccacgcctggctaattttttgtagttttggtagagacagggtttcaccatgttagaggatggtcttgatctcctgaccttgtgatccgcccacctcggcctcctaaagtgctgggattagaggcatgagccactgtgcctggcctacttttaacatttttgtgtctttatatttaaagagaatttcttgtagggagcaagcatatagttaggtcttgctttcatgtcaaaactgatgaactctgtcttttgctttttaattttttcttttttttcttttctttttcttttttttttttttttaagacagagtctcgctctgtcgccaggctggagtgcagtggtgtgatttcggctcgctgcaacctccgcctctcgggttcaagcaattctcttgcctcagcctccccagtagctgggactacaggcgtgcaccaccatgctcagctaatttttgtatttttagtagagacagggtttcaccatgttggccaggctgttctcaaactcctaaccttgtgatctgcctgcctcggcctcccaaaatgctaggattacttacaggcgtgagccactgtgcccagctgctttttaattttttcaaaaactcttttattttgaaatagttgtagcttcataggaagttgtgaagaaatggacggggaggtcttgtgcactctttacccaactttccccaatgttagcatcttgcttaactaccgtacaatatcaagataaggagattgacattggtaaagcttatttagatttcaccaggtatgtatgtacttatttgtgcgtgtttgtatggctctatgcaattttattaggtgtagtttcgtgtaaccacaactacagtcaagatatttagctgtaccatcacaagattcctttgtgctgtccctttatagccacaccaatccccacaatcatctccccaccccatacctaacctctgggaaccaccaatctgatggaatcatgtagcatgtattttctgatggtggcatagtctccttgttgttcatccaaattactgtgtatattagtagtctgctcttattgctgagttatattctatggttatggatataccacattttgtttaactactcatccaatgaaggacattggatagctgccaatatttggctcttataaataaactgctctgaatattcacatggaagtttctgcttgaaaatttttatttccctggaatgaaggttaacccagaatgtaattgctgggttgtatggtgagtccgttttcagtttcagaaggaactacaaaatgatcttccccattttatattcctactaacaatgtatgagtgacccagtttccttgtatacttactagcatttgttattatcaccgtttttttaattttagtcattctgataagtgtatgctgataaaattcattgtgtgtgccttttttttttttttttttttttttttttttttttttaagagacagagcctgttgcccaggctggagttcagtggcacagtcttggctcactgcagcctctgcctcccgggtttaagcaattctcctgcctcagcctcccctagtagctgggattacaagtgtgcaccaccatgcccggctaatttttgtgtttttagtagaggtggggtttcgccgtgttgcccaggctggtccaggctggtcttgaactcctgacctcaggcgatctacttgcctcagcctcccaaagtactgggcctcattgtgattttaattgtgcttctctaatagtggatgaagttggacaccttttcttgtgcttattcttgtgcttattcgccatctgtatattttattcagtaaaatgtctgttgatgtcttttgtccattttctaatttgaatttttttttgtttgtttgaaacagagtcttgctctgtcatccaggctggagtgcagtggcgtgatctcggctcactgcaacctccgcatcccgcgttcaagtgattcttatgcttcagccttccgagtagctgggattacaggtgcctgccaccaggcccagctaagttttgtgtttttagtagagacagagtttcgccatgttggccaggctggtcttgaattcctgacctcaggtgatcctcccgcctcagcctcccaaagtgctgggattacaggcgtgagccactgcgcccggcctaatttgaatattcttaaaatgttgagttttgaatgttttaaaatgtattttatatactattttatatttgctcacatgtttactatttctattgctttttatgcctttatgtagatttaaatttgcctgaacgactttaagttcttaagtgaagattagctagtaattaatttttctgtcttttgtctgcaaaagtttaattttcttctttatttaaaaaaatattttggcttgttatatagaattctagactgacttttttctctcctgtattcataaagatggcactctactgttttctcctttgcattgtttttgaggtgaagttttctgtcatccttatttttgttcctctgtaagacgtctcctgcctttgactgcttttgaggttttctctttattgctggtgttaagtgatttggttacgttatgtgttatgtgttgtagtttctttttctttttgatgtttattgtgcttgagatccgttgagctccttgggcatgtgggttttaaattttcaccaaattcggaaaattttttgctcttgtatctttagatatttttctgtgtcctctatactttccactcctacccccattctaattatatgtttatcaggatatctgaaattattctatcacttactgtgctctgttcatttttttttcagtctttttctttgctgtatctcgttgtggattatttgtattgcgatgtcttcaagttcactaataatttttttcttttgcagtgtctaatcttctctgcttttttttttttttttttttttttgagacagagtctcgctctgtcgtccaggctacagtgcagtggtgtgatcttggcttactgcagcctacacttcccgggtttgagcgattctcctgcctcagcctcctgagtagctgggattacaggcatgcgccatcatgctatcatgcctggctgattgattgattgattgatttaagacagtcagtctccctctgtggcccatgctggagtgcagtgatgcaatctcggctcactgcaacctgtgcctcctgggttcaagcaattctaatgcctcagcctcccaggtagctgggattacaggcatctgccacctcgcctggctaatttttgtatttttagtggagacagggatttgccatgttggacaggctggtctcaaactcctggcctcaggtgatccatctgccacggcctcccaaagtgctgggattacaggcatgagccactgtgcccggcctaatctcctctttatttcatcagtatgttttttacctcaagacattgtaatttttgtttaggctgttttatattttccctgtctttaacatgtttatgtttttctttattttcttgagcatatgaaatacagtttgactaatgctgctatttgtatcatttgtgattaattttctattggttgatttttctcattgtgggttatagtttcttgattgttctcatgcctggtaacttttgtctttgattcctggtacacactcctattgttcgcatctacgttcaatattccggccgcatgctagacagtgaattttatctcattgctttctgtatactatcatttcattttaagtatttttgaactctgttctgggatgcagttaaatcacttggaaatagtttgatgcttttgaggcttgcttttaattatacaagcctctgggaatagagcaacctttagtcttgggctaatgttgcccagtgtggaggcaatatccttgttaggattctttgggatgccacttgtattacaagtttttccactttgacttgtgggagcacaactgtgtttggtactgtttgagccatgtggatatttccagtgtttgttttaggtggtcctgggtgtgtgtgtgtgtgtgtgtgtgtgtgtgtgtgtgtgtgtgtctatgtatttatttatttattgaaacagggtcttgccctgttggctggagtgcagtggcacgatcatgtctcattatagcctttaccttccaagctcaagctgtgctcccactttggcctcccaaatagctgggaccacaggtgtgtaccaccacgcctggctaatttttaaattttttgtagctatggagtctccctatgttgtccaggctgatcttgaactcttgacctcaagcgatcctcctgccttggcctcccaaagtgttaggattacaggcgtgagccactgtgtccagccaatagtttattttaagaaaatttttaaatttttatgggtacatagtaggtgtatatatgagatacattagatattttgatacaggcctacaatgtgtaatcgtatccgggttctagggtaatttctttacctccatgtactcatttatttgatgattcaagagggagcctgtgtagaatctccagagtcctctctctgcagcccccttctctctcacttcctaccttgtgaactctaaactgccttggcgtacccagattcccagtccatttttgcctctgggaaacagcacttctgcctgcattcccctacctttgcctttgtgtcggaactctctccatggagtaagctggaatagtagtaggggtcacctcgtttgtctctcctctctcagagatcaatgccttgtattgtgtctactgtctgaaaatgttgtttcacatattctgcttggtttattggttaatgtggctgggtaaatctggttcccttttggccagaagcagaaagccttgataaatttttagttttgattttgtgtttatttaaaatctgcttatgcagagtactttttacaaaagaacaattcgtaatttatctttactgtaagaatgtcctatttgcttaaatttgaatagtatgtgacataaagtgtaatacaccatgaaagggagtaaggaatggtataggagtgaaaggatcaagtgccacatagaataagtgtcctaatgcaaacacacgtatttctagttttgaggccatagatttaattgtggttaatgcatgcttccattctggctttccacctacattccatggaacactgttgtcccactagattttaattggtttttacaacaaacagggtttcatggaccacatgtatttaggacatttcagagtaacgaaaattaaatttcgattgcagtgcttttcaaaattagtaatacactaatgaattctgtgaatcaccagtgaaacagtgtagagttatccaatcactggacttcagtgatccttttctggaaattctttagaggtaggttgttattaagtgtttaaggatctttccctccctccctccctcccttccttgttttgcagcagagtctcactctgttgcccaggctggagtgcagtgacatgatcccagctcactgcagcctccatctcctgggttcaagcgattctcgtgcctcagtctcccaagtagctgggactacaggctcacgtgctaccatgcctggctaatttttgtatttttactagagacagggtttggtcatgttcgccaagctggtcttgaactcctggcctcaagtgatatgttcgcctcggcctcccgaagtgctggggttgattgcgggtgtgaaccaccactcccggccaaggatgttttaatactgtttaaataagatgtatttaattatcatgggttacttacctaagcagattcaagagttcatatatttagtaagcctactgattcctcttgatggctgttcaggctcctttcagtcttctgttagtataatcttacatgttattttatgaaatgcatacatttatatataggatgaattcttagaattgcttgattaaaggaggatgatacgtataataggaccatacatatatatgcatgcatttgtatttttgatagatattgacactttttctccattgaaattatgtcattttgttgttacacccctttgaaagcctctgtttagagacatttgataaatattctctagttgccctctagtattattcatttgttctcctaccacctgtgtttgagtgtctgcttaccgttcctaccaaactgtttatttccatttctacctaataagttttgaggcagtttagaatagtaatgaaacatgtggactctggagttgtctttttccaatccttacttggccagtaattgtgtctcggtttcccagtctgtaaaatgagagaataaatagttaccttgcgcaagggctgttgtaattaaatgaattaatacatatgtagcacttagtgtctagcttataatagatgccatgtaagtattgtctattatcattgcattttaaaatttcacttacagggctgcctcccacccccgtcatatttactggccagtaatgtttctttttctgtgagttgcagttagtcttttctttaaatgttagcaaagtagtacatgcatatagtttagagtcaaaaaaatcctataaagtttacaaaaagggagcccttatctcccttcagtagagacgcaaccttccttttttatttcctgaatattttcaatatgcagttggttgagtccatggatgcaaaacccattgatacggagggaaaactatatataaaacaatagcaatctgaacatcaaatgactaaaggataacattatagctgcctgaagctgcagtgttggcaggggcaatcataagactagctggagattttacttggtaatctggggaatggaacagccatagtagaccttgataagctcccacatattcatgggtgtctggagagctgcacatgctcaggagagagcagagaggcctccagctgtctactcacctggctcaatgtgcagctttgctcaagcagaaagtagaagtcagaactgattcataagccacctgaactttgagtggggtccaaaccaacacagagggagatgctttggtaaaggacagaagccttactggcacaatatgtttaaacataacctcttatttatcattagccggtcaccaaactatactgacctaggagtgacttctagaaagccaagcttaaaaataaaaattgaggaaaaagtaaaaaacagaagacaactaaccagagacatcagtggtcatacactattgagaagactatagaaatagtccaggcaagtctgtaaacaaacagcaaccacaataatctgggaggtgtcaggagtcagaatctcgagttgttatattatggaaaatgtacaatttcaacaaaagttttcgagccatgcaaagaaacagactgaaaaaaagcctaggggactataaaggagactaaaatgacaagacaatacaatgcaaaacataattcctaaaatgattctgtatttaaaatacaacagctataaagaacactatgggagagtgaagaaattttaatataggctacatagtagataacagtatagtcaatgttaaatttctgaaaagtgataactacattgtggttattttggacaatgcccttgttcttaggaaatgcatgctggagtacgtaggtaactttcaagtgaattagtaaaatagagagggagtgtgtgcacacatgtggcaaaatgttaacaattggtgaatctagtgtattacagttccttgtactatcttttcaacttttctgatggcttgatatttttcaaaattaaaaatatcagaaacaaacatccgacgatgggggtttaatgagattccagtatgtaaaatattctagaatggctgaaaataataaaatagtaatatttttgatatcggagagaccttcaagcaatgtattaaaaaggcaagctattgaacattgtttacattttgtaaaagcagatacaaccgcaaacacatgcagaagcactgggacaaactttaacagaaattgataataataaggagacggggaaaagcttttgtttttttgtttcacattatagctttcttcactatttgaattttctacacatgtgctacctacctttttatgtcagcagcagttatctgggtggtagttggggggcattttttgtttactttatacttacgggaataaaagagaaaagaaaaaggaagagtggataaagggaattcagcaaacctcaaatgcacttcttagtgaatactttcaaatacttgttctatgctttcagtactataaccttcaaagtcattttactatatatttttttgagacggagtgtcgctctgtcaccaggctggagtgcagtggcgcgaacttggctcactacaacgtctgcctcctgggttcgagtgattctcctacctcagcctcccgagtagctgagactacaggtgcgcgccaccacacccagctaattttttgtatttttagtagagacagggttttaccatcttggccgggatggtctcaatctcttgaccttgtgatccacccgccttggcctcccaaagtgctgggataagtcattttactatgttttaaaaagaaatgtctaagggacttttttttttttttttttctttgaaaggggttggggagatattgtcattgttttaagttcctctgttttggaatttgcttctctctgccattctcaagcaaccactgattggctttctaccacgttagattagtttgcattttctaaagttttatttaaatggaatcatacagtatgtattctttttgtctggcttctttcagcataatttatgagattcaggcatgttgtgtgcatcaataatttattcccctttattgctaagtagtaattgagcatatggatataccacagattattcagttattgataggttgtttccagtttttggctattaaaagaaagctgctatgaacattcttgtataagtctttgtatggacacgtatttgtttttctttgggtaaatacctaggagtggagtggttggattgtatggtgggtatatgtttaactgaataaactcccaaactactttctaaagtggttgtaccattttaaatgcatttctaccagcagtgtatgagagttccaattcttctacattcttgccaacatttggtatgattactcttttttagacactttttttttttaaccttttaagctcaggggtacatgtacaggatgtgtaggtttgttacataggtaaacgtgtcattggggctggttgtacagattatttcattacccaggtgttacacctagtatcgattagttattttttctgcttccgtccctccaattttagacattctaatgtgtggtgtagtagtatctcatcctcattttggttttaatttgcattaccccttgatgatgagtggtttttcatgtgcttatctgtcatttgtatatcttctttggtgagtacctattcaaatattctgcttactttataaaaattattttttttcctttttccccctattttgagagttctttatatattctagatataagtgcttgatcagatagatgctttgcaaatattttcttcagtttgtggctttgctgtcattctcttaacagtataatttttaaattttgataaagtctaatttatcattttttctctgatgtattgtgcttttgtgttgaaacagaatattagtttttgtttagaattctatttttataaatttgatattttgttctaaacctcctgtagatgaaaagtaccatttcacaagtgagacaggtaataggcttctctaagtagctatattcaggatttcactataggaactctacctttttacatgttctgtaaattttggttcattgtctgaaaagggttgttctattcaagatatactcttattaaaatgtattggttctgtatttgccacagtgcagtttactacatggtatcttataatttactcttatttggaattatacaaaatgattttcaggggtatgaaatagtgttaattaaagctatttttaaagtattttggttaagttgaaagatacgcacttttaaaaatacatatgactgtaggtgttcatcttttgaagcaatctgaaaaattatggataatctcttatgtacctggaattaaaacaaatgccacaagcatgtataacaaatgtaatactaaacagaaaagtttctatccccatacctccagtctgaataatatatgccacctttacatttgaatttttaatactttattttcttatctgaggaccatccctcccctccttcatgttttgaccctctgccttataagcagaagacatttaaaaaattgatcttatccaacaaccccacttctgtgtatatgttcaaaagagttcaaagcaagatctctattctactttttttttctttttttggagacagagtctcattcactccgtcacccaggctggagtgcaaggctcactgcaacctccgcctcccgggttgaagagattctcctgcctcagcctcctgagtaggtgggactacaggcacgcaccaccatgcctggccaattttttgtatctttttttagtagagacggggtttcaccatgttggccaggctggtctcgaactcctgacttcaggtgatctgcctgcctcggcctcccaaagtgaagtgctgggaataccggcgtgaactacacacccggcctccaaagcaggatctcaaagaggtattaatgtacctatgttcattgtgacattattcaaaacagccaagagatggaaacatcccaaatgagcatcagcagatgtgaatggataaggaaaacgtggcatatacatacagtgaaatattatgcagcccttataaggaaatcctgtcacatgctacagcatggatgaaccttgaggacgttatcctagatgaaatatgccagtcataaaaggacaaatactgtatggttctactcatatgaagcatctaaagtagtcaaaatcatagaaacaggaagtagaaaggtaggtgtcaagggctggggggagttgtaagagaggattagtgtttgatgtgtatagaattttactttttcaagttaaagttctagagatctgttgcgtaacaatgaatatacttacactgctgaattgcacacttaaaaatggttaagattgtaaatttaatattaacaggtttttaaaaatcacaattaaatgatacagtgtgtctgagaatcctattttaaaaatatcatcttatttggtgttcttttagttggggaaccttggaatcgagaaatggatgcctgcttgaacctgctgatttgtcttgaactgaagagcttgcttgaatattcctgtgatatcttttagatcattgctgttttagctagattgctggtcctgattgctctaggtagccttttttttttttttttttttttttttttaagatggagtctcgctctgtcttccaggctagagtgcaggggtgtgatctcggcttactgcaacctccacctcccaggtttaagcaatcctcctgcctcagcctcccaagtagctaagactacaggagtgtcccaccacacctggataatttttgtatttttagtagagatggtggtggggtggggggtggtctcaccatgttggccaggccggtcttcaactcctgacctcaggtggtccgcctgcctgggcctcccagagtgctgggattacaggtttgagccaccacgcctggccatctacgtagccttttgctattattatttgtgttccaatgatatttaggcatgtggcaggttgcttatatttttcttatatcttagttgacttttaaaaagcaacataattcatgatagactatgcttgcattctttaaaaacttttttctcctttcagtttctttgacataccaaggtctcttgatttttcacttaactgccctttctttttctacctacttatttcacttagtcccacagctttctccccatttaattgtaaatatttattaagccccttattcacatgtcttatctatgtattgtttttcctaatttttttaaattaagaaaatgctggtacagaatttaaaaaacaaacctggagtggttctatgagacttatcgtgaaaaacagcagtttttcgtagtctcagaggtgctaccttcaatgcatagctgttactttggtatttgcttctgtatttcttttttctttctttttttttttttgagatggagtttcgctcttgttgcccaggctggagtgtaatggtgtgatctcggctcactgcaacctctgcctcccgggttcaagggattctcctgtctcagcctcccgagtagctgggattacagacatgcaccaccacgtccggctaatttttttatttttagtagagacggggcttcaccatgttggccaggctggtctcgaaatcctgacctcgtgatctgcccacctctgcctcccaaagtgctgggattacaggcgtgagccattgctccctgccttccctccatatttctagataatgtgcttataatgctgtttctgtgtccttctcttccctcacagtttatgttgatttttttttttttttttttttttttgagacggagtctcactctgtcgcccaggctggagtgcagtggcgtgatctcggctcactgcaacctccgcctcctgggttcaagcgattgtcctgcctcagcctcgcaagtagctgggactgactacaggcgcctgccaccacgcccggctaattttttgtgtgtttttagtgaagacagggttacgctatgttggccaggctggtcttgaactcctgacctcatgatccgctagtctcagcctcccaaagtgctggatttacaggcgtgagctactgcgcctggccgatgtttttgtttgtttgtttttgagacgaagtattgctctgtcgcccaggctggagtctagtgatgcaatctcggctcactgcaacctctgccttctggattcaagtgattctcgtgcctcagcctcccaagtagttgggactataggtgcccaccaccatgcctggctaattctggtagttttagtagagatggggtttcaccatgtttgccaggctggtcttgagctcctggcttcaagtgatccgcctacctctgccttccaaagtgctgggattacaggcgtgagccaccgtgcctggcctttgctttctattataaaggataatgtcgatattttaaaatcatattttcccatttctgtatcttttcagtataacagctttagttaaataaacaatgtttactatgttattgatgtttctagttaataagccaagaaatattaagatgtctgtttactttaaataatttccctaatgctaatcgccttttatcattttattgttttctataggttcctatcacaaattcttgcccaacaactgtaagagtgcttctggatatttttccttacttttgaaatatataatctatcagttctggtgaacttcctcataatccttccaggttccctctttgctttatatttggcatgccatcatctttaggggaatggggcttcactattgactagtgtcgagctctgtttcttggatgctttgtttttctgtgttcttctaccctcttgattgagagtttgtctggtattaagttggaaataattttccttcaaaattttgaaattactgttctttgtcttctgtgtttggggtgggccattttgtatgtaatatgatttttattttaactttcttcctcctccagttttaggattgtatctatacctggtattctgaaaaatcatggtaatgtgccttggtctgtctggaaactttcgttcctccggtctgggaaatgtatgttggattaagcttttcattatttggtgttaacttcatgggaaaaaattaggttctactctttattacctatatctgtttggtgaaattaccagtagatagcctacgcccattagaggaatttctgatgatttagaatggcaaccctccatgtgacttggggatagatctatgaatgagaattagagagaaggggaggtgatagaggcatacatgttaggggtggtggtatgatatgaagcaagtgattatgtaaatgttagaattctagataggagtagatcctatatagatgagtcaggaaaaaagaatcattttggcatattaggctttataaaccaatgcatggagctaagaaaaaaatgatatgtctagggaactgttaaagggaaagcaaggattttgtaagggtgttcggtagtgttatatcacggaggtccttggcattttctcttattgtggtgcaggccagtagttctccattgtttttacccccctctattaggatacatgcagtacttacttggccttttctgggattatgcacaatcctagaaagccaggtctttcatttaatgaaacattcaagagggtgatgttatagtgaatgcatacatatgtacaccttagtcgaagtgatttgtggtacagcatttaaaatgtgttcttaaagaaatccgaaaattggttttggaaagagctaaatacacatacttctagtaaggcttagggagagggcaaaaggggagcataaatataaaatatcaagaatgagaaagggatatatacacagttataaatagaatatgatgtacagccaaactgtaattaacttcagagtcttgatgaaataggtgggtggtgacaacaatacaaattgtgaattgtgattcataaagttcacggtggcgatgggtacaagttttcaaaaattctgatttttccttaaaatcttaaattatggtatgtattcctttaattcttacaataatcctttggggtagttgctataaaatcttcctgttttataaagcacaaagagattaagtgacttgcccaaggccaaacagtacgaagctaaaattcaaaacctagcccgtcaggtttcagagtctatctactacacttagctctcatggcattaaaaaaggcaaagcatttggatactttggcactataaatatcattagtaactgcagttgtccgctagggaactctaggctaaatagtcattcagacaagtaagacctgatcaggtcgcgcttggcatcatattgacatagaaggatattgcgcaggaaacagcatgccagcagagcaatgccttgctcttgcaggattcctggggcttatgtttggtccatgagtgacagctcaggtatgtgagaatgagaatcacaaaggtggttgcagagctactctggtgtattagtttcctcctgtggcttctgtaacagataactataaactgggtgattgaaaacacagaaatttattctttcacagttgtaaaggctaaaagtttgaaataaatgtgttggcagggccatattcctggaggctccagtggagaatcagttccttgcctttttccaccttctagtggctggtcttaacatcactgcctactttgtgtgcctgaaaactcctgctatcttataaaaggacacatacgattgtatttggggcccacccagataatgcaggacaagcgcctcctttcaggatccttatcttaatcccatctttttaccagataaggtaatattttttttttcagcctaccatacttgatttagaaacaccctcccttgccccatcacccccaaataggaaccaatatcttttttaacagttttgtggtcatactttccatgttttctctatagagatatgctcagttaaatagtattctgaggaaatcccaaagctgtggcatcctagcagatatttatagttcatttgcagttctctgactctagatttatttcattaatcagggataattttcaccataatcattgttactactacaggttgagtatcccttatctgaaatgcttgggaccagaagtgtttcggattttggagtatttgcatatgcacaaagagagatcttggggatggaacgttaagtctaaacatgaaattcatttatgttttacacgcactttatatacatagcctacaggtaattttatataagattttaaataattttgttaaacgaaattttggcagtgacccatcaagaggccaggtgtggaattttccacttgtggcatcatgtcattgctcaaaacattttggacttagcagcattttggatttaggattagggatgcttagcctgtaatacaactgacatacaacctttatcaggctttagaagtaaaggatgccaaggtcaaatttgttcatagaagagaaaggttttgttgacccttcgcaaattatttaggatacaccatgattactatagattgcattagaacttttcatgatttactgatactatcctaggccctgggagtagcagtgagtttgatgatacattgaccctttttttttttaaagtgaggatgtggcattataaaatttatgttttagattttgtagatactgaaatgatactataaccctgaatagtagggaggagatgttttcaatggattagagaaacataaattgtaatatttttggttaggggcaaatggattaacatgaaagaaggaacaggagagttataggcacaccttgctttattgtgctttgcatatatgtatatatgtaaacaaacggaaggtttgtggcagtcctgtgtatcacaaatctattggaaccatttttccaacagcatgtgctcactcagtgactgagtcacattttggtaattctcacactatttcaaactttttcattattattgtatctattatgattatcattgatcagtgacctttgatgttactgttgtaattgttttggggcaccatgaactgtgcgcatgtgcaatagtaaacttaattaataaacatgtatgtgttctgactgctctaccgactggccattccctggtctctctccctctcctctcctattccctgagacacagtattgaaattaggccaatgaataaccctgtggtaacctctgagtattcaagtgaaagacagagttggacattctcactttaagatcaaagctagaaatgattaagcttagtgaggaaggtcaagatagaagccaagatagactgaaagctaggcctcttagaccaaacagccaagttgtgaatacagaggaaactttgtttttaaagagacagagtctcactttgttgcccaggctggagtgcagcggcatgatatggtgtaagctaggcctcttacaccaaacagccaagttgtgaatgcagaggaaactttgtttttaaagacacagggtctcactttgttgcccaggctggagtgcaggggcatgatcttagcttactgcagcctcaagctcctgggctcaagccatcttcctacctcagcctctcaagtagctgggatgacaggtacccagctattttcattttcgtagagatggggtcttgctatgttgtctaggctggttttgaactcctgacctcaagccatccccttgccttggcctcacaaagtgttggcattacaggcatgagccaccgcacctgaccgaaaacattcttgaagggaattaaaagtgctactccagtgaacacatgaaagataaggaagcagaacagcctcactgctgacatagcaaactttgagtggtctaggtggaaaatcgaaccagccccacagcattgccttaagccaaagccaaacccagagcaaggctttgattctctttaattctgtgaagtctgagagaggtgaggaagctgcagaaggaaagattgaagctagcagaggttggttcatgaggtttaacgaaagaatctatctccataacataaaagtgcaaggtgaggtagcaagtgctaatggagaagtgtagcaagttatccagaagatctacctaagatcattcatcagtgatctgcactgcactaaacagattttccatctatatgaaacagccttctgttggaagaagatgccatgtaggactttgatagctagaggaaaagtcaaggcttagcttcaaaacttcaagggacagcctgactcatttgttaggggctaatgcagctggtgattttaggttgaagcaattgctcatttaccattcagaaaatcctagggacctttttgaattatgctgaatctgctctacctatactttataagtgaaacaacaaagcctggattacagcacatctgtttacagcatagtctactgaatattgtaagtccactgttgatacctactgctcagaaaatttcttttcaaaatattactgcttattgacgatgcacttgtttacccaagagctctggtggagatacataaggagacaaatgtgttcatgcctgctaacacaacatccattgtgcagcccatagatcaagaactaattttgactttcaagtcttattatttaagtgatacattttgtaaggctatatggctgccgtagttagtgattccactcatggatctgggcaaagtaaataaaaaaccttctgggaaggattcaccattcttgatgccattgagaacacttgtgattcatgggatgaggttaaaatatccacattagcaggagtttgggagaagttgatttcaaccctcatggatgactctgaagggttctagacttgagtagaagtagtaaatgcagatgtggtagaaatagcaaaagaatcaaaattagaagtgaagcctgaagatgtgattgaattgctgctatctcgtgataaaacttgaatggaggagttgcttcttatggatgagcaaagaaggtggtttcttgagatggaactcactcctggtgaagatgctgtgaatattgtggaaatgacaacaaaggatttaggatattttgtaaacttagttaacagagtagtggcagggtttgagagaactgactctagttttgaaagaagttctaccatgagtaaaatgctttcaaacagcatcacatgctactgagaaacctttcatgaaaggaagagtcaatccatgtggcaaacttcattgttgtcctaagaaactgccacagccaccctaaacttcagcaaccaccaccctgatcagtcagcagctatgaacattgagtcaggaccctccaccagcaaaaagattacaacttgctgaaggctcagatttttaaattaggtatgtacattttctttgactaaatgctactgcatgtgtaatagactattgaatattgttaacataatttttatatgcactgggaaaccaaaaaattcatgtgactcactttgttgtgataattctattgtggcggtctccaattatccccaaagtatgcttgtactatcagttattactgatgtcaacaaacttttttttgaggtggagtctcaccctgttgcccaggctggagggcaatggcatgatctcagctcactgcaagctctgcttcctgggttcaagcaattctagtgcctcagcctctctagtagctgggattacaggtgtgcactaccatgcccggccaatttttatatctttagtagagacgaggttttcaccatgttggccaggctggtcttgaactcctgacctcaagtgatccgtccgcctcagcctcccaaagtgctgggattacagccatgagccaccatgcctggctgatgtcaacacacttaattatacattatcaaaaagttacattcattgatatcaccaccaatctcatcagaaaaaacttttaagttttgcgaagctgtcaagctcacagtagtggtgggttgaagttttccaaaattctgatttttgcttcaaatctcaaatttgatcattggcagtaaatattgttatttgcttttctttaaatgatgggctcatcactcccatttttgagaagatgtcttctaactacccaaatctggatagacatattttgtcattcattctttcgagtcaaagtgatgctccatgaaaaaagaggccagttcacttaattaatcattgtacaaaaatgctttaaagttcccattctgttacacagcttattaatacaacatgtactcggcaaggtacggtgactcacgcctgtaattccagcactttgggaggccgaggtgggcggatcacctgcggtcgggagttggagaccagcctgaccaacatggagaaaccccgtctctactaaaaatgcaaaattagccaggcatggtggcgtatgcctgtaatcccagctactcgggaggccgagggaggagaatcgcttgaatccaggaggcggaggttgcggtgagctgagatcatgccactgcactccagcctgggcaataagaccgaaactctgtctcaaataaaaaaaaaataaaacaacatgtactcaagggttgacatttaataacataactttttaactgttttattgaggatattattaaatgaaactggcattttcttttaataaaaaaaacaaggtggtatgattactgtagtgtttagctctgtttgatttttgctgatgccagcagttttgctcaccattgcttttgtatcagttcaaataacatcttaatattaatgaaaataattttgacctagcagacctcttgaaagggttttagagactccagttgtctgtgaatcatactttgagaacagctgacttagggattacagcatgtatttttggcttatcaaagtctagttggtacttctgcccttttcttaggcaatgcaagattcttagagcctttacccctcccctcttccatcgttgtatatatgaattctgtaccagtttttttttttttttttaaaatagagtctcgctgtgttgcccaggctggagtgcagtggcacgatctcggctcactgcaagctccgcctcccgggttcacaccattctcctgccccagcctcccgagtagctgggactacaggtacccgccgccacacccggctaatttttcttgtatttttagtagagatggggtttcaccatgttagccaggatgatctccatctcctgacctggtgatccacctgcctcggcctcaagtgctgggattacaggcgtgagccaccgcgactggcaattctgtaccagttttaaacacaagttatctttaatgttgttacccatgtatttaacacccccccttttttgcttgccatttcttactgcatcactgaccttccttttgagatatttttctgcatgtgagtctgctatatttatatatctgaaaatattattatcacaccttcatgaggtatgcattgagaggttctttttttgagggggtggaattcgagcatatgaacttccagttctaccaccatttgttgaaagactttttttttttttgagacagagtctcactctgtcgcccaggctggagtgcagtgcctgcaatctcggctcactgcaacctctgcctcctgggttcaagcgattctcctgcctcagcctcctgagtagctgggattacaggtgcgcgccaccacgcccagctaatttttgtatttttagtagagacggggtttcaccatgttggccaggatggtcttgatctcttgacctcgtgatgcacccgtgtttgcttcccaaagtgctgggattacaggtatgagccaccatgcctggcttttctgtttttttaagaaattgtctttgcacattgtcaagaaccagttggctatatttctgagggtcagtttctgggttctctgtcttctgttgatctgtatcttctgttgatctgtatcttctgttgatctgtgtgtttgtcttttcacgaataccataccgccttgattgttgtagcttactgtattaagtcttgaaattaggtaatatatatcctctgactttgttctttttcataattgtttcggctattctagttcctttgcctttctgcttgctgatacatacaaaaaaggctcactgagattttgattatgatggcctttatatctctatataaatatatataaataaaaattaggggggattgatattaacaatgagttttccacatgtagatcctgcacatattttgctagatttatacctaagtactcctttcttccgggggttggggcaggtgttactgtaaatgtttttttaaaatttcaaattccaattgttcattactagtatattggaatataattgactattgtatattcaccttgaatattacacttatcggttctagtatttaatttcaacttttaacttgccacagtctaccttcaaataatatttacactatgtcatgtgtagaatggactttacaagagtatatacttcatttctctcattgtggtcttttgtattgtcatacattttatatccgtatatgttgtaaacctcacagcacattgttactattttttgctttaaacagtctcattttaaaaaataaactctttttgatgtataatttacatataccggcataccttggagatattgggagtttggtttggttccataccaccgtaagaaagcaaatattgcagtacagtgagtcacacaatttttttggtctcctggtccatataaaagttctgtttacactatactgttgtctcttaagtgtgtaataacattacatctaaaagaagtgtataccttaattgaaaagcaatattttattgctaaaaaaagtgtcagcattttttagcaataaaatattgctaagcacatgctgttggaaaactggtgctgatagacttgccacaaaccttcaatttgcaaaaatttgcaataaagtgaagtgcaataaaatgagggatgcctgtttgtaatttcactcattttatgtatttgatatgtttagacacatgcatatactatgtgatcttttgagactggcttcattcactcagcatgtgttcgagattgacccatgtgttacgtcagtagttcattcctttttattgctaaatagtattccattgtatagatgtatcacagtttgtttatccatttattcattgagggattatttgggttatttccaattttcactgattatgaataaagctgctataaacattcatgtataggttttggtatgagcataactttaaacttctctgggttatatatttaggagtgggattgctgagtcatgtggtaaatgtatgtttaactttatatttaactgccaatctgtgttctggagtgactgtaatattttgcattctcaccagcaatgtatgagagttccacttgttctgcatcctcattaacacttggtattgtcactttttgaaaattttaactattcatatagataatatagtggtacctcattatggttttaattgatttctgtagctttataataggtcttaaatttaggacatgtgggccgggcatggtggctcacacctgtaatcccagcgctttgagaggcagagactggtggatcacttgaggtcaggagttcgagaccagcctggacaacatggtaaaaccccatttctactaaaagtacaaaaattagccgggcgtggtgttgggcgcctgtaattccagctacttgggaggccgaggctggagaattggttgaaccccagaggtggaggttgcagtgagccgaagttgccccattgcactccagcctgggcaacagagtgaaactctgttaggacatgtgaattctctagccttactatttttcaaaattgttttgcttattctagtttatttgcctttccatatacattttacagtcatctgtagctacaaaaaaatcctgctggaattttgattgaaatttcattaaatctgtacatcacttgggagacttctcatcttaatgctattgagtctcccaatttcatgaacacagtatcttctctgcgcttatttaggactatttaggacttctttgactcttttcaccagggttttgtaggtcttctagcatatacagattctgttgcacatattttgttatatatttcatatttttggagctgttgtatgcgataaaaaaattttcttccaattgttcattgttagtttatagaaatgtaatttatttttgtatgctgactttgtagcatatgtccttgctaaactcagttactagttacaggagggtatttggggatagatttcttgggtcagttgtgttttaaggagactttcaaaattgagaaaaatgtcttataattacccatgagctaccatttcaggtactctttattttgttgtgtagatcagtatttccatttggtataattttccttctgcctgagaatttcctttaacatttcttagactgtaggtcttctggtgatgaattctttcagcctttgtatatctgaaaaagtatactttcatcttcatttatggaagatatttttgctgggtatagaattgtaggttatatggtgtcagttggcatttagaaagaaaaaaataggactgtaggttgacagagtcgccttcccctcccatttattaactataagggtattgttccattgtatttcagcttgtattgattcctccaagaagttttcccatacatgtgctgtagcctgaaaagtttctttaggcagtaagcttggggtaattagagctcacattcattattttctgtttattgtcatgtgttctgatattcaatgtctaaaattctttgtttcacgtttctttagttatttaattgttatattcaggagtaaatttggtcccttttactgcaccttggcctgaagcagaagtccgaagacttaagaagttttaatctcgtaatgccttatagagtggatgattgagatgccaagaatatcacttcagtaattcaaatgtatgccttgtatggaaaatgttgggtttaaggtttcttctgacactagtgggttggtatttatttcactggtttaaaataaaaaatttgaatacgagcttagacattcaagctaagttgaaatggtattttggatggtcaaatttcatattttatatgaaagtatttgagtatttagtgtgataaattatgagtagttatgacagttttcctttaaattcagatttttggcaaaatgtgattttaggactggtttttcagatgagctttttcaaattagtggagcacattgttaaaacagccactaataatgagagatacttaaatttgcccaataccgtattacctttaccctttcacttcctaaatgaacaaccttcctagtcatattggaaaaatttatagctgtgatagactggagcagggctaccacctagtggtttaaacagacacgggcccttatggagcatctgaatgcgtaatgcaactatttgtcctttgatcttttattatgaagaatttgtgttttgctttgttattcattcttgccatttgtggatcacagtggcagatcagattttcttttctttcgagatgaagtcttgctttgtcgcccagactggagtgcagtggcacgatcttggctcactgcaacctctgcctcccaagtgattatcctgcctcagtctcctgagtagctgggattacaggtgcacaccaccattcctggctcatttttgtatttttagtagagatagggtttcaccatgttggccaggctggtctcgaactgctgacctcaagtgatctgcctgcctcagcctcctagagtgttgggattacaggtgtgaaccactgcacctggcccagattttcctcattagtatttttaaaaacaaatttgatttttaggagttccttatatattctaaatatgaatcctttgtcactacatgtgttgaaagtatattttctcagttgtggcttgcctttatactaattttttttttataaacataagttctgagcattgaggtagttgaattaatgtatcagccttttttaatgacttgtactttttgtctaattttaaagaaatcccacgctatcctaatgtcaaagccatttttccgtgttttcttcttaaggatttatatagtttcacattagggcctttaataggtttttttatatgtagatataggagtccactttattttttttctcccgttagaaataacttgcaggcttgccaccacttttttgttaggttattgtttgccagttgcgttaccaggtttccacacgtacaagttctgtttctgagctctttattgctaaatatatgtattcatgcaccagctctcttgatttctgtatctttattgtgactcatggtatctggcacaatgccaactttcttttgattatgtttgtagtatttttctgtcttttttaagtctttctatgttatattttacgtgtgtctaaattgcataaatctggatttaaaaattttgttgaaagccattttcgtagcatatttattccatttacatttgttgtgattaaaatattgcattaaataaatattcatttaaatatatctacatattgattaccttctttgctctgccctaccccccatctccccaccagatatactgagtttttgaatataaagacttttgcgggggagatctgtaggatttcttttaggccaggaatgtgatagtactgtgtttgattttggcctgtactttggattgttattagttgaagaccatctatagttaaattctcgtctgaagtttgtgttctacccaggtcagatgaattcaggcttatggttgtgtaaataatcagaattttttttttttttttgagtgtctcccaggctggagtgcagtggcgtgatcttggctcactgcaagctccgcctcccgggtccatgccattttcctgcctcagcctccagagtagctgggactacaggcgcccgccaccacgcccgactaattgttttatatttttagtagagacagggtttcaccgtgttagccaggatggtctcgatctcctgacctcatgatctgcccaccttggcctcccaaagtgctgggattacaggtgtgagctaccgcgcccagccaatactcagattttcttttccactcattgccatcatggattggcagttttctttgtccttcaagaacagttttaaaataacatttaaaaaattggtttattattacattttagtttttacttagattgaaggtgttcgctcattgaggctcagtgttctgagcggttatcttatttgactcttcttcttaggtggctttcaggccttgtgttctgtcccccaaataagaccccagaacccaacacaggctttcagaatgtcatacaaaaagtcactttgatattctgtctgtctccacttctcttagttctggttcccctgaccgcccccaaagtccattctttgtagagcttaagaacttaagaactttgtgttggtcgcctgccattgtgtttaatctgacatctttagttttcagcacaaggtttcagtggttgtcctgaagtggaagcccttcccaactcttcattttatggcttacatggaagattgatagtagcaattactgagagaatttcttgagggctcttaagattggtacatatacaagggctctgtttgaaagactttggctgccctggcgtcctggctgttttatgcctggtagctctagcggttaaaagctctctctgtcttgccactcctattacccattaccagtacatttgttggagaactttggttgtagaatataaatcccagaaacagagctgtgtgtgcatggttaagttttttagttcatgagagaagggggaaattaaagatcttgactcatacctggccagtacaacattgcacagggaagaaaaatgcaattaggtgcttgctttacagtagaagaaaatattggtaagtgttttacatcgggtcagattctggggattttctaattctgagccgaacttatgtactgtgaaggaaatggtgggtggttttcagaaaatagggaaacttttacatcaaaaactctgtaaagaagtcaaagataaatgtaatctgggaaaaaatattctgtaacattatatatagaaatcctttatgtataaatagcacctgacatcatttaggaaaagaactatttatgatgtagtatactgagaactgtgcacaatgtatggacaggtctagtaaatattagggaaaaagtaatgaaaaaacttgaaaccagcaccgctggtggaaggttatattggttcagctttgctggttggcttatcagaagcttaaattgtgcttttaatttgactgtgaggaacttatcctaataatagcaaaaacttggttaacagatactcttcagtagaaacaaattatagtttaactgttcaataaaatgctatgcagatgttaattttgagatctatatgttttgacatgataatatattaaatcaaataaaaattttataaaattgcatataaagatttgtactaggccgggtgcggtggctcagttctgtaatcctagcactttgggaggccgaggcaggtagatcacttgagttcaggagtttgagagaccagcctggtgtacgtggcgaaaccttgtctctacaaaaaaaatacaaaaattagctgggcgtgttggtgcgttcctgtagttccagctacttgggtggctgaggcagtggatcgcttgagcctgggaggtccaggctgcagtgaacatgatggtgtgcctctgcaccctagcctcggtgacaaagtgagacctttcaaaagaaaaaaacaaaaagatttttactgtttgcatatatgcatagagaaaagtctgaaagggtatattcgggcctattaaaaagttttttttttttaaagcacttattttgggggagggtcctttatcatgttgcagtttctctagatttaaggtttttcatatgttcaagaaataaatctaagtgcctacattttagaagttgtagaattcaaggcatattttcagtggagctcatgctcataaaccctatctcttccaccttttcatgcaacctgaagtgcttgctttttcctttttatgtgcatttatttaaaaatgtgtgtaaggcaaaggaatgcatactttgctaccaaagatattaatttgaactacatatttaaccagggtacagcatgcagaataatgtagtcttttaccttcataaagatatggtctacataattttgctgcaggcgggctttctttatacatgtatctttttggaattctgagttaaatgtgtgcagcttaaatgacaggcataatgattgctgtaagactgtttctgtcaacctctaggtaaataatagaccctgtggagtagcacaagcaaattaaattaaaaaataaagggttataatgccaacttttttttttttttgagatggagtctcgctctgtcacctaggctggaatgcagtggcgcgatctctgctcactgcaagctccgcctcccgggttcaagcgattcttttgcctctgccttcgagtagctgggactacaggcgcgtgccaccatgcctggctgatttttgtatttttagtagagatggggtttcaccatattggccagcctggtctcgaactcctgacatcgtgatccacccgcctcggcctcccaaagtgctgggattactttacaggcgtgagcccctgcgcccggccttgccaactttttcatatggaaaatcacaggatcattctgaagtgaaattatctctcatactgtccttggccccaaaatacagtttttaaaagatcatttaaggcttaattcgttgcttaatttgagtaaggagactttataatgtacttgaatgtattccatctttacaatgttacatttaggatgctacaaaaaaatttggaaaataactcagctgttgtgtcaatacagcttctttttatttaatgtataccctgggtgtgagtgtgtgtgtgtgtgtgtgtctgtgtgtgtgaatatagaatccattaattcatgtggttgcatgcatctgagataagttttggagttagtagtaaactagcaacttgttgactattgagacagtacagcttagtttgctttgttgcagctgtatttgtcatttctttgctgtgggatatgatgaggtttctcttcaaataatctgatcaatcttttattctttaattcatagtaccctcccttccccctttttcctttttctccttttttttttcctttttgcctttgttatagatgcccaggcacgcaacagtatcaggcgttatcagtaccagctcacattcctttccttatttggaaagaggactaactttctacctcattacagatacctcttcccctttcctctccactttcttttacgtgcccatcttacctaaaaaaattcaaatgttcagccaaccgggattagtttagattgtatgacccgaccccggccaatgaggaaagggtacaggggcaggacttgcatcaggaataaaggctctcgtgcccctttgttcaggtgtgctctcatggtgactggccaaggaggcacccctctgtgcagaggtaaaattgctttgctaagaatcctttgttcgagtgttcaatttccttaggattttgagcgttattcctaacatttgccaaaaatactaaagagagaaaaatcagcaacacaaggtaaactaaggagttgtcattctgaagctgcaaaaagtgggataaagctgtttaacattttccagatacataccacacttagtctgaactggtgtattattttatacatatacatatgtatatatgtagtagtgttttatttttctgtcacagttgtcttttgaatatgggaacttagttttttttggttgggttacttttgttttggatatgtttatgtctgtttattttttattttttgttatagtgatgattgctttttataatgatttaaaataaagaggggcgaaaaaatatggtagagaactgaggctaagtctgggaatggtttgtgagagctgggagttgaaattttatgtgttgcttttctgcttggtgtggagttggggaggaggagctagtgtgtaggagaaaaagctgattatggagagggtcgttcttgcacatgactttaggtccctgggcatgacctgagtcaactaccttactgctcagaggctgtgaagccatactgtttgaatctttgctagtttgtagctttgtgaccatgagcacaggatttatttaggcctcagttttcctgtcagtgaagtagggttaattactgtaatagaccccatttcatagtaattgtgaggattaaagaataagtatatgtaagttgcttagaatagtgcttggtacatatcaagagctcaagtattagctatcaacactttactaagttgtctagtttgatttcaatagtgtaattctttgagagtattttgcaatagcaaagtgttttaaatagtttatttgaaaagaatggttcttaaagtgccagtgatggtttcttgaatgttgaatgatgcttgtttactcattagcattcaacacatcccatgaatgcagagtagtaggcccaaagagactgaaaaatctgggattcagactggcatctaactttcattctactgacctttttttttttttttttgagacgtagttttgctgtcattgcccaggctggaatgcagtggcgcgatctcggctcactggaacctccgcttcctaggttcgagcgattctcctgcctcagcctcctgagtagctggaattacaggcgcccaccaccacgcccagctaattttttgtatttttagtagaggcaggttttcatcatgttggcctggttggtctcaaactcctgacctcaggtgatcaacccgcctcggcctcccaccgtgctgtgattataggcgcgagccaccgcgttcaacccctctgctgactcttttgacaaaagatgtgtattaattgaaagtaggaaatagagagacagacagggtagagtgacaaatgtttaagttcctttatcatctcgaaaatgttagatatgggtgacgattaactgggtttccttttttcttccctccatcctttttgtgtgtgttaatgattatttcattaggcagttgttttgttgttgttgttgttggttttgttttgagacagagtctcactgcattgcccaggctgcagtggcgtgatcacagctcaccgcagccaccacctcctgggcttaagtgatcctaccacctctcagcctcctgagtagctgggaccacaggtgtgtgccatcatgccagcataattttaaaaatgtttttgtagagatgggagtctccctatgttgcccaggctggtctccagtaatccccccacctcagcctcccaaagtgctgggattacaggtatgagccattgcaccgaactttgtttttttttttgtttttgttcttaagcgaggaaagagggttacacacacatctgtctcttaaagaattctcaaaaacagtcagttctgggctgcactggaactctactgttccaggaacatgggcttccatttcctactctgcggatctcagctatggcatctacctcttagtccaggagagttactgaagttcttgccatctggatgattctacccaagtaggcagaggaggggatgaagtggagcctgtctttcccttatattccattgggcagaatttaatcaccaagccacacctacaagaatggctgggaatctcagccttcagtctgtgtaaaaatgtgcctaattaaatttacgggttctattaacaaagaggagaaagggtatctgagacacctagaatctgaagcaagtcacaaaacagtatttatagaaatattaatcaggtaggaaaagtatatgtgcttacatctgcatgatataatctcttttttctttttctttacaatataatcttgaatatgttagaaattttaaatatttgttgctcctgggaaatggaactgggcggctggggtcaggactaggagagagactttttagtatatatgcctttttgaagtggtgataaatagactttcaaaaatagtaaatgaaattaaaaggaaaaagtctgcaagtttgatatataagttcaggagtagatatgtcattaagaatcagcaatactttatgcctgtaatcccagcactttgggaggccaaggcgggtggatcgtttgagacccgcctggccagcatggtgaaaccccgtctctacaaagagtacaaaaattagccaggcgtggtggcgtgtgcctgtagtcccagccacttgagggggttgaagtgggaggagcacctaagcctgggaggtcaaggctgcagtgagctgtgattgtgccactacactccagcctgggtgacagagtgagaccttgccttaaaaaaaaaaaaataataataatacttaagattattttaattgtaactctttcctcattaaaaaaaaaaagtataatgtgttgacgtttcaaaaatggtttagattcaggtagtttcaatccttttaaattcttaagtgtatttatggtgttttaaaagcagccaggcaaaggcattgccgaatacccgcaaacaggaagaatttccttctgatttacgacacatctttctggaaaggatatcaagtttaatgatgcatacacttttagggatttgttgggaacaggtcagaagaatagtaatattatacattagatactatgtctctttatacataatgtaaagtaagaaaacactctaataactaagtcggtggtggtgatggtagtggtgcagtagagaaacatcttttcttgatattgtctggattactgcaacaaattcttttactgatctgtgtcagaagtaccaggggtgatctgctatagttacatagtttgccacctctttaggatgtctgaataacaagctgttaaaaatgtaggaagttagtgggatgagagtttgatgtggggttggagtagagtgggctttgtgttggggaacagggaaagaaaaaatatggatgtgtaggctgggactggagccaagtactcactgttataggcagtaggaaataattggaagtttaagagctgggaagcatgacaataaatagcattgctggaagagtgggttttgtttgtttagggtatgagttgggctgtagaaacagaccagtcaaggagcaacaagtggcagtaacggtgtagtacgggcattcattggaatttgcggaaataataggtaaaaagaaaaaggggaatggttatgggagaagtgttagggaagacttagcagtaatcaattagatgtgtaggcataaagaaatgatttgactaggtgctgttaatgaaaaggaaagttaaagagagaatttttgaacagtgccagaaacttaatttttacttggtgaatttaagatgatgttgggatgtccaagtggaaaaagtctgataagttgtttagagttaaaagatttcttcttccttctttgtctttcttcttattccctccccacccctgcttctcttgtgtaaacagaagtttatagtgcacaaaagtgactcttgggaaagtatctttagttaaggatcaagatagtaaggtagaaccaaggaagaaagaggagtgaggaaggcagatgggttagaaaagaggatccaggagaaaaaaaagatatacaggagaataaaggagacaggaaccagtttgtcttcactttggatacctagcagccaataaaagtgaccaggatggagtaggtgctcattgatgagtgactggtataatactaagtatttttaattatccacaggtattatctagtttagtaccttaaaaaaaaactagtgcaaaatatacataacatgcaatttaccattgtaaccttttcagatgtactgttcagtagtgttagtctccagaactcttttcatcttgtaaaactgaaactttatacccattaaacaactgctaatatttcagtgattttaataaaaatgtttgcaatatttatccccattaggttaatataggggtttttctttttccctaaaatagtcttattttaaaactgcgttgtcttgagtagtcttttattgagaaagttgtaagcttctaaaaaccataattcttttttaatttttaattttatcttattttttattgtataaattttacagggttgtacttagaatcatagagtccaaggatatttttttaaaaatgcaaattagaattgtatccaaaataaggtatctcctttgtaactcccactaaaatagcttagtaatatatgctttaattctttgtatttatatgaaccagtgatggcccatttaatttttggtgtgtttaatttttcctaccttctgaatgagctgaattaagttatactcattcattggcactatccaaagtgcaattaatcttctcatctaagtgactgctttttaaatatttaagtaaagcttcaatcctgttgattttcctcagttaaacttagttaaggtagttttcatatgacagtttccacatcctttaccaaacttgtagccctctttgtgttatcacctgttgaaatgtgctattcagaactgataatgctagagatctgatcagactagaccttggtgagctgattattgctgttgatatgtataatataatttattaatttgggccatgaatattttttaaatttccttccgtttccttttctttttcctcttcctcttcctcttcctttcccttttcctttgacagggtcttgctctgtcgcccaggctggagtgcagtggtgcaatcatggctcattgtagcctcatcttcccagacccaagccatcctcccgcttcaagcttcccacgtagctgggatcacaggcatgcaccacaccatgcctgggtaattttttttaatttttgtagagacgaggcctcgctatgttgcctgggctggtctcgaactcctgggctcaaggaatcctcctgccttttgctgggattataggcgtgctgggattataggcgtgagccatcgtgcctggccaaatagccatatttcatggatgatacattgacctgttgtctgcttaaatcccttaatctattttaaggagtctgctggttgctggatgctcaaccattgtgtatgcgtatggttggctttttaaaaattacgggtagggctcataattggtggctcacacctgtaatcccactactttaggaggctgaggcgggcggatcacttgaggtcaggagttcgagaccagcctggccaacatggtgaaacccagtctctactaaaaatacaaaaattagccgggcatggtggtgggtgcctataattccagctacctgggaggctgaggcaggagaatcgcttgcacgcaggaggccgaggttgcaatgagctgagaccacaccgttgcactccagcctgggcaacaagagtgaaaccccatctcaaaaaaaaataaataaataaaaataaaaattataggcaggactgcatatttgtttttattatattcagcctaaaagtttcactcatttaaaaccattggggtattaaaatctgtattttctctaccatttgtagtcacccagctactgcagttaatcttttaagttgaaaagaaaaaagtttaaatgttgcatatatttaacaattctaaaatattgacagcgtcctgttttagcaaggcactgaccaagttcatcataaaagattaatactgcacatgaaaaaaattaaattagttacatgtctgtgttcacaagctcaaaacttcacctgtcagagtttagaaatacggggtaatggtaacgttacttttctgggatagctgatttttaaaataataacagtgcagcagataccaagcacaagttatattgaatgttgtggaatatggcactatgatggaaataaaaaacacacctaagctttctacgtagctgggaggatcttagttcatttatttcccttttcagtgtttttttccctagtaggtagtaaggattatggatgtgcaatccaccagctataaacaattagaggatgtaacaatttttgtggagggtattgcttttatcctccttgctgcaagatattttattaggcttttcatttataaacataagaaattttgctttcctaatatttagtatacggattgaatattaagttgtttttaggctttaagaattatctaggtctgtactgtccagtatggtagccattagccacatgtttgtttaaatattaaaatgaaataatttaaaaattcacttgtccacttgcactaaccatgtttcaaagtgctcaataaccacatgtgtctaaatggctactgtattggacagcacagatcatagggtatttgtatcattgcagaaattgctctgttgattgctgatgcaaccacaaatgattttctttcaaatttctgacaatccttacactaaaggtataggatgagtcctcaggggaaagcataataattctttaatgaattttttttttttttttttgaggctgagtctagctctgtcgcccatggctggagtgcagtggcgcaatctcggctcactgcaacctccgcctcctgggttcaagcaattctcttgccccagcctcctgagtagctgggactacaggcgcccaccactacgcttggctcattttttgtgtttttagtagagacacagtttcactgtgatagccaggatggtctccatctcctgaccttgtgatccgcctgcctcagcctcccaaagtgctgggattacaggcatgagccaccacgcccggcccttttaatgatttttataagaatggaaatgatagaggttaattatgaaaaaaatctaaaaaatatagaaaagtaaaatgaacaaaatacaaggaagattctgtgtgggacaactatatagacctttttttttttttttttttttttttgctgtgacacagccctcaggagatcctgagaacatgtgcccgtagactttctttttttagtacctgttttatattccagtccttcttctctgcagttgtgtacaaagctactgtacagggataattttacttgtgtacatttaaaattttaaaagcaagaaataaaaataatcctattgactggagatatttttgctttatggaagtttatctgaatgttgttctgaatctaaacagtatgtatcttctgttatcattagccttttgagtaaaaatataaaaattctgtgttttattgtagattattgtatgagttaggaatattggaaattatctcaagttatttattttcctttaaatgttctttaaaaagtgtgttagatatttggctgtatctgatattagaattacctgagatacttcaaataaattcatgaagtttcactatgaagtagtaatacagagtgcttggcaactttcttctgcctttttgctcattttcatctcatttgatgtttggctctgtcagcatcattgaccaccaacgttgtttggtaggtgcatggcagctttatggggaaattattaagaatttgttaatcaggcctgagtgtatgggtacctgaatttaaaatcaaccattctggtttttacctgattttatatttcatgatgatcagcattatgtataatattaattttggtgtgttccttagttttatgacaagtagaagataggcaattgatgatcaaggcagtggcatgaagggtgataagaggaagtagagaatgttggcatcttttttgtttatatcattaaagtaaatttgtgtttatgtcttgaatcctttttaccatgaaaacatagttgcttataaatttaatgttaatcagccatatgaagctctcagaggagtaggaaaggtttataaataacctaagagttttaaaaaaaatacgctcactattatgagaactttatttacaatattcttattcattaatgtaaaattaagaattgtaatgtatcccaataatgttatgaatttctctgatattataaagcactgtaataaattgtatttttatactctagccatctgccagataagaattatatatgacttaaataaaaaggattttgaaatttcataccttcagattatagtaatttctgagacttcagtgtagcattcagacttttttaattatagggaagcagaaagattaattttcagtgattgtgatttggtacatatagctaagagtagaacaggaattgaagacaagttcttttgtaaacccttaggctttaaggataatagactcagcctagaattcgccttgtttagaatggattatccaaacttgttgaatatttatgtgcttaggataggtaaatgttaggatataaatttttaaactctatattaaaggctctgtatttcacaggagaggaaaaatgaaggcattcgaagtgagtactctgtcccacatcacattttcttatctcaacaaagttcttgaaatggtagtgaaagttttttattgtgatagaaactaaccaagtttctttctttgtggataccaaacttgcaagtgttcctgggagtatatcagagatttgagaattcacacacatttcttactttaatgactctgggacacattattaacagagcaatgttacggagcacttaattgttaatgggagaaattttgacaaaattattgggaaccttgagagaattagagctttgttattacccgtgaagataaagaaacaattaagtacctattgtgtcctgaacactgagataaagccttagagaagttttctagttttaatccttttatcagctctttgagtgttactaaaatagaaaggataaattccccaggatctcctgtagcaaatgacaactggaatttgtcatcaagccctagaactgggttctttccgttgttcattttctcctgcagttgtcctgtgttataaaaacgaatttatattgttaaaatagtgttatttttttctttgggagaggaaatgtgagagtgagagcatgtgcatgaattggagttaggaagtaagatcagaagcagttggtgtgtgaagtatatcatgtggagaagacaatggaaaggcagtatatggtagtttaaaactggtagaggtctggcaaaaagtcagtaaaagcagttcagtgtaaattgtaggtatttttattactctagagattctgtgagatctcacataattcaataaagttcttctcacctgtgggaaagatgcatattatttatatttgagagcagttttgtttatatcaacagggaccacagtaataatttagactttcaacttatgaataaaattatcaaagtgctcctatattatcttatttggcaagtattgtttccatgtatagatgggaaaagcacttatgccataactagtggctcttttaataaatacatagggaagctgttccttctatagaatgttgtattgaatatgtctaagatagaagtgaaattttcaatattgacttcttaggtgatcgaatggaggctatatgcattatcttggggaggaaatgtattttagggctttattttttgcttacatatttgtatttttttatttctaggctgttcgctgctatgaatctctaatcttaaaagctgaaggaaaagtggagtctgatttcttttgtcaattaggtcacttcaacctcttattggaagattatccaaaaggtaatttttttcttgttcattattgtttgatttatacatgtgttggattgtaattatttgtgctttatcaagaggattttcctaagaaattgtaagtgcatgagcaaactaaacaatgaggaagaaaagtagagtagatggaaatggaaatcatcaataagttggctattcagtaaaagtgaaaaccacctgcatgttcagtgcagttttgttctgccttgtgaaaatccttgctcttgaaaggccttcccatagtagaaagtgacccagtttgatatagatatttgtacattgatggatactttggaaaggtaacaaaaactcaccatttttctttatcctatttaaaacgtttccattttagctcaaaaatatttgaatgaaaatctgatcgttaagtagccatgttattgtaaacaagtaatacagagagatgatcacagatgagccttggataaaaccagtttttaaaatttacttgaaatgtttttcctttaagaaataagtgagttaaataactgaaagtagtcagccccctaagatttgccctttttatggtaccaagctgccaactcagaccattactcaggaagttaaaagcacccggaaaccccgcccttccaataccaaagaaaaaatccacattaaaagaaaattattattatgaccaagaacattttaaccttttgatgatagtaaacattttgatgtggagtggatggatgtgttatgcttgttttcaacaagtgtgtttagagggcaaaacacctggcagatagtttcagggctaaagtgaaggattgttagtatttcatattgatgttttattatgcgacttttatgttaggtcaagtgaatgttttcctaatgaaaatgcaattttagtctgagacaggcatattctgtgaggtttgaaattaggcttatttctcagcttagctctgttatatacagctgcactacctttaacagattatatataaacatcgctgagtatctgttgtctgatctgtaaaaggggaggaggtgagggatgacgcctcatggattttcagattgtgtgacactggttagtacttagcaaaatggtttcagtccaacagggtaatgggtgttaatagttacttaatactccgttagatattttatttttaattaaaactggaaacttatttaaaggaaactattgtaccaaaaaatagatagaggcatacctgggagatattgcaggtttgatttcagacccctgcaatttattgcgaatattgtaataaaaccaatcaaacaaaatttttttgtttcctattacatataaaagttatgtttgcactgtaagtgtgcagtagcattatgtctaaaaaatgtacatactttagttaaaaaaaactttcttgctaaaaagtgctaacaatcaactgagctttcatcaagttctaatctttttgctgatggagggtcttggcatcgttgttgatatgtgctgagtgatcagggtggtggttgctgcaggttggggtggctgtggcagtttgttaaaataagaaaacattgaactttgtcgcatcagtggactcttcctttcatgaaaggtttctctgtagcatatgatgctgtttgaaagcattttactcacagtagagcttctttcagaaatggagtcagtcctctcaaccctgccactactctgttaactaagtttacgtaatattctaaatttgttgttatcatttccacagtgttcacagcacctttatcaggagtagattctatttcaagaaactccttttggccaggcacggtggctcacgcctgtgattccagcattttgggaggccaaggcaggaggattacttgagcccaggagttcaagaccagcctggacaacatagcgagaccccctatcttaaaaaaaaaaatttagctgagtatggtggcatgcacctaccctggaggctgaagtgggaggaacacttgaacctgggaggttgaggaggttgaggctatggtgagctgggatcatatcactgcactccagccagggtgacagagtgtgtgtgtgtgtgtgtgtgtgtgtgtgtgtgtgtgtgtgtgtgtctgtctgtctgtctctgtctgtctgtctgtctctgtctctctctgtgtctcttttttaaagaaactactttctttgctcatctataagaagcagttccttatccattcaggctccacttctaattctgtttcttttgctgtttccagcacatctacagttacttcctccattgaaatcttgaacccatcaaagtcatctatggggagggatgggaatcaacttcttccagactcctgctaatgtcggtatttagacctcaaatgttcttgttgcctaggctggagtgcagtggcgtgatctcagctcactgcaacctccgcctcctgggttcaagcgagtctcctgcctcagcctcctgagtagctgggattacaggcatgcgacaccatgcctgggtaattttatatttttagtagagacagggtttcaccaagttggtcaggctggtcgcgaactcctgacctcaggtgatctgcctacttcagcctcccaaagtgctggggttacacaggcatgagccactgcgcccggccttttgacctcaaatgttcttaatggcatcaagaatgatgaatcttttccagaaggctttcaatttactttcccgagatccatgagaggaatcactatttatggcagctatatagtcttacaaaatgtattactttaataagatttgaggccgggtgcggtggctcacgcctgtaatcccagctctttgggaggcctcggtaggtggattacctgaggtcaagagtcgagacccacctggctaacctggtgaaaccccgtctctactaaaaatacaaaaattggctgggtgcggtggtgtgtgcctgtattcccagctactcaggaggttgaggaaggagaatcacttgaacccagaagggggaggttgcagtgagctgagatcgcaccattgcactccagcctgggtgacagagtgagactctgtctcagaaaaaaaaaaaaaaaaaagacttggaagtcaaaattactccttgatgcataggctgcagaatggatgttgtgttagcaggcatgaaaacaacattaatctgcttgtacatctccatcagagctcttgggtaaccaggtgcattgtcggtgagcaataatattttgaaaggagtctttttttctgaacaatagttctcaacagtgggctgaaaatattcagtcgactgtgctgtgaacagatgtgctgtcattcagactttgttgttctatttatagagcatagacagtagatttagcatatttcttgaggtccctaggattttctgaatggtaaatgagcaattgcttccacttaaaggcaccaccagcattagttcctaacaagagtgtcagtctgtcctttgaaactttgaagccagatgttgatgaaagtcctacatctgaaagtcctacatggcatcttcctcaatagaaggctgtttcacggagattgaaaatctgttgtttagtgtagctacctttatcagtgatcttagctagatcttctggataatttgctacacttctccatcagcacttgctgcctcatcttgcgcttttgtgttatggagatggcttctttccttaaacttcacgaaccaacctctgctagctttacacttttcttctgcagcttcttcacttctcttggccttcatagaactaaggagagagttagggcctttcactggagtaggctttggcttaagggaatgttgtggctggtttgatgttttatccagaccactcagaccatgtccatatcagcagtaaggctgtttttgcttccttgtcttttgtgcattcactggaatagcacttcaaatttcctccaagaatgtttcctttgcattcgtaacttggctgtttggcacaagaggcctagcttttggtctgtctcagctttcaaagtgccttcctcactaagcttaatgatttctagctttggatttaaagtgagagatgcgtaactctttctttcacttgtacactaagaggtcatcgtagggttattaatatgcataatttcaatgttgtcatgtattagggaatacagaagcccaaggagagggagagagactagggaatggcctgttggtggagtagtcagaacacatgcaacagttatcgattgtttactgtcttatgtgggcacagttagtgattccccaaaacaattacagtagtaacaccaaagatcggtgatcacaggtcatcataacagataacaataataatgaaaatgtatggaatattggtttaccaaaatgtgacacagagccattaagtgagcacatggctgttggaaaaatgacaccgatagacttgctctacacagggttgctgtgagccttcaatttgtaaagaacgcaaatatctgtgaagcacaataaagcaaagtgcaataaaacagggtatgcctgtagaattctatgcaatctgctacttttttattgctgcacctttatgtagttggaggacatgctattttgagagcatgtaaagagagacctagacttgaaaattaggtttacatatgaggctacgtgtacttgctacttagtggttgttaaacaataaatcttttaacttttaacactatgttagactgtgactatagctttatttttcacatatatatatatattttttttttaattttattttttgagacagggtcttgctttgtcacccaggctggagtgcagtggcagaaacatggttcactgcagccccaaactcctgggctcaagtgattctcctacctcagcctcctgagtagctggaactagaggtgcgcgccaccacgcctaactattttttgtactttttttagagacagaggtcttgctttgtttcccaggctagtcttgaacccctgggctccagcgatcctcccgcctcagcctcccaaagtgttgagattacaggtgtgagccaccatgcctggccacttaaaaattttggttatgaaggtaatgaatccaaggagattgatcttggatatgtgttttcttttttggaagggagggcatgtggcaactagactgtgttagcaaactagctggtgagagtaatctagtaaggtgagagaagagaaggataatctaaggatttaagtccttgaaaacatgtgcttcatttagtgttgtgtagatgacctgggcattgataggtagttagcagcttgattaatgtgtaatagggggaagaggaaggagaaaatggatgcaggggtatgcaaatgtattcagtatattttaatatttcaagctggtggtttctatttcctagatgtgttttgttatttattttttgaaatcctctttgaggctttttaaggcatgttgccacttaaaataaattctctctctctctcttttttttttttttttttgagacagagtctcgctctgtcgcccaggctggagtgcaatggtgcaatctcggctcactgcaagctccgcctcccgggttcacgccattctcctgccttagcctcccgagtagctgggactacaggcgcccgccaccacgcccggctaattttttgtactttttagtagagacggggtttcactgtgttagccaggatggtcttgatctcctgaccttgtgatccgcctgctttggcctcccaaagtgctgggattacaggcgtgagccaccgcacctggctaaaataaaattctctatctgttctcttcattgtctttctccaagtccaaaactagaatctgtctctaatagccctctcccttcctctccaacacatactcataccctcaagattaccagtttatagagacatttgttacctttggctacctccttctcctctctttggatctagtacaggataagagaactactaaccctgggcaaatagacatttatttttagagaacacattataaaccataacttcctgggagtaaaccatgtagtaaatgtgtaattctgtgagtgaactgctcaggtatatgtacataggcgacttactggccttgttcttctgaagacagccctgtaattatttgccctgattcatagtcatcttttctgtgtaaagttttctgagcttggcatttctcttgagtttagttcctttaaaaaaaacaaacaaaaaaaggcttctatttctatagtagaaaatggtagaacctgttttgtgtgtgttttgggctgtggtttttcttacccttaattgtcattttgctctcatctactttctgtcttacaagaattccaagaaacaattttggtctgaagatggtataatttggtaatcatttatcttttctgtgattccagatgaatttgatgcagaaggaaaaaaggctttgtaaaatattttcttagcttttctggctggtgatatgaatgaagagtttaaaaaaatgtcatgtcactttatttggtcattttacttgtaggaatttattttaagtcttaaaatagtaattggataggggattgtgggaaaatggaggctcactgcagtcagtctattgttgtaggttatgttcctcagtaaggagtttcctttatgttcaacagctttggaaggtggagggtagaaccagtattggacagaaggagaagttaagctgtgacagcctttactaacttcatgggatgctctggagccagaatggcccttgagagctataccaagttgggccaagatagccaggcctttatactccaattattccatattgaacatgggccagcctgagaagaactgtgaccagggacaagttggctctctgcaactgaggcagcttctgtagaatctcacagatagaggctttcagcaagcaggattcccagcagttctttcttgaagtgggatatgagtgcttctttacagtgtctactatacctcctttttactcctaactctaaagctaacccatgaacctccgaagccaaattgctgatggggctctcagatagcttataagccttaaaccatggagattatgcagtgatttcacttctttgggttggaggacaccctgagagatacataaccctgggctgaagcccaagcatatgtatttagatgaatatatgtgatggatcttaggagcagttaatagaaaataagtgtaaatatctataaatatgtggtaaaatataggtaaagagagtcacggaggttaaattagttgattagaaaatcaggtagcagctgggcacagtggctcactcctttaatcccagcactttgggaggccgaggcgggcggatcacctgaggtcaggaactctagaccagcctgaccaacatggagaaacaccgtctctactagaaataaaaaattagcagggcgtggtggcgcatgcctgtaatctcagctacttgagcggctaaggcaggagaattgcttgaacccaggaggtggaggttgcggtgagctgagatcacgccattgcactccagcctggacagtaagaatgaaactccatctcaaaaaaaaaaaaaaaaaaattaggtagcagattatttcaaagtacatagcaaaattataaacagaaattacgaggcaggagacttaaaggatagacagtaagaacttcagaagtaaaaaattagaggagtgtaataatcattcctgacattaatatgaaaaccttgaaactcttaaaaattgtttcttcatatttttgagctggaagttttcccaattataagttccctgaaattctagccagtgatagatttttcttgcattcttccttccctcaagtaattggtcgtttgttgcatttctgtcacttttgggcaaaatatgctttggttgtttcaattcttaagcagttacaaatggccagggcaagttacatgccaagagctgccaatgtggagaagccttaagttagagcttggagggttttctttctctttttatcttttttttttttttttttttttttgagatggagtcttgctctgttgcccaggctggagtccagtggcgcgatctcggctcactgcaagctctgcctcccgggttcacgccattctcctgcctcagcctcctgagtagctggtactacaggtgcccgccaccacgcccggctaatttttctatttttagtagagacagggtttcaccgtgttagccaggatggtctcgatctcctgaccttgtgatccgcctgcctcggcctcccaaagtgctgggattacaggcgtgagccactgcgcccggccctctctttttgtcttttgtgggttgaatgacagtactctatcctggaatatttatagtataagaacatgaaatgtgtgttttccaatcatagattttgtttggcttctccaaaattgtcaattttttaatccattttctgtaatcattctaaaacaggttttaagcattgtatgaggatgtccaaataaatgatttccctcattctgtattaaggactttagaaaattctagttacagtagactaggaatttttttatggataactaccttaaagattagaaataaggactgtgctttggtcaaaaggattttactagagagactttggtgaggtgatgggtacttgcatactgcacctttagagttttaatgattttttttctgattaagaaacagcacgttaagatccttcttaaaataagatgctaagcataatgagggtagagtataattgtttataaaatgtgtaaacgagtagaaagatcactatggaagaaatggaacaaatgctcatggaagaaatggctcaattacaaatctgttcctgccatttagagtattaactttgtgactttgaatttgagcattcatatttatttctcagttcaccatatttttgtatggatgccatgtttctcccaactgataattacatggacttcttttttaaaatattttattttttctctttaattttttatttctttgggggtttttttgtaacatcttttcacatcacatggacttcttatacttcagttttatttgctttagaagacatcatactgtctttttaaaggttccccaatcctaaaagagaattttatgaagccagatgatatatataattaatcaaattattgaaagtatgccctccaaatttgtggaaattctgtaatatcattacaagggcaatctccaggtttgatatggtgactgcacaaaattgtcagggaccaagtcttctgttttcagcatgtttttaggtacaagtattaaatacctgattctagcttaaacaataaggacatttattacctcacataataggaagttcataggtggatttttctccaggcatggtttgaagtctagaaggatccagttacttttcagtctgtttcttctgtgctgtgggcttcatcccaagatagttccctcgtggtggcagttggtaatatatgcttccttgttcacatccattagtagacagagaacctttttcatgtctgtcatctataaatcagtggtgattgggccacctgagctcatgtgcccatttctggactaaaacaatcaccgagattgccaggaaactgataaccttttcaaatcaataacggggattgagagtgtggttagaaatgaatgtgagaaaatcagccacaccattgactacacaaactcttgcttgactattttttttctacagctggtttgataaatttggtttgcttttctttttagaagaccattaattaatgacctttataaactagctaccctcatgcatgaagaactaggaaatgggagatggcttaaaaccagttcttcaccacaactggaaaaatttctcatagtctaacgtccttccagtgataggttggttggcatcatctttatgcaaaaaagatgagcattattcatatgtaaaagttattttttcagatatgtgatgatgtttttgggtaatgtttctgtaatttgaacatattcagaatgttctttatatgattttatatatattttggcaatttacagtaaaatgaaaacatttcatatagagtttcagaaaacattaacttccatttttggtaaatcttcttttattcagcatctcatatattgtaaggtcagccgagagaaaggaaaaatagacccaaagtcaggcgagtaagtttattgaacctgctggctgctccaccacagacagaggaggcagccctgagcttacaaaatgaggggtttatatgggggagagagaccctggggtcgtttgttggttaactttgccatatataaccttgtgacatttatggtagcagccagatgaaggaacttacaggagggtttaggtaaagtttgtttatgcttcccacgacctcccctgtgcagtctggatggtttgtaattggggtttgcttatcgcagcaaggtctgataagtgaagtctgctggctccactggggcgcctggataagagcttagaaaagtaaagaggctgggggaagggtgaacggcacagagaagggttgcagggcgttaaggcaaggggtgggcagtacgcaggggtttggggggagtgttggcaataccaagaagcttttttggggcggtttgtccctaacatatagtcagaagataatgttttatttactgctttgttgaagaaacaacttggtcactagtgaagggtaacatgcagtgtgttgtaaaatgttttttgctagtttctgatccttaaattgagcagcatattatacttaagtagaatgtctaaaaacctatatatggtttaaagactattaaaattgacacctgtctacctactctacaagttaagaaatagaatgatactgctaccacaagcctgtgttctctccagttgcatcctcctcccttcctctgtaggtgtaacccatgcctggctgtgatgttcagtgttctcttgcctttctttcttttttttttaatccactgataaaagtatccctgaacaagataccgtttatctttggaaagctgaatagcaggcacgaacatagctatgtaaggaaggggccatattgtcactatttagaggaggctcttgggagaagtaaaactaaagaagagattttagcgttataatgtggcttctggttcctcaatagtttacaagagccacttttggggaaggcagtgtgctggggcatgtgtgactcttggcaaacataatacccataattaggacatatgacatgaccaatatgaaccaggaaaatctggtcaggaatatgaacagagagagtgggttattcagaagtaaatcaaatcaggccggtcatggtggctcacacctgtaatcccacactttgggatgccaaggcaggtggatcacttgaggtcgggagttcgagaccagcctggccaaaatggtgaaaccccgcctctactaaaaatacaaaaattagctgggcatggtggcacgcgcctgtaatcccagctactcaggaggctgaggcaggagaatcacttgaacctgggaggcggagattgcagtgagccaagatcaccccactgcattccagcctgggcaacagagtgagaccccatctcaaaaaaaaaaaagtaaatcaaagcagaacacttaacacttctgggagccttcacatcatctattttgtagaatatagaggggagaatagaaactttatcagaacatggtcaaaaaaaagccaagcccagttaagaatctgggccaggtttatctgggtatttggtcctcaggttgagaagaggttacaagagcagcagaattttaatgataagcctcagtgacttggatctggggcatagctgctgtcctgggatcaccctttttcttcatcttgggtattcccatggcctcttgtctctgttgtgtctcctgctttcaataaaccatatcttcttctttcttgtatatactctcctttaaggggagcatatttgtcagatttttcttcaggaaagttatttgggagataattttctttggagactttgcgtatcagaaaatacctttattctagcctcctaatagatcgcttgactggatatataattttaggttggaaataattttccttcagaattttgaaaacattgttctgttgccttatttctagaattacatatctgttgtaggacccttcaaactaccaagtcatagccttcttttctgggaatatttttggaattatttcctgaattttcttttttccttttattctttctttttggggctctattattgatatgttagacctccggggcacagtttttctaattttctgtttttgtcctttttgtttattttttgagagatttcttcaaatttaattttaatctttttattgaattatttatttctgctatcgtactttaatctaccgaatttaattttttttagagcatcctgtttgttctcctgcacacacccccttttcatccccctcaatgaaaacaatattttcccttacctaagactagtaagaattttttgaagtatattttcccctgcatagtagtcattattttttcttttaggttgtctttttttcttttgtgttagtttcttcttggttagaggctttctttagatgtctgataattcttagctgtccatatttcataattggaataattgagaactggaggctctgaacatgggattgcggatctctgaatatgatatccatggccttttgttggagaatctctgcattttttggtcagattgcctgaacaacatcaagtgttgagtgagagagttgagggagccaattgcttctcaaatagtttttatcctggtcttccatatcttagcttgtgaattgtaaaccacaaattaaaaaaatccttttctagctgatcagaaaaatattatgcccccatgttttcatctagtagtcttatgggcttctttttatatctaactctcttaatcctccacgagttttgatctttgaggaaggtcgagttgatctaaggggttagcctagatgctgttcaagtgcagatctgagatttgaccatggttttacgtttctgaactgaggggggcccagaattttaagttgtttggtctgaaatatcactatctactgggaggtgggtgtggtgggaatcttgttaccgtgtttgttaagtgtattattgactttaaagtgagacataattatgactcataattattttcctttcagcattatctgcataccagaggtactacagtttacagtctgactactggaaggttagtgtacatttgcatgctgatttcatgtttgtgttttgggcagattattgccaattatactcaaaattaattgagctcttgcttttttttgttaattacttaaaatattgcttctaggggaaaggtattggaaaagggttgagagtatttatgtttgtgctgtcttgtatgactctccttgtattttattaagaattagagtcctctgacacattttactggtcaaatgtaatagaagtgtgataagtaaaaatcaagcaaaactaaacaaataacaataacaaaatgattccttggttttcttttctaaagttggtacctgggagtaaaagaaggctgaagacgtgtatatcaggctaaaatgggaaggtgtaatgggaaagttatgataaactctttcttggtgtactctgtttataattggagctttgaggagagctgaacctattttttagaagacctacctaaatgaaagactgtgcatagcagtgaaacaattaatcatccactttcttatcttaatttaagcagtgattaagcatgatcttttacatcatgtttacttttaagtttattgagcagtgagtttttttttttaaatctgaattgctgtttcagattttttgtggattttatttttctattggttaatttgtctttctttttgaagtaggtacttattccagtcttatatagactggctttgtctggaaaagcccttcaacagtcagcctatgcagagattttgagaacaccgtgtagaggttttagacatatatgtatatatattttttcttttttaagtcttttgaaaatatcttctctaatctctggcttttttttaaaagctttatcacatgctataaaattatagcttaattcacatgctataaaattatagctttattcacatgctgtaattcacatgctataaaattcagctgttttaactatacaaatcagtgatttttagtaaattttcagagctgtgcagctgatagaggcaggaggcagacaaaggtctagacagatagggaagggtccctggagaatcactgatccacccagcccacaggtgtttacaccagatgttttgtgcagataagggaacctgcacagggggcttgcctgggcatgcctgcagtggactggaggtacacatgcactgggggaatggggtggagccaccaataatttgagccttatacaggggaggatcctggcctcttcaactgtgtgctggggccctggtattcagtttgtgaggtggaaacctgctggcaggaccccctttctttgctgatagctttccttttgcttaataaattttgtcttcctcacccttcaatgtggctgcatgcctaattcttcctagttgtgagacaaaaatccagattagctgagctaaggggcaaaaaatcctgcatcacagccatcatcacagtcttatttatctccctggaatgaaacctcacatatatccccagccctggcaaccaccagtctactttctgcctttatatatttgtcttttctggatatttcatataaatggaatcatataatatatggtcttttgtggctggcttctttaacttagcatatgttttcaaggttcatatatgttatagcatgaatattttattctttatttcctgataatatagtcacccctcagtatccgtggggcattggtttcaggacccctcatggataccaaaatccatggatactcaagttctttatattaaatgataaagtatttgtatatcacctctacacatcctcccatatactttaaatcatttctagattacttataatacctaataaaatgtgaatgccatgtaattgattgctatactgtattgctttttagtttgtattattttttattattgttatttttttcctgaatatttttgatctgcagatgcggaacccatggatacaaagggctcactgtattccattggatcaatataccacagtttgtttatcctttcatcagttgatgggcatttgggttgtttcattttttggctattgtgaataatactgctgtgaacatttgtgtacaggtttttgtgtgacataatattttcagttttcttgggtaggtactgagaaatggaattgttggattatagggtaaatctgtgtttagcattttgggaaactgccaaaactttttttccctatgtctgtaccattttacatccctgccagtaatgtgtgagggttccagtttctctgtatcctactcagcacttttaattatctaatttttgagtgtactagttttttagtgtgcctagtggggtagaaaataaagttttaaactttgataaagtccagtttatcagctttgtaacacaactttttattgcttgtgtttttgttgttgtacctaagaaatctttgcctaactcaaggtcatgaagacttactccatagtttatttaatcaggtgcttcagtgctttgcttttacagagtgctgcagtaaatagtctagtaaaagtgtctctctctctatatatatagttttttagagacaaggtcttgctctcttgcacagggtggagtgcagtggtgcaatcagagctcactgcagccttgaattcctgggctcaagtgaatcctcctgcctcagcctctcgaggagctgggactgcagatgcacaccaccatgctcggctaatttttaagttttttttttgcagaaatagaatctcactatattactcaggctggtctcaaactcaatcactggcctcaagtaattctcccacctcggcctcccaaagtgctgggattacaggtgtgagccaccgcacttggcctgtcttttaatacttttgttagtgattctttagtatagattcctttaaaagtgggatcattgtgttgaagggtatttgctcctttgggattgaaccatttgcatttatttcaacaatgtatgcaagtgcttgtttcttcttggtcttaatcaagaacctttttgtcagcagacttgccagtttgataggtgagaaatggtattttattataatttaaatttacattttcttagttgttagtgagattgaactttttaaaaattgaagtgtaaagactatttgaatttctttttctttgaaatatttgttcatgtctcttgcccattttttttattaggtcattgttttactgttttatgtagctatataacatgtattaggcatatttatcctttatctgtgacattagttgaagctactgttgcccagtttgagatttgttgttttgctttgtttttgtgtgtttgtgtttgcctgtgcagaagttttctatttctgtgtagtcagattgatcagtcttctacattgcccttgtattttgaatcataggatgggttttttcctcattcccaggtgttagagaaattcacccacattttctttcagtacttgaatggtttaatattttacatttaaatttctgatccgtttgggttttattcttgacttacagtgtgaacaatatttaagattatcttttttcttatgactggttatcccaaagatatattttttaaaaattcattttttcctctgctgatttgagatgttgccttaattgtatactaaatattcatatgcagttttgtctgtgcattttgtggcatgctttgttcatgaactaatacaaaagtattttactaacagagattttataatatgttttaatgtatggtagtgctagggcaccctttccccactgttcttgcttctaggattttcctggctgtcgttggtggcttgtttttccaaataaactttctaattaacttgtctagcttcacaaaaaatacctgataatttattttctgtagcttttttgagatatatttagcattattttaagcattttttgagatatgatttacattatttgagatttgacaacttaaatagttgtataaccattaccataatgaagatatagaacattttccatcacccaaagtgttcccttgtgccattttcctactcttgatctctggtcccaggcaaccacttctctgctttcatccctttagttttgtctgttctggaatatcatgtaatggggtttaaacagcatatattcttttgtttttgatagctttcatttggcatgcttttactgagattcatccatgttgtgtgtatcagtagtatgttctttttcattgttaagtaggatttcatagaatggatatgccacagtttttctcagttgataagtatttgggttgttttcagcttttggttatgaataaagtgctgtgaatattatttgtctttgtgtggacatggattttcatttgtcttggtatatatacctatgatttgggaatgctgaattgctttgcagttttaggtttaaccgtcagactttttcaaggtggttataccattttatattccaaccagcagtgaatgagatttcagatgttccatatcttcgttagcacttggtattgtcagtctttttaactttagcccatctgcccattcttgttttttcttctttcttgttttctttctttctttcctcctcagtctttttaactttagcccgtctacctattctccttcccttcctcctctccctccctccctcttcccttcttctttcttttctttccttctcttcttcctttccttcctgttgttcttccttatcttcttcctcttcttcattgagttttatgggttctttatatactctggataaatgccctttgtcagatacttgttttggaattattagtctctggttcatcttttcattttcttactagtgtcttttgaagagcaaatgtttattgtttcaatgaggtccatttaattactttttttttcttttacagtttgtgctttttgtgctaggaaatctttgtgtatcccaagatcataaaatatttcctcaccttttaaattctgttttggcctgtgatacatttcaagttgtttatgatgtgagatagcatcagtggtccccccaccccctaccccaatagctacctagtttttccagcattatttgttgaaaagactacactttgaaaatctagcatttcttctttgaaaaatatcaacgtacaatttagttttctgtttctagattctctgttacgttccagtgatctgtgtgtctgtttttaagccaatatcatagttttgtttactatgttcttgaaatcaagcaatgtaagttccctgtattatttttttctttctttctttccttttttttttttttttgagatggagtctctctctgtcgcctaggctggagtgcagtggcacgatcttggctcactgcaaccttcgcctcccgggttcaagtgattctcctgcctcagcctccccagtagctggaactataggcccacgccaccacgcctggctaatattttgtattttagtagagacaggtttcaccatgttggccaggatggtctcgatctcctggcctcgtgatccgcctgcctcggcctcccaaagtgctgggattataggcatgagccaccgcccgcatctggccccaagttccctgtattctttttcaaaattgctttggtttttctaggtcttttgcctttgcatataaagtgcagaaacggtataattcagtataattctgctaggattatattggaactacatgtgctaagttaggaagaatttgtcatcggtaatattgcatttgcttgttcgtgaacatggcgtatttcaccctgtatttagccttctttaagactctacagcaatacttcatagttcttatcacatatgttttacgtttgtttttttttatgctattgtgattggagtggttgtaaaattttatttccaattgttttattgctattatataggaacatttattattgcatgctgatctagtatcctactgtcttactaaattatattgttctagtcatgttactctagataggattttctacatacattatgcggtctgcaaataaagaaaattttattttttgttttcttatttgtggatgcccgttagtttttttcttgccttgttcaactggctaggacctcccatacaatgttgaatggaaggggacatccttgttttgtttctctggggaaaacattacatttttactgttgaatgtgatactacctgtagggtttttgtagactaatattgaagatgttcccttctgttgctagtttacttcgagggctcttccctcttccccctacttcatgtttttataatgaatagtgtgaggatataggaaaaaactcagttcctcctatactctcacaacacagaacatttctgtaacaaaatgtgtgtgggttttccccctgcatacctggcaagcaatcagttctgcagtggctgctggtgtcctctaattcagttcaattctgacattatctacctggagatagtttcagatcccacagagtgagagctaagtcccacaagactacccccacttcagatgccattgcaggcctccggaacttttgaatgactggctatataaatcggggttcccatgaccctctccttggttccattaatctgccagagtggcacagacctcagcaaacagttagggtttactgttttattataatgggtacagatgaagagatgcataggatgaggtcatgtgggaagtggcatggagcctccatgccctctctgggcatgtcaccctctagggacttccgcttgtgcagctatccagaagctctccaaaccctgtccttttgggtttttatggaggcattattatgtaggcatgactgattaaatgattggccactggtgatcagcttaaccttcagtccctttcctctacccagaggttggagaatggggctgaaaagtcccaacgttctaatcatgctttgctctttgctgtgaccagcccccatcctgaagctacatagggggctgcctgccctgagttatctcattacagcccccaacctgaagctacataggtggctgcctgccctgagttatctcgttagcataaaagagacactcagggctgggcgcagtagctcacccagtaataatcccagcactttgggaggccgaggtgggcacatcacctgaggtcaggagtttgagaccagcctggccaacatggtgaaacctcatctccgctaaaaatacaaaaattagctgggtgtggtagtgcttccttgtaatcccagctactggggaggctgaggcagagaatcgcttgaacccgggaggcagaggttgcagtgagccgagatcatgccactgcactccagcctgggcaacagagtctaaagtaaacaaaaccgacctttttcttattttttttttccactttaagaaaagaaagaaaaggttttgaattctggaagcaatgcctatctgaatagaaccattgattaaacgttatggtaacatggaaggatggagaacagtgtttcagtttgaaaaactagttggtctgttacaagatatgcaggatatgtatttttttgtacattgattgattaaagtatttgtgggtacagtttcttaaaatagtgatcaattcattatttttttataaccctaattttataaagggtttgatagagttgtgctaaaatttagtttgggacaccgaaaaaaattgattattaaatttaacatacatactatctatatgaatgtaaatatcagctttataatattactgctgaagaatatcacatagtattaggttggcgcaaaagtgattatggtttttgccattactgcagttacttttgcacctaagattcagtttgttgaagagattaattcacattttttgggtatgctaattatagataattcttatccttaaaacagtttcactaaaaagttctaaataatactgttttactgcctgattcagcatatgcttgaaaattatactgtacttcttaccagccctgaatttgtgctggccgtattttcctaattgggcctgattggtaaggttttcttctgtatggtcttattttttcatcagtattgtactggtgtgggattatgggttaatgtcaggtaggagagaaatgttgaagagagaatttttgtaacaggagaactcaaggttcttctaattcagatttgttttttgaattcagaaatatattcagtatttaaatgtatcagtctggaaatgcttcataatatgaaaatatttagaacctgtaaggaagacagaactataattaatatttcaacaagtttattgcttaacctgaattttttttaaaagcctaacttttttgcttagaagagaccaagagagtgagctcttttaaagaaaagttaaaaagcagtatattttggaataaggattagattctttggaaattttacaagtttagaagcagaacacatcttagaaattattatctaattcctttactttatggactagacatggtgcatcccggtgattaaggaagccccccaagtcagcacaaataggtagtggataaactagtggaatctgtgctcattttctgactttccggtggctttttcagttatacagtttaggctagtctggctttcacatttgttgacagggtctcttttgacaatgcagaaatgaataagatagttcctgctctcccttatttatttatttatttattatactttaagttttagggtacatgtgcacaacgtgcaggttagttacatatgtatacatgtgccatgttggtgtgctgcacccattaactcgtcatttaacattaggtatatctcctaatgctatcccttccccctccccccaccccacgacaggccccggtgtgtgatgttccccttcctgtgtccatgtattctcattgttcaattcccacctatgagtgagaacatgtggtgtttggttttttgtccttaagatagtttgctgagaatgatggtttccagcatcatccatgttcctacaaaggacatgaactcattttttatggctgcatagtattccatggtgtgtatgtgccacattttcttaatccagtctatcattgttggacatttgggttggttccaagtctttgctattgtgaatagtgccgcaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccactaacagtgtaaaagtgttcctatttctctacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagggtctgttcatatccttcacccacttgttgatggggttgtttgtttttctcttgtaaatttgtttgagttcatcgtagattctggatattagccctttgtcagatgagtagattgtaaaaattttctcccattttgtgggttgcctgttcactctgatggtagtttcttttgctgtgcagaagctctttagtttaattagatcccatttgtcaattttggcttttgttgccattgcttttggtgttttagacatgaagtccttgcccaggcctgtgtcctgaatggtattgcctaggttttcttctagggtttttatggttttaggtctaacatttagatctttaatccatcttgaattaatttttgtataaggtgtaaggaagggatccagtttcagctttctacatatggctagccagttttcccagcaccatttattaaatagggaatcctttccccgttgcttgtttttctcaggtttgtcaaagatcagatagttgtagatatgcagcattatttctgagggctctgttcttttccattggtctgtatctctgttttggtaccagtaccatgctgttttggttactgtagccttgtagtatagtttgaagccagatagtgtgatgcctccagctttgttcttttggcttaggattgacttggcaacgcgggctcttttttggttccatatgaagtttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtaaggtggattcctaggtattttattctctttgaagcaattgtgaatgggagttcactcatgatttgactctctgtctgttattggtgtataagaatgcttatgatttttgcacatggattttgtatcctgagactttgctgaagttgcctatcagcttaaggagattttgggctgaaacgatggggttttctagatatacaatcatgtcatctgcaaacagggacaattttacttcctcttttcctagtttgaataccctttatttccttctcctgcctgattgccatggccagaacttccaacactatgttgaataggagtgatgagagagggcatccctgtcttgtgccagtattcaaagggagtgtttccagtttttgcccattcagtatgatattggctgtgggtttgtcatagattgctcttattattttgagatacatcccatcaatacctaatttattgagagtttttagcatgaagtgttgttgaattttgtcaaaggccttttctgcatctattgagataatcatatggtttttgtcgttggttctgttatatgctgggttacgtttactcatttgcgtatgttgaaccagccttgcatcccagggatgaagcccacttgatcatggtggataagctttttgatgtgctgctggattcggtttgtccgtattttattgaggatttttgcatcgatgttcatcagggatattggtctaaaagtctcttttttggttgtatctctgccaggctttggtatcaggatgatgctggcctcataaaacgagttagggaggattccctctttttctcttgattggaatagtttcagaaggaatggtaccagctcgtccttgtacctctggtagaattcggctgtgaatccatctggtcctggactttttttggttggtaagctattaattattgcctcaatttcagatcctgttattggtctattcagagattcaacttcttcctggtttagtcttgggagggtgtatgtgtcaaggaatttatccatttcttctagattttctagtttatttgtgtagaggtgtttatagtattctctgatggtagtttgtatttctgtgggatcggtggtgatattccctttatcattttttattgcgtctatttgattcttctctcttttcttctttattagtcttgctagaggtctatcaattttgttgattttttcaaaaaaccagctcctggattcattgatttttttgaagggtttttggtgtctctatttccttcagttctgctctgatcttagttatttcttgccttctgctagcttttgaatgtgtttgctcttgcttctctagttcttttaattgtgatgttagggtgtcaagtttagatctttcctgctttctcttgtgggcatttagtgctataaatttccctctacacactgctttgaatgtgtcccagagattctggtatgttgtgtctttgttcttgttggtttcaaagaacatctttatttctgccttcatttcattatgtacccagtagtcattcaggagcaggttgttcagtttccatgtagttgagcagttttgattgagtttcttaatcctgagttctagtttgattgcactgtggtctgagagagagtttgttataatttctgttcttttacatttgctgaggattgctttacttccaagtatgtggtcagttttggaagaagtggggtgtggtgctgagaagaatgtatattctgttgatttggggtggagagtcctgtagatgtctattaggtctgcttggtgcagagctgagttcaattcctggatatccttgttagctttctgtcttgttgatctggctaatattgacagtggggtgttaaagtctcccattatcattgtgtgggagtctaagtctctttgtaggtctctaaggacttgctttatgaatctgggtgctcctgtattgggtgcatatatatttaggatagttagctcttcttgttgaattgatcgctttaccattatgtaatggccttgtctcttttgatctttgttggtttaaagtctgttttatcagagactaggattgcaacccctgcctttttttgttttccatttgcttggtagatcttcctctattcctttattttgagcctatgtgtgtctctgcacatgagatgggtttcctgaatacagcacactgatgggtcttgactctttatccagtttgccagtctgtgtcttttaattggagcatttagcccatttccaattaaggttaatattattatgtgtgaatctgatcctgtcattatgatgttagctggttattttgctcattagttgatgcagtttcttcctagccttgatggtctttacaatttgtcatgtttttgcagtggctggtactggttgttcctttccatgttcagtgcttccttcaggagctcttttagggcaggcctggtggtgataaaatctcttagcatttgcttgtctgtaaagtattttatttctccttcacttatgaagcttagtttggctggatatgaaattctgggttgaaaattcttttctttaagaatgttgaatattggcctccactctcttctggcttgtatagtttctgctgagagatcagctgttagtctgatgggcttccctttgtgggtaacccgacctttctctctggctgcccttaacattttttccttcatttcaactttggtgaatctgaccattatgtgtcttggagttgctcttctcgaggagtatctttgtggtgttctctgtatttcctgaatttgaatgttggcctgccttgctagattgtggaaattctcctggataatatcctgcagaatgttttccaacttggttccattctccccgtcactttcaggtacaccaatcagacgtagatttggtcttttcacgtagtcccgtatttcttgcaggctttgttcgtttctttttattcttttttctctaaacttctcttctcacttcatttcattcgtttgatcttccatcgttgataccctttcttccagttgatcaaatcggctactgaggcttgtgcattcgtcacatagttctcgtgccttggttttcagctccatcaggtcctttaaggactgctctgcattggttattctagttagccattcatctgattttttttttgaaggtttttaacttctttgccaggggttcgaacttcctcctttagctcagagtagtttgatcatctgaagccttcttctctcaactcgttgaagtcattctccatccagctttgttccgttgctggtgaggagctgcgttcctttggaggaggtgaggcgctctgatttttagagtttccggtttttctgctctgttttttccccatctttgtggttttatctacctttgtttttgatgatggtgacgtacagatggggttttgatgtggatgtcctttctgtttgttagttttccttctaacagtcaggaccctcagctgcaggtctgttggagtttgctggaggtccactccagaccctgtttgcctgggtatcagcagtggtggctgcagaacagcggatattggtgaacagcaaatgttgctgcctgatcgttcctctggaagttttgtctcacaggagtacccggtcatgtgaggtgtcagtctgcccctactgggtggtgcctcccagttaggctactcgggggtcagggacccacttgaggaggcagtctgtccgttctcagatctccaactgcactgggagaaccactgctgtcttcaaagctgtcagacagggacatctaagtctgcagaggattctgctgccttttgtttggctatgccctgcccccagaggtggagtctacagaggcaggcaggcctccttgacctgtggtgggttccactcagtttgagcttccaggtggctttgtttacctactcaagcctcggcaatgggggcgcccctccccagcctcactgctgccttgcagtttgatctcagactgctgtgctagcatcaagtgagggtccctgggcttaggaccctccgagccagacacgggatataatctggtatgccgtttgctaagactgttggaaaagcgcagtattagggtgggagtgacctgattttccgggtgccgtctgtcacccctttctttgactaggaaagggaattccctgactccttgcacttcccgggtgaggtgatgcctcgccctgcttcggctcacgctcagtgggctgcacccactgtcctgcacccactttctgacactccccagtgagatgaacccagtacctcagttggaaatgcagaaatcacctgtcttctgtgtcgctcacactgggagctgcagactggagctgttcctattcagccatcttggctccacccgctctcccatatttctatgaggaggaaacacgtaaacataattagtttttggtaagtaatacattggaagtgttgagggctgtgccggaggcagaagtgcacatgctttgtttgaggggtttgggaaagtctcagtggggattaggaaagactttacagaaaaggtgaaacttcagggaaggattagtgggagttttcaagatacaagacctggtcaagttttccaagaagagaagtgagagagcagtgcatagcagtacagtaggtgttttggaaactcccacgttctcggtctagagcagaggtccacagactttttcttacagggcaaaatagtaaatattttaggttttgtgtaccaagaggcaagatcaggtaatatataggtgcttagataatcttttatataaaaatcatttttagctcccaggccttaaaaaaaggatttggctggcaatagtttatagaccactgtcttagagcctgtcatgattgttgggcgttataggactcaaactggggaaaaggaaggcaaaggccagatcataaatgcgtttgcaacagttagcactgttttgcaatcttagatttgtccatatcttgtgaaatacgatagtgctggagatcagataaagttaaataaaacacagttattttttaggggttggattgggattgcattgactttgtattttaaaaacaaactgtcgctgggcacagtgtctcatgcctgtaatcccagcactttgggatgccaaggtgggcggatcacctgaagtcaggagttcaagaccagcctggttaacgtggtgaaaccccgtttctactaacaatacaaaaaattagcccaatgtggtggcacgcgcttgtaatcccagctactcaggaggctgagggaggctgaggcaggagaatcgcttgaaccctggaggtggaggatgcagtgggccgagattgcgccgttgcactccagcttgggcaacgagcgaaactgtgtctcaaaacataaataaataaataaataaataaataaataaataaaagctgtcatcttttgtcagtaaagttttgtaacttcctcacaaagttctcgtgcttcttataaataatgtattttacatcttacacttctattgctattatacatgccattttaattttattttttatctctgctggtatatagaactgcagttgacttttatgtgttaaatttatcaagcaacttcactaactttcactaatttgggttatttgactatgtaactttggattttctctgtagactatcctacctttgtaattagtgacaattttgtttcttctgttatcagtattgtaaacatttcattaaaagtgtttggaatgttctcatcttgtattttctgaaatagtaaatattttaggttttgtggaccaagatataatcttgtaaaagtggtttcttgcatgtttgataaaaccaacctgttaaactctctgggattggtaatatgtctttttgggaagattttatactactggttttattagttaccagttacttttttaggttgtaaatctctgctacatttgtttatggtcacatatacctatagttaggtccttaattaatttctgattcttagttgtgccttctgttttcttccttgcttcaatcaaaggtttgtaaattttaatactgatttcaaataatacagttttgacattgttgatcatctctagtttatttccttctttctttggacttattctctttttttctttttctcttctctctctctctctctttctctctttctctttctctctttttctcacctaatttactccataatgcctcctacagtctttttgtccagaccactatctagttcaggaccataggttagaactgagtatgtcccttaggtgtctttttaagcattgtcttccctccactctcatcccttttgtgtttttgttttggtctctggcttaaagagaccagcacagttgtcttatagtgtgccattttctgactttgttttattgctttcttttggtattgtttagctcatttcactatcttctgtatttcttttaattaagttgatagttaaccaacaactgtttgcttagtgggtgtttttgttgttgttgttgttgttgttttgagacagagtttcactcttgttgctcaggctggagtgcagtggcacaatctcagtttactgcaatctctgcctcctgggttcaagcgattctcctgcctcagcctcctgagtagctgggattacagctgtgcaccactacgcctgactaattttttttttgtatttttagtagagacggggtttcaccatggccaggctggtcttgaactcctgacctcaggtgatccgcccgcctcagcctctcagagtgttgggattacaggcgtgagccactgcacctggcctggttagtggtttttaatgccccatcagggcttataaaaaaatattttccctccatatatatgtatattccttcctgggtatactttagagtaaattacagataacatgacatttcaatccttaatattctaaatacctttctacaaaataagaatgattccttaaataactgtcagatctttaccacctaacgaaatttagcaatactgtcttcttctttttttttttttttttttttttttttttttttttgagacggagttttgctcttgttgcccaggctggagtgcaatggtgcgatctcggctcactgcaacctctgcctcccgggttcaagcaattctcctgcctcagcctcccgagtagctgggattacaggcatgcgccaccacttctggctaattttgtatttttagtagagatggggtttctccatgttggtcaggctggtcccgaactcccagcctcacgtgatctgcccaccttggcccccaaagtgctgaggttataggcgtgagccaacgtgcctggccagcaatactgctttttattccttcaaagatgcacttttttttttttgagatggaatctcactctgtttcccaggctggagtgcagtggcttgatcttggctcactgtaacctccacctcctgggttcaagcgattctcctgcttcaacctcctgagtagctgggactacaggcgcatgctaccatgcccggctcatttttttttttgtagagatggggtttcaccatgttggccagaatggtctcaatctcctgaccatgtgatccacccacctcggccttccaaagtgctgggattacagtcatgagccaccatgcccggcctaccctttttgtttaaatctttggagcaaggtatctaataatattttaagtcttcattggctgggtggtagtcatgatatatagttgtcaatgcctatgcatactcatctttgttgtttttcctcctgtcatgattagatagctgtagcctattgtttcagtagataagtcacttatggagcatctgaggaaagaatatgagttttgattgctgactaaaaacttttcattgtcagcttctggtaaggtcaaaaaagtgatgtcaaaacttgcagaaatggggtttgtagacaacagtggaagaatcttctaagaaatgctatatcaccaccttttttgatgtcccagtagttgatattgtgtggaaaaacatggacgagagtatggttaacaggattaaaaaattattcagaattggacactaaggatatcttaatgaaattttttcacttaaattttcctttatgtgtgaaaaaaagaatgtgataaaaatttatctttaccattaaaaataactgaaaataattttaattgctttttttttatttgagatgaggtcttactatattgcccaggctggtctcaaactcctgggctcaagtggtctgcccacttctgcctgccaaagtgctgggattacaggtgtgagccactgcacccagcttcttactgaattttcactgactcctagttttcctggatagttttaaaaagttgttagtgttgttttagctcttttgatgctgttttgaagctgttttatagctcttttaatgtcttttaaaagctctcctcgcggatcacgaggtcaagagatcgagaccatcctggccaacatggtgaaaccccgtctctactaaaaattcaaaaattagctgggcatggtggcgcgtgcctgtagtctcagctacttaggagactgaggcaggagaataacttgaacccaggaggcagaggtttcagtgagctgagatcacgccaccgcactccagcctggagacagagtgagactccgtctcaagaaaaaaaagctctcgtctttttcttctgcaccttccctttgtgcataggatttgtcttcctttattcatctttctgcatctggggagtattgccttcagcactagaaaattttcagccactacatcttcaaatattgcctgtgttccattttattttttgactccatctacatttggttttagagatatgatagattttcccacatacccataacctcacttacttgtttttcttggtgaatatttgaaatatactctcatcaatttgaaatatacatgattattaactatagttaccatgctctgcaattgatcactagaatttattcttgtctaagtgaaacttcgtaccctttgaatagcatctccccaattccctttccccaccctccctgagcctctggtaaccactgctgttctctttactcctatgagatagatattctttgagtttgacttttttagattccacatgtaagtgagatcatgccgttttgtctttctgtctctggcttattttgcttaacacaaggtcctccagattcatccatgttgtcacaaatgacagaatttccttcttttaaaggctgaatagtatttcaaggtgtatatataccacgttttcttaatccatttatccttcaatggatactttggttgattctgtatcttgtctattgtgaataaggctgaaatgaatatgggagtatagatgttataaataaagttttagtgccgcaaaagaaatagcactcgaatataaagtttcctttttaattctcaacaaggcaaggtacttctatagaagggtgcacccttacagatggagcaatggtgagcgcacacttgggcaagggaggggaaagggttctttccctgacacacctggcccctgctgctgtgtcgttcccctattggctagggttagactgcacaggctaaactaattctgattggctaatttaaagagagtgacggggtgagtggtttggcaggaaaaatggttatgacagggcaggtaattggaatgagtcagggtggagcaggtagtcgaaaaacgttgctttacgaggaagtgaagtttaaaagtagaaggcaaagaaatgaacatactgattccttggaaagaaatttagaactcatatataacatagatatctctttgaaattttgatttcaatttctatgatttatagctagtagtgggactgctggatcaaatggtggttctattgttagtttttcgaggaaattccaacattttactaagaaagaatccccaggggttcagatttatgtgggaaatcttgggtacaactctgtgtggtacctaatttgtttcctaagtctcagggcattttattggctttcagtgttggcttacctttctgtattctccttttttttcagcctttttccttttgcggccagctcagccattcatttataaagatccttttaaaatatgtcatctaatattttaaataattttgtattaggaaggtttttcagtatgtatactgcttgccattggccttatttttggaaattatactataatttaaggaaatataaatgaaattgttgggatactatttatttatttttatttatttatttgagacggagtcttgctctgtctcccccaggctggagtgcagtggtgcgatcttggctcactgcagcctctgcctcccctgttcaagcaagtctcctgtctcagcctcccgagtagctgggactaaggctaccacaccaggctaattttgtatttattttttaatagcgactgagtttccccatgttgccagggtggtcttgaactcctgacctcaggtgatccacctgcctcagtctcccaaagtgttgggattacaggtgtgagccaccaggcctggcctgttgggatacttttaaaaaatcctttgtgctttaattataatcatttctgtttttgaaccagtttgtggttcagcagcacggggaaggaagttgttgatgttattagatgcattgccccgttgtcacaaaaattctaaatgccaggtagtatttttaagtattttacatgtatcatctcatttaattcctcagacaaccctttgaaataggtactgctttctccattttacaaagatgaagacattgagatcagctaacttgtttcatgagtctttctgaaattatttatttatttatttatatttgtttatttgttttaatttaagagatagggtcttcctctgtagcccaggcaggaatccagtggtacaattgtagcgcactgcagccttgaactcctggactcaaacagtcctttttagcctctcaagtagctaggactacaggcctgccccaccatgctcaactaagttttaagttttttgtagagaatgagagtctcactatgttgcccaggctggtctcgaactcctggtctcaaacaatcctctcacattggcctcccaaagcggtgggattacaggtgtgagccactgtgcttggcctttcatgattctcataactagtaagtgacaaggctttgattctgactcaggtctctacagtcttgggtcagaatcacagccttgtcacttactagttatgagatgacttctacagtctgattgcattattgctgtacaatactacacatacactttggaagcagaacttctgcttcagtgttgtgatttgggcatgatgcatataataaagttttgccaacctcttctgctagattatcttaactgtaaatgttcttttaattgtccagaaggtaattcagactataataaggaaatgattctgtataaattgaatcagcaaagtatcattcttctatgaaaaatatgtaacaggttattaaagactgtaagatactgatttactcagcggcaagactttcctaattaacttacatatgctggttactttgctatagggatcaaagcatgacttgggttcgttttctaccatttatagggtcatattctagtggaggagataaatgacatacttacaaaagatgtgagtattcatttggaagtgaaatgggagagattcccttgcccccctcgcagggcatgtgatgggggtgtggctcgcttcttcagtgccccactgctcaaacctctaggggagcatacagactggcaggctgtggggctcccaccccacggcaatgtctgtctaggggtgaatgttacagctgaatccccagtgggcatgtgttagagggtgctcttttagtttgctgtctgtaggcggcttgtgttcaccagctcagttagaccctataccttgtcgcaaggacagagggtttcctgtatcccgggttcttgccttggtgtactggaagaatcggatcacatgtgggcttggagaattagtgtaaagttttattgagtggaaagtagctttcagcctatggggtagccagagggagatggctgcttggcagccccagctctcctccgactgcgctggccaaactctgcctagtcccactggtcagtggcctgccggtgtgccagcgtttgtgggtgtgctcttccgcctgcatgctcccctcaacatcctctcgatgtccagccacttgtcttcttccaccgatgtgttcctctcgccatctagcagtttctgtctctgccttgctagggtcttgggtttttataggcccaggttgggggcgtggcaggtaggcagaagtgcctgtcttcacttaggtctgagggggtagagccctagccagggaccacaccctcctctacccagcacttcccttctcccattctgtatcatttaaagggaccacactcttcccttcccagcagtcccgtatcagaagcatgtattagaaactataactcactctgggtttttgggaatatgtcaaataatacttctggaaggaagaggtgaatgttgctttttaaaggatagacaggaatttgcccgattaaggagtgagttgagggaaagatggcaatggcttttttaaggcagaggaagcaaacatggttaaaatcatagaaatgtataaggttgtattttattcacagatctgcatgttatttgtcctgactgaagtggtggttatgagattgggaacatttcagcaagagtcataaaatgaaggcccttataaatcaagctagattgtggggacttttcagaggagtttaaaatagaaagtgcatgttttgcacttcatgtttgagttttcgaaagctcactggcagtggtttggagggcagattgaaagaggaggaaatggagagagagcctacagtttgggagacaagttagaaaactgttgaaataggccaagtatgtaaagttgaggtcctaactaacctggagaaacatagtaggaatggagaaggggtggattcaaaggcttttagattgtaaaatgaactctgtgaatagaaggaacatggtttattggtggagaagaggtgagagaggaaaagtaggactactgtttggcttggtcaactggtaagattgttaccactatctaaaatctgcagtaccattagactttcttgttcagtgttaagattcatgtaatttcagatattcatggtatatgtaacagatgggggtaattataaagaaagtatttggaaattcatacctttataaccttcatttctatacccaccttccccctttttttattccccagtaggttttgttttgttttattttattttatcatattgtgtttttctttcccagatctggtagacaaaggtactcagagggttaatagcagatttttttccccaactgtgtatcactaggtttgtgaattagagtcatgatacagtaaaattaagacatttgatgtttttgtaatattttggcatggttttatttgttaatatcctagcataaaaatataatagtcttcaaagatgattactggggtatggggtgcttggtggtggctacagtcaaattcttattccaaccccaaattggcaacgttataacaacatagaatcttattatttagaacctaattactgttgttccccttacccatgagggatatgttccaagacccgcagtggatgcctgaaacttcaggtagaactgaaccttattatatacgtttttgtcaacaaaaagagtcaaactctgtaaaacattttagctgggagttgtggctcatgcctctaattccagtactttgggaggccgaggcgggtggatcacatgaagccagtctggccaacatggtgaaaccccatctctactaaaaatacaaaaattagccggccattgttatatgtaaagtttcggtgccgcaaaagaaatagcacttgaatataaaattttctttttaattctcagcaaagcaaagtacttctatagaagggtgcgcccttacagatagagcaatggtgagcgcacacttggacaagggaggggaaggggttcttacccttgacacacgtggccgccgctgctgctgtgtagttcccctattggcgagggttagaccgcacaggctaaattaattctgattggctaaagagagtgatggggtgagtggtttggcgggaaaaatggttatgacagagcaggcaatgagtcagggtggagtaggtaatcaaaatgagtcagggtagagtaggtgattgaataagggtggagcaggtaattgaaaaaggttgctttatgaggaagttaagtttaaaagtagaaggtaaagaattgaacatactgacatattgattctttgaaaagaaatttagaactcatatctaacaacccctccccttgtatttcctcacagctttcttttcaaactttttttaaacatgtcttggcttagttgtttggcttgattttccaaaagaagatgcttctctggataaggtggaggatagttaagggaggtttgagtaagtgccatttttatgagcctctgcatcaacctttggaggcatggtatgacacagcacctgacaagaataagtacacccattacggctgcgagggaagtaagaattgaggctattattcctttccatttactgaactacttttctagccatcctgtaaaggggtcatttacccctgagttgttggctaactcattggacagagcagtcagaccttgcaatgcccttgttatacttccatcagtggtggtggtgtttgggatgaaagtacaacattgagttttcatcatgacgcaaactcctcctctttctgctaatatcatgtctaaggctatcctgttttccccagccatctggctagttgcccctagttgttcagctattcctttaacagcatctctagtgtagttaataaattattgttggttgtagtagatgtggtttatccaatctacatttttattaattgtcacctaccaaaatattgacttaaatcctgcagctatttgatttcaggttttaaattgatctggtattccccgtgggactccagttgcgtctaaatagacatgagaatcgaaagacccataaggggcttctctcactgtacgatgtcttatttttccttcctctggttgatgaagtgccagggtgaaaggggttgatgaagtgccagggtgaaagggatagccagttggactaaagcataagtgccactccagttatttggcagagtgtccagtaaaggtccaccacaataccaccacacatctgctcggggatgaacaagggctgactgactgataagctcttgaaaattcttaagctcactgcatcccttcaggtctccaaggaacgccgtttcttccctgtcgtgagagacacgaagtgaacttagtgttgggagacggaagttggatggccctcgggggctgggagatggaagctggatggccctcgggggctgacccgcagggtgccggacttcgggatatagcagagagagcttggcatgacttactactccaggctgtagaatcctggaaaagagctaccatgcagcccacaccaggtcaactggaggaccaccttagtggaaaggggacaatctgggcctctggcctgctatgcgcacaagcatagcaattgcttttgttcaacctgtggacggaatatttgatccattccaaccaggcatttgcatcttgatatcctgtcttaattgccaaagtttgttttaagtctttaacttttactatagctatcttggtcttgtcgttagatggaggaggagcaattgttctgttgtgagaggttttggaaggaggcttagaggaaggtgcaggcagtaggggatcaaagaaactcattttaaagaatttaatagggtttgctgaaacctcagcccccataccataaaaccggcttaaagaagggaactggcttagaaaaggggaagaactttgagcgtttgagataataacctgtatagaattacactggtttagctgacagtggggagggctgtccttctagtaaaatgtatggttttaggaaattacaaaaaccggttggggcagtccattcttgttctttagtgctccacagaatgttggactaactacagcataaaagctctgcattggggagcaagactcctggttgacaccggggtctttatcgaaatctttctggattaagtggtcccaatttactaaggcccagtctgaggagagtcaggagggacagaggtacttttctgaagtagagagctgtctttgacttggcaagcacccacgggtataacaaggcaagcatcaaatgcaatagtttgaggcaaaattgacttggttatgttataactagatggtcagcaatagaacggggaaagaagaaagtaatagaatagatgaaagagagttaaatttttcttaactttagtttgatagtgttttcccctgagactatggcccacgactcttgagggagcggtgctttcttgcctcgggtgtgatgagtctatcccccttccgctgtaggaacagcagtctccgtagttagcagcacaaggtagggtccttcccaggcttgcttgagttttccttctttccaccctttgatgagaacgtgatcctcaggctggtgctggtttaccggaaattctaggggtggtgcctgtgctaaaagacttttagttttgaaggaaaggaaagtggaagataaaccaagtatataaattctaagaaactgatcttttgttttaaatgtggggacatcagcagtggtctttatagcccttggtgccttcttactgagaaatttcccttagcacctatttttgttagtttttagaccgaagaaagccaaacaccgttttatatttgacagtgcttcctgtatgatttttatactagataagctaaatttcacctttatattagtgtgttattaatgttaaactcagttttaataaaaccttgtagacatatttatccaattttaatgtctgaccataaggtaaaatttttatagactctgtttaaccttttataatttttgttaaagagcaggttagtgctttaagaaaaaccttttgtgcttttattttaatgtccagttcacagaaagactggatgatacctctttaactttagccagtatgtttacacacagaatttcctttacaattaacattttaaaaattgctcaaacctttaaaacaaaatatatttctttaaccttttaatgtaggtaaaaatgcacattcttatgcctccttttaatccttttaccaaaggtatattttactttccttacaaaccttgcacataaactgtttcttcaatagttttacattcaggaggcctaattacttttaaattatataacatttcttgcataaattcccttttataacattttttttcacgactttcacagacaattctttgacatacctcaactttctgacttgttgcaaacatccctttctttaaacaaccagttaatttattttaggacaagaatttaccatataacattctttttatataaattcttcccctccccgccccccccccccttttcattcttctccaaagtgaacttcctttatgtctgtggactagactgcctaaggccacaagattagaagttaggataatacatgttacactgttaatttttagcaaactttacttttgttgaaaaccttgtaagtttgggatttcagttatcctttgctattaataagaccttgtttagtccaaattaacttagaattggtatagatggttccttcctggttctgtaagtactttaaggcttggctgagtgcaaacagctcccatatttgagcagactaattattaggcaattttcctaattctgcttgtacaagagttgccctatcaattactgaatacccattgtgtctttttccgtcaatcacccaggaggagggaggaactgtctatcgtcctgtcctgaagggagttcctcctaggtctggtcggacctttgtacagtaattaagatttagatcctgttaggaaacctgctgggttaagggaatttttagtggttaatgttgaattatccttcttttttttttttttttttttttaacagaatagcctcatactttcttgtgttagcaaaacagttgtcgctacagattgaatgtattagggccatctgcgggttactgggttaaggatttttgataggaaggctacgagttgtcagtggcctcagtgcttttgggctatgcccttgtttacactgacaaggtggtattggagtgttacagtgtcacggagaagaccttcaattatcaattataggttttaaatttaccctggcttttaaaggaatagggtacactgttttttcctttactacttatctctctctctctctttctttctctctttgactgtctctctctttgactccctctttgtctctgtctcttcctctctctgtctctctttgactccctctttgtctctctgtctcttcctctctctctctgcctttttttcctctctcccctgccttctcctctctctcccctctctctctcttctcccccttctcccccttccaccccctcttccacccccgcttctctctctctctttcctttctgctggtttttccctgcctctgccagacgcttatgctgctgttctcccctctctttccccttttaccccggagagggactcaagataaaagagacagagcccctgacctccctattcttcgttgaaagtcatgagcggaagggcttcttttgtcctttcttagttcaggacatcctctcttgaagtggcctgttcttcgacatcaatagcacctatcttgtccttcctccttagttctgggattctttaaccctgctccaccatactctttagggggcctggtagatgaggaccttggtcctccagatggagactggggtcctttaaaagagggtttggaccctttatagtttctagctccctggaaactgtctagaagtacctgggtttggagccatctgttggaaggtagaaaacgtaagttttgtcttttgtttctgtttttcttcatcccttttcacatatactttctgagcttccctgagaagctcacttaggggacggtcttctcaactgtctatgttttgtaacttttttgaaatgtctggccaacttttagtgacaaattggagtttcaacattcctagcccaaggggatcatccaaattgaggcctgcatattgcctcatttgctccctcagtctgtctaggaatctcataggcccttcatccttttcctgttgtatgtcaaatgctttagaaagatttcgggttcggggtactgactcccgaattccttttattattgtctctcttagatcctgcatattttcctgttgatctgctttgttattgtcccaccaggggtctcaggcggggaatttctggtccgcggtaggaacgttttcaccaggaggatgctcacattcccaaactaccatagcagccctacaaatcatactcctttcttctcctgaaaagaggatgcccaagatggacattaactcgacccaagtgtataactgaggtcctaagaattgggcaatttggtctgccactccataagggttatctagtagtggtttaagctcctttttaaaattctagactttggttaagggagcatttacaaagccagtggcccccccctccttatggtacctctttcaaagggaagagggttgggcctcttaggtatggagggaaatgggaaattctgaatatcttttttacattgttctacctcacgctggagtccttttagagaggggtctttaggttgggagggaatgggctggtgggacggtaattcccaagagtcagagttataaggaggagggataacgtgagtggaggtggaatttggaatgggatctgaggaggcagtggctgtctgaggggaaagattggggacactgagtgggggaagatagtctaggggatcccatgcgctggagtctttaggcatgagagctggctcctctgacttttcattttgaggtgccagattgggttcttccctatttgtttttaagggaaaaaggagggcaggtccatgcctccaacagagggcatagcctagttcttctgagacactcgacttttatcattaacatgtcggattagaagctgacacattacatcctcattcgatctaaactttggccagaagattgagggtttgaggatgggtctttgagtctaaattaaacagcaatattttatcatttgttgctttttcctatgtttagtcctttcgttatccttccagtgttttagcttgagacctagggggctatctggggggatatctttgttaccatctttatccctcttgctccctgtcttgcttgggttatttcccatcttgatggttttggggtaagtttcaaggttcaatttcccttactgaaaatttgtcaccttttgtggggaggctcaatttcccccactggaaatttctcaccttttctactactggaggttcgtgtgaagttcagtcccctccaatgggcatgtctcacctctttttaacctgtaagccaccccaaccaaggagtacttcacctcacccccccacccccccaccccccccaccccccaccacccaccacccaccacccaccacccaccacccggctttcttaccttggtccctaccaccaaggaaatactttaccggctcctgtggcttctccttccttggtctgtgtacagtcatcagtgtggtatgtgagaatcctttaagctaggttactggccagtcccccccagccctgcgcccccccccgccgccatgttgccaagagcttgggttattcctcgcactgggtgagttctgatttctcacccctgaggtgaccacaaggggcagggcatgcctcctcatgagggagaaccagagactgtcgggaggggaatgtaatcatgggtgagcccccaaattgttatacataaagtttcagtgctgcaaaagaaatagcactcgaatataaaattttctttttaattctcagcaagacaagatacttctatagaagggtgtgccttctatagaagcaatggtgagcgcacacttggacaagggaggggagggggttcttatccctgacacacgtagcccctactgctgtgtcattcccctcttggctagggttagaccgcccaggctaaactaattccaattggctgatttaaagagagtgacggggtgagtggtttggtgggaaaaatggttatgacagagcaggtaatgagtcagggtgcaatcagtaatcagaatgagtcagggtggagcaggtaatcgaaaaaggttgctttgtgaggaagtttaaaagtagaaggtaaaggattgaacatactgacatattgattctttgaaaagaaatttagaactcatatctaacagcatggtggcacacacctgtggtcccagctacttgggaggctgagtcaggagaattgcttgaaccccggaggtggaggttacagtgagccgagatcacaccattgcactccagcctggggacaaagcaagactctatctcaaaaaaaaaaagatcctgagcatttcttcaaaggattgtaacaggaggtgaaacttggctttaccagtatgatcttaatgacaaagcacaatcaaagcaatggctaccaagaggtagaaattgatccagtcatagtgaaagtggaccggtcaagagcacagatcaagacaacagttttttgggattctcaaggcattttgcttgttgactttccggagagccaaagaatgacaataacctctgcttattacgagtatgttttaagaacgccaaagctttagcagaaaaatgcccagaaaagcctcaccatggcagtgcctctactcagtcctctcatcaaacaagggcaatgttttgagagttttcatgggaaatgatacagtcttgatttggctccttccagcttctttttatttcctattttaaaaaatctttaaagtaaaatctttaaagggcacccacttttttcttcagtaaataatgtaaaaaagactgcattgacatggctacatcccccaggacccctcagttgtttagggctggactaaatggctggtgtcattgcttacaaacgtgtcttgaacttgatggagcttatgttgagaaataatgtttatatttttatcttttaattctgtttttttccatgaactttttgaagtccccttgtactgggtgattggattagtaaatctttgggcatctactctatggaagtgcgccctgtgctaggtgataacaaggaatacaggcagtgatcactcctgcctttatggcatttttatttgatcggatggagtttagtcaacacacaagtaacaaatatatggtgtaatagttaagagtgagctctggagactgacctagtttcagttcctatgtctgctagttagtacctgtttccttgagtaaattgcttattctctgatgcagtttcttcattctataaatgaagccctctaccaccacataaggttttttagaaccttttgaaagagttgatgttagatattgcataaaactaagtttttactgttacataataatgtcagatgatagagacgttgcagtaagaccaaatttagaggttggaaaaatcacctctagtttgaggtgggacaagaagcaaagctttcatggggaaggtggcatttaaatggatcttgaatgattaatagaatttatagggtggtggggattgaataagatttcctagagggagaagaatgaagttgggagaatgtacagtgtgtcctgaaatcagaaatgcccgtctctactaaaaatacaaaaaattagctgggcgtggtggcgggcgcctgtagtcccagctgttcaggaggctgaggcaggagaatggcgtgaacccgggaggtggagcttgcagtgagccgagatcgcaccactgcactccagcctgggcgacagagcgaaactccatctcaaagaaaataaaaaataaaaaaaataaaaataaactcatatttctatagtacgctcactccaccctgtccaggcagttgcctaaatagatgttaagatgttgctccctttcctttcacaaccaccctcacccccacacccccattgtctttcaaatcttgactttttaggtagaacactaaatgactctggattaactattaccacttttaccacattctgaatatccatgcctcctctcccccaccctctagattgcatacttcttgagagcaggggaagtatattttattcagattggtttgtttaacccttgagaattgtccctggcaccaagtaaatgctcagattatttcaggggatgggatagtagatgaatgatcctgattaaaaacagtttcaactaaatttaaaattaaaaaaaatttaaacaggaaatttaaaaatggatgttgtctgagacctttgtgactcctggaatttgtgaatacttctgtaatataatttcctcattcggaaaattgggggtaatgaggacttaataaaatgaaattaccatatttttacatttgacaatgtatttaagaaacttagtgtttctagaaagatacttagaattcaaaggaaatgcacaatataattttaggacaaactttagcatttttaaaaagcaagaaaagtcactcagcttgttactggaaaggggtcctgatccaaaccccaggttggatctcacgcaagaaagaattcgaggataatccagagtaaagtgaaagcaagtttattaagaaagtaaaggaatatctgctcatctgacaatacttacagttatttcttgattatatgctaaacaaggggtgaattattcattagttttccaggaaagcagtgggcaattcccagaactgagggttcctcacctttttagaccttacagagttctgacgttgtgatagtgctgctaggagtgtcttttagcatactaatgcattataattagtgtataatgagcagtgaggacgaccagaggtcacttttgttgccatcttggttttggtggcttttggctggcttctttactgcaacctgtttttatcagcaaggtctttgtgacctgtatcttgtgccaacctccagtctcatcctgtgactaagaatgcctaacctcctgggaatgcagctcagtaggtcacagtcttacgttacccagcccctattcaagatggagttcttctggttcaaatgcctctgacaagctgtttacattttgggctttaaacatcattggttctttttctcaactaatgaattacagaagttgtagtataattaccctagttccttcatacttagggcaagatgactctgagaaatgttccatactgtctcccagagatctccagcaggcttgagtcccagttgcctagagtcataatcagctccataatgcatcctttattggcatactttcctttcctgactcacttctttacttcattaaaggtatttcctcagatacttctcaaataaactacttgtacaaaaacctttatctcacagtctttcttgggagatgcaacgcaggcagcatgacaagcattgtaataatagttaaaattttgaagttttagaaatcagagacatttgtaatttgaagcttataatttcgaagaagaaatttgttcacacagatcagtatgaaagctttaccttcttttttaatagggaagatttactaaaatagatttgcttggttattgataaaacatatactgggtactcaaacatttgctgtttttgaaaataaggagtaggatctgggcatggtgtcacatgcctttagtcccagctacttgggagactgaggtgggaggattgcttgagcccaggagtttgaggctgcagtgagctgtgatcgcgttggggtgacagagcgagaccttgtctctttaaaaaaaaaagaaaaaaaatcatggagttatataaatataaattatataaatagctggatcctattaggagtccagaggtcaaagttagtcaggataagtgttgacacatgtcttgtttcatactgcaaaaggagtcaatgatatttaaagcacaagatgttaatgcctaggtgatgattggcatgatgctatttttcttaaatactaaaatttgttttaggtttatactgtgcatttcctttgaattctaactaccttcctggcagtactaaatataaaattaaatccaattcaagaaacaaaaagaaccagaggaagaatgtagatacaagcaagagagaataggataacataggctgagcattctcttattcctgaagaatagatttttaattttagatttgaccatagaatttctgctagtaaatatttttatttcagggctggaatacctctctaagttgattggaatctgtgccatctgatcactgttattttggtgttttaaaaatatattgtaatgcatgatagaattttaggacttaaaacatcttggataccgtattttacaataataacatcatatatgttagatacaagtatttttcctaaaaatctttttcccttcctttacagaatgctgcctttttatatggtcttggtttggtctacttccattataatgcatttcagtggtaagttgacataaaaccagtaattcagtcattttcagtaaatggcttgtttgcttgttttgtttgtgcttgattttttgtgtgtgtgtgtaataaatagaaaatttagtgtcattaaacctacacttttcagtaatcttttgaaatgattagattgttccttgaagggtgttggctcaccttagatttttagagttgtatgttttcctgaaagaatctagtataagattctgttgaagaaggcttagattagaaagctttttggaatttcttagtcattcattatggactggtgttccccaagttatttgaactggtgaatcactgtgatctcagaagtcaagatatgtgggtaaatggtctatgatggctagttttcagacttctagacaagattgaccacttctcccttccacataccagctagcactttccaatatccagtaactaggcaccaactcataaactctcagttctctgtagaatagtaccacttcagagttggagattaaatataataatagtaatatataagattttctaaactgtaaagtgaagtaccctgtaatattatggcctttgccccattgttgtttttctgtttaccagacaatagtatgcactaatggggtaaaaaggcatatagttttagttgaaagattggtattgttgtcacagcattgccacttagtttgatcttgaattaaataacttctctaggtctgtttcctctttagtttgtttatttatttatttatttattttatttatttatttattttttgagacagggtctcactctgttgcccaggctggagtgcagtggcgagattgcagcttactgcagtctcaatctattgtgttcaagcagtccttccaccttagcctcccaagtagctgggaccacaggcacatgccaccatgcccagagagtttgtttttatttgtagagatggggcctccccctatgttgcccagtctggtcttgaactcctggcctcagggcatgctcccacctcagcctcccaaagtgctgagatttacaggcatgagcccccacgctggcatcatcatttgtttaaaaaacaaaactacatagcagtcacttgcctttcctatagagttttgatgatcaagtgagatacagtacattttataaaatgtcaacccaatgtagattttttttttttttttttttttggtcagagtctcactctgtcgcccaggctggagagcagtggcacgatcttggctcactgcaacctccgcctcccgggttcaagcgattctcctgcctcagcctcccaagtagctgggattacaggcgcccgccaccatgcctggctaatgtttttgtatttttagtagagacggagttttaccatgttggccaggctggtgtcgaactcctgacctcaagtgatccgcccacctcagcctcccaaaatgctaggattacaggtgtgagccaccacacctggtgacattttttatttttagtgtatctgaccttttcagagtcccttctgtgctccagaattttaagctcacgggtgagttctgtgggagtccaaaggaaggtgattgagtggcaaaatgttacaactctgtcatatacctattgggcaccctgaatacttattacagagcatttacatatgcattgacagtgattttatatggtttccctaaagaggaggctttatacatggatggtttttcctagtatcctttttcttccctcttagcttttggtcttgttggcttttgatcatgtgtggaagcactgctttgttagagaatacctgtgtgtatatagtgtattataatgattcagatcactggttttctttgtaaatcttaggaaggtataattgatttttatgaagaagctttgtaattttattctctattaaattatcctaaataaagcctcctaacttcatgttcagtgtattgtatttaaaaccaaagatagattaggactgttttaaaatctttcagtttctttaatagcctacttatagaattcaaattctaaacttctagaattagaagtagtcttagagataatttagtttttcccccttaattttgtagatggagaaagcaagggggtgtgtgtgtgtgttagtcagtattacataactgttgagtggcagaagcaagcttatgctcatagtctccaatcaaatattttattgtactctgtccccaggttttaagattgagaggtggttattatttaatcagtatttgtcattgttcacttgagcacattgatataatctttatggccaactagaaataatttaggtgacacctgaggggaggaactcttctgttctacctcataccagccagttttcgcatacctatggcaatttgtaagcctctctgtgtactggggttaagaacataaaattagtaatgaggtgaacctgtcaatagttcaaatgttgattgctttaataagcatgtggccatgttaagttagcaggcttgtagctgtgattccttatctacatatgatttctatatttttcagttgacctaagaaatgaaactgaatgatataaggacaatgcaatgtctacattaataagtgccccctgctctgttgatcctgttctggttaccatcattttctcatgtcttgagtttcaattcttatagctgcttcctaaaatgatacatctcacaccctatcttatgaattcactctggctgtgtttttctcttgctaatcaaatgttctttcacaaatttgcctcacatttttgctttaacttgatatttctttaacagctataaaattagaaagtatggggtaggtgcttggtgatagttttagagtacagccttaattgattggagcttatttaggttaaaactacttttgtgttttatttgtagatacttgctgattactgggatcaggaatgttttagttacatgtcaggttctttgggatctattgagaaatgtttctggggatgagtatgggttcttgttttgtattgtcagcatgaagaatctgcctatgatgtttcagagtgttgtatctctggtacatttataatttaagtaaaatttggtatttgctaattgtgtctgttggcatttgttgaggttaagcattttatgataatgtgtgtgaccaacgtgtgtctgagttggtgacttaaaatattgagagcaattttattagttatagtgttactcttaacctattgtcatcttatgctacctattttttatttcagagttgattttattggtcagcctctagatagttcaattatttggtcagtttttccagtatcagttgcagcctcttcttagacagaggagcccagtcaactgttccatcctcattggacttacggtaacagctatgctgttattttactcagtaatctgggaccaaacttaaaagatgcccagaaggataaaggaagacatagaagcagagtgtaaaatatatgcagcagagtgctagaaaccagtctctaaaaagccattgctttacatgtgcatgcatgcaagcccctgcattcacttgttcttattcattaaggtggctctttgctaggggataccttgaactgagctccttgcctttggaaggaaacctatatcctagggtgagagtaagtgaaatacaaagcaaggaaaagttagactaaaaaaagatagttgggggaaaagataaagtcagtacaatagaaatcattcttccttgtatagcttatagccatctctctaaatatatcttcctaagaatccttattaactatctctgtcctgtaacctttttccttctttccattccattgatcaatatcagaatggtcttatggcagcaaatgtaagagatactgtgctagaagcataggattttggaaattaagcccccaaatataattgacaggcttaataaggaaatgtgataattattactttgacataaaaaaggattaggagaatgaggtagaaatgaattcagaaagacagaaatattaacaaattactactaaagttttcttttttcttttctcttcttttttctttcttttcttttcttttcttttttttctgagacaggatctcagtctgtcacccaggctggagtgtagtggcacaatcacggcccactgaagtctcaacctcccggggctctagtgatccttctacctcagcctcccgaatagcttggactacaggcttgaaggcttgaaccactatgcctggctaattttttgtatttttttttgtagagatgaggtctcactgtgttgcccaggctggtcttgaacccctgggctcaagcagtcctcctgccttggccttccaaagtgctgggattatagatgtgagccacggagcctggtgtaaagtttctgtaggattcattttcatagcactgtactagtcacaagtgttcttaggggtgtaggaatttctactctcctgtatagtcactgctttgggttcagtaaagaaaaagaatagtggttttaatgatgttcttacagctttttgatggaacgaaagaataatgcaacatagacctaatgcatggtggtaccattgattctgaggcttgtctagcatggagcctggcaaacgttgtatttttgagctatcatgatacaaacatactcttacatttccattgaaattaagcagttaatgttaacatgttttgagtttattatatatacttttattttggaaaatagcagatttaaggcagttctgataaagttacacttaaacagtgatacatagattgccagataaattttggaagggctttgattaattaggcttcagggaaattgtgaataaaaacataaatcttgcaatagggtaggggaaagaaaataatcccactcctgaagtgatgaaatgaagagtggctagagaggagaaaagaaccaggacaggtgatatattagcaactgtcagtgtgaataatccagggtatgacatttctaatttagcctcacatttaaggtcatttctgattcaacctcaaatgatccttctagcctactgctcccctaaatattaatatattctttgtgccagtcacagtgtattaacatttccctgaaaacatcttaagcattttttttaacctatgtgacttttgccttcttccatctcaaccttttaaaatcttacctacctgtcccttacttcatcaaatgtttctaattatttagaaacaacttctaaatttcctaatatatatgtatatctgtgttgtgtatgtatgtgttataactaaattagagctaaaatattcttttattagtatgaaaatttgtggaattagttgatttatcccttcatatatctctgtgagaaatctcttgttcagcctgttagcctcagagaacttaaagttttattgattttattttatgtatgtatgtatgtatgtatgtatgtatgtatgtatgtatgtatttgtttatttatttatttgagacagagtctcactctgtcgccaggctggagtgcagtggcacaatcaaggctcactgcaacctctgcctcctggattcaagctattcttccgcctcagcctcctgagtagctgggactacaggcgcgtgccaccacgcccagctaatttttgtatttttagtagagatggggttttaccatgttggccaggatggtctctatttcttgacctcatgatccacccaccttggcctctcaaagtgctgggattacaggtatgagccaccatgcccagccaacttaaagttttattatgtgtctttccaaatgtactggaactgtgctaagaatattaatactattatttttactatagttttagaggaggctttaaaaatgactttgtggaagtcttattaaaaatgaccattgtgaaatatattcagcacatgtatatgttttttgtaggtagtgttattgaggttttagctttatatcattttctttttaaaatggttaacagtggcaaacattaaatgaaaaatcctttaaactgaaaatctatagaaactattttgatgatataaaaactatatttttcagattttaagaaaaatgccaatgataccatgcagagcaatgtgcatttcttttgtttcgttagagaatatgctttaagtatttgaaaactgtaaacctttccagggaattgtatcataaaagtatttatggtttctggtagctatttctcatgttctaaaattccatcagtcagaattctgaggttacagaaattgaatgtgttaatgatttagtctagtttgtgccatagagatcatgttgtggccacctgcattttggtgaaatatgaatgcagtaagctgatgaccaaaattagaatgtagtctgagtgttacctattttctctaccctcccactccctcaactcttaactctaaactcttaactccaaatccaccttcccttgtacttccttctccccctcccccagtgtttttatttcttatttatttacttgtttttcttgggatggataaacctgaagacgcacacaggagaagaacatggaaaagtttagaaaaggaaatgaacttacatgttcgaataatgtgttttgtgttagaagaactgatcagtaaagaagtcccatcaattaactgtaaatgtgatggcaccagtaaacatctattaaatttaaaccctttgctgtattattttaggatattaaacatagaagagaaatataggcctcaaggaatacacttggaaaaactggagacagcacactgataggtagtgaatgaaatgatttgatcgtaaagtagacctaactgctggtttacactaagcaaaaattgtcgttgaccagtttgggtggtgtgtcttgacgataatagtggatttagagggcagcagatgaatcaaaatattagagatcaggagaattagtaaggaaaagcagtgaagtcaggagaaccagtatttaagaattcctgagataagccagtttatagctgaggaggagcaataataggggtagaagaagaaatggagttgaataagtactgctcacccatcttaagtgcaacatggagattttatttatagtatcataattgttaggcaatcacaggagccacacgtttgagggaatatgtacaagccagagcagagcaaggaaagtccttaaggagactatttcagtaatctagtaatgagatacagaagcagaagattgggtctataaggttttcgattagagataaacttagaaagaacaacgaggagaactttgattatatatatataggttgcaccttgtcctgggcacttaatagtccctaaagagtaaacgtagacaactgctgttatttggaacatgtgttttttgcttatagattaacagtgtgtttttttaacctcagtttgttaacagacatagagaacatgttaaacccatgtttctttgcgcccgtgtgacattgtgaactaagtggaaaagatgtctgtgctaaaggcacccatggagtaaaacatatccacaaatactgtgtttagggaaaaggctagaaatagaaactgagagtaggaaatattgcacctgaggggctgttattgtactgtgttccttctccttctcttcctgacataccctttgttatacctttttcctttcctgaattctttgttatttctttattcttttccactttcattctttttctttcatatctttgactcaggcctgcctgggttttttattggcatgtgtggacattgcttagttctgacccattccattagagagttttctggtcctataaggtaaggttaagaagcattatccataattttattattataaaatataacatacctacagaaaaatgcataaatcgtcattgtatatcttaacatgttgttataaaataaacattcatgtaatcaccacctccatcaagaaataaaatactgctatcaccccagaagcttctaaaagtctttgtataccctttcccagtcacaccatatgttttaattggcagcatttattgctgcagttgtcctcgtcctaacccttttgatgccttttccaaacatgtgacttgccccaacccctaagtgtacattgattaagtaggaagctgcctttaaatgagaatggtaatttaccacagtttttgcctgtcagtgctttaactctcctctcctgcctcaaagcctatatacatcagataataacacacataccccacctacttaaaaatccacctaacagatggatacccagctccccttcagaagaaagtactgtcataatcagggtaaaggtgtctgatgccagacctgtgttccacccctcactgccatctgcaataaacactaccttttaggactcttaattttatagcaaaagtgtacataaccattcacacttttttgggaagtaaataatgtatgaattgatgaaagtaaagttactaaatacatgaagtattattttgctctattttgtggctatgatgtttcgaactattttatacaaaagattgtttttgttttgaaagcatctaagattctaaatagccactttaaggtctgtaggggtagagataattgattaaaagttttgcaaataatatattagcttgtgcttggaagaagctttaaatcatgtagaggaacctaaaatgatactgaatatactgttatatctgatataaccttcaaaattcaaagtagacatttttctttgtcattattttaatatttatttttgagtaggcaatacagtcatatgatcaaattaaacaatataataatgtattcaatgaaaagtgtttctttccccaacccctgaacttgttctattggtgatcaaaaccttttataaaagatacaatgtgaatttggggcaaagatgaactgatagacgaagaaaagcggaatggaatagagaagtagacctacacaaatatgggtatttgatttaggacacagtagcaacatagagttttggagtaaggatggtcatttctacaaatggtgcaggtactattggatatcagtttggaaaatatgaagaccgtctcttaaccgcacatagtataaaagataaggtacagatggtttgtaagcctaaatatgaaagacaaaaatgtaaacttttagaaagaagacttatttttatagagtagaccagaaacaagattaatcccatatccttaaaaactttcctgtttgccccaccctgttttcctctaggaaatttcagaaacaatgaaatcagttatttctactgataatttgattaaaccatgaaatactgtctgtttgaataatttagaataaattcaacctatcttccttcccctttatatcaaattagattatatacgtttaattatataaaaggtccatatgccccttttcaattttacttttttagtatttattaacatcatttttataaaaccaacatttcctttaaaacaatattgcataaaacagaagtttcaatgtactaccaagcaagaattcatgcacgtgttaaaaagttaagatatcttatgtctatattctttcagggcaattaaagcatttcaggaggtgctttatgttgatcccagcttttgtcgagccaaggaaattcatttacgacttgggcttatgttcaaagtgaacacagactatgagtctagtttaaaggtaggttgttgggttttttcaagatacaatgtttaattttgtggtttttttgtttttgtttttcttaaatattagagcattgagaaatgttggaatttatattggcactttaaaagaaaatttgaaaattcaggtgacagaactgtttatcaactgtgaagtagagtttcaaggtacaaagtagttatgctaagacttccatggtaacattatacaattacactttaaaaaaatagttttaactaagatctgtcatcaggaaagggtgaaggtttcagtctgtttggatatgtaaataactcctctagaaatgatttgccactgtagagttcagaaccagctgaatggttctgaaaggatgtttttctgtgacccaatcattgaccctgtttccatgggtctcagtacttctaccagcagaagcacatcttatatttaaattagaaaaaagagtgttctctgcaaggcatttggactgttggtttgtgagcataaacgttgtgggaaaagatgatatgttgttgattaacttcgtatccatggaaatgtgatatttctccagtttttaatttttcattgagttttttatgctatctgaaccatcaatttaggtcttgctgggctttttctgaaaatagtgctttcctgcccaacagaggaattatgttttgaaaggagtagcagttgtaggaaaaagtttaagtttttgtgaatttatgtttattgtttataatggttgttgtattctgaatctccattgcagactatcttgattctaaaggaagggtggttggggagataaagaatgacattcaagtagattgtaatttgagctcactaataaggaactactgaaggttaaaaataaaaaaaactgtactcaagagtgtctaattgttctagatttttaaagtagaaaactatgcaagtactgtttctaccttacatgagttaaaagaacaatactgatgatgttaaagagagagggaggtacaaccaaaaacactaaaaacagtagattgcgaagaatttagatcacacagtggttgaaggtaagtgcagtcgaggaataagttccagggtaagtgcagggtgcaggtagtgtggagaatgagggatgcctggaagttaccacttttcctcaagcttagagtagtagcatttctgacaccatactgtgggacgtcagcggatatgaactggaaaataagtttataaagctgcctcacattttttttgcagtttctattagctatcaaagactctttaaaatgtcttataatacagaataaacatttaagcatttcacatgcttattatgttgcagaagtgtttttggtagcagtttggtaaatgttgcttaggaaatacatttgaagggaaaagcaatcagatgtgtcccacattatggaatgtgactatgcgtgtatcagtacagtgataccttaagtaattctaaagatgcaaaattccatttaaatgaaagtggcgatatttaaaatctcctttaatcaagggaaacagtgtttcatggccgattgaaagtgttctacttaacttaagcttggtgggaacattcctgcataccacttttatttgttcaggtagaaagtctaaaaagtcaagtcatggtgatcttagcaaaattgccttaagtgagggcagccttcttttgggggacttttacctttaacgagtccatgatatttctcgtccctagagtgtgaaggtttcatttgatttttatctcatcctgactttggctttttcagccctctctctagtattccttatctattttaagaagaatttgggcatgaacatttttagtcaaagaggaggaggtattttagtttattactaaagtgcttagcattcagaatgagtgaaggtaggaatagaaggaatgatatccccctttaggtggttttccatttttctaatacttcaccttcatctggataaatgtggaacctctgatggcttttccacaacattaagctgttttgtagcacagtgtgttggtatagatgctttttaggctgtaacctcagggactccaactcaaattggttaaaataataaaaaatatgctcctatgtgaagtctagccttcaggattggttgattcagctgatctaaggtttcatcaaggattcattttcttctcagttctgtattggctttttctaaaggctggttgctctgcttagtgtaatgctggcatataagtgcatagtaaatgatgatgatcatttcatgtaggagaaagatcctggttgcctgttgatctcttcaaaaatacttcaccttgcatcttattggccagaaataggccacatggccattcctaattgatttcttatcaaaggaaatgtggttgctcttagactagttatgcccagtctttgagaattgttcaaatctgtaagtagttgttatccagtggagggatagggtgggtaaaaaggatattttggtatggggagtggtgtgaacagtctgtccgttacagatcagatcttctctatcccatttcctttccctctgcccaagtgtgtataatactttttggatggtaaactatttaaataaaatacagcgtattttcataatagattccttttttttcctcccaatatgaaatgaattgtagggcctcctgttgtgtttctgtcactggtgataactttctcacaaaatgtgtctctgaaattctgtgttggtgctgtgtaaacagctctcagagcaaaccaacttggttttcaaaactttgaccctgccgcatatcttcgtgaccttgagtaagatttctgactcttgattttctctgtgtctgaagaactagaataattatagccacccacatgattgatataaaggtgaatatatgtgtgtgtttgtttttatatgtgtgtagttttatatcactagttttgggggaacaggtggtgtttggttgcatggaaaagttctttagtggtgatttctgtgattttggtgcacccatcacctgagcagtgtatactgtacccaatgtgtagtcttttatcccgcacccccttgcctctcttccccgagtccccaaagtccattatctcattcttatacctttgcatcctcatagtttagctcccacttctaagtgagaacatgtgatgtttggttttccattcctgagttacttcacttagaataatggtctccaactccattcaggttgctgcaaatgccattctttccttcctttttggctaagtagtattccatgatgtatataccacattttctttatccactcattggttgatgggtattcaggctggttccatatttttgcaattgcaaattgtgctgctataaacatgtgtgtgcaagtgtcttctttatataatgacttcttttcctctggatagatatccagtagtgggattgctgggtcaaatggtagttctgcttttagttctttaaggaaccgccacactgttttccatagtggctgtactagtttacattcccaccagcagtgtaaaagtgttcccttttcaccacatccatgccaacatctgttattttttgatttttaaatcatggccattcttgcaggagtaaggtggtatcgcattgtggatttgatttgcatttccctgatcattagggctgttgagcattttttccctatgttcgttggccatttgtatatcttcttttgagaattttcaattcatgtcctttgcccactttttgatgggattatttgtttttttttcttgctgatttgtttgagttccttgtagattctggatattagtcctttgttggatgcctagtttgcgaacattttctcccactctattggttatctgattactctgctgattatttattttgctgtgcagaagctctttggtttaattaggtcccatctacttatctttgtttttgttgcatttgcttttggattcttggtcatgaactctttgcctaatgtctagaagagtttttctgatgttatcttctagaatttatatcttacaaataaatagtttcagcccttctttagtctcagttatctatcatgtaaaacaaccataattgggggccagcatagatactgttggagaaataaatgttcctgtcttagaacttaatccttgtatttttgtccctctgcccatcctcagaaatgtgaagctaatgctcagcaaactttatgatcctatggtgttatttttacattaaattgaccaataaagattgtatgtgtttagtgagcagtggagataccaattcttaattcgtgaactagtttaatattatctgaaccagagtccatttcagggtgacaggtattttgttgtttttcttctctgcttcagctaatatcccctaaggtgggtttggttgcctagttaatgccatacagttaattcaggatttttttttttttgagacggagtctcactctgttgcccaggctggaatactgtggtgtgaactcggctcactgcaacctccgcctcccagtttcgaacaattctcctgtctcagcctcccgagtagctgggactaccggcatgtgccaccacacctggctaatttttgtatttttagtagagacggggtttcaccatattggtcaggctggtctcgaacttctgacctcaggtgatccacctgcctcagcctcccaaagtgctggaattacaggtgcaagccaccatgcccagcctaattcaggacttttatttcattatcctttaatgatattaatgacagttacttattttcagtatatatttgaagcagtgtgctaccattactttaataaaaggatattactgttgacagatagttttatataatgtccctaattttcacatcctggcagactattaaaattatttccttcatgtgaagaataagatacaatgacacccttattcttcagtcagttaatgcctgtgcatctatttagaggaagcttatataggaattttccctaatgtttacatatttaaatattcctaaactatgtcaacttagaactcttttgggattttaaagttaggtaaccaaaaagggtgccttttttatggaaacctgtagatcattggctgagatgccaatttaagtccccttttataatttggtatttgaatatgataagtgctgattgaaggggttaatgtgaaagggataggaagatgagaattatggagacagtaaatgtttcaaaggaaatggattgaactcaaatgagacttgtgtgttagcttgccattttactgggtgttggtgtttcttgaatgggtagataaataaaatggaagaggctataaaatgagaaaatgcctacttatagaacaggctggaaaatttgaagaaaagaaaaaaagctggttttattcatcatcacttaacagaatttttttctatacaaactgacactgcagttgttttttccagatggctcagttcaccaattcatgcagtatgcttgccatcttattatactcgacatgaaacttctgagtgaagtggcagctccactgtctttgtaccatactcttctttaggaactacttcattacgaggtgtctcatttgatcttctaccctgtataaactcaggaattttattgtaatatttttgatgccaagatatttaggcagaaggaatacatgaagacatgatcatgtatgtgtacctccttttagaaaccgcttttgaaatctgaaatgcctcctgtcttttattattttattcatgtagaatgcacagatcatttgtttcatataattaaaatattgtgggccgggcgcagtggctcacgcctgtaatcccagcactttgggaggccaagcgggtgggtcccctgaggtcaggagttcgtgaacagcctggccaatatggagaaatcccgtctctactaaaaaaaaaaaaaaaaaatttagctgggcatggtggcgcgcctgtagtcccagctactccggaggctgagacaggagaactgcttgaacctgggaggtggagattgcagtgagctgagatcgcaccattgcactccagcctgggcaacaatagcgaaactccatctcaaaaaaaaaaaaaaaaaagatactgtgaactttctgtattttagaaataacttgctgagtttgaatgctagctattaaattaattttatccatgccttatgtttctagaatatttgtaatgtttctttattgacattttaatagtatatttttgttagttcagtagtctgaagataatgaaagtttagggctgggcaccatggctcatgcctgtaaacccagcacccagcactttcggaggctgaggcgggtggatcacctgaggtcagaagtttgagagcatcttgggcaacatagtgagagagagacacacacacacacacgtttgttagttcagtagtctgaagataatgaaagtttagggctgggctcagtagcttatgcctgtaatcccagcactttgggaagctgaggcaggtggatcacctgaagttagaagtttgagagcaacctgggcaacatagtgagacacacatacacacacacacacgcaacatagtgtgaaacacacacacacacacacacacacacacacacccgcccgtctcttaaagaaaaagttattatttctccatacttgctctgccctatttcctttatgatgctcaatagctctcacctctttcagctggcattttgaaaattttaatcttgagtggtttgatttgagagaaagaatggaggaaggcatctcactcatatgactcaattttcttaggggattagaaaagtcctatccccttgccacccccaacagcttggaataattggtggtagttataaaactataagatttggtgtttatcctgagatttggcttagaacatgggaccgggaagggaaagaaattcttcaagaaaggatctacagagtattggcatatcatggaagctgcatttgtagaatcttcataggaattggttgggatgtaaaaatggtgaggcctaatcgttgttttttggtacttttttttttttttgagacggagtttcactcttgttgcccaggctagagtgcaatggcgcgatctcggctcactgcaacctctgcctgccaggttcaggtgattctcctgtctcagcctcccgagtagctgggattacaggtgcatgccaccacgcccggctaatttttgtatttttagtagagatggggtttcatcgtatggtcaggctgctctcaaactcctgatcttaggcgatccgcctgccttggcctcccaaagtgctggttggtccctcaaagtgctgggattacaggcgtgagccaccacgcccggcctgtactttttatttaatggatttcctcctggagtaacagcaacaccacacagcaacagcaaactaagtttggggccagaaccacaaattaacatcatttttcattgctaccatgtttaacatttaaaatgcttcactgaggcagttcttaatacatactatttttggataaaccaccaggcagataccaaaaaatattagcacactattctggtcatcttaagaaaagaagaacattcttttttagtattagttacactgtgtatttcttcctttggtataactgttggttctttatacataaaattcatatagtcagattttgcttggctttttatggttagcagtagattggattatgattgaggaaactgcaacccagtttattttctttgatttaaatcttccttttcctttcagtcattgacagtagaactcagtttcacctgagtgtaacatcactgttccttttggcagaggatggtcattgctgtttattttgttttctactttttctcacttgtagaaaataatcatcctttctctgttcttttctctttgtactactcgtcagcttgtactttaccaatttcctagataatagtttctgatacgaggcaacctcctaattaatttatctggccacttaataatgctttctctatttcactctgcctgcccaactttggttttctgtttgatattatttctgccctgagttctataacgtgccttcaagtgtgaattagtaaaagtggccgaaatacttcaatacctgcaaaatgcatgtttgaaaagtacatggctgctcatatatgtgcagtaacaccattctttctctttgaaactgaggagttagggtgattctaggttccctgtgttacagtttctctcttctagtatattttaactacagaagtcatttctaaagtgatttctggtgctaacttacaacaacttaagggcgttatagatatttggtcttcaaaggcagctttataaagcagtcactgtattgtcacatttagaaaaaggttgtgtggctgggcgcagtggctcacacctgtaatcccagcactttgggaggctgaggcgggtggattgcctgaggtcaggagtttgagagttgcttggccaacatgatgaaaccctatccctactaaaaatacaaaaaataagccggcatggtggcaggtgtctgtaatcccagctactcgggaggctgaggcaggagaatcgcttgacctgggaggcggaggttgaagtgagcagagatcaagccattgccctcagcctgggcaacaagagcgaaaccccatctaataaataaatacatacatacatacaaaatttagtcgagggtgctggtgtgtgccagtaatcccagctactccagaggcggaggcccaagaatcgcttgaactggggaggtggaggttgcagtgagccgagattgcaccactgcactccagcctgggtgacagagtgagattgtctcaaaaaaaaaaaaaaagttatattttaaaaggatattctacagtgcaaatttttgcagtatccccctttataaaacatcatattcaccttgtattagttatttgtgtacatatcagtctcaaatatgaatacaaattgctcactagatagaaataccttggaaattaagttggctcatattctgatcattttgtgtacataggttagatgcaaactaggaccagtttttaaaaatttctagtcagttgcatacctatacttttgtaaagtatgatagaaatgaagagttggaagactaggtaggatacagctacaggaagaaagatgagcaagagctgtaagataaatggttgctcataggatggatgggggcaaggtaatgaatgtatcctagagatcttaaagagatttattaactgacttgatgtgggaagagattcccatttacgggctcagaccactttactatgttaaataaagtaggggataaagaaagtagcagccggttttgggtttaggaggtgaaaaggctctgaatggcgataagtcatttgggagtaaattgatttggaggtacctgagggatatcagatattcatgcacacagacataaatctggagccaaaaagaagagctagaactaagattttgaacatcttcagtatacagtgcgttttgtcccccaccccccaccccttttttttgttaaagaaatttttagaaaagaccggctggtaaacttcaaaaaagaagcctcttttttgagcgaagattgtcaggatttgttagctattagcatgtcattggtatgcagtagattccctcctggaaacagttgtaataaccttgtattacaaagagtatcagaactgagttttgagggctttgggagaacctcagtcagatcatcttgaccaggaacgtggctcacaagccctaccaaaacttagccgttttcagttctgtatcttattttagagaccacatttttaaagtaagtaccatggcatcctagggcatttccctattcttacccatagactattcattttaggaatcaagtttgttggttttaatttatacttttattttattttttaatattaattttatttttttgagacaaaatctcactctgtcgcccatgctggagtgcagtggtgcgatcttgggtcactgcaaccttcgcttcctgggttcaagcgattctcatgcctcagccacctgaggcatgtgccaccataccctgctaatttttgtatttttagaggagactgggttttgccatgttggcctggcttgtctcaaacttttggcctcaagtgatctgcccgccttggcctcccgaagtgctgagattataggtgtgagccaccatgccctgccctaaattcataattttagaaatgtggcagtctgtaacaatgaataagaaaaaaatgatttatctttgacatgcaacagtacctggcacacctttccttttctcacttaaatggtcattataaccctgttttataaggctctgtaaaaataacttcagtggtttcctcagcctgaagtaactcttttcttactttcctcatctatatctttttggattctgttatggagttgtctttcctgtgtattctcagagcaggttaaaattttaaaaatcctattaaggcattaatttcagtgaacattgtattctgtagatgtatagccatagaagcgtgcctggcatagataaaagctggttgccagcatgtcagtcctaaaatgccatgtttctaccttaattggatatagacagcagtatcaactatacataccttgtttatatagtctgaaataaaggtttctggggcaagcacataatttaaaaacttcaaaatagaatagtgtggtttaactctgtatattagaatagcttgcataagttttttttctggtttgcaggttgttgcctacaacccactgaatcagaacattctagattggtactggaatctaaacattgctccaaattaataacttataaccaaatacataatttgtcaattgcaaaaagttatcccattgcttgttttcgggattgggaatatagttgaagggttctacaagtaaaaagattcatgaggtaatcagactatatacagctagaaataaaacaatttaaagggaaataaagtcttgaaactcaagttttatgtgttaattacatgaatatagatttctcccccctccccatagaaatcaagttccattggctgtattaggcaaaatactataacattattttgaaatattgaacacgttgaaggcttttaaaacaaaaggtgactttggtgataaagatgtcaacagaaatagtaatgaatcaaactttgcgttaaattgggccagaagtgctccataaaaagaaaatctctataacattaaaaaaaaaaagtcataagtaaatcttcttgcttggaaactaattttctgtagactgctttccgccttcaggtttgtatatagtctttgaactgcagaggcctcttctgcataataattatttcacacagcagtagccagtttcagcactgcagtatttcagtgtgaggcacagatgtttcctagctgcctctgttggttgcagggaaaggtgctggatattttaccatggtattttcaggtttgtgggctggttatcataattgatagtcctttctactggtgtatatgttaataggtatatctattttgcatctggtttaggtcctggaaatgaggctttgtggtcatgttatccctaccccggttcttcatctctcttgagagtgctgaacggcatatcagtgtttttctttatgtggaacggtgttgttagtttcttataaacacttagtaattattctgtaagttctttcattgtcatagtggatgtttttgaatgtgtattcgtgttttttttgtttttgttttttgaaacgcattctcattttttctgccacaggcacccgccaccatgccggctaatttttgtatttttagtagagatggggtttcatgatgttggccaggctggtctcgaactcctaaccttaggtgatctgcccgcctcggcctcccaaagtactgggattataggcgtgagctactgtacccaaccaatgtgtattcttttgctgagtaattttcctatgtcttcactgtttggaaatgtttggtatttcatagtgttgtgggtttgaaatggtgcatcagtaacttgattgctgcgtttaagattgttttataattacacaaaacatggtcaagaaatactcctgccaggtttcactgcagaatcttaaattactgatagatgaaatgtaggctaggctgtttgaattctacatctctattcttccttgtggggtttcagtgaaatagtaaaactaaaatattgccatattgaaggccgtttcttctcatttcagtttgtaccctttgatggctcagttaggaatggtggtctgtgttcttctatctaaatatttatgcttacaggacaaattagacttagaaatatagtacagtctgaatgtgtgactactcttgtgctctttttgtctagaggaaagcaattgattataaagcatgctttgctttcatagtactcaaacgttttaaaatagtctgttctctattgctatggtagcacactaaagggatgtttgaagacacagtctgcttagtaggccaagggaaaataaaagcagttttcaaagtgttcaaatgttagatttttttcattcagtcaactatggcaaatgatttttcagttttattttgttgaccattgcatccctagtgtctgcattgtccttagggcattatagactcttgacccattgagaagatgtaatcagctttaagtttaagaatattacaagtgttggtcagcctaattatgcatgcacatcagagacttttattttattttattttttttgaggtggagtctctgtcgcctaggttggagtggagtggcacactcttggctcactgcaatctctgcctcccgggttcaaggaattctcccgtctcagcctccggagtagctgagactacaggctctcaccactatgaacggctaattttttatttttagtagagatggggtttcagtatattggtcaggctggtcttaaactcctgacctcaggtgatccacccacctagaactcccaaagtgctgggattacagtcgtgagccaccgcaccttgccaagagacattcttgagtgaatacattaataatagccagtgttcataccaagtgatgttttctaattttccttctttgtgacttttgggtagccaacatcaataactctttagatttttggattgtggataggaatgaatttattatggtcattttttttaatgctttccactttaattacttttaatgctaaaaatttgtggaggctcagaaaatttgaatatatatttgtaggaatattatttagaagagtttaaagagatttactcatcttttttaacttagattttataccaactctattacttatcttaatttatataccttgtttaatgttgataaactagatattaaatgtcacccagtgttcttgatgataatatgcgctcctaaaaattagtgttatgcattgatgttaacgtgcttatatgatattattacaagtggattctgtattagtggtttattgttgactggaaaattatacaaattctatgcatataatgtcacattgtaaaaggacagttatatttggtagatgaacttggacacaggctattttaaaaggcacttaagtacagtgattattgaaagatcaataaagacagaaagttttaccctctatgacaatactcatagtgattttttttgtttcagaagtccatgtctcattttgagataagcagtggtgttctgacaataccattagacttctacttggattttcaaaaataatgatatgttctctaaatatttaaactgttgtataacacttcctgtttacttgacttaaaaatcttcacctttttcacataaataaaaatatacataggataacttgataaaattaattctttttcaaattctccattctcagctgtctcaagaaaataacccccacagcatgtcagttgtcagcagtaaatgttcaaagtatttctagttggtaggctagtgtattttatttgcatagcatgtatttattattattttagaccttacatacctgaaaagtatcttaagatgcttttgtgtgactctaaattgactgcattaattttctcactctcgtcttgcagcattttcagttagctttggttgactgtaatccctgcactttgtccaatgctgaaagtaagtattattaagtactgtagttttctacatgtattccgatcacttcatggcaaataacaataatgttagtgataaattctgtgcaattttttcttttagaattgtttaatgtaactgtattggttgccatggctacttacataaatggaacctgcaagaccagatattgtgaacagcctgtgtctaaaatagataggccagtgaagtgagttgttgaattaaaagtatcttcactaataaacaagattgatttttctctgtcgtgtattatattgtagatgacttggtaggattaaaaacaggttttgctggtcttttaggaaacatgagtatataaagattcttatctgatagcttactgattcctactgcgtgggataaaaattattggtaattatgaagacatttgtgacttttatgatagttttatatatcatttagaaagcttgagttgacatttttcaattaattagaaaggaatacatttacgaagcatgttctaacaaagtatttttttccaaacaattattttctgcttctatgtaggtgtcttttcaaaagcagattgggttgattatatgtttatcgatatgtatttaggtatatttatttaatatacactaaagtatccagtaaaaaggtttaagaatattcgttgatgctaaatttcttaaaaaccttcttacttgaaaaataaattattattattattattattttcttttttttgagatggagtctcactctgttgcccaggctggagtgcagtggcgcgattttggctcactgcaagctccgcctaccgggttgacgccattctcctgcctcagcctcccaagtagctgggactacaggtgcctgccaccatgcccagctaattttttgtatttttagtagacatggggtttcaccgtgttagccaggatggtctcgatctcctgacctcgtgatcctcccacctcggcctcccaaagttctgggattataggcgggagccaccgcgcccgtccgaaaaatgaaatttttaattggtataagaaaaatcgagcaattaatgacagtttcagtcatacaaaggattccgggttttagaaagtcagtgttttgctgtaagttacttttttgtttttgttttttgtttcattttgagatggggtctttctctgccacttaggctggagtgcagtggtgtcagagtagctcagctacagcctccaactcctgcactcaagcgatcttcctgccttagcctcctgtaaatcacttgaaagagtatagagagatattagtgaaaagtagtcttagtctttagaaatgccctaggaaattgttgaatcagcgaaaactctgtagaattttcagtataacgtggattaagaaatagtatggattaaatcatcatttaagccagatgaattatgtcatacttttactaaaggtaatttcctgtgaaaatctaaaggatttttactttcttaaatgaaattcaggatccagtactgattagggtgtttgtagaataaacggtagaataataacaaatgcagcagtattttatagtttctaatataaggttagatttgaaaaaattgactcattggtttagtaatttataaagttttaatttatacctttttcttaattatatatccaggttataaaccatctagaatatatagatgcttaaaattcttttcaaattagtttacgagaataagaaaacaaccgattatcttttaattcattatggtctagtacctaaaaggtaactttggtaagtcagttgaatgataacttttatggatgtctcataaatatcaaactaaatattttggtaaatcctcattttattctactctgtttaaatctcagttgtagatcattactcttgagagaaaaatgtctgcataggtaggatgagtgccacatggcataaaactgttgaatttgaaacagtttgaaccatcatgagtgctacaaggtggttggtcactcaaacgggagagcatattttctatttagagactttaggctattacagtttagtagatttggatagtttactttagacagtctacttgattacttgatagctataataatgcctgatgtcacaacaaatgtagagtacctactttgagccagtattactcttttcaacaccaggctccttattgtctttgtaaaacttatttttctttgaatttttacatcatcactgatttgtactttggttttaatattttttaattaaatattgattttactcttttttgacttgggattcagtttttaaatactgtgttttgaaatgtatagattataaaggttttctctctttgcttaatgttgccattttgaactttgtaaaacatatattcacttgctatagatttaatgctaattttaataattgcattgacagaaatttcatttgataatgaccaacaatgaatacatgtggtttcttatcatgattgtgttctttagtgtgtttgtttgtatattctattttagtaaaagcaaataaaagttatgtttttctattacttaaatctatatagtgtagactgtgataatgtttgatgctttgttattcttacttaatttgccccaaattctgctgtattgttactgatttttttgtctttcctcatcctttgcagttcaatttcacattgcccacttatatgaaacccaggtaagtattttaacttattctatttaaaacaaaagcaaacaaaaatcattactcctatcatgctttactgaaatcagaagtgtacagataatttaatggagttctgggcgttacttcttaggtaaattttgtattttatactcattaaatgtgatcaagatgctgcttagtaaaacaattattccaaggagtgcttgctgtgtacaaattaattccatttaatattttcctttaaacttgatccatttgcggctgggcgcggtagctcacacctgtaatcccactggtttgggaggccaaggcgggtagatcacttgaggccaggagttcaagaccagcctggccaacatgacgaaaccccatctttactaaaaatacaaaaaattagctgggcatggtggcaagcacctgtaatcccagctactcgggaggctgaggcacaagaattgcttgaacctgggaggtggaggttgcagtgagctgagatctcgccactgcactctagcctgggcaacagagtgagactctgtctcaagaaaaaaagaaacaactgaacttgatgtagatcatttgcaagctcaaatggctatatttaagatttatcttattcttgatgccagatgccttcctttcttttcagaatgtttatagatggttgttgtaatgcgttttttaaagaattcttttgctttttcttaagactgaaataactcttctatgtgtcattattggaaaggcatcaagagtcacctcttgatgtccttgccattaatttcatggctccttcactttaaaaaacttttaaattttagaacatcttggttttgtgtgtgttgattaatacacggtcaagattgatacatcttgattttgcttagttgtatgataaaagtataacacatttgggggggggtggttggaggcaaggggagggagagcattaggacaaacacctaatgcacgtggggcttaaaacctagatgatggggttgataggtgcagcaaaccaccatggcacatgtatacctatgtaacaaacctgcacattctgcacatgtatcccagaacttaaagtaaaatgaaaaaaaagtataacacgttcattttaggcagtggtatggaaaatcaggaataaatttgtatgagactcaaaattaggtcatcatagtttacataaatttttaacagctttttaggaaacaaatactgttggttttttttttatgcctacataatttataaggtctgttttgatgttttggcccaagtgttacaataaggcatatatgtgccatgcagagttcatacccaccagatacaagatcctgctacatcccgttatttatattgttataggatgtaatcagacagtttgagatcatttatgctggtggttcccaaacccagctctatggcagaattatttgggaagctttataaatcagctgtcatggggagttttaaaaaattaacatcagatttctgggtacctcaaccctccccatctgcactttgcctccccatcccccctctgcctccccatccctcctctaccccatactctagtttttctagttctctatgagatcactggtctgtcattagctaaagaagcagaagtttttttaacctttatttttaatgagtatttttgccggagatggaattctgtttatctgactgctttgaaattcacaatacattgtcttttggctttcattgtttctgatgtggagttgtctgttggtcttactgtttaatcctgtgaaggtaatgtgggcacagggccctcctcccattgattcatttgataattttttttttttttttttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaaggagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatctgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcggctggccgggcggggggctgacccccccaccatcctcccggacggggcggctggccaggcagaggggctccttacttcccagtaggggcggccgggcagaggcgcccctcacctcctggatagggcggctggcccggggggtgggggtgctgacccccccacctccctcccggacggggcggctggccgggcagaggggtcctcacttcccagtaggggcggccgggcagaggcccccctcacctcccggacagggcggctggccaggcggggggctgatccccccacctccctcccagacggggcggctggccgggcggggggctgaccccccccacctccctcccggatggggcggctggccaggcggggggctgacccccccacctccctcccggacggggcggctggccgggcagaggggctcctcacttcccagtaggggcggccgggcagaggcgcccctcacctcccggacggggcggctggccaggcggggggctgatcacaccacttccctcccggacggggcggctggccgggcggggggctgaccccccccacctccctcccggacggggcggctggacgggcggggggctgacccccccacctccctcctggatggggcggctggccgggcggggggctgacccccccaacctccctcccggacggggcggctggccgggcggggggctgatccccccacctccctcccggactgggcggctggccgggcggggggctgacccccccacctccctcccggacggggcggctggccgggcagaggggtcctcacttcccagtaggggcggccgggcagaggcgcccctcacctcccggacggggcggccggccgggcggggggctgacccccccacctccctcccggacggggcggctggccgggcagaggggctcctcacttcccagtaggggcggccgggcagaggcacccctcacctcccggacggggtggctggccgggcggggggctgacccccaccacctccctcccggacggggcggctggccgggcagggggctgacccccccctcccccctcccggacggggcggctggccgggcagaggggctcctcacttcccagtaggggcggccgggcagaggcgcccctcacctcccggactgggcagctggccgggcggggggctgacccccccacctccctcctggacggggcgactggccgggcagaggggctcctcacttcccagtaggggcggccgggcagaggagcccctcacctcccggacggggcagctggccgggcggggactgacccccccccacctccctcccggacggggtggctgccgggcggagacgctcctcacttcccagacggggtggctgccggacggaggggctcctcacttctcagacagggcggttgccaggcagagggtttcctcacttctcagacggggcggctgggcagagacgctcctcacctcccagacagggcggcggggcagaggtgctccccacctctcagacgatgggcggccgggcagagacgctcctcacttcctagatgggatggcggcggggaagaggcgctcctcgcttcctagatgggatggcggccgggcagagacgctcctcactttccagactgggcagccaggcagagaggctcctcatatcccagacgatggggggccaggcagagacgctcctcacttcccagacggggtggcggctgggcagaggctgcaatctcggcactttggggggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggtcaacacagcaaaaccccctctccaccaaaaaaaaacgaaaaccagtcaggcgtggcggcatgcgcctgcaatcgcaggcactcggcaggctgaggcaggagaatcaggcagggaggttgcagtgagccgagatggcagcagtaccgtccagcttcggctcggcatcagagggagaccgtggaaggagaccgtggagggagaggggagaggggagaggggagaggggagaggggagaggggagagggagagtcatttgataaattttaatactgattcagattaaacaaaacagaataaactcatggcaaacagtatataattattaggtgacactgtaagtatatgaaaggattaaaaaaaaactctacaccagtgattataatatggattttcattttcaagtgaaaaattaagagaagcaagatggcctgcttacctacctattaaaagttagtttttatagttccaccaatttttaccaatggaccctatttatgaatatggatttaggaaatttaagtgagatgtatttaatggctactgctaggtaaacaatagttcaagggaagtttctctacttctctacataggaagaagtttccccacttctctacataggaagaagtttccccacttctctacataggaagaagtttccccacttctctacataggaagaagtttccccacttctctacataggaagaagtttccccacttctctacatgggaagaagtcttccccactaataaatgaagaaggatcatttcataatccccgagggccctgtcccgacattaccttcacaggtttaaatactaagatcataattaaaactaaagttatggaataccactttacctagaatggtgttaaagaaatgttagcaagtacaatggctttgtggtattgagcttataatgtttgaaaggcaaaaaggtcgtggccgagcgcagtggttcatgcctgtaatcccagcactttgggaggccaaggtgggtggatcacttgagctcaagagttccagaccagcctgggcaacatggtgaaaccccatctctaccaaaaatacaaaaattagcgggatatggtggtgcatgcctgtagtcccagctgcttgggaggctgaggtggaaggatctcttgagcctgggaggtggaagttgcagggatctgagatctcgccactgcgctccagcctgggtgacaaagcgagaccccgtctcaaacaaaaaggaaacgaaaaaaaaggtcttttgtagagatatgagtaaaggattaaaaaaatttttttgttgaatttaataataggcatttgggtttgtttaattttaatgagagctcatcccctaaccctgtatttttatcttttatgatcttatagacaaagctgttaatactttagtagattaaaaaatattttagtagattggccgggtgtggtgactcacacctgtaatcccagcactttgggaggccgaggcaggtggatcacttgaagcccagagttcaagactagcctggggaacatgatgaaaccctgtttctactaaaaattaaaaaattagctgagtgtggtagcatgtgtctgtaatcccagctacttgggtggctgaggcaggagaatcgcttgaacccggggaggcggaggttgcagtgagccaagatggcgccactgcacgccagcctggatgacagagtgagactgtttaaagaaaaaaaaaatgattctcataggtttctatgtatattgtcataccatctataaataaagataactttgcttctctgtacatgtgccgcacaatgatgttttgattaacaaaggatcacatatatgatggtggtcccataggattataatagcatatttttactgtactttttcggtgtgtgttttttgttttaactgaaccttttctatgtttagatatttaccattgtattgtaattgtagtattctgtatagtaacatgctgtacaggtttgtagtcagaagcaagaggctataccatatagcttagatgtgtagtaggcaataccatctaggtttgtgtaagtatactctgatgtttgcacaacgatgaaattgttaagtgacacatgactgtataatgtcatatctccaaatatattgtcaattattcttgaacatttatattgatgaattaatttaccttccctgttttattagctgggacctccagctcattttttctacagtaataatagtattaacggggcttcttttctttttcttgaatttagtgaaataatttgagcagttcactatcttgattcttatagcctttaaggtttcaagatagaggatttctcccttttcattctgttactgaaatgttagttatttttgaatagataatccaaaatgaaaagttttgaaagaatacacagtgaagtatcctcttccttccacttcctcaggcatctactcccctccctaaagccatcaatgttaccagtggtttttaaatccttccagagaaactcagtgtatatataagcaagtccacatatgtttgcatgtttatttctagtatttaattttattcaaatgatagccaataatgtatgttctcttctgaccttgctttaaattttaacttaatcttgtatcttggaaatcattctgtatcagtacgtgtagagctgcatcatatccctttacatatagatgtacagttaactaatttaactactcccctttgaggaataattacaaataataatattttgaataacactgtttataagaattgtttcatttttaacacttttctgtcaagcattaatatattaccaaaacactatagacttgtgtatgttattatactatagcaaaataatatagataagtgctataatacttatctatattagacatctataatataagtattttacacgaatccaagaactctaaataaagaaaaaaattccagctgatacataagtttgtgataaatatgtagggtttatttcatgaatacataggattttaccattttgaccagttttaagtgtacaactcactgacattaagtaaatttgtattgttgtgaatctgtcaccaccattcatcactaaaactatttcatcatctcaaagtatccattaggtaataattccccattactcccttcactgggctcctagcagccactattctactttctgtctctgtgagttgaccactctaggtatctcataaaagtggaatctgccaggcgtggtggctcatgcctgtaatcccaacactttgtgaggctgagggatggatcatttgaggtcacgagttcgagaccagcctggccaacatggtgaaaccccgcttttactaaaaatacaaaaatcagccaggcatggtggcaggtgcctgtagtcccagctactcgggagactgaggcaggagaatcgcttgaatccaggaggtggaggttgcagtgagccaagatcccaccactgtactccagcctgggtgacagagcaagactctgtctcaagaaaaaaaaaaaaaaaaaaaaagtgaaatcatacaatatttgtgcttttgcatctgacttatttcacttagcataatgtctatatggtttagcatgtgtcagaattccattcctttttaagaccgaataatattccattgtatggatacaccacattttgtttatccatttcatctgttgatggacacttggtttgcttccagtttttgtctgttgtgaatagtgctgcttgaccatggatgtgtatataagttgttagagttcctgctttcagttctttttgcaatatatccagaagtggaattgctggatcatatggtaattctatgtttaattttttgagaaacagtcatactgtttttcctttttgttttgaagcaagtattacatccgaacctaataaaagacagtataataagagagtcaatatacagactgatatcatgatgaatattggtgtaaaaatgctaataaaatattaacaaacagaataccttatctcattaaacacagcaatatactatgaccaagtgttattcatttcaggaatgcaaggttgactgaatcttcggaaatctattaatattgtaataatagagctaaaggtaaagtcaaattattatcaccatagattctgaaaaaatctttaaattcaatacccatttctaataaaaacactcttatacataggaattgcaggttactttcttatcgtgataaaatgcatatgctttagtttcaaagtcagaattttacttaaggccaaattctagagaccttttcactagaatcaggagcaaggtgaagatgcctactatttccattagtccttggtattatactataggtattagccagtgtagttagataagagagagaagtcagttacaggcacaaattaacatacagaattaataagcttcaacaacaatagtcagaacataacaggaaaaaattctatttagagtgttcagcaaagtatattaaatacttaggaataaactttagagagatactgtgactcagcagtataaagatgttgattctccttagtgtaacagaaatgtaatacaaaaataccaacaaacttttgttaggagttagctaagttgatatggtaaaacatgataaaacgggtgggaggattgtgtaggatatactaacccaataaaacttgtataattaaaaatgtggtactggcatgtgaatagacaaattagtgaaatatcctagaaagcccaggaatagacccaagtacatgtagaagctgagtatatcataaaggtattgttcttaaattcttggggcctgtaatgtccatcccataagtataatgttcttggctcttacttttgtagctctattctggcagtctcttttattggtggtgatgatggtggtggtggtggtggtggtggtggtttggagtgtctagttcatttatacttaatttgattattgatatggttggataaagttagctgtcattcctgttgtattctttgtattgtattgtttttctctggttgcttttaaaaggtttttctctttatatttggttttcaaaaatttgacttcaatgtgctcagatattttttttctttataattatactaatagtattttaagtctggggtttgattttttttttatcagttttggaaaattctcagccattgatttgtcaaatattttttctgctccaccgtttttctcttcttctcggactccaattacatgtatggtagactatatgctattgcctcaaacatcttagatgctttctttttttttttttaacttttaacttttgtgtgtttgtatgtgtgtgtttctgcttcaatctgtatgctttctagtgacttgttttcaaatgcattgatttctttttttttttaaatatactttccaatctgctattcaatccatatagtgattttcttttttaaatttcagattaacattttttcaattctggaatttccttttgtttctctttctggagtatgattttttatacattaattcattaggattatgtttttcttttgtccacattcttcaaatatctgcttgctttttttttctttttttttttttttttttttttttttttgacaggatctggctctcttgcccaggctggagtgcaatggcataattttggctcaccacaacccctgcctcccaggttcaagcgattctcgtgcctcagccttccaagtagctgagactacaggcgcgtgccatcacactcagcctgaatatctgctttaaaattatctacagggctaggcgcagtagctcatgcctgtaatcccagcacttgtgagagaccaaggtgggcagatcacctaaggtcaggagttcaagaccagcctggccaaaatggcgagacccccatctctactaaaaatacaaaagattagccaagtgtgatggcgtgcctgtaatcctagctgttcgggagactgaggcaggagaatcgcttgaactcaggaggcagaggttgcggtgagccaagattgtgccactgcactccagcctgggcgacacagtgaaagtgcgtctcaaaaaaaaaaaaaaaaaaaaactacaaatttcaacatctgagtaatttcacagctggttttcattaattttcttttcttttgaatataggtgaaattttcctgatcttcataagtttaataatttttatcctgcatatcatgagtaatacattgtggagattgactatatttttctgaagattgatatatttttgctttattagccagttaactcacactctaaactttgtcacccttgtaatggcagcaactgaaatctctctctagttcttttaggctgctcattatctgttctgttcatgcataattcggcagtcagagctttgggcagagtttatgtgtggaatttggtgtttccactctctgtctcctgactgggatttctcccctcacttccaactctttatggtagcctcaaaagctgtcctatgattcttcagcctagtaagactgccatttctatttgagttctagccagccaaagtaccagttgaagcctgccttcaggtgaaaatccaagaaaaagggagttactcatctagtgccgtttccttcctttaagtgtgaacttttcctttggttttgcctgattttggtctctctccagtgccatctggtagttgacttttatattttatccagaatgtgaagctgtgtgtggaatgtcactccaaatattgtcagaggcaaaacttctactcaacactattaaagataaactcaagttacttttttacacatcgtttataattgctaattaatgtactactataagcatccattgtattttgcttctacttgtctagtgacagacacttaggttgccccccaacttctccatactacaagcagtactgttcagaacattacctgtggaaaggtttccttggcatacatattccaagagtaagattgctagattgtagcatatttgtattcctaattttttgagtaaatccccttccaccaggacgtgagtgttctcctttactcacatctctacaatacttggaattactcaaatttatgtttgccagtcttaaaggtagaagctgttgtgtcatttaaacttgtatgttctgatttctagaggagtatagttactcacattgtttttcaccttttatgtgttggattacttatgtccattgcctgtttctctgcctatgctttttgagtcagatctttactcttccttatgatttgtgtttttttggtcatgtccaataaattctctcccatctcaaggaaacattcttctacattttcttctcttaactttatacttttacctttcatattcaggtctttaatgcagttgctggttttgttgtatatggtatgaggtagaaatctaatttcatatttccaaatatgatgctaccattttttcaagtagatcattgtttttattacagtgttgggaggtatattttaacatttgttaagataattcatgaaggtggttttcctaaaatttaaatctgattacattacttgaaatcattcagtggttctccattgttttaggatacagtcagtagtctttaaatggattagggaggtctttgtgaagtagtctttgcattttctgtccagcctgctagtactctaaacttaatatgcgctcgttcttcctctgagaagtattataatgttatcatacacagcacaatatgcttaatttgtttttcttgtatatatttttcactactgtgtagtcttagcagttcctgttatgtattaggtgtttaacaaatatttatcaattgaaggaattgaataacttggcccttatccttggcctaactatctaattaactttttttagaccagatgagtgttttgggggaactagtttagctgataagtaaaagttgatttaataactctggatcgctggacgcggtggctcacgcctgtaatcccaacactttgggaagccaaggcgggcggatcacctgaggttgggaattcgagaccagcctgaccaacatggagaaaccccatttctactaaaaatacaaaagtaggcgggcgtggtggcacatgcctataatcccagctactcgggaggctgaggcaggagaattcacttgaacccgggaggcggaggttgcagtgaactgagatcgtgccattgcactccagcctgggcaacaagggcgacactccgtctcaaaaaaacaaacaaacgaaaaaactgatcatctcaatagacagttctttcaaatcttccttatgttagcggtgtgtgtgtgtgtagctccttaattgtttccatcattaggacaaccctgtaggtagcaagattggatattagctcttgttttattgcatcagttttttattgatgttgaatcctagtttaagtgaattgcctgaggttcatacagcctagttttgtatttctacctacttttttttgaaaatatttgtttgctcaggcagttatatactggtaatgatatgaataaaagccacttcaatccattgttctgccaagtatgttttacaggtaatatttatgagcctttcttttgttagttttttccttttgttttgggggagttgtcttaaggtttgtaaccatagcaataaagagtttcagttatattagtactcttgagaactgtggctaaatggtttcatttagacatttgcctgtgaaatcctaagtcttacagacattgttaggctgtaacagagttttgatgtctttaaaatcatatgtattataaatatttttataagatattttatatatactagaaactgtatctttaaaatttagatttttaactacttttgtacttatttagattttgtctacagcatttttgacatgtgctttatttatttatttagagacagagtgttgctctgttgcccaggctggagtgcagtggtgcaatctcggctcaccgcaacctccgcctcccggtttcaagcgattctcctgcctcagcctcccgagtagctgggactacatgtgcgcgccaccatgcctggctaatttttgtatttttagtagagacgtggtttcactatgttggccaggctggtctcgaactcttgacctggtgatttgcctgcctcggcctcccaaagagttgggattacaggtgtgagccaccacacccagcctgacatgtgctctatttattgagttgcttgggagctcagtgtttctaggcagacagatatgcacttggaggtagaatacgtctaatgttattaaataaaattgagaccacttatgttattaaatttcagatgatattggcatttggaaaattcttaaaagtcatactttaatgatacttcgttatagtgaatgtcagttttactggtgttaggtactctggaacaaggcttattactcaactgtctgatgttaaagaaacattcaataatggaatcagcacttttttcttttagttttaaaaaatatgctaaaacatcagtattgtataattcttaatatatgaagtagttccttaaagattatgttaatttttctccaaatctctttttctgttctttagaggaaatatcattctgcaaaagaagcttatgaacaacttttgcagacagagaatctttctgcacaagtaaaagcaactgtcttacaacagttaggtatgtaatagtatacatttagtgtattataagtgcttctctttatgttttttccatgtcgagtgtggcaaatatgtggctcatatattctattcctttgctcagagttgataaaattattctgaacccagcatatttgtatcctctgcccagcattgtccttcccacagtctgtctcagtgtaattctttagtacagctggtccttttaaattatcaaaattactccctagtatttaacccaaggaggattgaatacttcgtttgtgccagatatatgcttaagcacttaatgaagttgtgatttacctaatgtcacttaatggttggggagcttgctttcatagctttattagttataatgactacaaaacaatttatctaaaaactgtagaacgtctaacactgtgagcatgcagttctattctaatgtgggacatgagggaatctattcatttggatgtcatgtgtaactatcaccaaaaagatagtgaaagaactccccagcctttaattttgttgcttaattattgagtcatgtttcttgtttgtatttgatatttgggttgttttttcagttttgtttttggtctgggcaaatcatttattcttaatttttagccagcattgtagcagtatgaatgttttcataatgtaactatttttacatagttttaaagtcacttaagcttagattttatcattatctttagataatatacatacaaatttaataattataaatcactgaataaaaacaaatattttgacacttttataactcttaaaagtatagacaacttgagtaaaatcctaatggaaaaaattataaacaaaactaaggctttattatgaaggcaatgtttgttttttcagtcatcaaatactttatagtttgtttgcttatttattttagacagagtctcgctctgtcccctaggctggaatacagtgtcgtgatcataactgcagcctcaaactcctcgggtcaggtgatcccacctcagccccccgagtagctagggctgcaggcgcatgccaccacgcctggctgatttaaaaaatttcttttgtagagacaaggtctctctctgtgttgcccagggtggtctcaaactcctggcatcaagcgatccttctgcctcagcctccccaaattctaggattacaggtgtgagccactgtgcctggcctatagttttatatagggtgcgaatatatgtagtcagggccagtgaggtaggattgtgtgtatattttttaatctgaattatcgttgattctatagccttatatttattccttggaaataaacattttgttaatgggatatcttggagattcttaattggctcggtgtggtggctcacgcctgtaatcccagcactttgggaggtcgtggtgggtgaatcacatgatcagaagatcaagaccatctgggccaacatggtgaaaccctgtctctactaaaaatacaaaaattagctgggtgtggtggtgcgcgcctgtagtcccagctactcaggaggctgaggcaggagaattgcttgaatctgggaggcggaggttgcagtgagctgagatcatgccactgtactccagcctggcaaaagagcgagactctgtctcaggaaaaaacaaaaaacaaaaaacacacattaatttagttttacatggaatagtaaataagacgtaacatctttatattttttgtttcgtaacttggaattttttcagatatcaaaattagaaaagtctgatttataatctgttatatcagtactaaaaattgttttaatttctcttgaatgaaagccctttgtagcttttacagtaccttactgtgagaaactgactttcttaatggccagaattggcagttctaaattttggaaatatgtactccaaactaaattaataaattgacagaaaagagtacttttttggtttgttttctgcttcgtattcttaaacatagaagaacaattaagtcatttatgtaaatttttttaaatcatttactgtaggttggatgcatcacactgtagatctcctgggagataaagccaccaaggaaagctatgctattcagtatctccaaaagtccttggaagcagatcctaattctggccagtcctggtatttcctcggaaggtgagacttaccagacatttatgtttgattttgtctattccagctaagagatttgaattacaatttaaaatgttagtttacatatgtaacctgatcagtgtattttctcttctaaatacattattaaccaagattcctgaaagttaaacaacaagataaagtttccaaatatggtggtttttttatagcataatctggtctagcaggacgtttcttattttggttattggatttttatttgatttgagttactgctagttttaaaaaagtcttatccaatagtaacttttaatgaagtatttaaatgcctttccttcagacttccagtatttttttctatatgtctgttttataaaacagaggattaatttctcatctgcctgatgactactggtagtcaatggaacctttataatttataattttgattcatgatatttaccttagaattgacataatagtaaatctcaaatcacagttatacttgaaatcttacagtgagaaagtgaatacattattagatttgttggaatggagaagtgtcatgtaacaaaaatcattttctgcaagtctgtaaccatttctccatactatttatccattgaatgtctgaattatgcttagtgatgatctgaactatacctcatgcataagtatctgatagattatagttttagactatcatcaggttgtattttgattcctaatcacttttcgctttcatgatatggtgaaaagatcaatgtactaggagccaggacacttagattcaagtcctgattcagctactgtttgtggaattgtggatggtttagttaaaccttttaaagcctcaaattttgtttaacgtatttagagaattgtattagatcagtggtcctcaggggcaggctattttgccactcttgccccggccaaggacaattcacaatgtttagagacatttatttctttcatcacagctgtaaagtgtgctactttcatatagtgggtagagactagggatgctgctaaacatcctacaatgcgcaggacagtcctctatagcaaagaactggctggctccaaatgtcaattatgctgtagttgagaaaccctgagttagatgatctgttacgtatcttcctgctctaaaggttccaattttatgacttctttagaaattatcctgttttaattttaagttttgttctattattgtttacatagaatacttgattgtaagtaaatttgccatataatcacattaaattttaattatatggcttcatttttcctttaaggaaagtatgtttgtatgagacattaattttaattaatgtaattttaattaatgtaatattactttaattaaagtaatattaatatggttccttccctaaaaatatttgattactcatagtatgcttagaaggttaaggaaaaaaatttttaaaaacatttgattaactcattattaacatacaataagagttgactgaaaaggtatctaatttttggtgaggatttcctaatccctccccaggcttataaaagagcctaatttggattgcttctaaataaagctggagggtccaaacttttgtgtttctcttctacagtagcagaaactggattttattatttttgtatctttttgcctgacaaagtggctattcgataaatggatgacatgaactaactaaactccatttgcttttggagctagcactattactgttagtgttgtggagtgtgaggctttatatagtgactgtaaaggaggtctggaactgggaaacagtaggtgcctgtctcttgttttcaggtttatatatgaaaatttcttttagcatagattaaaacgaatgtatactagaaagtatgttccttctgacctaagatagtttaatacagtagtgtgtagatgtctttttagtataggtttttaaatttaaattctagttacgtaaaattataatgaaccatgtgtagaattaactatcatagtcatgctgtaattttcagcttcgatgagcagtatttaatcatcagtatttcagtgagcagtattttatcatttttttccagttaactaattttacattgtaaaacattatgatgcttttaatttaatctttttgggtaaatttttccaaatatacaatatacttttcctgactaaataaaggatacttatcacaatttaacttggtttcgggttcaaggttatcattttagacatattattttccatctgtaataataaaattctaaatcttttagacttttcatattctctttcactgccttctaatgtgttgcttctaatctgtttcttgtaagaaacattttatgaatgaattatgttttagaagtttttaaagctccaaatgaagacctcaattgtcagtaagaaattttggggtttgatgaccctcatatttgttaggatttctattaacctctgcattcaggtctgtgttgaagatggactttgcttgtcatttggcacttgtatttcaaagtaaaattgtaatgtgatattctgttttgctagcaccaatcattgactgtgttatcacagaactatagaatattacaactgggagggaccagggaggtcatctagttaaccttgtaaatcctgtcacttcaaagatttagaaagtgggttcataatcacagataattagtatgagagcagggattagaccctagattcacccaggacttttttagttacatgagactgtctcagaggaacctactttcattagaggaaaagtggttgatggttggagtgggacatctgtatctgggcacattggtttcctactttgactttgtaggaatggaatgttaaaacattggttttgggaagaactgcttatttctcccagcagttaggcaaatttgtctataaatctgaaatggctttgatttcacaacaactacagaagagcatgttttctactatctgttaagcattccctttcacgctggtgtctgtttctgtttggcattgtagctgatctcttcttatgaatttttccttcataaaacagtttgtagatgctctctgaaactgccttctctgtctcaatcacggacatttcttacatctttcaaaccacaggattagtgattccttaggcttttacttctccctttagatgtcctgtgtttttacagcctctcttccatatggatgaattccaaatctagatttcaacatttaaaggtatcttaaacaccaggacaacatctcctattctttacttaacatttcccattttaatgtcctcacatcatgtcaaagtcagcatatttcaaaccatgttcaccatattcttccccagaccagctcttttctccttttacttttgccaaaagatcaccattttctttttatcaaggttaaatactaagttacagcccccaccctgtgaacatctaatcaattaatcacaaagcctttatcaatcttttggtttcttgtttctcttatcttttttttcttgccgcttccagtactttcactccaattttggcctgttctaaaccagtgaatgtagccaccctcttttttcactgtccataactattttcctttcagtctgccctacatattgttagaaaattaatattcctataaagtgctttcagtgtgctattctgcttgttagaaaagcaaactttagggtaatctttggctggatttaaaattctctactgttttgtgtctgtgctttcttgtatatacattaggttttgctcatgctgttcaaacccatttaaaacgccttttctcatcttctctgcccgaatcagtggttcctagaattttaggttacataaatcagtaaaatttcaaagaataattatgaggatagaaatatggtgtttgggcaagtaaaaacattaactttttttgcaatttactgtcagccaataatatccaaaataagagaattacagcataaatattaattcatttattggaaaaactttatgtatgtatatgtgtgtgttgtctttccaatttgtttgcttggcaaacgtgccatatactggctggcaattaggaatcactaaataatatgcatctttacatattcaaatcccttactcttactctcccccccccccctttttttttttgcctttcctaaatcttgcagaatatgatggtctcttcttatcctaaattctcaggccaattattgtctatactggccatttgatatgacatcatgacatttttaatgtatcttcagtcctcaactaaattgtaagcttcatgaaaatagggactgggtttttgttttttttctttttcctttagtgccaagaataagaagataatttcagtatttataatttcaactgttatctgtgtatccatcatgtccatcgtgtatattcacattaagaaaattacagtccttgaatcgttaatcttaccttgctaactttactagtcataaaatattatactttatattatttttactttttactttatactatttttgatacttagtttgagattaactatgtcttacatgtgcattttttttatgaattaaagaattattgccctcagtgttgttacttgggaaaggaaaattgaaatctgatacagcaaatcttaccaacgtatatagtgtttttgtttttaactctgtattttgaccatataggaaactagaggtcaagctgtataagaagagtggaagagtgccgtgtgtgtgtgtgtgcacatgtgcatgcagctctcagtattataatattgaagtgatatgtcccctaatcattttaatagagttcattaatgcagcatgctttttagcacctataagacagactataatatggtttgttggagggcaaattataatattcattatagttaacaagtatatacatacatacacataaatatattaacttattagggttttaaaaaaatttgctgtgatatatagtccatcctttcagccgattaatttgtttcagtattaatggaattctcttgattttttttttttttcccttcccttctcaggtgctattcaagtattgggaaagttcaggatgcctttatatcttacaggcagtctattgataaatcagaagcaagtgcagatacatggtgttcaatagggtaagcctttgtataaaaatagtagtaatttaattgatatacaaagatggttgcatcacatatagtacttcatagtttaaatcattataaaaccaagcagttcttctgagttgacttattttttcttaatttctctttccagtgtgctatatcagcagcaaaatcagcccatggatgctttacaggcctatatttgtgctgtacaattggaccatggccatgctgcagcctggatggacctaggcactctctatgaatcctgcaaccagcctcaggatgccattaaatgctacttaaatgcaactagaagcaaaagttgtagtaatacctctgcacttgcagcacgaattaagtatttacaggtaaaatttttaaatggcagttttttaaagccacatatttccccagaacactcaggcagaaggagggtggctggaaagtttgtctagttgtgttttgatgtctataatctgtttccatattttgtaaacataccatagcttgtaatattattttacttttcattttaagtaagatatgcagtatttttaaagatgctcttttgcacatttactctgttgatgcatattaatttacataatttttttctatgtactgtctacatttttaagttgtcatagcattttatagaaaacacaaacagtctttcactcttgcttggagtttcttgagaagacagctatgagaactctgaaaacagagctcagctttgttttgattctcacaaaggtttatattccggttaccctgtttatacttagtgtcttctaaagccccaaatttagaatctattttcttttaaaaacaattagctatagcatttaggaagatttagtggacttgctcttactcaagtaggcttgtgttaaatttgctttttacataatttttcctaggctcagttgtgtaaccttccacaaggtagtctacagaataaaactaaattacttcctagtattgaggaggcgtggagcctaccaattcccgcagagcttacctccaggcagggtgccatgaacacagcacagcaggtgagaagttgggttatgttctgcaggtgcccagctttaagggttcttttcaattctctagtggtcaagcttaatttactaagcacaggaggcttttagtaatgaaaagccttttgatttaattgcaaagggaatctagatcaaaataaaattccctctaatatgggaagagattttggggtaccaacttagaacctttgtgcattttcatgattttgaaggagatttcttaaaataatgctacagtggtttgtttaatttttaaggcaagtttttcaaaggaaggtacacattattccattgatgaatcatttaattttgattttcaatcattgcaatcagcgatgtccacatagctttgaaaagtatgcagcttgtaaagttttataatttgaaggaatgaattaagaatatatagaaccctatttttgtcttccttctgtgattcttaggcatgtaaacctcatcatccaaatactgaacctgtattaggcctcagtcaaacaccaatttcacagcaatccttgccactacacatgattccttctagccaagtagatgacctgtccagtcctgccaagaggaaaagaacatctagtccaacaaaggtatatgttttagagaaatagaaaatcccagtcaaaaaagaagtttcagctgccctgaaattgtgcagtttgaacatttcctgtcctttattttaaatttgtggacatcaaagagtgaaaggtttgagtttttccatcccaaacccttagtatcatattaaatatagaaagtagggataaatttgcattcatcaaatcattttattcatctccctgccgttaagatcccagcacacttttcatcatcactttttactgacattgaaataaatttaatgttggatctagtggacagtgtggtgtttaggctagccgtttgggccatagtttgagggtgggcctttttgggtggcttattaaatagtcagtaatttttaaatgtatgatttctaagtttaatatgcatgtaaaattattttttaaagaatttaatgttataacatctttttaacatgtaaatattccaattcatagtcatttggcctcctctaaccattattattaactgtggatttaaccaaatattctttaattttttttttaaatcgattttcctcagaatacttctgacaattggagtggtggacatgctgtgtcacatcctccagtacagcaacaagctcattcatggtgtttgacaccacagaaattacaggtatgtaagatgtttttgacaaattgtttattaaaaaggagtagaggtagcaaacaagtattaattttttttttttttttttttttttttgagatagagtcttgctctgtcacccaggctggagtatagtggcacgctcttggctcactgcaacctccgcgtcctgtgttaaagttattcttgtgcctcagcctccagagtagctgggattacaggcacgcaccatcacaccccgctaatttttatatttttggtagagactgggtttcgccatgttggccagactggtcttgcactcctgacctcaagtgatccacctacctcagcctcccaaagtgctgagattacaggtgtgagccactgcacccagccctaagtattaattcttataagttaaatggcagtacattcaattaaaatgcacaaaagtaaaatgagcctgcatttaccagaataatgaagagcattcattcttgtttttaatttctttttttttttttaaacaggacatggtttacactacataaagtataaatatagggtatatagggtaaagttttcttctaactctggcccctacccactcaaaatgtggctggtattactaatttcctatctatcattccagaggtatgttatgtatgtacaagcaaatatacatccccccctttctcacatgtattattatttttcttcttttttacacaaatgataggattcttatttgctgttaacaacatattttacagacttctgcatgtcaatatgtgaagagcttccttgttcttttatggttacatcatatttctttatatagatgtaacacctttatttaagcagatcagtaattttggacattcaggttgtcttcagactttgcttattccagacagtgctgcttttagcatacttgtcaatatatttttaagcttcaagagttttctctgtgaatacctaagaatactgtatggatgagtaaaatttcatgcccatctattacaaagaactcatagtaaatcttgttcagatgaatgcttagttcattcttatatttctcaagcttattaaaggacttcatcttggagtgtgtgactgttggtcagaagacagtgtgtttgaccagatagtggttctgagtttagtcatttcagggaaaggttgcttagaataatgatcttatttcctaaatatatctttgactatattctctttttgttcttcttctagcatttggaacagctccgcgcaaatagaaataatttaaatccagcacagaaactgatgctggaacagctggaaagtcagtttgtcttaatgcaacaacaccaagtgtgtatagcatatttttccctgaaatttgttagcattttgagtatttttattgactctaatgtcattttagagcatgtttatgttcatttttactttctactggtatttgacagaatttagtaatctctgtattttaaaatactggtaattgacggagatttttagacaaaagcaactataattttgaagaagatactttgtattttatttatttacatgatatttcacatgtattctaagggtttgtttacattatttagtactgaggcaaggtttttagggcttatttagtttacaggatctggcatatatgtaacagaatgaaattttgagatgtcccctcttttgtgattgagagaaggacctataagttcggggtcgttttctataattttcagctgcttccttttgtcattactaatgggattttttttttttgaaaccgacttttgctttttcaaggaagtttattttaaaatgaacaaatacaatttcttgtttttaaagtatgtatttctcaacttagagaaattaagcatttgggtaaaatcacacattccctaattatacatcttcatattcatctggggattcatagagaatcccctatagattctcttccctatagattacacaaccagcatttacttttcctttgtttttttgacagatgagaccaacaggagttgcacaggtacgatctactggaattcctaatgggccaacagctgactcatcactgcctacaaactcagtctctggccagcagccacagcttgctctgaccagagtgcctagcgtctctcagcctggagtccgtcctgcctgccctgggcagcctttggccaatggacccttttctgcaggccatgttccctgtagcacatcaagaacgctgggaagtacagacactattttgataggcaataatcatataacaggaagtggaagtaatggaaacgtgccttacctgcagcgaaacgcactcactctacctcataaccgcacaaacctgaccagcagcgcagaggagccgtggaaaaaccaactatctaactccactcaggtaataggaggactagcttccttgttggcttttcacataaatgtttttactgggttttatacactttgagagaagaagagagaagtgtttggggaactggttttataagaattttgtggcactacaatgttactacattgtgattcattatgtacatacatgagtatatctttgttccctttgtacagtctctaccgacatagataacttagcaaatttacaaaggaagaaaatagatcatataaatcacccaaaatgcaccattaatttacagtggcatcataagcacatttatgtaatattacttagttcatttctgcataaactgcctacttaagatcaggcactaaactaggtgttaggtatttgctttagtgggagaaaaagaccagtgaataagtatttaccataatgactgtgaagtgtgactttggtgggaaagttctatcagagtacctacgagagcacataaccaagatgtcagagtcttccagaagctagagtttaggggaggagagggctggtgaagtgtgcctagaagataggttatgaagaggggagggtgaaataagaggctgagggagaggccaaatttatcttgaaggcaaagttgatccactaaagtttttgaaacagagtaatgaattgcatgcacattatttttgtcaaggaaatgggtcataatgtattcaacgttagcacattcgttagacatttaatttctaagtttttacttctgaatgtttatgtgcatagtatttcccatattttggattgtttccatgatatgggtactcgctgaggtgaaactgaagggccaaagagtaagttttaagaaaatgctctcaatatgtatagccaaattgcttgtacttttattaatttactatgagaaatatttgacttaaaaagagaaatatttggctgattgtcggttagtcttatattattgataaaactgaaataagttctttttctaagatttttaagtttattcttgaattaatatccttggtgggaccctgatctaaagtgattagtactttattcattcttagagaaatactgagtacctactaggttcatttcctactcaaggctctgggaatacatcaataaagaaaatatactgagatgtctctacttggtgtaggtaaatagatagtaaacaaataagcaatacatatataacattagatgatggttgtgattagtgctatggaaaaaagcactaatagaaagggaacagcagaatactagagattggtggtaggagagttgcagttataaatcagaagggcagggaaggcttctctgaaagatagcatttggatgagagttacaggagtgagccttgaagctatttgtgataagattgttccaggtctagggagcagcacggagcaatggaccctaaggtaggattgtgctgtgcacatttgaggagaatcaaggtggcaagcatggcagaacaggacaggcaaggagtgagaagagagagaaatgtgctccagctggaaacaggatggctaaatcatgatcagccttataaggatactggattttattctgagtatccaggaaaccgtagggggattttgaacagaggagtgatgtgatctaactttgtttttgactaggtcctctttggtactctgtggatagactgaaagaggcaaaagtagaaatggtatgaccattttagagattatacctgtaatccaggttaaaagttgatgatggctcccagagtggtagtagtagatggtggtcagcttctgggtatatttggaaggtacagccaacaggattagttgatatagagtgatgtgtgagaaaggagtcccagctggcctgaccaactagaaggatggatgaaactggatggtatcaccaatcagtgagaacagattgagaaaagaactcaagattgagccttagggcattccagtgtattaggctaggaaattgaagaactagcagagaagaatagaagagattgacctgtgacatagtaggagatcaaagacaatgtgagtgatgccctggaagccaaatgaagaaagtttcaaggaggaggacatgatcaaataatgctcataggtcatataaagtgaggactgaaaactgaccatctgagatatttgctgacattattggagtaaggaaactacaggttacaggcaaaatttaccccacgacctgtgttttttataacccgtgagctaagaatgatttttatatttttgaagggttgtaaaaaaagaataatatatgatactgggtgacccacaaagcctaaaatatttgctatctgatcctttacagaaaagatatgctgaccattggataagggcaatttcagtggattgttggggtgcaaaagcctaattgtagttcgcttcaagataatataaaatcggcagagaaaaactgaagtagcaagtatagacagttccagcacacatgcttacagttgtttgggctacacactgcacagtgccaaggcttccatttccatataccgtggcataaaagagaacaacaaccgggtgtagctgacagggaaaatgggattaggagttgttgtcttgttgttgttttaaatttaaaatgagagaaataacagtaaaagtcaatgggaaagattcagtagagagggagaaaatggcaaaggagaaaggggaattgttagaatgggtgagaggatgggattttgggggttcattgtctttaagcattaaacagttgttaaaaggataacacgagatttttgttaaaatgcctatcatagttctaaggtataactggcagttaataagtgaaagcctttgttatgattgtaaagcatagttctattttcttttctctcacatctacttctttggctcacttagttgctgaagttttcaatactctcttaaccctgttttggaaatgtgggattctttaaaaacgtaattcgtaattctaataaaaaggaactcctcagttggcaggccacgaggcttctgtaatttaccatactaagtagcagggagcccccagcctttgcttcacacgcccttcaaagccattatctgtaggaactttacaatttaagtaatgaggttgagagagttgtttagaaaatgatgttgaactgattccaggtcaaaagtttcccaaatgaagtttctgcatatcactacagctgggaagcctctgtctctgctgttgatatatggtattaatatcatagactctaaagaggcctttttggtaacttgtcttatacaaacctatttgaataatttttgaaattgtaatgaaaactagacaactggtagacctatatggtatatctaccttttagtttttgatcaagggaggaatttacattacagtgtggaatgggtttattcagattgcttttggtagcaagggtataatttaagatatgaaagtaaaattatattaattgtaggtgattattcagcaagtactctaaagaatttgtagcttaaaataccttgatttgcagatagagaagatgtaataaaatagttactttgtcacatttctgcatattgtaatcagtgtatttgttaaataattggcctctgaattaaatattttacatttgatgaaattttaactcacctacccagactttcttggataatattttaaatattgatatgattataatatgcagtgtttttgctttatgagaaattttcatgtaacttacaaatttcaaccttcctttattatgattgaactttgttacttattaaatcatttacaactaattgcactcctttacacactcactggtgtgtatcttttttttgtttttttttttttttttgagatggagcctggctctgtcgccaagcctggagtgcagtggtgcgatcttggctcactgcaacctccgcctcctaggttcaagtgattctcctgcctcagcctcccgagtagctgggattacaggtgcccaccaccatgcccggctaatttttgtattttaatagagacagggcttcaccatgttgaccaggctggtcttgaacttctgaccttaggtgatctgcctgccttggcctcccaatgtgctgggattccaggtgtgagccactgcgcctggccaatgtgtatcaacttttaatatatctagtgttttaggtagataagcctattgagtaaaaacattagtttaaaattttcagcttcagaaactgattttaggggcatgctagctgactttaactagatgattaaatgcaccttttagtatataaatatcttgttatcagctatagttttattcttttatagcttattactgacaaaatgctctaaccttgttgctgaagtaatctcaactccaaatgtaaactcgttttatgattccaatgttactttaatcagtgttgctgaaaaattggctgtcctatttaattattttgtaagtaaaatgaaatgaaaatattcttcttaaagaagtttctctgtgacaccagaggcaaatttcaggtaaaaattagttccagttatcatattttcattctattaaatgccctaagtgatcttcctctagtcttaaaacttctattaactgttagtatactgccccctcagattgctttaacagtagcagtgtatttttctaagttttcaaattcaggtgatgaaaaataaagtttatctcaaagtcattagtggagacttaaaatgtctttttctcccctttttttttaaaaaaaaaaaaaaaaaagagagacacaaggttctgctctgtcacccaggctggagtacagtggcaccatcttagctcactgctggctcaaactcctgggctcaagagatcctcccaccttggcctcctgtgtagctggactacaggcacacttgtcaacacacctagcttgtctgcctgctttccttccctctctcccctctctccctcctctctcctctctcttctttctctttctctttctctttctctttctctttctctttccctttccctttccctttccctttccctttctctctctctttttcttttgtggagacggagtctcattgtgttgcccagcctggtctcgaactcctggcctcaaacgatcctcctgcctcggccttccagagtgctgggattacagacataagccactgcaccaagcctatctagtcttctaaatatgtgtggatggatagatggggaaactttaggtattttttgaaatattttcatagatttaatagttctgcccttaattttgaggatagctactttaacaataggatttgaattacagaagattatattttaatgataattttaaaggcttaatgaactcactttctatattaatcttttaacagatcacagaccagtgagagttggtttatgttgatccatggtcatagcttttaattattaatgatgatatatgtctatccatgtctgattttagagatgaaaatatgtatattggaacttaaaatttgtaatgcttcatctgaagtagtttattctacactaataatggagtcattttagatagcaaggaagaaaaatttctctaaagatgttaaatactgattagctaagttgcaggtactttttgataactttaggacttgggtcaaattatcttatacagttagatatttatttttagtggcttttctctttaatattttaaattctgtatattctgagtttgcttaatattagatttaaactatttttctttctttttaggggcttcacaaaggtcagagttcacattcggcaggtcctaatggtgaacgacctctctcttccactgggccttcccagcatctccaggcagctggctctggtattcagaatcagaacggacatcccaccctgcctagcaattcagtaacacagggggctgctctcaatcacctctcctctcacactgctacctcaggtggacaacaaggcattaccttaaccaaagagagcaagccttcaggaaacatattgacggtgcctgaaacaagcaggcacactggagagacacctaacagcactgccagtgtcgagggacttcctaatcatgtccatcagatgacggcagatgctgtttgcagtcctagccatggagattctaagtcaccaggtttactaagttcagacaatcctcagctctctgccttgttgatgggaaaagccaataacaatgtgggtactggaacctgtgacaaagtcaataacatccacccagctgttcatacaaagactgataactctgttgcctcttcaccatcttcagccatttcaacagcaacaccttctccaaaatccactgagcagacaaccacaaacagtgttaccagccttaacagccctcacagtgggctacacacaattaatggagaagggatggaagaatctcagagccccatgaaaacagatctgcttctggttaaccacaaacctagtccacagatcataccatcaatgtctgtgtccatataccccagctcagcagaagttctgaaggcatgcaggttagtgtgggaaagttcatcaaagtgaaaatgtttgacttactggcatgatcagaatgctgaaatttggaccgtttaagatatgggaagtaagcaaaagatggtgtagtcattcatctaagagtttgacagaagctttattttgcttagatgttgtagtcaaatcagatgtgagaagtattcctgtaaattgcttattttgagtgggtgtgtctgattgtgctgttactgccctctactggttactaggttgtcagcttcagtgtgattgacttcgctctggggatttaaacaagagaatgggttaaatcatatttggccaaatacagcaaggctggaaaaccctatgggttttttttttttttttatcagagcctattaaatgttaggctaggaatggaccccatcacttatcaaggctagtctttgcttacaattgagaaaactggactgtttgaatctagaagaggttataaagcaggcagaagaggaaggaagaggtcaggggcaatgggcagtggagagacatgacagactgtcagccattctggaaggagccagacatattctgctagtctaggaagggcagggcctcagaaatttatgaagaaatgaacctcctctgtcccacaaaagaagaatcaaaggatcaggcagcatcatctttctctgatatttggaggacatatagattcttactggccttttcattgtatatgacacatatataatttttctcatttacttgtagttgttgtcctctataagtgactaaatcttgaatgaaatttagttaacataactggaacaaacaaataattctgtaatattttctgatacattaaatgttaagtttgagcagacatatagtagattttaaaaagatctttttttggttgtagattgtcatgatatatagaaaataaccattctataaatagaaattataaacattagttctagtttggctacattgaccatttaatatagcttttacattttaaagttcaaaacaattcttatttatagccatataaacctcttcctgcagttgctagtacttatatgtcttatttattgttatgtaaaagtgtgattatcttttctgttgttcagattattttattagaaggtatcctgggtctaccgttaaatgtttgtcactgacgaatgattgaggtgaaattaaattttatttatatataagtttgctgcttgggagggatgtggggtaggagcaatggagtatggagaagaaatttcaattaatttaaatttatcgctttaattgtgacactagaactttactataaattacactatagtcatttttctttaaagagtttgagtgttaaaaataccttttggtctgtgttttcttttcttttcttgtcttttcttgtcttttcttgtcttttcttgtctttttttaagacagtttcgctcttgttgcccaggctggagtgcaatggcgcgatttcaacttaccgcacgctctgcctcccaggttcaagcgattctcctgcctcaagcctcccaagtagctgggtgggattacaggcatgcagcaccacacctggctaattttgtattttttagtagagacggggtttctccatgttggtcaggctggtcttgaactcccaacctcaagtgttccacctgcctctgcctcccaaagtgctgggattacaggcgtgagccactgtgcccagctggtctttgtttcattttctattagtttctatttctgttagtttctatttcattatttcctgtcaaattttaactatttagttgttattctgacatagactagggcagaaattacatccttttttatattttatttttttctttattgggtccacgttgttggcagcattttccttagtgacctacaacatggtgattgctgtaattaatcttaactgtcttacaagattttttaaggtcagtaacttaagaggacattggatgatctctaaatgaaattcttctaaagcatatagtgaggttcttgagttcctaaaatttgtttctttagaaatttttatattataggtttttatattagttttttttttgaagttaggctatcattcagttcaactctgggcctacagaaaatagggagtgttcagattaaatgctacacttggctctccttagacagtgccttgattcactgccagtttgactgtcttctacctgctcctcactcatctgctggggcctctgtcctgtttcctaggtactgctgctctaactgctggagcaggggctttctctctcatccactctctgtagactcaggacagttgctagaaaatggggaagatttggaggttcaaaactaacatcatgaactgcatgggacctaaggaggaatattgtcagaaagagttccatggagctatgttctgttccccaagttacaaactgtgtatagtagcagttttcataagtttgtattaataaattgtatattatttaaaaaaatataataatatatatatatatacatatatatactttaagttctagggtacatgtgcacaatgtgcaggctcgtttcataggtatacatgtgccatgctggccagctgcacccatcaacctgtcatttacattagatatttctcccaatgctatccctccccctgccttccaccccacagcaggccccggtgtgtgatgttcctcaccctgtgtccatgtgttctcattgttcagttcctagctatgagtgagaacatgcagtatttggttttccgtccttgtgataatttgctcagaatgatggtttccagcttcatccatgtccctgcaaaggacatgaactcatccttttttatggctgcatagtattccatggtgtatgtgtgctgcattttcttaatccagtctatcattgatggacatttgggttggttccaagtctttgctattgtgaatagtgccacaataaacatacgtgtgcgtgtgtctttatagtagcatgatttataatcctctgggtatatacccagtaatgaatgggattgctgggtcaaatggtattctagctcttgatccttgaggaatctccacactgtcttccacaatggttgagctagtttacactcccagcagtgtaaaagtgttcctatttctccacatcctctccagcatctgttgtttcctgactttttaatgattgccattctaactggtgtgagatggttatctcattgtggttttgatttgcatttctctgatcacctgtgatgatgagcattttttcatgcgtcttttggctgcataaatgtcttcttttgagaagtgtctgttatatcctttgcccacttttggatggggttgtttgtttttttcttgtaaatttgtttaagttctttgtagattctggatattagccctttgtcagaatggatagattgcaaaagttttctcccgttctgtaggttgcctgttcactctgatggtagtttcttttgctgtgcagaagctctttagtttaattagatcccatttgtctattttggcttttgttgccattgcttttggtgttttagtcatgaagtccttgcccatgcctatgtcgtgaatggtattgcctaggttttcttctagggtttttatggttttaggtctaacgtttaagtctttaatccatcttgaattaatttttgtaaaagatgtaaggaagggatcccgtttcagctttctacatatgaccagccagttttcccagcaccatttattaaatagggaatcctttcctcatttcttgtttttgtcaggtttgtcaaagatcagatgattgtagatgtgtggtgttatttctgaggcctctgttctgttccattggtctatatctctcttttggtaccagtaccatgctgttttggtccaaaatctgcttctttcttcaactcctttctccactttggatttttatatgaaagttttattatttggcttgaggtgttctaaacagtgttgggcatttacatagaagataaagtctattcctgttatcacagccctgccctttgcattaggattggtcaatatattttaagtggaaatagcttatatttgctatgcagagcactatagataccatcagttccttcagggaaattcctatgtgtttgaaaattgaccttaataggcaggtagtcagcatttcaaacacaataagaaactgctaggtatgacttgaatgcactattggatacccctttatttccatatatgtagttaaagtgctggttatttttaaatctgattcttgtttagtttatcttattgttgcagtggtcagtggtatacattaaaaggcagttataatacttttgcttctttcatgtctaaaattgtaattgcaacattcaagtgattgaattgttgtcagctcccttagtcatgccccacctttttcttttctattttaaaatattggcaacaacattttccattgttttactttgtcatttgtctcttttttaattgttacagatctgtgtaaatgacagagacagaattctactaatctgtcaaaccttgttttctagtctcatctctcaatgtccagtatgttgtagaagcttaaatttaggtgccacatttaattagtttgagatgctcttgtatagcacagttttaatacatggttcatatacttcaatttcttcaaaatagtaaccatttactctacagtagtatatccatctcctttcctaaaagacagtttctgtattctgagtcatattttgcttatattcgatagagtggcagatacacaattcagcatgaaaactattatttatgtagatattgtaactgttttatcttgcattggtttaatgataatacttgagttgtttctttcccagtctcgccaaaaattttctacatgttaaaagcaaaaatttgatggagtttataaattggtaccaactttatacccaaatctaaaagcttaagtgtatatctgtctttaaatgtacaaggcacatgtgctttgtggaaagagattgaaaactagttttggacagaaaatttattcaacctttaaccttacttgttagctgaatgtaaaatttcagtttaataatattttcatgtatttttatttaaaagtcaattattttaaatgtaaatcattcctttgagacctgccatgaactttgttgtttttacttggagttgtagttgaaaaaattaagaaagtaacacccatgatgctatttagtataacatcttaaaagtctatggcagtgaaggtttaagccctagttttcattagtatcaaccaaaacaggctaatttgtaacactttgttcagtgtagcaagataaggaaaattaattttgtttcaacctgttttattctttgtgatgaaaatagctaattccttcttaagttactgagtttttgagttcccagaataattgaaaatttcaaattattacttgaaatttaatatattaagagtacttaatattttaatgcattgattgcttttgaacttgtaataattcggtggggtaagttagttaaactggagtggtttgaaagctcaaaattatttcttgttgattttctaagtttagtagaaacattggaaatatcttgcttgtactgaaagaattattgttagggaataattctacactatcttaagaatttataattttaacagagtgataccttcatcaacctaaataccagtaagtaataattatatacagtgtcagagagtagatagcagttatatgcattgtttaaaaagaagtagcataatttgctgtatagtcaaggagttgcataggaaatttttttctgatttgagaaaaaggaaaaaatctcaggtttgagagttgttacaaagatattctgattataattgctaagatgagacacaggaaaagagacattctgttttttactattacctagaactttttttggtcaagttaatattttaacattgatggaaaagaatgtgatggtagagaggaaattgtaagctcatgtttgttgtttaggtgaaaataaattggaaaattacgagcaaaataaggaatgtcatcaataatttatatgttgtgatatcttttattttccttcagtggaggatatataggaatcaagtctttgctgaaattaataatcattcttagtgtttttcctgatggatccacatcccacatctcatggacttgtgcaaatgcctagtaatttaattaggacttaattcaggattctttttttttttttctgttttccaaataaatgtacaactgattatccctttttttttttttccaggaatctaggtaaaaatggcttatctaacagtagcattttgttggataaatgtccacctccaagaccaccatcttcaccataccctcccttgccaaaggacaagttgaatccacctacacctagtatttacgtgagtctgaattgactgactagaaataaaacagtgtttgcaactacctgtctttcataaaatctttaaatttacatggatgccctttaggaaacattacaattattggcagcagattaaatagtttgggggcgggggggaagatatattcaagaagattttgtaatagcatttttaaaggaccttctcagctattaactgtgatgatattagaatcatgagaaacattttttattgccctaattttgagcagcgttaggaaaaagctacctaaaagtgtaactttttttagtaaactgggttttaaatccacattctacttagttatgtggaccttaacattcattctgttttatacatctacccccccaaaaaagatactaccttcaaaataagtgtttgagaacataagtgtgatagtagatatatgtgactaaaaaaacttaataggttatttaaaacatttaaaactagatactagttttactttatagaaatataggaatctgatataggaagtcattagcagttcaatcaaaacaattcctatttctgtttcttccaaatagatcttcctatcctatttcctttcattttcctgcttctatcccaaattaaaattttgtaagtataaagttagggtagtatatgtataatgatcttgcatctataaaatggtactagagtttgttttatagatttaacccccttgccctctagaggccaaatattatcatattaattcttcctccaaccagttgttgtttatcccttactatgtaagggaagcactgggatagacatgtaaaaaaacttgtaaagtgagctctgaggagaaaaaaaaatgcaaaattaagtttttatcttttatgggtcctcttcagtctgctttctttgataatatttgtttaggcataattttttttcttttcctctcttatattgtgattttttaaaaacacatagcataaaatttaccatcttacccatttctgagtgtgcagttcagtactgttaagcatattcacattggtgtccaaccaatctccagaactttctcatcttgacaaactgaaactacacactgaacaactacccatttctccctcctgccagcccctggcaactaccattctactttctgtttctataaatttgactattctagatacctcatgtaagtggaaccatacaatatttgtctttttgtgactggcttatttcacttaacataatgtcctcaagattcatccatgttgcagcatgtgtcaagattgtcttttcattttaagactgaataatatttaaaacactttgattttgaagtttaatttcagtttcatttctcctacatatttttgtcatgataaaatggaaaggagaaatgtatgtggttactatctgattaaaactagaatcaaaagtcacagtgataagatactgtcaaatagaaatatcaccccataaaatgcgttatttaaattgtgaaaaataatgaatattaatttggagcataatatttaaataaaagctctgttttcctgagatctaaccacatattttaattttacagttggaaaataaacgtgatgctttctttcctccattacatcaattttgtacaaatccgaacaaccctgttacagtaatacgtggccttgctggagctcttaagttaggtaagccttaaattaaaaaaggaaaacgtttgtctctttgttttgctatcttttaacttttccagcactggcagatacttttcttttttttcttttttctttttttttctttttttgtattttaattttacttttttttagtactaagaatgagagagagtgtgtgtatcacttctttaatccatgatgtgaatatattgttggtgatactggttactgacaatttggtggaggtttttaaatttagctattactttggtccgtttacataattgtgatttaggttaatagaaaaaatttgattataaaatgtaggtgaaatttgatgctactaataaatactatagccccataagtatttcctggcatctgcagaaattaaataaataagtgaaatttcagtcctttcacacttaattctttctcggatgggatgacatagcagttagattcagggcttcagcgtatggttctgcaaacttggcacatagctcaggttgtgcagaggccctagttttttatgggaactggatacagtgccgtaaaatgctttaccttcttcctttaaaaaaaaaaagcacttaaaatattatcccaaatataattttcattttttaactacatttatgtattcatgaagacctgggacttttctctactaaaactttggtggaagctaacaatgaacatatggtagaagtgaggacacagttgttgcagccagcagatgaaaactgggatcccactggaacaaagaaaatctggcattgtgaaagtaatagatctcatactacaattgctaaatatgcacagtaccaggcctcctcattccaggaatcattgagagtaagtatttgtatcctaaagattattttaggattttaaagatgattttactttggagttttgaaaggacacattacttttatatgcatctcatcattttatgttacataaaatactttgtaagtgttctccagttgtctcgtatgtatatatgtatgtatgtatgtatgtatgtatgtatgtatgtatgtacgtacgtatgtgtattttgagacggagtctccatctgtcgcctaggctagagcgcagtggcacgatcttggctcactgcaccctctgcctcccaggttcaagcgattctcctgtctcagactcctgagtagctgggattacaggcatgtgctaccacgcccagctaacttttttgcatttttagtagaaactgggtttcaccatgttggccaggctggtctcgaactcctgacctcaagtgatccgcctacctcggcctcccaaagtgctgggattacaggcgtgagccaccgcacccaccctcagtttgcttttagtaaaatctaaacaaattgatggattcatgaagtaaatagcatcatggggaaatagaattactgtctagtgaaatgtctcatttctgggatactttttttagagcagggtttcttaacttcgatactattgacattttggactggataattctttgttgtggggggactgtcctgcaccttgcagggtatttattagcatctctggcttctcaaaaatatctccagacatgtcatataccccctgaagggcacattcactcctggttgagaactactgatttagaggataaactaagtctcaagtttattttatgcttgtaaaatccggtttggtcttctcatttttttctttagtgctatctcatagacaactcctgcaggaaacattagtgttcttcttaccaatcttaggctgtaagagaaatctgaaggaggaaattaaaaaacaaaaatgtaaaaataatcaggattattattattaaaagacccatatagccctttcagcactgaagcattacaaaaatcctctagcactataatgagaactttgtgaattctcttacaaagtgaacataatacatccaaacaaatgagtttattaaacgtattactcaaatacttgtctgcactaagttgttttttcttcaaatgtcctaccactgacagtatgtggctgaaagtctttaatttgtgattcattagatttgcttgttgtctttgtttaaaattctgccaactcatattttcaatcaagatagcatttctgcctgtaaattgtatatttgtcttcctttccccctgccgctccctatatattacaaagaaattcttctaataaaaactatcctgtgactttactgagttgcagtgaattcattgtccatataactctgtagttcagactttcaagatacttcaagtacctggtaatattatagtcagaagagaataaatagtaagaaggagtcaaagatcatcaaagaaaaatttggaggaagagttgaaaagcaaagatagtaagaggcagtctatttaaatggggagggttccatagccaaagaaagcttggggttttgttgttgtttttttgagacggagtttcgctcttgttgcccaggctggagtgcaacggcatgatctcggctcactgcaacctccgcctcccaggttcaagcagttctcctgcctcagcctcccgagtagccgggattacaggcatgtgccaccacacccagctaattttgtatttgtagtagagacggggtttctccatgttggtcagggtggtctcgaactcccaacctcaggtgatctgcccatctcggcttcccaaagtgctgagattataggcatgagctaccgtgccctgccagcatggggtcttttagtatgctttaagacatggaccattacatgtgaaaagtttgacaaatgttcagacactatacatttaaaggaatggaagccaaaggtcagaagtattgctaactcagaaatcataaaacagtgttaacagatatcatgtctgtgactcaagagttgtaaataaaagtaatatttgcattgaaaaatacctatatgtatccagcaatgttctaaacattttgtcatttgtgtgtaattcattgtggaataaatatcccctggaagaacttttcctttgttcataatcaagaataaaaagtatcttatcttccactattacacatatatagctatgtacacatacatacacctctgctagcttatatcatttataatcaagattgggatgccctaggcctttcagctttcctcaagttttctctcctcttgaaaatggggcaggtatgagaatctgtattataactttgtggctagtggaggaagttggataccatgccggtgagattcaacttttcttgggtatttatttattttttattttttattttttttagacgagtctcactctgtcgcccaggctggagtgcagtggcgtgatctcagctcactgcaacctccacctcccgggttcacgccattctcctgcctcagcctcccaagaagctgggaccacaggcgcctgcccccatgcccggctaatttttttgtatttttagtagagacacggtttcactgtgtcagccaggatggtcttgatctcctgacctcgtgatccctctgcctcggcctcccaaagtgctgggattacaggcatgagccactgtgcctggctttcttgggtatttatttatttaatgtggtgtttgaagaaattttcatgtgtaagaggcctatagaaacttagtttcaaggccaggcatggtgattcacgcctgtaatcccagcactttgggaggctgaggccggtagacagcttgagcacaggagactagcctgggcaacatggcaaaaccccatctctaccaaaaatacaaaaattagctgggcgtggtcatgcgcacctaatagtcccagctactgaggaggctgaggcaggagaatcgtttgagcccaggaggcagaggttgcagtgagccggggtcgcaccactgcactccagcctggtcaacaggagtcaaaccttgtctcaaaaaattaaaaacatgaaacttagtttcaaaacacaaataatactattcaatctagatatgaactttttttcagttgtatggtggaaaggattgccagttgtagaacactaaactagactgctttttgcttaatctataggaagaaaatgaaaaaagaagtcatcataaagaccactcagatagtgaatctacatcgtcagataagtaagtcatttttaatgtccacttagtatttctttttaaaaggcatgtttctaatactgtgtctcttttttaagttctgggaggaggaggaaaggaccctttaaaaccataaagtttgggaccaatattgacctatctgatgacaaaaagtaagtccttgtagtaatatttctgtgaactgatgcaaagagttatcctgtgctagattgggaattctctacaatttcctcttctgtttcatttattgtcattttttttaagttgacatgaatttaagctaaactttttttgctacattttacaattaaaattttaaaatttttttttaaaaatagagatggggtctcactgtgttgcccaggcttgtcttgaactcctgggctcaagggatcctcccacctcagccttccaaagtgttggggttacagttgtgagccactgcaccctgccaaatttttttttttacttaaaacttttctgcagtttttcatcaagactctgactatatgctaattacataatcacaaattatatttttaattatatgaaatagttacgtgaaaatgtatttataaaatataattgtacaactattaaaatagtttttttcttttattggtgaataatttttatgcctattttttgttgggaagttttctttggaaaaaattaaaaatttaagcattttcttatggaaaagtaaaatatttatagacttaattgttttttctgattggaacacaagggttttgaagaaatggtaaacttccacaggtatttgtagcagagtttcacttttgatgtgttattttattgcaggtggaagttgcagctacatgagctgactaaacttcctgcttttgtgcgtgtcgtatcagcaggaaatcttctaagccatgttggtcataccatattgggcatgaacacagttcaactatacatgaaagttccagggagcagaacaccaggtaatttgtatgaactaacatatcttgttaaaatggaaaacaaaatcaaaatatgaaacatgcaaagacagccagaatcttgtcatttataatgaataaaactgagagttgttcctgttataagactttttaactgggctcagattaagatttttccccttttcattatctttttttagtgtaatagcccagaaacattataacaatttaatctggaaaggggtcattggagcaccactgggaaataagttcttttggcctgaagactctgttgtcaatcccatctgttgcagagagtgatggggtgcagtgtttttgaatttttcttttaacccaagtaacaataaaaagtatgttttatatgtaaccgaatgcacatgtatgtatacagcagcagttttattgaacaatacgttttccaatctattctattctgtttcatttaaaaaataaagtgtaggttgcagttttctaagtggatcacaactcacggttttaaaaaaacttcatcatgtggagacattactagactcattctaataactagtctagactttgccactaattaggcttgtcacttttggcaagttacatttcttctttaggtctttttcttcatttataaagtgaattacattgtttttagacttaaattttccatccagtactgaagtaccatcttctttgtgctcttttgcattgacatgaaatttcacagggtgatattcaaaatatttaacaattgccacaatcgcagcactgatcaattagaagagatactgttgatgaccagttcagctgtaccaatgtacttggggctgcaggtctccctcaggtgcttctctttgctacttgatgcagccatggtttgaaaaccagactgcttccttctttgttcacattcttactgagtcgtgcttaagaattttttcagaatagggctatgcttgcttctgggtaaaatgggtcagtggttccccatcctggctgctgatttgattctcttgtccttttttcttttttcttttttaagagacagggtcttgctatgtcactcaggctggagtgcagtgatgtgatcatagctctctgtaaccttgtttaactcctgggctcaagcaattctcctgcctcaacctcccaagtagctaggactacaagtacatgccaccatgcctggctaattgttttgaggttcacataatgacttcaagttattcttccctctggacctcccaaagtgctgggattataggcttgagccaccacacctggtagctttttaaaagtatgtaattaattaatctctaggattcagatccaggcatgagggtaggtgggtgggttggttggtttttaactgaggtccccagaggattctaatatacagccaggattagaactattggttataattgttatcctcagaccattagaagcccaattctgtgatattttatccatagtcaggtaaagtgcaaagagttctggaataaatgatagaagaactatgttctgctctgtactctgtcattggacactgatataaatgttgggcaaaaaacattattttgagtaccttgttatggggtaaacactgttcctggagattagttcataaggaaaaaaatggtaatgatatctataatagctaatatttattgcttactgtgtacagatggtccctgagttgaaatggttcaacttaccacttttggactttatggtgggtttatcagagtattaaatgcattttcaacttaaggtatttttcaacttactatgggtttatcaggatgtagtcccatctgtaagttaaggagcatctgtattaagcactgttatatgcattcattagtttatccatcttcaaaacaacccaacaatttatagagattattattatctgttcttacatatagggaaactgagtcagaatggtttaccaacttgcccaggttcaattaatgactaagccaaggagtctggctccagagcctaatctcttaaccatgattatactgcctatcatagaagctcttactgagtatgttaggagttgacacaaaaatgctacagtgatgaagaactaaatactactagagtgttctctgttgagcatttgtaaggttttgtttccaaagacccatttttctatagaattatagtgtgatgattaatttttttctgtataagtaccgtgtgctaaccaattgcaccactggagctccaattttttttcttttcacatttcaggtcatcaggaaaataacaacttctgttcagttaacataaatattggcccaggtgactgtgaatggtttgttgttcctgaaggttactggggtgttctgaatgacttctgtgaaaagtaggtttccaaagtaaattttcttaaaacatatattagaaagcagtaattgtaaacgacaacttaccaagctggatctcctaatggatacattgccagtattcacttaccattcagcgaagaattcattttaaattatttgattccaaacctcatattttgtgttattggaaatactttaagaaagatgccatgaaacaacttcatgcagtagtagtacccatgaattaagaagatagaaaagttgagttattagtttaatttttaaaatgatgcatacttattcatttgaaatgtgtgtattccaagaaaaattgttttgttataaatggttttaggaagtagaaggaattctttattgagcacccgtataggctgtgaataactcaagcttgaccataataccttttgccatatcatgatataaattctttttaaactgacaactttttctatgaagaaattttataaaatgtattatttattttttatttttaaatagagatggggtttcaccatgttgcctaggctgctcttgaactcctgagctcaggcgatccacctgcctgggcctcctacagtgctggattacaggcatgatccaccacatccagcccagattttgttttctctagttgaaagaacttggatagttcctttccttaagatcccagaaatagcttttatttacttctgtgtcttgtgttaaaaagtactttggaatttttttttagttggtttcaatttgatcatttgtctagatagaaccttactctcttcttttctagaaccttattctcttcttttctagaaagtacttcattatataaggacctggtattttcatttagtaataacattagcaaattagtataggatgaaaatatacattatatacacatttggtgttatgcccccaccccaattaaagggggaaaacacccacagaaaacatttacatgagattactttgaaaactaattatacacatattccacatactactttatttttattttttccttttttaagacggagtcttgctctgttgcccaggctgtagtgcagtggcacaatctcagcttactgcagcctccgcctcccaggttcaagcaattctcctgcctcagcctcctgagtagctgggattacaggggtgtgccaccatgccctgctaatttgtgtatttttagtagagacagggtttcaccatgttggccaggctggtctcgaactcctgacctcgtgatccacccaccttggcttcccaaagtgctgggattacaggcgtgagccaccacgcccagccccatactaacttctaatttcttactttggtttaagaatctttgctgtaaatatttggatttagtaagaagtgcatcgtagttgaaaaacaaaaaaatatattaatccacagtttccttatataaaagcaagagataattaccttatgttgtcttctctattcatatattggtttccttcaatgtaagaaagccaaagatacagagttttaaagcttctaatgtactgatgaaataacctgattactttaatctgtactttttttatggaccagtagcagcagagaaagaacattgttatatgggaaatctccattgtgctatagaaagatttttatttcttaaactttgagttaatactatattgttgcagctatagtacaggaatccttgttcattgtttctgagtagggactggctatttttagggtgtagttttgtttcctatctaaatggagaggtgtcttgggaaaaaagataattagaataagcagatgatgtccaaaaagcttgagcgtagggataataaaaatatcaagttagaaggaagggttaggtaaatctaataactcagttgtgaaagtagtacttgcttcttcagcatttcactgtaattttgtttcacataaagattgttgcttttgatagtgactgtatactgtatctgtagtttattttatggctttaaataatacctgtcttgaaataaccattcttttgaatatatgattaaaatgatgcatgctttttggtaagtttgatttttggggcggggggtgtctgtttgggattacttgcttgcttttggataaaaagttttctctaattttgtaatggcaatacatgggtgaaataaggctaggatttgtgtctatagccattttttgctttataggcaactttttctggactgtatctacttggccttgtcacacacaataagccaatccttatccctttgcagttaggctaccatttgcactctagtctaaactttcaagagtagccttgcatttttcaagagagaaaaagagagactaaggttctttctagatcatagtttggcgatttcttttccatgaagggccagataataaatattttcacctttcctggtcatgcgctgtctgtcacaactgtgtcattatagcacagacacagagatagtacgtaagtgaatggacatagctgtattctaatgagttttttttacagaaacaggcagtgggctgaatttggcccgtgggccatagtttgccaacccttgatctagataaaaaattaaatttaaaccagtaaaaacaattgtaaagtatactttatcatgtgctatagcacaagacaaataaagtaagattatttcttagatcttaaggaaaggaacatttttactgtgtaagttcttccttccccaaaatatgaaatttgaagtggttaattcaattttataaagttcttttatgggaaaggttgctatgttgtttaaaaagtacttcatatcatgatggagaataagaagccagatattaaaataaaagcttaataatatctaaggaatgtttccaaagtatattggtagtagtggtcatgattatttgtgcatgtgcgtgattgtttgtttttgctgaagttgttttgaactgcatagttttaatcagctaatcatcaaactatatggagtctgacatccagtctccttttcctcagaaattaagggaagttcctggtacttgtattgccacagtgttcctgtttatggatttaaatgacttgatgtcaactccaccttccatttaccttttagggatttctaggtgctccagggagaaggcttcagtcaaaaatagtctttgttgaaatgaaattgaaagtgaatttatgtgttacttgaaagtagctttggatttcatttggatctttgaaaaatcaatttaagatggtaatgctgggccggtccacttactacaggtattataattcctgtaatcccagcactttgggaggccgaagcaggcggatctcctgaggtcaggagttcgagaccagcttggccaacctggtgaaaccccgtctgtactgaaaatacaaaattagccaggcgtggtggcaggtgcctgtaatcccagttactccagaggctgaggcaggagaattgcttgagcccaggaggcggaggttgcagtgagcctagatggagccactgcactcccgcccaggcaacagagcaagactttgtctcaaaaaaaaaaaaaaaaagtaacactgatctttagtaatttagtactcaaccataattacacactctatatacatacagcagatctttttgcacaagcaattatgtttcaataaaatgaacaagtgtttatttaaaaaatttgtgacattttcttccagtcttactaggagcttcttaatgtagttgatccatttgcattatttttttcttatttcagaaataatttgaatttcctaatgggttcttggtggcccaatcttgaagatctttatgaagcaaatgttccagtgtataggtttattcagcgacctggagatttggtctggataaatgcaggcactgttcattgggttcaggctattggctggtgcaacaacattgcttggaatgttggtccacttacaggtattataaagaatatgctttaaaaaagttaatttataaaggattatatccaataggactgttccttttttcttgaaatataactcactaaaagttgtaagaagaatgactccttgcatagaattgtaattcgtagtacaacaaattaaattcaagttaacaaatagaaatctaagagcatagatgttagcaaataacaagtttatggctttaatatacatgaaggttataataataaattttagagtgcttggttttattttaaaaaaacccttatgagagaaaacaaagtagaaaaattattctttcacatttaaaaaaatctagtgtttcatatgaatagctctgtaatgtcaaaatctgtttgaattatgcctgccttcaggcagtactcacttaaggttaagaatgtggagtttagagccagaaagacctggattaggaccaggatctggctcttgtaactttgggcaagttatttaacctctctggtcctcgattttttcatctgtataatggaagtaatgaaattaataaggtgatggtgaagagtaaatgagataatgggtaaaaataaaaacacagtgcttggcacatagtcataggaagtgctctttatatgattgctaatattattactactgtaattatcataaagcataaaaattatttttatagtgttttgaggttttcagaattgatgttgaagatatcacctgagcaggtgataatggttatcttcatatcttttggtactttgggttgctttataactgtttttttttttcctagcctgccagtataaattggcagtggaacggtacgaatggaacaaattgcaaagtgtgaagtcaatagtacccatggttcatctttcctggaatatggcacgaaatatcaaggtctcagatccaaagctttttgaaatgattaagtaagtcttttctaaaactgctgtagtccctctctttttggggagtgttaactattaagttttttttctcccttagaattacgttgacatcaaagcaaaatggtgcaaaagtctagcagaatgtattatgagaatccacatgttaaaaatatttttccctttcaaatagcccactatggtacagaaaggaaaaaaagacctatgattataaaccagtagagtcacagacctgtgcttctttcccatttccctctgaaccacctgatatcccaggataactttagttttaatatgaaaatctaccattaataacttgaggggaaaatggcatcacagaatatttgttgtcacagacaaattagcagttaatatagggatttgactaaaatgctgattttttaatttttaattaaatcatctattttttaagtatctcttttctgagctacttaaaaaaatttagtataagttatataaattcttacctagggacctagtttgaatacatatataccagtaagcttcacatttgttttcacagtttctatcttagccattttgtaaatctatttagaggtactattttcaaatagtgctatatagcagtgtttccctaaactgtgttttccactactagctctgtccccaaaagatggggaattctggctatggaaatatgggaaatgatagattaaagttcagcaagtggacaagtcctttattttttgtaaaatatttcagatactgtatatgttaatgtaatttgtgaatgagggagaagagttatagtgtatggtatttcccaaacttatttgaccagtatcttttgaagaattagttttctcaaaagctcattttgggatacactgctttatattaattgataaaaataagtttgtcttagtctttgttaaaatagagtttacattaagtatttctcctgcagatatattaatttggtcagcatgtgttgttttcaaaatactgtattttgaaagtaatcctggtttgttaaaatgatttcaaatctagatcgaaacttttatttaaacaaaagttgtgtggccaaggtaacatgcctataaattattttatgacagtcttttctcagttgcaccattttacctagttataggtagaagggtaggggagacaaaaaggaccaaaagccaaattatagcgagtaatgtactacaaattctttagaacattggatcttaggtaccatactctcgataaatataatttatagtggggtggggaattgtctgtccatttatcctgttatatgtcagaatggtactttaccctgaatagcaagttcagtgttattttttgaaacaaaaatgacctaaagtcactgaaggtgtttagtagatcacttaaaggtagttcaaggtacaagccatttatctaacagctatatagactgaaagtaactcattacattatgagtagattaggattttataattggaaaggattttaaggtcacttaatcagctcctacttaatatagtaatctcatctgtattcataatttgtggtcatccagtgacttcttaaacattcttttcacctcactataattcttgcaagttctttacaaaatggcctaaagtctacctgtcatttggtcccaatttcctaaatatatttaggatttctgcagaataaatcccattcaacaaatgtttgaaaactcactctatgccagacactgttctaggcactgatgatggacataccaatgtttaagatgaaattcctgtcctctggagacttcaattctagtagaacaagacagaaacccccagtataatttatttatatgaataagataaaatacaataatatttgggaggagggaaggtcggagtgctccttttgcttaactggtctgagagtgtgagttttctgcttagccctgaataatgagatgaaatcaactacacaaagatctatgggtagaacctttcatatacagagaacagatgaaggctaaattgggaataactttggcatgtttatgggacaaaaaggccagggtgactatagctgaatgagagaaaggaagagtgatggtgataaacttaagcaagcaggaatgagatcatacatgggctttctggacatggtaagaagtttatatattaattctaggtgttacagcttgccatagaggattttaagcaggaaaggaataggtttcactttaaatttagaaaatggatctagtgggtgcagtggctcatccctataatccttgcactttgggaggccgaggcgagccggatcacttgaggtcaggagtttgagaccaggctggccaacatggcgaaaccccatctctactaaaaatacaaaaattagccgggcatggtgatgggcacctgtaatcccagctactctggaggctgaggcggcaggggtggtggggcggggggttgcagtgagccaagatggtgccacttcactccagcctgggtgaaagagtgagactctctctcaaaaaaaaaacaaacaaacaaacaaacaaaaaaaaaacggatctaattgctgtgtgtggaatgagttccaaggggtaagcttagaagtagggaggacaaattaggaggcaattgtaacagtacagaccaacctggacagagatttccctgtaaaaatagagagagggggtcaaactagggagtcttatggaactaaagcttgtagaacttgctcatagattaggtggttgagtgagagggaaaaaggaaccaaggaaaacttatagtcttttcttcttgttgcctgattgtcattaatgtaaacattaatcacctctatcatcttttccattccctaccccaccctcaatattcttgataccctttgagactccttccagtttatcattaaaatgttgaggtatcgacatttatgttgttataaagttgtcttgtgttgaggttggacacacaaaatttgtgtgtttttctacttataatttatagtgatactgttgtttcttatacatttcttttttttaacctagatgcacttacattcttatctatactccattttgccctacgctacaaaatgtctcatcatttaaatcttgattgcattcctgtgatattaacaattcttctcccagcttgagtacctattgacacaccaattgaaaatgttaaccacaagtctagacccctaggccttgctttataagcctccctttttgaaataattgtcattgagccattgctaaaaatgtacttttcagcagccaacatggctccctttctttgatttaatgagtctttgcttattgtatgcaaggctctaggctaggccctgagggtttataaatacatggtataggtcctttcttcaagtaacagttagtgcatataaataaaatagattgaaagaaattcggtgatagatccactgatgtttccagcccaaggagtcaggtctttttaaaaaactgtgcattctggggaagaatgtattttgtgtgatgggtgaaaatgaggaggcagggagaagagaaaggaatagcacttaagccagcttaaaaccaaactcttgcaccatgagaaagatgccccagttcatccataaaatagcatacataccatatctccttaagtccagcacagttacgttttcatccagtgaaagaataaatcccttttcttcacttgagcaccaggcaaaatagttggcttgtgtagagaggccatgttgtatgaataacttcagtcttcaaccgctaaagtcatactcaacatggtaattttgaaaggctcggaggaactctgtagaggaatagcaaatgtatactccaagtaatgttctcttcctcctgctgtcattctctccactatacctctcttttttgccctccctcctgattaccctccctgctgtgcatttgcgtgagcttaaatgtatatacgatacaactgctatatgtttattgtccataattggtggtatgttttggcttgagtgcaatgtgtgatgagtagtaaaataagatacagttgtaaaagttggttagaagccaattatgctttgtgtaccaaacttaagactttcttctgtcagagagctcttggtgggtttttaattaatatgatctaatttaggtttcgtaaaggtgtttctagctattaaatagagcaaacttttggatagtaagaggaaggagtgaatgaaagattctttggcttttaagtctggatacttagatggtttaataataatgctagttaataaatcgggctcagtacttagccaagcactgagcaaagtgcttcccagactgtattatttctcacagcatcccaaggtcattcaattgactagaggtagagccaagatttaaacccatatctgtctgtgaaagtgcttgagtgaatctatggcacatgacttcatttgggggcaagtttggggagccattaaaagagttagatagagctatttagaagaagctgactagggagtcttctacctaggagttgctgactgtcttgagaggaaaagggaagaaaaagttggggatagcactttgtgggggatatgcctgtttaagaaaaagaaatacgtgagctatataacaggagagcatggagactgtattgttgcagaaatagagaaggaggtctttttccacaagcacagttttgccgtataattgttatatccatatcattgctctggtcttcaagtctagtagttcctgccaaaaaatgaagtgctgttggttttttctggtttgtgagctgtgccagttcttaataaatggttttcccttgccattccttccctctgctttgagttattttcttcatctcctgttcactctgccacccacagcagtttggctttctacccttggtaagcccaacacttctcttgttgaggtcaccagtgaccaactgttgtacatctgcaaaggcactaatgtacactttcttcagaaatctaccttttttaagcctagcatgtgaatgcctcaaatctgattcccacttgccttgtcagccatttctcccactgctgcttttaaatgtgtgcttgaattgttttctatttattaatatttttaccactccatttgctattttaaaccatctttaatatgaactgcagtttttacatctccccctttttttcctttgaatcatcttttaataaagcattaattctgtatatgttgagcatacgaattataggctatattaaaagaaaaaataacagctaaatgaaatgaaatagagaagatatacaaacatagtcttcttccttaattctcccctgaattgttatttttaattcttaaatactgtgaatctacagtgtgtaatttttaggctttcatagttaagtggtaagcccgctcaaccaaaaagaatgtaagcaaaatttaccttgtgccttctcatccgctccctccctccctcagctctacccagttctttttattcagtgaatgtttattgtgtactgcattggtacccaggtttgtgctaggtgaaaaggatttgatcacttctcagactgctcaaagtgaattgagaaaccgtcaaaccattaaaacatgtgatctttaatgatagagatattggtaagaaaccatggtggggcagcatagaggaaggttcttccgaaagagtggaaggttcagtaaaggcttcaccagaagtactacagcttcgcagtctcttattgtaaaccctttagactaaatgtgttttggagctaagaatttttagatttagcaaaaaccacagtgagataccatctcacaccagtcagaattactattattaaaaagttaaaaaataacaggtgctggcaaggatgtggagaaaaaggaacagttacacactgttggcgggactgtaaattagtccaaccattgtggaaagcagtgcagtgattcctcaaagagccaaaagcagaactaccattcaactcagcaatcccattactgagtatataaccaaaggaatataaattattctatcataaagacacatgcacacatatattaattgcagcactattcacaatagcaaagacatggaatcaacctaaatgctcatcagtggtagactgcataaagaaaatgtatatatacaccatggattactatacagctataaaataagaatgagatcatcttttttccaggaacatggatggagctggaggccatatcctcagcaaatgaatgcagaaacagaaaaccaagtgccacatgttctcacttataagtgggagctaaattatgagaccacatggacgcatagaggggaacaacagacactgggaccgattggagtatggagggtgggaggagagagaggaaaaataactaatggatactagacttaatacctgggtgacaaaataatctgtacaacaaacccccatgacacaagcttacctataacagaccacatgtacccctgaacttaaaagttaaaaaaaagataatgttttttagatttagaaaggtaattgagtacatttataatatatcgtaccttcccagcagggtctgttgcagtatcctgggaacgaacatattagtatttcagcactaaaacatagaaatagtcactctaatgagctaagtgaataccgtaagtagccccaggtcaaatttcagcaccacatgagtttatgcaagatttatgaaaaatttgtgggattataataagggattatgaacctgtatttgcactgggttatttaataatgggaaatggtgttttcttctgttgtcacctcctgattcctcattatcattttgagaataaatcgcctgtacttccttaagcaaatcagtatcactcttgctttttctctgcactttcaagttcaagtctggtctttaaggaccctgtgattccataaagttctgtttatctgagtaagtcatttagtaaatctcttcaaatttctacaacctagccattttgctaaaatacattaatcatattctgcttcacattcttccagatatttcctatgttggcataagtcaaaagaatatatattatcttgattacttctttcatttgataatgcagtgaacttgacttaaaagttcacaacctaactacttaggaaaatttaagtggcagctcagtggataactttctcttttgacttcatttaactatttaaatgaaataacttttctctgcaaatgaacttaatttctcctttagaccaaactttaagtgtctttccctggtttatgccatacttgtgtgttcatattagctgaagatagatttaaacttttgttgctaaaaatttcaggtagacttcacattggcaatgactgccaatgagaagtctttatcatttttaatattttaaataatggtcaaatttgcatgttggatcacttggtagcaagatgaagcattaaatggaaggcagaagatttagagacataaattagaaggtaattgctccagttcagacaaaaggagagacaaagattagagggtaaaatagactacacttggtaattgattggtggtagagttgagcgagaaatctgtatcgctggactttggcttgggccagacagtggaacatttgtgcttgttgttgaaactggagataaagaagaaatgagttgggtgtagagaatgatggttatcaacttgactagctttagacatgcagaacttgaattgctcctacaagatttaagttgaaatttctattaaataacagctagatggatgtatggttctattgcttagaaaaggagtctgagataatacatttgtagccctcagctggctgataggcaatcactgctaaggtattagctgttgagttttccgaaccattagttatttttaaggtagagcagtgcccatacaaagaaatgaataaaggaaaactttaagatcaagggtactgatctcctttaattcattcaactatgatggtttttctaggttaatatatctagtctcctttaaaatatataaaatttacatgtataacacatcactgccctcctccccaacttgtttatactttttcctccaacttttactttgaaatttcttaaacctacaaaaaaagttgaaagagtagtacagcgaatacctgtgtaacctcatctggattcatcagttaagtttttgccacatttatttagcggtctctgtatacacatacatgcttgcacgtgctttttcatatgagctctatgaaaaagtaatttgcagacatcatgacatatcacttcagatacttcatcctgcatcttaagaataaggttattctcctacatacctgtaatacgatttaccatatctaggaaataagaaattccatagtatgagttaatacacagtccacatttagatttccccaactatccaaaaatgtctttttttttttttaagcacttgcctctccctattgaattaaggttcacatttaattgaatatgtagtcattgtgtcttctttagtctcttaaacctacgaaagtctttttttaatgacattttcttcttgaagacagcagacctttgtgttgtgcagagttctacattctggatttgttttctcataattgtatttagggtaaatttttgacaaaaactactaatgatgtttacttttgttaaactcctgcctcactccagtataaactatgtcagagatatcttccttagtgggtcctgagtaaattaagttttactttaaaaaggcaattttaaaacttaaaattaggggtgaggagattattgttactttctagtccatctttttcatagtatatggtttttatcctgtggctttaattttacgactggtagattaagatttaaaagaaaccctcactgggtgcggtggctcacgcctataatcccaacactttgggaggccaagtcgggcagatcacaaggtcaggagatcgagaccatcctggctgacatggtgaaaccccgtctctactaaaactacaaaaaattagctgggtgtggtggcacacgcctgtagtcccagctacttgggaggcttaggcaggagaatcacttgaactcgggaagtggaggttgcagtgagccgagattgtgccactgcactctagtctgggcgacggagcaagactctgtctcaaaaaaaaaaaaaacccctctgcaaattcatgattcccattttaaggtatttgagatacagtactttgggttatattttatttttctctttgtacaatactaagacgctttacgtcattttcataagactcatacattccttgttttgcctctgaagtattttttttaacaggacatttgaaaggaatcaagtgttagtgcaggagatgagctctgcagactgttggtactgatgagagttccctgtagataacaggctttcagaataaatagacttacaggtgcagttgataaagccgacccccagcaaatatgccataagttgttacagtcatgttggactgttgtcaagttagtgcaatggtagtatgttttcaatacattggaaactttggtttattcaccagcaactttgtgagttcacttaaatcaccacgataagtaatttagtaaattttaaaatatgtcaaaaacagaatgccaaggagtgcattttcctctgaaaagtttaatgttaggaagtctcagatttaggaggagcatatcaaatagtatgctgaggagtagaaagttaattttgaggatacacattcatttgtcttacgcccctgtaatctgccagacactaacacattctaaaaatgctaataacatataagccaatgtttgaaaataaattctcttcaatttcaacagtgccaagctcattgaaaaccactcttgcacaaacttaatttcttgtcatattattttgttattcttttgaccatcttataaagcactgttttatattttttctttttctttcttctttttttttttaattaaaaaaataaagacaggatctccccatgttgcccaggctggtctcaaactcctgggctcaagggatccccctgcctcggcctcccaaagtgctaggattaacaggcatgagccaccatgcctggccaatatttcagtttttaaatgtgccatcttatatgcacaatgttaatgttttatgtgctttctctgtgccttttgtgtatatgtgatcactatgtgttcgatgtttgcccatccatttttattttcctaagtcttagagtctatgctatttaatatcccagtaagatattacaggaagggcagcattgtgtagtttctggaatccaatctgccttcatatcttagcttcttcatttattggctggggaactgcggacagattgctaaacctattagtctttatttcctcttctgaaaaatggggataatactgtctttctaaaataacttttatgactgttatgtgagtcttagcatacgataagcattcagtaaatggtagttgttgtaattattattattttatagaaaccccaattaccttctatttttttaattaatattcttggacctagtgtagtgcttctcaaatgtggacaatttttcctccccccactttcctttcccaggggacatatgccaatatcatgacttgagtgggagagatgctactagcttttttgagtagagattaggaatgctgctattaaatatcctgcagggcacaagacagctccccataacaaagaattaccataccaatagtgctgagattgaaaaacccttatctaatctaatggaatccagactaaacaccttttgaataactttatttcattttctttttggtgtgttaactattatactttgagttggcattcatcatacaattttttcaaattaaataactttaatttagtaattatatgattattttaatacagtttaggaatttgacatgtcaagttcaaataattaacatttattgagcattaactgccaggcacaagtctaagcattttatataacatatgtaatcctcataacagcactgtaagttaaatatccccttttttcagctgaggaaactgaggcacagaggtgtgcagctggaatttgaacccagacagtctaggtatagaatctgctcttgcccactctacagctctttctatggtctcttaaaggctctaatcctaaaaacacagtgattcgtgaagttgatattttaccagtctattgaaaaatacactacaaatctgagacattggttttaattttgacacttacgaagtaagaggtttgcactggttctctcacttgctgatcacaagaatcacctggaactcttattaaaataggttttcagagctctatgcaaagaactctgggaacctttttcatggtggcctagtgaatcttatcagacaaattaggtcttttttagaactaagaatttctttgctcccttttctttcacatacattataggttattaccttacctacctacataaaatatactttatcacaaacacagaatttcaaaatgtaaattaaagcgaactcataagtattaactcccttttctctttgattcccttatttaaatggataaatatggtgttatacaactctttagtccacacccatttgacctaataatggaccaagatttttccaacactatgcgtagataatggtatagccataaagaccagtccatagttagcattgatcctagtgatgtagtgctgtagtcctggtggtcttctaatactctgttgggtttgatatataatgctttttgataacaatgaccaaacaaaatctaaaaattctaaaactgcattctcatggttaatatatatgtatttgctttcatgcttttttccccccatctaggagcttaaagttcttaagatatgcgttttttcattgactgagaccttgattttcagccatgtggttggtgtaaataaaactgttagatgccttattgacattcatatacccactattgtcctaggagaacacaaccctggagtgacaggtggcaagagagttttcagagctcatatgttggcttgcttttcctgcatggctctttcagtaagggagactaggcagagcaaggcacctcttggtgttcgttaagttatctacttctcagtggctgagactgttaccataaagcatttaaaagtgcagtaccaagttaacccatatttcatctatcttcacattgatatttggtaacttactttggaaactgagtcacattgccattagaatgtcagagtaacccccagtgttgtcttaactttgatgtaatataatattattatggcttcattcctgttacttcctgccccagaaacgtcatgcgaagattaaaatcttgtaagaacagttgtttgttccccaaagaagcccccatactaccttcttgtggcattctttctgtaccgagtgtgccttcccccaactctttttcctgttcataatcaattaagtaaattgattcagaaatttcaacttctgtttgaaaacttatgtgattctctacctcccctcacctgaagatgatctctcgctctccttttagtatccatagcatactatgtttattttttgcctaatgtcctcatgtattgatttatgaatatattgtgcattaattgcccataaatataaggcttttgataatttgtctacatattattttattcagttctcttgttctaatattgcaagtgtattttcattctattccctgtgtgaagttgttctctaaaattctatcgctctttaagcttcatctttgcagatcactttttggttggattagattctagtatataacctcaaatatgccaagctctcaatcagcttcttcctcatggttttcttccattctggaacttcctttgtcccctgcctttttgtgtagtctttcatcgaaacaactaaaaacagggattgggtcctgaaaccaatactgatccttaaacgtcaaagaatttcctgcttttctagctgttgaaatcatttttgaccttgtttctaaagtacacgtatgcaaaatagcattttccatcttctatgtgtttacaccttttgcaaatgatttattcttctgtttttagcaaattgaattctttttttttttttttttgagacggagtttcgctcttgttgcccaggctggagtgcaatggtgcgatctcgtctcaccacaacctccacctcccggattcaagcaattcttctgcctcagcctccccagtagctgggattacaggcatatgccaccacacctggctaattttgtatgtttagtagagacggggtttctccatgttggtcaggctggtctcaaactcccaacctcaggtgatcacccgtctcggcctgccaaagtgctgggattacaggcgcgagccaccgcgcccagccctcaaattgaattcttaattaccataaggtaaacttacagaaattcagcaaaactaaaattaagaggaaatgagaatcctgattttgtttagcttttattttttagctctttaatgtacttaaatgttgtctttgtataaaatcagtctggggctaatcaaagcagaacaggttatcatttaagtcttaaatattatatgtttctttactacgatcctttccctaaatcactttgctttctatttttccctatccttcaattgaatcacattctttcttttttaggacttgctcattactgtggactccataagagcctctctctctctaaattcttctgttccaagtgctgccttttgaaaaggcgaaggaacaaaaatttccaatgttaaaaaagtaaaggcaagcagaaatcacagttttgttattcatcatcagataagattaatagaactgtcagttttctaagattttggtatcacacaaaatataaaatataaattctggagcagaatttattccagaagcagactgactacttatggcttaatatttattcttagcaaccttatctcagaccccttgttatttgcaggaaatcagtatactgccttttttaagatgaaactaccaaactaacaatacattgtaaatttacagtctaagtgccagtgtagtcagtggcattgaagatgaaaatttatctgctgagtaacaagtagcctgatactccatagaaccaaggctctgtgtttggaaaaactgtgcttcctgagcccaagaatctcatcttcgagggggagtgggtgataataagatgtgaggagaccaaaaagaagggttacagtgtgagatagtaagggggaagcttgagattttcttttaaaaactcatagctcaaccacttaaatagctttatgacattagacaaacttaacttctctgcgctcctttttccccatttgcaagatagagataacctttctcccagggttgttaggaggcttacttggcataatgtatatgaaatagcaaatacatggcccctgtctggttcttattttttatttgcttttattatattatttttgtttggccatgtggaaggacagttgagtttgaagtcttccaatggtatctacagagttttaggcattattttcctgtaagagaccttattttgaagccctacttggaaaacttgttcagtaagatctgtatctttagaagtgaattgtatgggacatgaggagggacaaagaggagcaggtgctattcaagagctagagacagagtctgaattatattctctctttgctatgatctaaatttttacttgctaccttccctggtgccctatacaggcacgcatgcacacatcaatagctgtcctaaccttgacacacagccacaggctaaagcaggggtccccaacccctgggctgcagaccagtatcagtccttcgcctgttaggaaccgagctgcacagcaggaggtgagcagcaggcaagctggcattactgcttgagctccagctcctttcagatcagtagtgttattagattctcataggagcaggaacactactgtgaactgcacatgcaaggcatctgggttccttgctccttatgcgaagctaatgcctgatgatctgaggtggaacaatttcatcccaaaaccattcccccccgccccttcccctaggtctgtggaaaaactcatcttccacgaaactgatctctggtgctaaaaaggttggggaccgctggtctaaagcaatgtttttgtttctaaataagttaaatatgcaagaattgttgaagccaagctgagagtgcaatctttgaatattgcacttaaggaattgacctacaactataaaattgatattgttttatatttgttaagtaagctaacaggttttacaaatgtttttagtcattccccacctccccacccaccaccaggttaatatacacgggttctgatacataacaatactttaacatagtaacgtataaaatagcaaagaaatataaaataaggtatattaaatattttagtacttatttgaattttagttgtgtattgattaagctactatatgctaggcactgccctaggtggtgagtagataagtagatagcaggaataaaatagataagacctttgctttcaagacaacactcagttgctaaacccatttccttttctttaggatattttcattgtctccgaattttagagctgaaaagtgccttagagatcatctagttcaacctctccgttcaaatggagaacctgagccactaagattcacaggagagtaagataattgagcaaacaactccaagtaatgacagaaaattataggagaatcagtacaaattgtgagaatttactatgttgttagcatcctaagtatgagtttagaaaaggtagaagttataagaaaagttaaattgttttaatatgaatggattccactgttaccttcaagataaaatgaagacatacttttttctttagtattatagttaaacgaatattgtatcctgtagtgactaaattcataaatattttttctgcttatagacttgagtttcaaaagcagctgtacagatgatgctgttaatgagtgtttaggtagtgttgattaaaaaaaaaataatgtgccttcctgccttactagaatcatagaagttcatatctggaattcataccccttatttcacggatgaggaaattgactcccagagaggttaactgacttgcccaaattaagagccaaaattagcaactcacatttaagcagggagtcagtttttatgtactaagaccattatattttgatatccagatattacttttctcaactttaaatgttttaatattgtcttcatcaggcctgctgagcattgtcattttaaaatctgagaatatttgataaattgatgaaagaaaaattatgaagtcatagacattagaatcaagtctcttggcattatttctagttggtatatcttttatgctaaaaatattcaatattcagttgctggtcacaaataatttctcccccacaataggtattgtcttctaagaactctgaagcaatgtcagacattgagggaagctctcattgctgcaggaaaagagattatatggcatgggcggacaaaagaagaaccagctcattactgtagcatttgtgaagtaagtaattgtttttatccacagttgttttataaagcctcttccctctccactgttggtttctctttatttttaaaaaacttttttatacttttatgtaatccagtttatagtaattaacattggattcaattttgttgcttagccattatattaaaattcagtgtgataataatgatatttcactgtgaattaaccttaaaagtatctactgcagagtcatttttgtggtagatcttcaacagacaataatcagcaaatttagtctgagattttaaactaagaacaatctagatgtacacagatgccaataaactggatgtttggtgtaactctaggcagatcgattatcagtcctctctggtgcaattaacaatacatttgtcaatcttgtgtggccaaggcttgcaagaggtgcaggaacaaagatgtggtgcctcctatgaaggagcttaaattctacttggagcagacagattataaacaactaattgtaatgtacatgagactatgatgaatgtgaagttggacttcctgttaatgataacactgagggggaaaatgacctaattttttcttctagtattggcataagaactcacaaacgtattagcatttgagtccatccttggaaaaaagagtatgatatcaagtagactaaaaaagtgatgagaatcggaggtagactgtcatgggctataggcacaagaagagaacagggaaatgaaatggttttagaaaaggttgaatgtgttccgatttggctggaacacagactgtgcaaattccgctcataagtctaggtggcatttaatttatagcacatcttgaatggttttaaggaatttgatattccaaggttattgaagccattaaaaggttttgagcaggcaactaagggtaagtaagatatgtgtttcagggagaaaagtggttggaaaggacagcgatatataagctattgcagtggtcttaagagttatgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcacattctcactcataggtgggaattgaacagtgagatcacatggacacaggaaggggaacatcacactctggggactgttgtgggatggggggaggggggagggatagcactgggagatatacctaatgctagatgatgagttagtgggtgcagcgcaccaccatggcacatgtatacatatgtaactaacctgcacaatgtgcacatgtaccctaaaacttaaagtataatttaaaaaaataataataataataaataaataaataaataaataaataaataaagtacctgtaaaaaaaaaaaagttattttaaggcctagactagaacctggcaatgggaatattaaagaagggaaagaattcaaaaatatttagagggtaaaatcagcgagacacctcattaaatggcagaagtggaaggacaagttgaagaatgctcaccaattttctagctcaggtcactaggtttgtattgctgcttgttgacagtaatggataacatggtgaactctaggattgtagttaactgttaaaagaagacatgggatcataagagttttctgtcattgaagaaatttaaggataagccaaagacaggatgttgatggtccatttcaaaccttgaaattctgtaattctagcatcaacctttatttgaaatgatagaatccattgattttttttttaaatgtcatatggcctgaccaaagtgagtcattaggagatcagatagattccagttaggtgtgttgttccttatcctacctgaaccctagcaactcatcaatctttctgtataagatagaggtattatttctaaaatcatgctgtactcatgaatacataaaaatgatcacttatgtctgattgtatactaatgttttagatttaaaaataggttgacctttatcaaacttttgaactgggctttgccagtggttgtcatgagtatgtcattccctttgattattcccctaaatatgcattactacccatgtctttggatttggtgcaaaataaacctggtctgttaaagattctcaaacacagccatgtttttcttaccacctactcttaaccagagatcactgtccacaatttcattcaagtagaattccatgattatactaaagcagtacagtaaataccactatctctattgaatacgtttttctcttgtataaaacaggtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagtaagtcaaatcaacatgtgagtacatagttagctgggttatgaagcagcagtgtttgctctgccacctgataagtaggaggtaatgaaatattttaaattttcctttggctcattatatattgcatgagggtatattcatatcattcccccctccatttccaagtatttattcctataaaattggcatatatcattttcagttttcctgggtgagaccagcctaaataattttacaacaattacatttaaaaatctttgcgtgctttagatagaacactatcatatcctttatgtcattttatctcagttgataaaatgtttgtgtacgtaggttattagagcccacaaaatgaatcagtaagtgtgcttttaaatatacttctgcttttagagctaattgtatttgtttaaaattttgtccttgccagaagtattaacctcatgggagtatttaatggagcttaacttcctggtatattatgtaaccttatgaaattcaagtatacttataaattgcacagtttttaatttcagacagcagatgcttgggggaagcattttactttcgcagatcaatagctttatgaatagaaacacagagataatttatgaattgttgattttctccagtacttgtctcccacacatatgtgatcagaaactaactttttgaaatttactttctgatattttcacttgaatggtcttcaagattgcttgaagaagaaaattatctgaaatatgttgaagaaaatatattacctagctgagatagattctgaaggcagtcactagtgaaattgtaatttgttaaattattttgcaagaagccccctttttttaagcaatcttaaaaaatggtaaacgtaataacattccaagagtttttgactaattggtgaagaagtatagaaaattgcaagtacactgagtaggataatggtcttagattcttaggaagattggctgaatgggagatagtaaggtaggctgtacttttatgttgcatagcaggctgttgaactttttgagagttatttcccctaacttcacaagcagactatatgtttgtagccatgagctattaacaatttgtatatcaaaataacctaccttacttttattttcaggctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgccaa

SEQ ID NO: 2556 - DNA, 36350 bp, Homo sapiens
  source 1..36350: mol_type = genomic DNA
ttgtatttaaaatgttctttttttatttgtcgtttaaaaacaaacttggaagaagcaaaatccaaaacttgccctttgcctctcgcaacataaatatgtacagttcagaatgatcgctgatacaaaacatgccaaggacaggggcgctgagggtggagggagagagggcgctttaaaaaagggaaccatttcatccgttgttacgaaggaccaaccttgctgtacaggatacacacaacacaaaataaagtcttcacgggattcacacttgtcagcgatttattttttaaaaagggggagggtcctggaggtgaggggagaagactgtaaaggggaaaactgaaaactgagtatgtgcgagtgtaaaccaacccaaaatacaaacacgggggcggggggtggggtgggggattctgatgcaattatacaggcagggtacttaaaaaaaaaaccaaccaaaattccaaccttgtagcttgggtctgagttatagtttatataaaaattaaaaactgtataaggtttcttcactaaattctacaggactatcggatacctagcatatgcttacaaagtctgccccatccccttttcccaatcccagggcccaagccccaaacacagcctgactcacgggagccaatctccccctccctgtagcctagaccttctgctctcggaaaaggaacatccaagggctgtggctttgagggcagcagcccagtcttcctactgtctgatttaattacagcggttcctgtgggagtgggggctgttattctcttaaacatttgcagcttgaaacagttgaggaagcagctttaaaaaaaaaaaatctccctacccccaacaatccacaaccccccaaattcaaaacaaaacaaaaacaaacctaaaatcacaacagcgaccaagctccccctccagcaggcccgcccgtccaccaccaccaagcccacccctacactccagacatctgattcttgaaaatattaattacaaaatgccctttgcccacagcccctagaagagaactgcatataagcttcatcttcatccccacggttccctaccagagaggggtttggggcctcacccaccccttacctactcccacccccaggaagaggttcaactgcagcacaagcttgggcagaaaggggaaggaaagggaggcaaggaacccatcaccctctggctccccctggggtcagctctcttttgtgcgttataacatagtccaactatacaacagggggtgggaattgcccagcctctatacccccatcttacagcagtcacagccagggggtggggagtggggtggggggtgaggaaaagggcggtaggtcgggtaatggagggggcccccccacaaggggagctccatgtgtccgccccacacccccctaccatttataaactggttttgtaaaaagaaaatagatatatttatatagaatatataaagcacaaaaattagtagttttacatttgctctccccggggggtggggggagaggggagggttctcacctccagccggctcccccatgccccacaagactatgtacaatcccatgtataaatagataaataccccccaccctccccgcgctgacactaagctcccccacccccacatcaccaccccttcccaccagaccagcagcagtttggtgactgagggaaagtgggagctccgggccacaccctgcctcactaggtatgggcatgccactcagggatagccctcaccctaccccccacccaacccgtccaggggctggagggcaaacaggctcatgatgaggttgggaaaacaggagggagatatcctggtcctaggtttagctccctcctgcccccatgtccagatggagaaggaagtcctagagcaactaggggccagtcatccccaatcttcatcatcatttgcctcaaccaccatcccatgcccataattaaaaacaaagatggattttttgttgttgtttttcttcctcctcctaccccccttccacccactcagaagagggcagtgaggtgggggagagggttggggcagtagggggcttggagagggtctcacatttcaaaacagcaaaaaatccaacacttaaatgaggtaggtgtgggtgcggggtctccttgcccggcttgcccagcttgccctcctaggcagctgggcgcctctttcccgttcatgttgcatttgtcagagtggaaaacaaggaaacacaacccatagagagacagaaacacagaggaaaagagggaaacagagacagatcaagagggagggggatgggggtgagggtgggggcaggacccggcaggcagggccaggtgtgggacccggcctttgggattgtcaagcttagtcaagtctctttgcagccgtgagttgggccggagaggtcagtgggagcagcagggctgtgaggcccggccacacatcctcttcccccaccctgctgcctcccagatgcttctgggtagttcccggcccatatccccctcaaacctgagatgcccaatggctgcttctgtctggcccctcctggagctgggggcagagatgccagcctgagggccggtggtggggaagaggattgtccctggtgcccagggtgggcttggcctagggccctctgccccagcctcctgctccaggggctccgggtcagccggcagccccaaccctgggtcctggctctggctgctacctctcttccccctcatccctttcagggaagaggttgtgggtagggggactcccctgcctggtagcctcaaagcttcttagttcatccatttccgacaattccaggctccacagtggcaggggatcttgtgctgatcgtcctcaaaatcaaactgatagtcataggttagctgaaaagagaagagggcagaatcaatgctagtcccccacaggaagaggggaggccagagaagatatgatctgaggtgcccagcctaggaatccacatttagggaatggcagagaaggggtgaaaggaggaggagctgctttgtcactcagtcaggatacttcctctcacctcctctcctttggggattcgccggctggagatgatgatgattttgtcctctttgtcaaatgtcacgacttcggccacacagttaggggcacaggaatggttaatgtacctgggcagtgggacagagtcagggatgtcaggcaactaacttgggacaattttgattccttgttcgtctatcccccagagtgccactctcagggaccactaaatccctccttcctcgtcatctctcacctggcagggccgccggtcaacgtagcatcaatcacatgttcattgtttattcggaacatgtagatgcctcgattctagaaaggcagaggttgcagaagaagggacaagagtatcagagagtggcagtggtggctgtgggatcaggtaggagactcaggcagtgggggcttttgttgcatgtacttcatttctcctgcctttcccttctccccaccacagctttcctcctgctctcctgtgaccaatcctgcccttgctccttggttgagtgcagactatgcaccacaatggcccctctgccagctcatacctgctcttcgtagattttctcccgccggttggccacctcgttccgaatgatggtgccaatgtactcgataaccattgtgtgcttttctaggtccttggctgcatagagccccaggccctggatacgggagcgagccaggtacacgttgttcttccattcggtgcgcagccgccggtactgagatgacttggagtgcacaaactgcttgctgtagggggtgttggtctcgcctgtgaaggtgctctgatatgccttagacatgctggtgctgttcagggtatggggcctgggaggtgatataatccatgacaagacagctctccctcagaccaagtacataccacccacctcctctgccacctcctgggatgtgcaacacaccagttaggggcgtgtgctgctggcaagcactggaagtgcagccttgggaaaggagtagaggcaactgggtctcagctctggtgaggaagcaactagctacagggacccttctgacaccctgggtggcacagagagcccagggtgaggggtggggtgtggagggagatggggggcaccaattcccctacactgagcctgttctcccatctcccacttcctaccactctcctgccaaaccattctcaaggccatgctcctctgggaagttttccgcaagcagcccaggcctagaatttaagctgatggtttgcttgaatgtctgaatcctacctcctgcacatactggaagccctgaaaatggggactgtgcctaccacgctgggctagatttgaattaaaactggctgtgaactcacagcctaaaggtggtatcctttcttcggactgtccccttctctgacataacattgggctctgtgcagatggctcagtgcaggggaatgacggctgcctggcaggatgccttttaccaccttagggcaccagccaaattcttgccatcccagagcagtggttttcaaacgtttctggttctttttttatttagcagaaatctttgcttttttctttaacaaaatgttgactggaactccaatacataaactagatgacaatggagctcttctggtttaatccaatttggggaaggaagagatatgcatgggaaggaaaagttcaacccatcagtttaagtgatccaggactttttggaacacaggcactcacagtttgaaaaccaccattgcagggcatcaaggacaaggctggctagggatggagagtctctgacattctacaacagcctaggagccaccaaagaccttcgagaaagccctgctaccacagattctgcctccctctacccagggactaaggtccctggtacacagaaagaacaaggacctgcagtgaagaagtaagggtctggtcccagctgtgtgacctttgcctagtcatttaatctttctgggtctcagttttctcagctgtaaaatgggggtcataccacctgccctacctacctcataaggttgttgtgaggatcaaatgagataatggatgtgaaaacgctttgaaaaaaaaagtataaagtgctatacaaatgtaaggttttattatttttctattatatctctaactatttatttttgacaccaacactcatggggaagggaaggtgaccctagcacccatggggtatctgaggtttgggagaatcacaggccctcccccagaagtaaaacaggagaagaaagaggtgaccaagtcccttatatatttcataaaatttcaccagtttacccattacctccccagggtgcccaagataattctgtcctatatcccaagtgcatctgagcaggttgggagaggaggaaaaggataccctactaatacctgcatgccctctaattaggaagtctaagagtgattccccattttctccacgggaactctgatctgtatcctaaatcctcataatgggaccagaggatccctgtcaacacccacacccacatcccttggctccagcatcacaagctcaccgtttgtagtgtgtgaggattttaggctctgatcgggcacagccagtggggttgatcatgagtggcagctccataagggggtggcgcccatagcggaataaatagttttgacagctctccaccccgggcagctgtgggcacagttcatactcaccttagcctgagtttttttggggttaggccaaagttctcagtgcccgccaagccccccagctcccagccccttccttactgattcagctatgcgaagcacggcatgcaccgtcagcccaaagagctcctcgcccttcagatactcagggaagagtcgcagcatgtcagcctcttttctcatggcagccacaggctcaatgatgcgattccacacggctaagaagcagggaagagagcagtcctcagaggcaacttctgctcactgacctccagtccctaaccccaatccagaactgcagttttctgaggccttcaagcctccctatcatgaagttgtgttggtcttccagatcctctcttggcctcctagtctcactctctcttaagaagcaggaggtttccaaccccaaggggtcatcacagagccttgagatacaaacccagggcccaggagacccagcataggccatggaaggtccctagtgaaagagcaggcatgctttggagttggaaagacttgggttcaggttctagtactggtcatgagaccttgagccaaatacagtcacgtgcagcttaacaacatttcattcaatgaggaatcatatatacaacagtggtctggtaagattataatactgtactgtatttttactgtatcttttctatgtctagatgcacatacttaccgtatgttacaactgcctacagtattcagtacagttacatgctgtacagatttgtagcctaggagcaatggggtataccgcagagcctaggtgtgtagtatgctatgccatctaggtttgtgtagtacactctatgaagttcacacaatgacaaaatcacctaacaatgcatttctcagaatgtatccctgtcatttagcaatgcacgactgtactgaaatctgagactcagtttctttatgaacaaactgggcataatcgtagtataatacttacctcatagggttgtatgaacaaaataaactacacaaatcacttagcttagtttgtggctcacagtacacactcaaaaaaaggtacctgctcttactgttattttatcattaacactaaaactaaaatcaaaataattctgatttcgtccagggaaaaacaaccccaaggaacttggttaggattaggttgggtgaggcagatgatagtctcagaactgtttccttttgttccactggggatagcaacagaactagaatatgtgagattagaccagcaaaatattttcaactacaagggaatttagggtgacaagagaggctcaaacactttcactgggagttttcaagagaccccctgcctgcctgaggtgggggaaggaggatcattcacatagaagctacaggtcctcttatagacattgtaacagtgaccctgggagaaacttttcccattccatattatccatttcaagggcccactgctcaccctggggagaggcgtcagtgaagaccaggtcctccaggccctgctcgatgactttgattacaaactccggccgcccgttgttctcaccaatagaacagcgatagcagcagcgacgattgttggtgcggaggctccaatagatgcgcgtggcctcgtagcccacgggatagagggcagtggcactatgaaagtcagccatctggtgaggcagcagctgtccgatggcgtggaacacaaggccccccacacggaacatgtgcagccgttctccccgctgaatgatgctagcgatttgcttcacctcgtcccgctcaatgtagacccgccggaagacagcaaaagagctcagctcttgctcacagggccccttgatcttatgcattggacacagcatggtcttgtccttgaagaacatgcacttggcacggatggcacaagcaaaatggtagacattggggcaacgcatgcgattgcagctgctggtggcaccagttcgctggcacagggagcacttggttagcagtcctcggtgcagggcaacctccacattcatcagtgccccgccctgggtctcatacacctccgtggaccaaagggcacagttgaggtgcacccacaggtccaggtccaggttcagcagacgggcaggcccatcagtggccccgtcaccctcctcatgacagaaacagcagcgacgcatgtctcgcggtaccttgtcaggtcgcaaggctgtgccaagctgctccataaactctgccacttcccgctcatcctcctgccgcccactgcccttctggatggtcagcagcagccgaagccgcttccagcgcactcctttccatttcttgaggcgaggaggacgggaatcttcaccttcttcagggggccgggcacggggcttgggtcgggctgattcaggggatgaggccagtggcagaggtgaggggacgggtggctcagccaagggttcggtgggaagttcaaccaagggctcagtagggggactggcaggagaaggtgccaagggggaagggggcggggagggttcttcaggaggtggggccgagagctgtcgcacatccagattggagacattgtaggtatagctgtgctgagtgggtggctctggggcggggctctcctgtaggagggtgccctgtatcattagtgccagctcctcatctaactagctccctccttcccctcacccatatgccaccctcccaaaaggcctccacattctttgccctagacagcctcttttttcttttcttttcttttttttttgagacacagtcttgctctgttgcccaggctggatccagtggcacaatcttggctcactgcaacctctgcctcctgggttcaagggattctcatgcctcagcctttcgagtagctgggattacaggcacgcaccatcacgcctggctactgttttgtttttgtttttagtagagacggggtttcgccatgttggccaggctggtctcaaactcctggcctaaagtgattcactcgccttgcctcccaaagcactgggattacagatgtgagccaccgcgcctggccggcagccccttttttctaacacccacccctttttctcccccagacctacctgtttcaggaggctcaagatgtctagttggctcttcagggtatagccaggcaacactgcatcaaactgcttcagccaatcagggccagtgtctgggctcttgccttccagacccttttccttcccacctgcagaaaggagtggatcagagcctcccaccagaatcactcccctcaagtcccaaagggcttccctgccacactcaccaggaccctcagcttcccccttctttggctcagtgcctgcccgggcggggctctctgggaacagcacctcataggagttggggatcttcatgctcagcagctccgccactgccaccatcacgccattcaggttctgccagggccagggaagggatggaagaaacatatcagccaagtgtctgaggtgagctctactaccagctgggtggggacaaggacacctagaacccactccccagggtagttctatcctatgtcacccagctcttttcatacacttccctcacagcagcctttcccaaactgctgtgggcactgacgggagctccacgaaaagggaactacatcaactacgtttaggaaatgatgcatgctctatccatgacttggaggctcatgatacacgttagcaaattaaaaggacctgaggactcttgtagtaaagaaacccatattgtcattttaactgtgttttccaactttctttgaccacaaaagcccgttaatattttcaaaacagctgacagagtcccaccaaacatgactggggcaatgctgtcatgtagtacctgtgtcattacacacacaggtgctccttagttgttgacttgtctgtctttaccatgggactacgagccccgtgagggcaggaaccatgattcatttacccgaatctcacagcctctagcccaggctttcacatacaataggtactcagtacatgtgcttgaacgactacatttttccttatccagacaaattccagggactgccctctgatcaggttcccctcagcctcgaggtacccctaggacacaccttggctgcagcagcagagactgtgagcatgactgacacctcacttcctttgcccttttcccaagttgtgacaggcagctttccagggacctccaggccaagggccccataaggtttggtatctgggaagactgaatgagaaagaggaatttgtgtaacacttggccgcctctcccccagcttcggacaacccaggtgaactgggcctggcccacatccagagtagcacatacctgggatgctggcccgaggaatgagggggatgacaggggagagggcccggtcctcttgctcccaccggcctgagcccagatgagggaaacgaggggcctcctcccccaagatgctctcaggggatgaagctggcacaatgctgtcaggagaatcgctatcctcatcactctccatcctggggaccaaaagtagacatttgttgctacagccctgcagactcccctcccaaatctagagatgaatagatgtcttacttgaaatctccattggccaaaggaaatatgaggcaacctgtaccccacccttgttcctcatccccatttctggccccgcccctacctgacatcctcagtctgattgtgagggggtgtaggcaaggcagccagcaggtctagactcttcacctctgaagtatctgaggggtgggtagggagaagaaaagtcaggtgagggtggccagggctgatggtaccttctcccaatattttaggcctaattagcatgagatctcagctatcatgattagctgtcctcccacctaccagtttggggcaaacaaggtatatttattgagtctgtcctgcatgccaggcactgttgttttttgttttttttgttttttttttttttttcccgtagagatggggtcttgttatattgcccaagctggtctcgaactcctggcctcaagcaatccttccatcttggcctcccaaaatgttgggattacaggcataagctaccaggcctggtggcagctggctttagatatactctttggagtttgtttagtcatttaataactccattaagtgagtactacaatagccattttacagtgaggaaactgaggctcacacaagtcaatcaagttacttggatacagtaacacagttgaatgaatgcaggaaccagaattcaaatccagatcagagtctagctccacactcactaaagctggactgttccttctatacaaagcttcataaagatgctccctgccacccacctctcctattgcatttgctctagactccaaatgtccattctggcccccaagaaatcagtcctgaaagggcccttcctacctcaggtgccctgttatgtaaacacacaggacagcaggcaacccactaatttctaaactgtacagcatactaactggtttggactccagctaccaaactccaccaggggtggcatctgctcttgacttacccctcagtgccctttcactatcccgggcagaggcagcatccttggggtgctcccccagctcttcagatggggtgacgccattcaccatcttctgctgcaccgatgggggtggggtggggggcagcgacgagggtggtgtcggcgggttactcaggttattctgaggggtggggggtggggtgttgtgtgcaagatggcatagggagactgatataatctcctggccccactctacgtcagcaattccctcaagttttctattcccaccctcaccttcccaagaacttcactattcccaaaaaatattgccatttttctgaccttggtaagcagctgggaatagtagtcagggccagtgggcagcgccccacttccaaaggcccccctcagctggctctgcccattgactgggcagccactgccaaagggggcaaagaggctaaaattggcggtgatagcaggctccgttaggggcagcagggacagctcctacaaggggcaagatgacaaagttcaaaacctgcagcgtttgcatcgctgtcttgcacagctgggggacagggtgccccctatcctgggatgggaccagggggactgtctcctggggggtcacctgtttcagctgtttcagcaaggcctcgctggccctgaccccgtcctccttccgcagcttctttcgggagctcaccaacctgtcgcttgccttctgtacccgcttgggcttcggtgtcaaaggcttccttgctgctgcatcctaagccaaataagcccattgaaggctgctaccctcctcctcagagccctcatctcttctgtctgacccaggctcactcattctgccccccgctggctctaggacccactctacctgctccactctactcagagtactcacctccttgttgctgggggtaccctgtagtttctgctccagcccagccagcttgctgtcaatgtgcccgttgatctcagctcgcagcccctcggacccccgcccagtgctgagttgcacattctttgcccggagtagcttctgcaagagcagatgcccagcttctgagcgagggcctgccagcaggaggtggttgctggttcctggtgcccctattggctccccattggcctccctcttcactgactgggctcccagggcacatggctcttcccgaggttcctgcttgatgctgagttgggatgcctcaggcaccacctgtccattcacctggtccagatgcccaggtaccaggctgctctgctctggcttctgggtttctgctaggttgtctgggggatcccaaggtcccagacccttgctaaacaaggtatctgcaagctgggcagcagcaggtgagaccctcccaggaggcggctccaaggttggcccctgaggtttgggggtccctggatgggtgggagggagctgggcctcagtgggaagctgggagctgggggaaggtaattgtgaaggtctctttggctcttgagggctggatggtggaggtgtgggatggacagggccaaggactggtcctgtagataaggctcctggtggggcagggagccggggtgggccctgaggtcgaggccctgcccctagctcctggagggggcctgtctgtggtccagggaagcccccaagttgaggttggcagcccaggaggccctggaggggagaggtctgggtcccaggctcctggtagggtggggtctggcgtactgcctgactctgctgcagctgccgctgcatgaggagtgcctgtagctgctgctgctgctgaggacttaagtgccgcagctgtgggtttttggccaggactccttggagctgtgctcgaagctgacccaccgtaggcatgattccaaccccaggcagaccctgcccagactggaggacaggtcctggtttgggaggttgtggccctgtattattttgcatgggccgctctagcatgggctgttgggggcccagaaggttctgggtcatggacccaggctgatcccctaaggaaacagagggctgagccagcaggtggggcacagatgaggcctcagaagatgatccactgcctagctgcccatggcttcctccacctgctgtgtggagcaggctaacttgctgctgctgttgtcctggaagcctcagaggtggctgcagctgcagagagctgggctgaggctggggctggggttggacaagcaggagttgtgagtccccagagagtgagggctttacctctcctggttcagtggccattgactcaggggtagttcctattgctaacggccctccctgatgtgtagagggcccctcagtggcctctgaagaaacggctgggtctacggtgttttgttccttgcccgtcaggaggagggttggacccagggctccagggctagaaaagtgttgaagaggctttgctggcatgccagggccaagtgccacttgctgctgctgttgttgctgaggagacagtaaagttcgactctggtttaaaaggcccatctgctgctgttgctgctgctgttgaaactgctgctgttgttgttgctgttgctgttgtagctgctgttgctgctgttgaagctgttgctgctgctgttgttgaagctgctgctgctgttgctgctgttgaagctgttgctgctgaagttgctgttgctgttgtagctgctgctgctgctgctgctgaagttgctgttgctgttgcagctgctgctgctgctgaagctgctgtaaagagcccatgggctgagcgctcagtttgggctgcccactgtgtgacatcagactctgctgaagatgggacagccctgccatggacccttgctgttggtgctgttgttgctgctgctgctgctgggctgtgaccagcctgtgtcccataaggccctgaccctgctgtgccagctggggggaactgagcacccgggactgggtcataagcacctgtctgtgagggccctgggggcccaaagctccagggtgctgctgctgcaacacagccacctgggcagggcccagcatgccctggggcccctggggtggttgaggggacagctgctggaccaggaggccttggtggctgctgggaggcataaggccctggggcttgggacccagagcttggtttgtctgtactccaggaccctgctgctgttgctgctggattgccacctgtcctagaaggtgctgctgctgctgttgctgctgctgctgctgctgcagtttctgggccagctgcatacgttgctgctgcagctgcagctgcctttcctgtaaaagccttgaatcaggtccgaggcttcgaagagcaaggttgccagggaagaagccccctgaagggccagccagggatccagccccaccagaatgttgctgttgctgctgttgggccagagctgtattaaggaaggggccaccaggctgtccaggtagtgccatacccccaggggtcaggcgaagacctccggcttgcccacccggaggcccctgtggtggctgcagcccatggccagggagcagctgaccagggagcttggtgagcagccggggactctgggaagggctgagagccagcacagctgagtgctgttgctgttgttgctgctgctgctgctgttgttgctgctgcttgttccgatattctgccatgagattagtgtgctccttctgctgtttccggacctaacatgggagggtcggagaggtcaggctggggcatgctccccccatgccaaccctcttccctgccttctgggtgctaggctgaagtttgctttcccccacctgatccagttgtttctggatcttgctctgctgctctgtaaccagcttgagcttctcagcatcagcttctgggaactcacggccagcttttttggcagtgcgctgcttggcacacagagccttccgggacttgcggtgtacaccaatctgctcctctagcaccttcagctgcatctgtaggagctgctgggtatggaacagccactcctcatactgccgctggtcagcttcatctgggaaaagaagctgggtgtcaggacctgcaaaagggtaatcccaatccctcttcctccatatgacccaaaccactcccctgcaccttcctcccacgccccatactcactgatcactccctgagcaaaagtgggcgggttgggacgaggctgggagggatcaccagcactccgctcctgcaatgagagaggctgctaaagggtcattgttccctgctaggccctaagaagggtggcccagtggcataagacacaagttcctactcccacctgaccacttacctggccactcccagctgccacatggttctgcagatcactgctaggtccccccgagagcctctgggctagcagagacacttgctgtctggagtccaccaaagcacagaagataagtgttggcaataagaaagttggaaagcaaagagacgtgggacaagtagggaggggagccaagaaggggtgtgactgggaaagaaaagggccaaccccattccagccctgagtcttacctgttcataccaggtgccaccccaatgctgccctgagccatcactttcttgatgcctttcaaagccaccatcttggcctttgcaatgggatcaatgatatcttctgcagcaaatttgtccaggtctggagaggggagaaccaagtgagctgggctatggggccaatgctccagtgaatatctgcgattcccttcaacatcctgacttcaaccacgccaggcagaacaatggcacggcaaggcagaaagaccactgaattaggagccagtcggcctgggtgaatcagctctattcacaggacatgtgggcctgtttttacttgcaccgtgctacaaaaaggggctccgtaaatatttgttgagtcaacctgtgttatttcacctcagtttacccttttatttgatacagatgatgatccctactccgtctacctcacagaggtgttaagaggatcaaatgtgacaagaatataagtacactttatgactcggaaagcattcttcaaaggtaatgttcttagtccaactagcacagcccaagcacccaagatgctggcactgttgcaaagccctagattccagagctgttttgggcatcacctgtagtccactctcctgtctgtctagaatgctgggcaaaaaagaagaaacaaccaaccaccaaaaacttacatcatcctaaaatcccacactttgtatatttctccactgctcagaaaacttaactgagcatccactttctttttttcttttcttttcttttttaaagacagagtcttgctcttgtcacccaggctggagtgcaatggtgcaatttaggctcactgcaacctctgcttcctgggttcaagcgattctcctgcctcagcctgccgagtagctgtgattacaggtgcccaccaccaagcccagctaatttttgtatttttagtagaaacgaggtttcaccatgttggccaggctggtctggaactcctgacctcaggtgatccacccgcctcagcctcccaaagtgctgggattaaaggcgtgagccacagcacctggccagagctcccactttcttaaggactaacccaaactccctctcctggaatcctgaggcagtaaacagttaagaggagtaccgaccagacttcagatctagctctgctagctgctgtgtaatcttggacaagttacttaacctccacttctgtttcctcttctgtaatcaaagataataacaatacctatttaatgagtctgctataatgattaaattggacaaaaagtataaagtgctcagtaaactccttggcaaatagtaattactcaataaatgctattataatttgaggtctttttcaatctggcccccatcttatctcaccaaaattatgtcacttacttcactcgaaacagtttactccagcctaaccaattcactcactgttcttgaaacatcccataggttttcccaccattgcagcctcaatgaactttttcacctatcccaatcgcttttttttttttttttaagacagagtctcgctctgttgcccagcctgaagtgcaatggcgtgatctcagctaactgcaacctccacctcctgggttcaagcaattctcctgcctcagcctctcgagtagctggaactacaggcgtgcaccaccacacccagctaatttttttttttttttttttttttttttgagatggagtttcgctcttgttgcccaggctggagtgcaatgaggcgatctcggctcaccacaacctctgcctcatgggttcaatcaactctcctgcctcagcctcccgagtagctgggattacagggatgcaccaccgcgcccggctcacacccagctaatttttgtatgtttagtagagatggggtttcatcatcttggccaggctggtcttgaactcctgatcttaagtgatccacctgccttggtctcccaaagtgctgggattacaggcatgagccattgtgcctggcctcaactgcttttttttgcaccacttctcttcaagtcttaagctttcaacttcactacagctacaaaggctctgctaattaggcttcattcatacattcattccatttattcaaacatctgctacatgcctactatatgccaggaactgttctctctcttcttaaaagctacagtgtttctgcctctaccactagtatgatatttagccaaagttctttgtgtcccatcttaagtagggattatctgaggtctctagcctcagtgcccatttagggataacaataatcaccctgagtaacttggctatgttaccagctgaggttacctgtatctgggaagaagctgtttgccagctgctgctgcattgccaattgctgcggcttcatgcacatggaaggtggcatggtgcccatgggcttctgtgatagcactggctgtgagctctgctggggtaccaagcctgcctgccctccatgctgcccacttagcatatgcccttgattggacaccatagccatggatggagccaggcgttgctggagggcatgagctggtggctgggtgggcatcagtggctggggcaaacctggctgtcgggcacctgcaagacccagggaaagctgctgttgggacccagccaaactgggagaagagccctcatgtggcaaagacatggcctgggcagggcctggtgcagacagtagggaatgctgctgctgctgttgctgctgctgctgggcaggctgcaactgtgctgaaagctgctgcttcttctgcagctccttcttctcatgctccaacaggtcctcaatgagcaggggtaactcgctggctaccagtgagctctccatcttgtctagctcatccccagatgctgcaggtccaccaggcaaggtcaaagccccactctcgagctcaaacttttccagcagggaggatcctcctgggccactcagtgggctgggggtcagcaggtgagctggtggtcctcccgtggccccaaaggaggccttctcagctgtgtgcccactgctagaaaatggccctgtgcccatccgggtatcccggctgcccatcatgctctgtcctggctttagccccaggccaagggaattggcagcaggtgcgggctctaccttgggggtagcaatggtgaattggcaaggagaagggtggcgtccaccctcctccaccttgggcttcacctcagggagcacagatgccaggcggggttcagaggcatcagcagcagggggagggcgctcctcagggcccaagggtcctggctccaccccccgcagcagggcctcccgttcagccttctcattagccgattctaccagcctcaggtgctcattgaagatatccttcttgtccccagtgtccagctcaggatcagtatatgccagcaggtcaaactcgtctccattgagcaggtcatccaagtgggggtcattggtctccaggttttctaaggtgccaagttcatcatcacccttggccacatccacacccagacccaggtgagcaagctcttcatcatcctctagggccttgtgggcatcaaaatcgtcatccagctcgggatcctcacagggcaacttcccagcttccagggccagaggattggggcggccaagctcagtgctcgacgggggccggttgaccagctccaaaccagttggcagggtaggacccttggtgtggggtgttggatgaagactgttgttcaattcaggggccggtggggctgagggtttctgtgggggaagacctgataccgccaggccccgaagcccttcaggagccagtcggtgggggtcctcacttacagggtaaaaacggggtctctgaggtgggccctgaccaggaaacggagtgcccccaggtcccagtcctttctgtacattgtgccgcagctcaatgaactgggcaggaccagctggaccaggcactggctcaccagggcctggcagacgggtggaaattcccgccaacggggaacctagggcttggcggccaagttcaggtccaggagttgatggaaagcgagctgacatggcaaatcgcatggaggttgctgctgttgcctgttgttgctgccacagttgttgctgttgctgctgtaagggcagggacccaggatagggtgctcgctgatagaaagcttgggagcctcctaccagttgcctggaagaatatacagtagtcagtaggatgaaatcagatgaaaaggagcaagaacatgggcttagggcagtgaggaaggatagaattaatgcagtgagggagaaaaggaatgaggaagaagagaaagtgatactggaaaaggattagtgatacaggaaaatcacaagagcttccaacagtgataaaatccatcccccttggtttacccccagggaacctcctggagcctcaccggctgttcacatccatagaggaaggcgtggctggtggaggtggccgggagagtcggtcatcgctagggaaggaccctggccccaggatggggccactcagcttgcttgggggcaaccccacaaggctgctcttgtcctagaagagacaaggtagatgaaggtggagcaaccttcaatatcctggccccactatcccttgccactctacctacctgtgtcccagcaaagggggtctggcctcgactcagctgctcaaaggcagggctgctgggctcagcaccccagctgcctggaggccccactgctcctgcagctgctgcagctgtttccttctcctgccgcagggtgttgcgctggatctgctgccgaatcagcagctctcgtagtcgctggcgctatgcaaaaaaaagagaagaggaataagcccattctactccaatcatagggctgccccagagacaggagcgatatagggggcttagctccagggtgtcaacttacctgccgttgcttctccagctctgtttggctaaggccggacatgcctgggtcctgggtacctgggagttcagctgtcgccaaagagctacccattccagtccctgggtcttctcgcttttcgacaggagaggtgatgcctgatcgctgtgaggctccatgggacaggtaggggagggatccgtcgggtgcaggtggtggcagaaccgacggagggcgtagtggggacagcccatagctctcccctgtggacccgctgctgggccccagggggctgcccgatgggtggaagttccctgtggctactgtgtagtttgtgctttgaggcttgcccaaggtggggccgggcccaaaatggctgttgatcccatggggtggcgggagaccaggctgagggacagggggctttagggaaggctcccctactgcctgagggaaagtgaaacgcatgggagagggggtgcccacaaatgcacccgtcccaggggaccggacaaaattggggggctgcccacttgggaccttggcatggagctcacctgctggccccgcgggcagggctgctgggaaccccccagcccccagcgaagtgtgggctagagacccagccttaaaggcaacttcagggggctggggtcggggtggcttatgcaatggggcaaatgggtcacgggactgagggcgtgagggtgggcgagaataagggtcaggggactggaagcgaggggtaacgggtgatgggcaaaaagcttcagcagacagaggccggggtgtcagtggagactgggagctggactgggactgaggactggcaggcactcgggagaaagggtcggagggcagtgagcgagggggcagagcacagcagctctcagggggcggaggttggggccgaggagtcaatgggggctgagcatatgggtcagtgtaggagccagggcgaaagatgtctgggtgacttggaggagaaggtgccaaagcctgggcagggggtggctcctggggccttaggcccaagcccgggctctggggctctacctgagatgcccgaggggtcaggggggctttgaagacatcaggtgtctttaactccaggccacccaggtgggtgcctgaggagggtgagtcaacaaagcccaggtttgggggcccatagctaggagaggatgccccaagctcttccttcttcacctctagggccttccgggactccccaaaaggtgggggcgagagcaggggctcggaagctttgcctccccctaccccagggctctcaggcacagccaagttatccagcgaggggcagcggggtttgaggaatgggtcaggtgtggagggctggtgtctgggggtgccaggtggggtagtgtggaattcccctggctggccagccccaggacgagatgaggcgcccagcatcgggggctgcgcaggggcccccgtaggactaggataggggggataggtgggcggtgccgtggggaagcggggctccaggggataggcaggggccagtccaaaggggtcctgcgaaggcacttgggcgggcacctggggtgggagcttgaggaagagctcaccaggcgagtcagggccaggcaccgagcccgccggcggcttcaggaacccgtccgcagaggtagacaagccggcgggggtagtggggctgccaatgaaaatggtgggggcagcagcggggggcgggctgcccagtgcccctggctgcgggggaatgcggagatgtagggccggtcggtcagtcttacgggctatgtcgcccaccttggtctgcttgttgatctggctctcagcctgctacagggggagaccaggcatagggcagtcaggctgctgcaggcaggccccatggccctccaccctcaagagaggccacccactagaggactgctacaccccagcccagccccactcaccttctgcaccttgttgatgcggtgagctgcccggttatctttggccttttgctgagggatatgggacacagccttagggcctagtgcttggtctcatgccccgcccccatactgtagtgttttcacactccctacccagaagcagatcccttctggcccagctgctttaggagtggggagcggaaagaactgaggtaaattacccaaagatccctccctccctctcagttcccacgctaatccatgctcctttctgcctcaccaggtagggggctttgtcagctgctggaacctttctccagagcttcatgatttgtttgcaacggcttgaccagtctggagggcagagagagtgagtcagagaagacttggcaggcgactcctccacctgccatgttgccaggctgtctcccttgccctcatcccacaggtacctgggtagtcttgcttgagattaggaaaattaatgttggcatagagcacaggtgagatggtggacagctggcccaactcctcatccttctcccagcgctgaagactccgctggttataggagagtccgtcgccctcaccctccgtggtgggggttgtgggggtggagggcgtggtgccacctgagcccgtccaggggctgtcgggctcaccgggttccgggctaaagaagcccccgcgctccctggggcgcaggggcagagagtcacagggcgcagggatgccaagtcccaccccagacaaactgcctagagccccaggccactgccctgccccaaaagaggagggtcactaacaagggaatggggaggagcaggggaagtgctgcaggagtccgagggaggcaaagcatgaactcagatggagggaaaggacaacgaggactgcccacaaaggttacgcagagacaccaacctagaatccaggaacggggactggcagaggcctgggtaggagtccattgggctgctggagggcagattgcccaaagggagtccacctacaagacggacaggatcagagaaaagagcaactggcccatcctggaggcaagcttggttatgtcagtcttcagaccactcccacctgtattaccttgaagaaagggcctctgcagtggcgtacggctgccttctaggccaggggttccacaacccagatgctgttctcgttcagagcccagaacatccttgaagagctgctgcaggtccttggattccatcttgggcagttctgtgggggaatgaaggacactgttgaggaagactgggaagttcaggtgacaccacaggtctacaaatgatcatggccaggaacagtccaggactccccaccagagaagctgtacagatcacagtcccaaagataggacctcctccttctcccatagaaaacccttatacacaaagaggtacgggtcacagcctcaccttctgtggaaatcctgtctaagtcagagctaagcatcccttcacctggggtgcctggcttctcagggtcactgggcactggggatgccttcacgcccccatcctcaggtcctgtaaatgccaggagaaacccatgggtcaaggccaggatgggtcatggccactctgaaccacagagggccatgggacagtttccagcctccaacactgacaatgctcaggggcacagcagagggacagaggcaagcaaggccaagacaggacacagtaaccccggcagccctcacctggtgtatcggctttgccctcgaggccacgggattcttcatctgcaatatctggaccatcatctcctatgagcaagagtcccccctccaatcagagatgtcctacatctgatgcccagaacaggtctccagtcccacagccctacaggccaggacccttgaccccacccttgactcctggaggccagtccatttcccatcaaataacttgccagctcctaagccagaagaaagttggattctctcacaccactcactcccacataactaacctttctgcgatgtggggagttccttcctttctgagcctccatctcccttggcttttggggtccctagtccaaagcttggccggcccaccccaactgcaaaaagggccttacggctcaggtccagcagctccttcccaaagaaggcttcctgtggggcagtcaaggagaaacagttttcttcatgccctgcagggcacagacacctccctcactgcttggagcctgagacccacctgcaagtaagcagggaacatgtcctccagtttgctcttcttgcgccctcgccgctgttgcttcttcttctcatccccttcagctaagctctgctccacggcgccctctgcaggcaggtcagcaggtatcactgtggacagaacggaagtgtcagactcgggttgagagcatgctgctcccaacttgcagggtgacactttgtgcctactctctcccacaacaccagctgggtctaccaccctcttggccctttcaatgagtccaccccctgggtctctctagcattgccccaccttctcccaggccccactggtgccctcacccgtctcaccctcgtcgggctgcccatccccactcaacacctccgcctgtgcagcaggcccctttttcgtgcgtgtgtgggatttccgctgtcgcaccatgaaaccaccaatgcctatgaggaggcagagttgtggatgagaagccgctgggggacctattgagctgccccgcaccaccccaccaccccacaaccccatcccaggacctcaccaggccgatatggtttacgcttgcgttttttgctttcctcggtctcctctttgccaggctccacatcagggctgacggggccctccagtttaatttcgcactccatgtgctccacaccacctgcgtatggtgacagaagagatggaggcaaatcagaactataggcccttttaaccttgtcatcctgccactgagagagctgaataccttgcctcagagccacttagacgagacagcagtgcttaagggtaactgagtggcaatgtagcccccacccaacatcccactcccagagtcacgctccccctactctgccgctccctaagattccccaagctaaccttcacccttgagcagctcatcggtgtccaggtccccatccttcttgtcatcagggccaagggcatctgagggctcagaaccctccaatcctgcctcgcctgggaggccaagccgtcctcgccgttggcgccgcttgtgcagtggtgacatggtcaggttacgcagcaaggccatgccagtttctgtcagccacacaccttcgaagcgaaagtactggggctctgcataagaggaaagagtatgtgatccctggatggaagccccagggaaaccagaactgcaagtttcaacctatgtccttagctgagacaaaggcagtgacaaaagtccagcttagggtctaaatgctgaggagaacaggccaccaaggggcactggctgaggcccgagttctctgtcagtgacccagggagattcagagaggaactgtaactcagaagcctgcctttgctcatgattaaccctaggttcactaaatagattctcttgctgtctggggctatgagggcccctacttgctgaatgccagcacacagtgtcctagatgccagcagcagtgccatatcacgatggagatgtccctggcccctttcacttaggaaaaagagttatgttctcagccgggcgcggtgctcatgcttgtaatcccagccctttgggaggccgaggctggcagatcacgaggtccggagatcgagaccatcctggctaacacggtgaaaccccatctctactaaaaaatacaaaaaattagccgggcgtggtggcgggcacctgtagtcccagctactcaggaggctgaggcaggagaatggcgtgaacccgggaggcaaagcttgcaatgtgccaagcttgtgccactgcactccagcctgggcaacagagcaagactccatctcaaaaaaaaaaaaaaaaaagagatctgaagacgaaatcctagcagtgaagagaccatggtgcctgatgaaaggaacattgcccgggaagctggagaccttggttctaggcataactttgccactaacttactaggtgaccttgggcaggccacttaacttctctgggtctgagtttcctcctcttaaaataaggagatgaagctagggggttggagctagactagatgatgtccgacgtctggtctggctttggcattcaaaatttctgtgactcacctggctctttcaccttcatgggcaccagctctggaggtgcaacaggcgctatggagagaaggacaaacggaggtggctgaggtcctgtcccaaagcaaggtacccctgctctgactcctccccctacccagcagctggtactcacccacaggctttaccacgtagggctggcaggagacacagtcaaagccttcatcggctgcctgctccacatcgtcctctgtgaagaggctctcacagcctgcatgcatccacctggagaacagagactggaggaaataagctcaggcaatgcgaggctggcaacagggccaaagtgaggagaaagggatgttctcaccgttcacagtggcggcactggattagtaggtcctcttctacgtaaggagcatgacagatagggcaggtcaccaggctggcacagggcccacagtgtgtgtaactattctgccattcacagtggaagccaggggaagcagccccacactgcatacaggacacacacctgataggagcaggaaaacagagctttagcacccaacctacccgaagtacccagaagtcccctcaccggaaacccaagccaccagcctggcctcctaaacccagcctctgtcacatactcaacatcatatccactttaacatctcaaggccccagggctccactgaagatcccagtctccttaccacttgcacttccagccgcccttggggacggtgagcagtggggggtccaggcagtatgtgtggtagctaatatcacagtcatcacagagcagcaggcgtgaggggtcggaggcctggccacacacctcacacacaatacactccacacaacgccagcccttgagcagcatcaccttggtgatctggggcagaagatgggaacttctcagggtgtgaggtggaaaagaggtagaacttctttttatttttttttggagatggagttttgctcttgttccccaggctggagtgcaatggcgcgatctcggctcactgcaacctctgcctctcaggtacaagtgattctcttgtctcagcctcccaagtagctgagattacaggcacctgccaccacacctggctaatttttttgtatttagtagagtcagagtttcaccatgttagtcaggctggtcaccaactcctgaccttaggtgatccacccgcctcaccctcccgaagtaaagtgctgggattacaggtgtgcgccaccgtgcccagcctaggaggtggaacttctaagggtgaggctggaggcagcccaatgcagagactaggcctccatttgagcacacagagacttaggcagagcacccttgtccccaaaacagtgactctaaacttaggctcccaatgatctctgctgatcagagaagagctgcactagccactgcctcattgtgaatagaatagcaatctttccactagccaagcccctaaaaagagactgtggaccgaattaggtcccccagtttttcctttttttttttttttttttttttttgagacggatctcactctgttgcccaggctggagtggagtacagtggcgtgatctcggctcactgcaacctccgcctcctgggttcaagcaattctcctgcctcagcctcccgagttgctgagattacaggcacgcgctaccacactcagctaatttttgttattttttagaagagacggggtttcaccatgttgaccacgatggtcctgaactcctaatctcaggtgatccacccacctaggcctcccaaagtgctgggattacaggtgggagccaccatgcccagccatgttgttattttttacgatggactgaattataccagcaagtcagggcctaccacaaagaaactatcaagtccaccgttgagttccaaagtacttttccccaagaaaagtttgataaccactggtgactaatgaacaaccatgaccgatggccgctttaagaggtggtatggccaggacaaggaactagggtaagaaataactgaccctattccccagcctacacctcttgggccctgaactcaccttgctgttgacacagtaagggtgatagcactgagagcactgcgaacaggcaaggaggtggccctctgccccccggccaaagctgccacataccacacacatgtcctggggaaacacagagaaacccaaatgtccaactagatctccccatcccactcagatccagtctactatgacgctacaacactgatttgcgaccagagtcaggaaccccatcccacagcgttaggatgctgtaagctaccaagggaccctgctccttcctaggatgccttactcacctaatcaggtcacttgaatttataaagcctgacatgggtgaagttaagaagaaattaaaggaagataagatggagtaaagactggtcaggtgagaatcacatatgtgacaaaattctatcagcttcaagattattcaagtgaggacacatgtaagttccctaagctataaagttcaataaggcaaagactttttcactgctatttctctagctcctagcttagtgccaagctcagaagagatactcaagagaaatgtgatggatggacaaaccaatgaataacatgattagaattcatggtctgttttctcattagctgggtatccccaaagtaggtccagttttcccatctatcctctcaccaaacacacacatacacaatgttcagtgtgccaggtctcactgtatggtacctgcattaggacaaatttgtctgtgttggagaagagaaccacggtattctgcatggtgtcatcatcttcttcctcctcctccttactgggagagctatcaatgtcagcaacctgatgggcagagagttatggaaagtgaggcagataaatctgcccccaccaagctactttcctctttggtgttgggggaagaaagtgtgaacccttggttaagatgaaggccaaaagccaggaataacagacagaacaccccagctcccaaattgagcctcagtctgatagcagagatttcagaaaaacctgcgggccaagtggacaggaattcagacatagccagacaggccctagacgagcaggcaggtaggcaagcatgcaagggactggcaggactcagagggtgctaaagcatggttgggggatgggaggaataggaggcatctccttactaccagagtctcaatggaagaagcagttgactttagccgggcccgtcctctaccacgtcctccatgggctcctccacgaggccggcgtcttcctgggaaactgctgctgcgaccctgagtgaaagaaggggacaatgacaggagcatgtcaagggctagtgtgttgggtttacacacttgaacagaagaagtgacaaacggacagagtaagacaggtaataagcccaggagtcccactcagggcaagggaaaaggccaaactcccagatatcaacaagcgcatagctctagcccaaacccattcttcccctcccaagagtggttgagatgggcaaggagaaaaaacaatggcttgaaagaaccaagtttctggtcccaattctattactgagtaaccatgaatctgggcaagttacttgtcccttctacgtattagtattttctccttaataactggaataaaggatctccaagtctaggattcacaaagcaaggtgggaaagtatcagtgacacaggactgtacctctgacagtgggctaactctaatcacatcccgcagctagatagcccctcacctgtttgatgcgggaacgggctggggagctgcgccgccgccccttctccccctcagctttgcctccgctgatagctgtcccagcatcgcacaatagtgagtcatcagtctctggcagtgagtcagtacagagccgtagggagccctcatctcgggctggactaacatccgtagagacccccaactccatggacagggagccacccccctccgggtctggagagcccaggaggggctctgagccaggaaaactggcactggcatcaccctggctcagattagagatctcgttaacgatgtcggatttgatgagagtgggtggtgtgggggccaccggtgcacgtggctcttcctgttcttcacatggtgagccctgccctgctgtctgcttgcattcggggtagacctccataggggtcacaggggccagctcctcggggtccaggagcacaggggagcctttaagttcactagccaaactgccaggggtctgtccaggctctggctgtgaacccggagcatcaatcccatccagaggggctgtgtcttcccctaggccagagaagtcatccagggctggggcagggctgggggcggggcaggaaaggtcccccattggggaagggagaggactggtggcactgggttccaaggctgggcattcaggttctgaaactttctcagtctccatctcgtgcagctcagcctcatctgagacccccactaccttccctatgggactcaacggggagggaacggacagtggtagggcaggaggagagcactgggaaggaggggagttttggggaaccagggaatgctgaaggagtggcgaacactgaggaggaaggggctccatcaggatgggagaagccggccccactggggagcctggagatgggggaaggatcataggggggacaggctcagggtcagtgcagttagcttctggtggagggctgatgggtgtctccaggatgggggcagccaacggtgactcagggtcactgtcccctttggcaccaaaggggtactctaactcccccaaaggagacagggccggtggggccgcagctgtgatgatgggtgagagtggaggaggaaggggatctggaaggaaagagaaaaaagaagggctcttagattagatgtgccatgaagagttacagctgttccagaataacagagtactaacatccccttacctggtggcatcagctgaggcgacaaggatggctccccagatggggacaacggcagctcctcgggcagaggggacagaggtggttccccaggctcagacagggctggctctccaagcaagggagataaggatggttccccagggggagggaacaagggcagctcctcaggtgcagggcattggcctggctcctcagggggcttttcaggccgaggggacaggggtggcttctcaagctcaggggacagatgcgattcctcaggccggggggacaggcatggctcctcagactggggggacaggtgtgattcctcaggttggggggacaagcatggctcctcaggcacaggagacaggtgcggctcctcagtctggggggacaggtgcaattcctcaggctgaggggacagatgtggtccctcagcctggggggacaagtgtggctcctcaggcacagcgcataggcatggctcctcaggctggggggacaggtgtggctcctcagcctgcggagataggtgtggctcctcaggccggggggacaggtgcggctcctcaggccggggtgacaggtgcggcccctcggaccgggggcagagttgcggctcctcaggtagtggcaacaggggtgactcctccagcggcagggacatgagcgagtcctccggtggtggggaagcaggtgagtcctcaggtggtggggatgtgggggagtcctcaggtggtggggagaggcgtgaagcctcaggtggaggggacgtgggagactcctcaggcggtggggacaagggagattcctcaggcggtggagacaggcgtgacaccacaggcaggggggataggcgcgatacctcaggtgggggggacataggtgattcttcaggtggtggggacataggcgagtcctcaggtggtggggacaggcgtgatgcctcaggtggtggggaaaggggagactcctcaggtggaggggacagaggagactcttcaaatggtgggaacagacgagatgcctccggtggtggagacatgggtgactcttcaggtggaggggacatgggtgactcctcaggtggtggagacaggcgagatgcttcaggtggcggggaagtgggcaattcctcaggtggcggggacaaaggagattcttcaaatggtggggacaggggcgatgcttcaggtggtggggatagaggcgtctcaagtgcaggagatgggggtgactcttccggtggagacaagggcgactcctccagtggagaaaaaggtgatgattcaggtgggggagacagaggagactcctcaggcggcggagagaggggcgattcctccagcggccgggacaggtgcaatgcctcaggaagtggggatgcgggcaattcctcaggtggtggtgacaggcgtgatgcctcaggtggtggggacgtgggtgattcctcaggtggtggggacaggggtgactcctcaggtgggggcagcagtggcatctcctcgtttaggggggcctccaactggggctcaagttggacccctgctttccctgcagacacaacaacacgatgctcctatctagctcagatctactccacagaaagtgtggggtctggggcaatgcacaaactgtctcttgccatagaataaaaggggatgaatttcagggaccctcaaaccctactcacctagtggtttggcttcacattgcaggggccctggttccttgggttgcatagaggtcacgtgcccaccctttggctgcccttggcatgcaacgtacagagcatcgggctcgtcagtgggggtatcgccaggctctgggggtgaaaatctgcagagggtacaggggagcaggcactgtggctctcaccagctaacaaatcctagagagcacactggggggaggcacgaatgctgtggatggcactgcccaccttagggctctcctctcaaagtccactcaatttaacaaggcccctgccaatgtcagttcttccaacctgccagcccaatctcagtcagtccccaccacttacctgctacacaccggggtatgctgctcagcaacggagcggatagtctgacctccctgggctttgtgacagcggtgacagagagagtagttctcaaaccactccgagttgggattcagttctgctgagcccgccccacaggcccggcacacccggcacgcctaagggaagggagtgggcaaaacaggcattggtcagacagcaaagactaaacgaaagtacacaacttgtcaagacagagaatgctgtagcagacacagttagggacaatagggcagaatcagggtacactcaccttgcacttccaagagtgagcaggcagttcctccatgggtggttttaggcagaaagtatggtatcctttgtcacacgtctcacaaaccaacatcttagagtcattcccaggtttcctgcaggtgcacatggaacattacagtgtcctctctgccctcatttcctttcttttttgttgttttcatgttaacaggccttctccgactgccctcattttcaaccctaacctgtgttgtgcctaagactttcctcctgcccttccattcctacctgcaggcttggcacactttgcattcagggcactgccagccagcacgtttgcgggcagtcagagcagtgtccaggcaggccccgtgatagtgatgcccacagctggtacagaagaacaggtcacacaactcccctggcccctcacacactgcacagcgagcctcctctgcagggggtagagacaccacaggtcagctatggattccttgtaagcctcagcacattgctgtacacaaaacaggcactccatgggcacagaatgaacaaacaacaaagttactgagtgcctgcccaacgtctgccagctactgttctaggcactggagacaaaatgataaatgagacaggcaaaaccctggtgctcacaaagttcacacctattttagtggggcagaccaacagtaaataatgctatactttgatcagtgctctgtagagtacaaaaatccaaggcacatttggtctctcatttgccctatgaccaaagatcaggacttctcacccagatatgcagccccctcactgtgctctgggcatagcagctgcagtgttttcatggataggaaggaaccgctggcagtcgcgcaggggaagtggtaaagccgtggacatccaggtgagcggcaagggatggaggcaccgagcctggtgcagtgggagcagcgctgccagggtgaaaaaagagcctcagtgtcagccagctctccccagacaaacagttcaggcactagctctgccccagtatacccatggtccttctcattccaacctgactctcagaagcccaccagccctgcccttcacctatgcaatcccctggcccagccccacctgtgagatccctgagaagatggccttgtccacaccacatagttctgggccctcctgcccccatacgcctgccgaccatgcagcacaccaatggtgagcccagcaggaccctttacaggtgggaagaggtaaagagaaaggaaagaattaacaaaaagaggattgctggctcaggactacccagcccttatcccatttcctgccccattctcctcactcacctccaggttctcctaggtgggcaggtgtaaggccctcagggaaaccaatctgtgataggtcctcactgggcagcactgcctcattgggccctgggctccccccaggggacaccactggacaccggggccaatcaaatggcaactcaaagcgccgtagctcccgctgcccgtgtagactgggctccccgcagttacagagagcacaacgccgcaccggacccccactgtggacacacaagcatcagtaccacgccaggcccccagcaaccccatgatctggcatgcccatgcttccccaacactcattttcctaaattctcttccttgaaagccctagactctcaaatcctcatgtgccctcaaacaagctacctgcagtcctgaggagtctcctgaagcctgggactcccagaactaaggacagagacctctcccacatgtgggttgggcaggtctgactcagtggcacttgggtcctcagaagctgcaggtccatcagctgaataaacagacaaacagcatgtgtcagccatcatccctatttaacacaaagtccactcaccagacgcatgagattatccaaaacctgagtggatcagagtgatgatatttcaactgttgtcccaaagaacaaagttgttccattacttatctgctacatagacttagctcatgtccttgtgccaggaccagaaatgtaaggttgccaatgaaatctaaaagcaaacaaacaatttgtcctactcacctgccggttctgaatctttatcctcaccagccagcttctggctgtccat

SEQ ID NO: 2557 - DNA, 45675 bp, Homo sapiens
  source 1..45675: mol_type = genomic DNA
gtcactgtaactatttttattacattacaataattaggagtagtacagttcatgacaaaaatattacaaattttagatcacttcacagcacatactcctataaacatttaaaagttaatttcaattaaaagagtggtcatttttaatgtttgatatgaccaacattcctaggtcagcgcaaccaaatgatggaaaacaactggatcacactgcatatgtcccacaaaagaaagcacaatgtacaaaatgtgcatgtttcagtttacactatacaaaaatagttaaaatacattccaggtaaacatgttacattaagaaatagtactagtaagaaattggcactcaaaggaaaaatgcaaaagtattttcaacatgaaaacacaagacagtggaattggaaactttcggataaaacactgtaacccagttagctctgtgggggtgtggggggagagatgggccctcaacatatctgcagataacttttttttcccctaaattcatctaaattacctatcattatcccaaacaggcacttcaaactattaaactaaaacacagatcttaatctagttatgactattcttcaagaactcatgtgagtatctttctttagaaagaaagtttcattttatgacagctattcagtttctcaatgcagaattcatgctatccagtattaacacagaagttactaaatataaattcagctttaaggtaactgctgggttctaaaaaacattactacacaattatcaagaaatcattactttttgacaaatggaaatcttcagatagtttttgctgtctaaaaaaaaatcccctaaaaaaagttatatactgtttgaagaaaaaatgtttagaagaaaaaaaaaatcaatggaatacaaatgagatgaacttgtgcaaactgtaacttaacatgccccacaaagtttctatgtatatattaggacaaaattgtgcaatggtgacaacagttttgataacctataaaagttaggttctaaattcctatgcagtgtgactcagttaaatagagcctagaatgcctacttgggaacattcactcaaatgatacaatatacgtctgctatattcttccacaaacatgttaatgcctaagtctatgtaatttagctttttttaaaaaaacttcaacaaggatttttgtctttaaggctgtaataattaggtaacatttatttctagaattctccccctttaaaatctctacaaaaacaaatcttttgttaaaccattcaaagttcacataaaggtaattaaccactaccttaaaaaaatgcccatctacatcaaaaattcaagaggcctaaatatcccctcataagcactgcagttcctgaagtatggccatttctttctctgtgtagaaacgaggtactgtgtaagtcttaacaccctacctaaacagtgttccaaagatctgtagtttcacatagcaattcagaaatcatagtgatttttacatagaagtttccttgtctgtgaactagttcaggcacctgtttatttgtacccagataaaactattaatttttaagtatattttaattacttatgcagagaaaactggaatattacacatttgggtcaatatgaatatctgacatacaccttaatgtgtacagtaattgtcctaaaagaatcacagttatgccaaataaaaaaacaatataatcaagtttattcctttaaaacaatgaagtgatttacataaagtagcttgatcgaagagtttcagtggaatcgtagcaaaacaattatagagctggcacagagaccaaaccccttctttgcaaaactaaaatacgcatcgtgttatctctgggtcgtataccaaaggccttagtaagatattacagaccacactagcactacctaaggaccgggattatgtctcttgtttggggataccatatacccagtgccttgtgtggtgactggcatctggtaggcactcaataaatatttgctgaataaatgagttctgcaaaacaggtttatgaggccaaggtgggtgaatcacttgaggtcaggagttcgagaccagcctggccaacagggtgaaaccccgtctctcctaaaaatacaaaaattagttgagtgtagtggcacacgcctgtaatcccagctactcaggaggccgaggcacgagaatcgcttgaacctgggagatggaggttgcagtgagctgagatggcgccactgcattccagcctgggtgacaagagcgagactctgacaccaaaaaaaaaaagtaagcttcatgaattaaagtatttttcattgcatgaagatttctggttactaaaacaatggaatgtattactgttaccaggagtagtcctagttatagattacctaaggaattctttcagcactatctttattaaattctccttccactggatagggttctgtctattcataccaggtttgaaaaatcctactgtcgctaatggattgggcagcaaagagatgttcaaagcatcagccaccacctgaaaattagtgattaggtcaaatccctttatggtatctgtcagattctcttgagccctgaggaaataagatgtagggcatttctgatgtgactcagtgggaaaacttcatggagatatccacagcagcagtaaatcttatggttaggggaattacaagtattaaaactgcatcaagtcatggggcatgtggaaggtagggaggcaagatgacactaatatggaagaagagtcctaaaacgagaatggatattcaaatataaacttcacctcttgcacaattttgcccaagactggcactgaagatggtgtaacataggttaaaaatttacagattgtgctgagcttgacaaataagtgtatccttatgtaaatggaatataaattacatagttgtaaaaaaaaaaaactaagagtttgagatgacttcttttaacatgaagaaatggatagtaagtgatgtcctcaaaatcagagtcctaaaagacacctatctagaacctaagtcaccttcttcctagtccagtgatactttcacctcaccatgccatctcacttcatttattttaaaataagtaacattttaaatttatcaaaaggattgtttttatttttattttaaagcattattaaatatggatcagacttgaaaagtgtttatgcaatgttaatttaaccagtgttaagagaactagccaaacctagagattgtaaaactttttcacttcattgtttaaaaaaaaaattaatgtcttggcacaccaccaccccaaaatctcaacttttgagttaatatttaaaagtaatttttaaaaaagagtttgttttcttaagaaacaaaagcaatgctcttgatttgtcagcaggaccaccacagagtgagattgtatcttgttgagctatccaaactgccctagtccctccccattttgactaaccaatgcatgacaacactggatgaccgtggggacacagtccatgctgtgaaactctctatgaaagctcaaaggttcacacagggcctggccttgcaaccttggtctcttcaacacctaataagctataactggcccaaataatcttttaatgtcacaagcagaattaaaactatcttcaaagactcaagttgaagaaaagatttaaagttatactatgaaagagcagtctgacacagggagactacatttaattcctatgagaattttttatacttgttaaaatcttttcaattattataaaaatttagtagcatgtaaatatagccccaaaatggttgctataataatccccatttcatactgggtctgccttaacaggaaaagctattaggagtctttatagtaatttatctaatgtgaaaaggaaatggccttataatagtttccattgccttgtaatttttttccatttttttctttttatagaaaaaatataatattttggggagagtgaccatgactaatagcagtggaaaggagacaaaacctttgtgaacagtgtaactttacattcatcagggatgacaaactataggacatgatgcctagaagaatcatcatcaggaagcccataaatttgtgttccctcaatgtttcagtaaaaaccaattagaaggtctcaactgaaattagtaattaatccatttatgtgactagataaaacacagaatagggatgattcaaaagcttcattaatttgtttcacaccaacattcacaattggtaagaaaaataagaagtaatcaactgcatgcaccaaaagccccaagacagaaatcttaggtattcagtttctttttcacaggcattgctagttcaaaaaccaaaactctgggaatactggcacttagaggaaaaaaaaacttccactgtcattttaaaataagcatttaaggtaaaagctaacagtctgcatggagcaggaaaaaaattaggtaatgctaaaacaaatgctaataatttagtgtaatgtacaaaaattaccacttgtactagtatgccttaagaaaaaagtacaaattgtatttacataattacacactttgtctttgacttctttttcttctttttaccatctttgctcatcttttctttatgttttcgaatttctcgaactaatgtatagaaggcatcatcaacaccctgaaatacataaaaagtattaaaatgtgaatatatacgatggcttcatgtgtacaggtaacaaatttcattaatggaaaaaatattaagaaaggattctttatgtttctcttcaggcaactgaatatatattacatatattaggacttttagaattcttaaatgtcatccgcataggtgttttgtcaatattataaacaggaacactaattttcacaaaagacaaggataaccaatggcacagaattttaaataaggtaacgactttttcacaggagaacttaatttgctactattttttccacattggcaaacctaagtcatcaaaatccaaatgcatgtgtgtgtgtgtacacttaattgtccttatgtttctggactttagatataagccatgcaactgtaaactatgttcatatatcttcacacacagtaacagtatttgagctccagttctatacttacgtaaaatccattggatttaaaaatttaccaagaagtaaacagtattcgaacatcctattccaataatttatcaacaagtaaacagtatctaaacatattatttcagttttcaaatgatatatattaagggattagtttcaattcatatatttatcattaagaaaaaggtttaaagtgaccccaacacaggagaataccactttaaaaaaaacactaatacctcagatttgtggagaaattagctaaatcatttgaaaggtcttatagtttaccaatttggaggagattctttctatcccataaagttttaatttctgttgtattcaaaagcttgccatataaagccaaatatcctgtcttcaaagagtttaacagttagtcattgtgaccaccatctatttatgattaaagcaaggttatttaaatttaatggctaaaagcgattttaagccataatacttttcaacctaataatctacagtgtgaaaaatggcactctcaaactggtagtagattttaaacctgcagtacttaaattatgcaagatccatacacaagtcaattcttgtcatgtctccaattaaaagaaaaatataaataaaagcaaaaaatgaagaaaaaatatgattctctctgtattttaaagcctgttcaactgagtagtaactataaaaagaaaatctgttaacctcacaatacttccaaacctagacagcagagggagtcttagaaacaaatacccaacacattaagttgtataaatcaagccactttaggaacaatgaaaactgggtttttactcattgtaatcactttgtaggatattataaactgtgtaaataaatgtattaaaaaaattatatgtgtaaaaatattcaagtgatattatcttgaaattaatttaaaatgttaagtgggcggggtgcggtggctcaagcctgtaatcccagcactttgggaggccaagacgggtggatcacttgaggtgaggagtttcagaccagcctggccaacatggtgaaaccctgtctctactaaaaatacaaaaattagctgggtgtggtagcaggtgcctgtaatcccagctactcaggaggctgaggcaggagaattgctgaacccggagaggcgaagtgcattgcagtgagccgagatagcaccactgcactccagactgggtgacagagcatgactctgtctcaaagaaaaaaaaacaaaaaatgttaagtggtatttctcctttactgtactactaagattaacgatatttcaaaataaatctggagcatgaacaatgaaaattagctacagttcatgaattttcctaatagatctataattcaagaaagcgtgaccaatattttaagagaggtaaacatagaatgggaataagaggctagtccacattaagcaaacagtaggataaaaaccagcattatttatttgagcactagtgaaagtctccaataaagtccccaaactgcactcactgatgtttcccactctctaatatcattactgatactacacaaacatatgcttttgtttctcccacaggagaaaggaaaagtggtaagaaataatttatcagcaatacaataccatcaaggtttgattacatatatgtatgtgtatgtatcccttcaggctaaactctttaacacatatagaggggaaaatttccaatgatacaataaaaattattctgtagcttgccagcacttgacaatttacttgacagtttagaatcataaacccttagaatgtgatagaatcttaaaagaggatctaactcccttaccctgaatgaataaattccctctgatcacatccttatgtaatctactccatttctactacttttacaatgaagaaaaatgccaatggtactaaaatggtaaagcagaaaacaatgaaaaaccatgtgatggacacagagaagacacattttatggtgaaaacacagaatttgaaaacattacttcctaagattctgacaaagattctaggcttatgttgcaatgaactctcctctctacatcatcttgttaaaattaagtaattttggcccagtgcagtggctcacacctacagtcacagcaatttgggaggctgaggcaggagaactgcttgaggccaggagtttgagaccagcctgggcaacacagcaagaacctgtctctattttaaaaataaataagtaataaaaaaaaattaattaatttcaatcgtgaaggaaatgtcacaacctacacagagcaatgaattctttttttctcatatgagaactaatcattctcacacatacacataacattatctttttcaggactaagaaaagctaatttatatatgtttatcattgtcaaatttttatttatgtatttatttcctaaaggtggggtctcattacgttgcccagtctggtcttaaactcctggcctcaagcagtcctcgcgctgtggactcctaaagttctggcattataagtgtgagccactgtccctgtgccaaaatttttttatttttactttttttaagagatggagtctctttctgttgcctaggctacagtgccatggcaccatcatagctcccttcaacctcaaactcctggggtcaggcaatcctcctgcctcaggctcccaagcagctgatactacaggcacacacaccacagccagcttgtcaaataaatttttttttaaattgtatttaattttaaatttttaattaccaagtatacttctcttttatatgaattacttccacgtgtactgaaaaacaaggattcgtcacatcaaacaattgtgacattcacctacagtcactgtataaaacataatttgcacaaattagaaattttagaatagtacgtgcttaaaccttcattttaaatataaattagagcataacacttattttactctaaacaattctatttttaaaatcatctaatggtgagacaataggaggagaaaataaaaaattaaaaccaccacctaaatctggtcatggtactgttatttaaaatgtgtaacttttcaaactgtattgttaaatttgcaatattttagaggttgtggtaaaatttaacatgcaaaattgctttaattgcaaaatattgctttacagaatgatattcaaaaacattcagagttcataaatttcaacaaaaattaatgccagtcatgctttgtttctgagtttagtagattagtacaccacgtagtatcttttgggattgagtctactattcaaatgtatattttatacttttgggaaatacctaaaattcatgtaataaagaacaccaacttgtaataaatataataaatgtagtagtttttgaaaactgtaattttattgcctattcttaagaacatgatatattacaaacaatatgcatccaaagcttaagctctgccatgaactttatgatacctagtgaagtattttctgagcaagacagagtttaatacgggtttagaaacgaaaatgagaattccacgcaataaatatttactgggtagttactatgtcccaggaaccttactaggcaatgggtgtgcaaagattaaaaatatgtaattctggctaagattttgctgtcaagtaatataggaatgaaacagaagaggttagttatttcaacataacatgggaagcatataatagttaagaatagtattctgggaatacacaggaagggctccatgcctagtctaagggtttaaagaaaggtttttagagagtaggagactggggaatcatgagagtgttagctaattagtaagactagggataaaaatactggcattccaaacaagagccaagactcaagggaaggtaggaaataacatggtatttatttatagaagaacaaaagaaattcaggcaagatgacgtttttagatataagaccaaaaaagagctggagtggtgggaaggtagtaaggactatctgcaacacatgtggaacatgagattttattctatagctaaaatgactttttttttttttttttgagacagagtttcgctcttgttgctcaagctggagtgcaatggtgcattctcagctcactgcaacctctgcctcccaggttcaagcaattctcctgcctcagcctcccaagtagctgggattacaggcacgtgccaccacgcccggctaattttttgtatttttagtagaaatagggtttcaccatgttagccaggctggtcttgaactcctgacctcaggtgatcacccgcctaggcctcccaaagtgctgggattacaggcgtgagccaccgcgcccggccaaaaatgacatttctttaaagtgtatctctccggtttcacaatgaatgatggcagcaactggtaaaccaaataggaggttctaacagtccaacaagaaatgataggggcctgaactaatgatgacataaaagacacagaatgtaacgtcacaggaatttgtggatacttccaaaccagggggaaaagagggcggtaggagtcatcctaaaattcccaggtttctcactgggataagaaagtgctgtgctgctgatgccactgagatggcgaacttaggcagaagttattatttgcttgtaaaatatccaaaagaaaaaatacatttaagagtggctttttcccaccttctgggccattcaatattactgctgtctactatagctcatatctttttctccctactaaaaaaaaaaaaaaaaaaaaaaaagctgctgattatctcaaaacttttcccttaaaaataaaggtaaatatcagtttccaaatatttagtttacttaagactcattaaatcattagactttatgccaaatatagattagtctactacagccatcaaaattgtctcaattataattaattcccactagattaaaaataaatgtactaattatggaaacaagtttcttatcttttaatacttcaagttagaatactacacctaagtagttctaaagtggttgccaccttgttacctttaaaagacatctgctttctgccaaaattaatgtgctgaacttaaacttaccagattacattataatgcattttttaattttcacacagccaggagtcttttcttctttgctgatttttttcaatctgtattgtcggatctccctcaccaatgtataaaaagcatcctccactctctgcattgtaaaacacaacttctttaaagtctgttgcattggtaagagtaatttactgggaaagccatgtgcaagaagtttgagattatgagcttgagatttttttttttttaaacagacatcagactgtttgaataaaactgaggatgcagttttaaaatatgggctagaatcctggtttgttcttaaaagtcagttttgttttctaatggaattaaattttaaaatttttaaattaggaattaggagagattatgacaagcctaaacacaggtattagcatctgtttgtcaattaatgcaaccattttagtttgctagtcctggaattaaagcctaaactgaagttagctttaaattacttctttgacttaggaaaaaagtgatttatatactatcgattcccacaccctcctccaggggagaatgagaagaaaaatggtaaaatatggacgtgaaacctttgttaaaaaacaacaaaaacataaaagaatctcaaaggtgagtcaagaaactggaaccttgagttttatcttaaattttaacacctttcagtctatttccagggtatacaagtgaagctgagactgggtcttctgtacatgtttaattacattattaaaatcttaaatgagagctgcttaccataatataaaaacatcatgaattaaaggacacacacaaaataggagcattttgtatccttactacaagttctttttttatttttttgttttagagacagggtctcactgggttgcccaggatggagtgcaatggcacgatcatgactgcagcctcgacctcccaggctaggtgatccccctgcctcagcctctcaaatagctgggactacaggcaagcaccaccacacctgactgatttttgtatttttcgtagagacagggttttgccatgttgcccgggctggtctcaaactcctgagcacaagtgatccgcccaccttggcctcctaagggctgggattacagccatgagccaccaaacctggccttactacaagtcttaaaaataatttttagaacagtgttcaatcatactggctgtgtgccttccattctaatttaaatactcttaatagggtttttcttgcttaaacataagagagctatgacaacaggtacaatcatatattggccatatggagataaaagtttttaatattttccaatctagaaaattaggcagtcatcaaacggggcaaagtgcttagttaactgtgctgctagtttgttcagaaaagcataccatcaaagtaggggcacagagaaatacacagaaatattaatctatatatagtgcaaattaaaagatgtaatattatgttcattcttctaacagaaaggtgaatattttttaaagctggtatattttactccacatttaattttaagggaattctattcttttatcttaaaattaagaataaattacctaatttggggattggcatacatattttagctttctgagattggtaacatcaatgtttctactgaaccaaatgtaacaaagtggacctagcacctaaaaagttaatgtatcaccagtaccatttgcagttttaaattcaatcacacacagagaattggcaactaagtattagttgaagtaaaccaatggctagggcttaatttttgcatgcagaagtcatctgtacatctactgcctacagtagttaagaaaaacacacctcaattctttagggcacactaatttttagaaatctcagaattatattaagaactgctttagtaaagtacagaaatttacctctaaagtcaaactttaatttaaattcataatgttaagtttcagttcaaaggcaggcatttaagtaacgtgattatatgttaaaatgcgtatctcaagtcattaacatatactatccagtgatatatttatatttaacgaataacaaaaatcattatattctaagagcagtcttatcttatttttaatggaatcaatttagttaactagttagctaagccaactacaaactttcaactacattcgttggcactttaagttagatacccacttacacctgtatataaaagattttaagtgtcaggtgtggtgactaatgcctgtagtaccagcactttgagagggcaagagatgccaggagtttgagacctcatctctactaaaaataagataaattaggcatgttggcatgagcctgaagtcccagctactcaaaaggctgaggcaggagggttgcctgggcccaggagtttgaggcttcattgagctatgactgcaccactgcacttcagtctgggcaacagagcaagaccctgtctctaaaaaaatttttttaatcgttttaaagtttatatttatcattaatcctcagaaggaaagggtttattatttttacctttgtcttgaaaaaattatgtatccaaaattttcattaataagcaacataaataatttaaggcactaaaataactttgtagcatgtaaaatgtaaagcatgagctctgttaagatactttcacaaatggttctctttcaatttgaaaatcaatgtaagaaatttaaaaatatgtgtatatatatacgcacacacacaaaccaggtaaaagctcatattttcataaattttctaagaatgtaaacttctatttctgtttaaaaaaaaaaaagttataatgtcaatgtagaagtaccaaaacatactatgaaggagaaaaacagtattggtcctctactaatttagcagaagcaaattttgattttaacttatttctaaaatcaatatgaatgtgtctactttttcagtgacagcatccccaccaccaatagtgaaatatatgatttttgtttccagcaatgcagagagaattggaagccaataattaaaaagaagagattattatccaccaccaagaattcagtgtcaggacctcagtggctcatataattaacagcacagggtgacttttaccatttcttatttttagtaataagaaacttaggttttagagtaccagttatttaccacagtttttcagacttagttatttcttgataatatgctttaaagtcatactgacatcaagagaacatgagaacattatccttgtgtacactgtaaaccactggcactggctcttatttttaaaatgcctacagtatatacctatgaaacaaaacactagtttttcacattccaaaatctgtagataatttttaaagataaaatatagctgaaacagatatttaataccgactggctactcattaagctcttaactagcacacaataatttttttgagaataggacttgttgccacatatactcattttgtgggggttttttgtttttttttaactttttctttttttgttttttttttttgagatggagtctcgctctgccgcccaggctggactgcagtggtgcaatctcggctcactgcaaccgccacctccgggttcaagcgattctcctgcctcagcctcctgagtagctgggactacaggcatgcaccaccacacccagctaatttttgtatttttagtagaggggggtttcaccatattgcccaggctggtctcaaactcctgaccttgtgatccgcctgcctcagcctcccaaagtgctaggattataggcatgagccaccgtgcctagcctacttttgtttttatacacatatactcattttcaaatgtcacttattaaactttaagaacaactgaaaatacgtaggaacaaaagtatacaactttaaatatgtaaattttttaaaatcaagagattgacaacattttcaactcaactattatctgaaaacatacttgtgaggctatggaaacaaagcactccatatagagaaagtactgttagccaaagtatcattctaaatcttgctagactatgcttttactaagagattttgttttaagtaagtttttgttcctgttaaatctgcaaattcttgcaaaactctgtcaaggaagcaacacatcaaataccctaactatatacaaatgcaagactaccagccttttggtggggaagggcatggaggaacaagatgtattctaaaacccaactgtgcatccctcactttctcaagaaaccttgccacccacagcctatctcatgtactattgaaatgcagaaaaaccactacttgggagactaccatggtgcacagcaagtgcacagtaactgttccgtcaatttttaactcataaaaagctatagttcaaaatattgatctcatgtacacaaactcaactactattaaacagagacatagcacataaggaggttgttttgcaaagcattctttaacggggttcttctaacaattaatttaaatatctagaaattaacaacaaaaccaggaaatgaatcactcaacatttttaggttcgtaaaactaattttcacattatatttaaattgagacccccagagagcagaaaagccgaatgaggagtaacagataccccgaaaactctgcttctgttattcaccttactgaaccctcccacttttgattttagcagactggaaaacacacaattctcatggtgtcaatgtttcaattttgacagcttttgccaacatggccatgcactgtccaaagggaccaggaaaatctgtcaacaacccagataaatgtgaactaggtaacagtccttatacactaggaacatagggactacacaatgtactagcagaaaataattctatttgcctttcagatatggactgaactgagtgtaaagaatatgtaacgcattatattctagccaagtaattagctttttaaaattataagttattaagttggtaaaaatatataccctgcaattcttatcttaaaaagtacagctgggcacagtggctcacgcctgtaatcccagcactttgggaggccgagacgggcagatcacgaggtcaagagattgagaccatattggccaacatggtgaaaccccgtctctactaaaaatacaaaaattagctgggcgtggtggtgtgcacccatagtcccagctactcaggaggctgaggcaggaaaatcgcttgaatccgggaagcggaggttgcagtgagccaggatcgcgccactgcactccagcctggcaacagtgagaccgtctcaaaaaaaaaaaaaatactagagaccaggcacagtgactcacgtctgtaatcccagcacactgggaggctcagatgggaggatcacttgatgccaggagttcaagaccagcctggccaacatggcgaaaccctgtctctactaaaaatacaaaaatcagtcaggtgtggtggtgcgtgcctgtagtcccagctgctcgggaggctgaggcacaagaattgcttgaacccaggaggaggaggttgcaatcagccaagatcccaccactgcactccagcctgggtgacagagggagactctgcctcaaaaaaaaaaaaaaaaaaaaaaaagagtactagggtaaaatttctatttcctttccatgaactatgttaagttttactttaagattattaaagttagcctgtaaaatacaaaagtttaacctaacttctagtagctaatcaaacactaaagttacccagagaattaggaatcagcatattacagccaatggaccaaatgcagccacagccttttttttttttttttgagacagagtctcgctcggtcgtccaggctggtgtgcactggcttgatctgggctcactacagcctctgcctctcaggttcaagcaattctactgcctcagccccttgagtagccaggataacaggcacccgccaccacgcctggctaagttttgtatttttagtagagacggggtttcaaccacgttggccaggctggcctcgaactcctgacctcaggtggtgtgcccacctcggcttcccacctcatttctgggattacaggcatgagccacagcatgcggccagcctatttttatactatgcacaagctaacaacgatttttgcattttaaagggtcataattaaaaaaaaatgcaacagataccacttgtggccctcaaagcctaaaacatttactatcttggccctttacagaaaatatttgccagcctctgatttacatggatgagaacttctaaatgaatgttttgttcctttaaccggaatataattctttttgggtgtttacgtgttttaggctcatgatcaagaccccaaaagttagggcataaaacaacttgccgataaaatacaacaaggatatgcacactaattttgtttaaaaaacaaataagggccaggcgcggtggctcatgcctgtaatcccagcactttgggaggccgaggcaggtggatcacgaggtcaagagatcgagaccatcctggctaacacagtgaaacccgtctctactaaaaatacaaaaatttagcaaggcatggtggcgggtgcctgtagtcccagctacttgggaggctgaggcagaagaatggtgtgaacccgggaggcggagcctgcagtgagccaagatcccaccactgtactccagcctgggcgacaaagcaagactccgtctcaaaaaaaaaaaacaagaaagaaagaaaaataaataaataaataaataaataaataagctgaataacagatgagtaacaaaatactctgcagaaaggaggacttgacattttcaccagtaactggagatgtaaaatttattaaaattcccatatttcattttataatctctacagttactcggaatagctctttaaagtcttccagaagcatgcaaatatcaaattaatttcaacggaggaagattaataagacttttgaaaggcaaattaatttctaggcaaatcaacaagtccatttaataataaaaggaaatcaaagaacagaaattaaatatctaatttatagtttagcaacataaattacataataacatcagtgaaacaggatgtaaaagaaaggttgagtgctctgttaagaagtacaagtattctttcatactgtatccctccatttttaattagatgatccacataaaaatgtctacaaatcaaatttgtttatctacttacatattatataccttcaaaaaaacaaatcaaacaaaaaaacccaaggccacaaaactgtataaaacctaaaaatctcttataaaaggaagccagatagttttctgatcaaatatgaatgctgtgttatattaaagtattaaggtcaaatagcaagaatcaattagtacttctgaggtagtaatcatacaaccaccaaaaaggagacacagctattttaggatattatcaaatgagaagtggacagcaacaaagtgggactaacaagactctttttatgtcctctactgcttttctactcaaagtatggtccaagtaccaagaaaaataccacctaggagtttgttagaaatgcagactcggtccccacctaaaccttctgaattagaatctggattttaataagcccagctgatttgtatgcataagaaaatataagaagcacttctttactgcaaccccttaaaacattatgcaaagtctcttaaattttttcttttctttgtgaaatgtaagctaaaatgttcagtggtataaaaagcatcttttaaaagttgtaagtaaagcaaatataaaacaacaatggtagaatctaggtagtatatttgcaaatgttttaaataaaactcaattttgtatttgaaaatgtttcataagaaaatgttggaagaaaaaataataaatattagaatcatgttttctcagtaccttctctcctaagaaaagtcaaggagactgtaaagacagtaaaaagaaaaacaaaaaccaagcctcttcctggtctttggaacctggaaatggatttatgtgaaatcttaattcctctaaagtaaagtgatatatgatatacaccaagtttaacctataaatcaggttttagtaaaattgccagataaatctgtacaatggtcaaactagagaaattcagtttttaatcctcccaaaatgacttgaagtagaatttactgtttctttactatatatcaaatttgtataactaggaagaggtacatatgctctcctactagggaaatacaacatatatattagctggataatgatttacatttacatttttgcacctttatgaaatttgataaacttctagaacgcttgtttttaaatgtttaacaatgtaaaagttgttcagcaattttttttaactcctagcattacagaagttaatttctacaaaactggttttctgggctcacaggtaaatgtaaccagaaaaagccctaaacaaattgatggaatatagatggatcaatttcttagtacagtcatgtaccacataatgacattttggtccacaggagattgcatatgtgatagtggtcccataagattataatggagtttaaaagttcctattgcttagtgatgttatagccatcctaacactgtagtacgacacattgctcacgtgtttgtggtgatgctggtgtaaacaaacctactgcactgtcagttgtataatggtatagcacctatattgttattttatagtgtactcctcctatttactaaaaaaaaaaaaaaaaaaaaaaaaaagttaactataaacagccttggataggtccttcaggaggtattccaaaagaaggcaatgttattataggagatgacagctccacgtgtgttactgcccctgaagatcttccagtgggacaagatgtggaagtggaagacaatgatattgatggtcctgaccctgtgtaggcctaggttaatgtgcatgcatgtcttagtttttaacaaaaaagtttaataagtaaaaacaaacaaaaaattttaaatatggaaaaaagcttacagaataaagatataaggaaagaaaaatttgtatagctgtataatgtgtgttttaagctgtattacaaaagtcaaaatgttaggaaaaattaaaaagtttaaaaagttacagtaaagtaaggttaatttattattgaacagaaatttaaaaaaatatataaacttagggtagcccaagtgtaggtttagacacacaaaacttaccattgtgttaacaattgccttatagtcattagtacagttacatactgtacaggtttgtatccctggggcaagagactatactacatatcccaggtgtatagtaggttatactaccaaggtttgtgtaagtatattctatgatgtttgcacaatgacaaaatcacctaacaatgtatttcttagaaagtatccctgtcattaagagacatatgactacatataacaattaattccttcctatctttatgtattcatttcctatatgttaaactcttcatacaaacaggttaaataatagcaactgaaattattttattttacctgaagaaaaagtcatttttaaaacaaagatgatttttgaaacaaaattcaggttctctctggcaataatttttgtcagaaaaatgcattaaatgagtaacagaatttctgttggctttctgggtattgtctttctttaatgagacctttctccagaaataaacacatcctcaaaaaaattctgccaaagtaaaattcttcaaatacaacaacgtttaacctagaaacatgacataatggtttaaaagtactaccgaaatagaaaacgcaaaaatttgttgccctgttctttatatatatatatatatatatatatatatatatatatatatatatatatgtaaccatgggaaaaaaaaatccccacctcttgaattctaaatgttaacatgtgctcagaattgaagagaaattttcaatgtagaaagaaaccaaagccaaaagcagtaccatggacactggattaagaagcaatgccctctcaagagacaaaaacatttactaaatattgttttatttcctagtatagcataattgagagaaaaactgatatattaaatgacataacagttatgattttgcagaaaacagatctgtatttatttcagtgttacttacctgtcttgtctttgctgatgtttcaataaaaggaattccataacttcttgctaagtcctgagcctgttttgtgtctactgttctagaaggcaaatcacatttatttcctactaggaccataggtacatcttcagagtccttaactcttttaatttgttctctgggaaagaaaaaaaagttatagcacagtcattagtaacacaaatatctttcaaaacctgtccacaacttttgtcataaaatttggctgaaagaaaacaatgtaattcctagtttccactacaccaaattttccttccttcttctactagttattttgtttctttacctttttaaacagaaaccttgtatctctctcaaaagatcaaatacctagaagtatagtaaaactataacctaataggttaatatgcaggtagatcataatagtaaaacagaaactactgaaaaattctagacccaaagtgctatataacagactataattttagaaacgtatgttaaatgtgtaaagataaaaaatattttacaaaaacctgaattaaagcattaacataattttcatattactttttcaaaaaacaaagtggacaactagaaagattttgatttctaggtaggcaacactgaagttactacaccacttattccattaaaagcccttctacatgttaatcattttcaatataacaagtgcataaactctaaatttggggtgaaattacattccctcacaattttaggtgactttcaaagacacagcacaaaagaaggagcagagcagacaacagagtcagaattggctcaaattcccggttccgaacaccattagctgggtaaacttggataatagagctgaaatttggtaactcctctataaaaatactaccactaccacccacccaaatgtcttttcctctattactagactatacagtaaacatgctgtaacaatgttcttaaataaaatgttaaacttcttataactaggctaactcgttattatatgacatagccactgagtgattcatttgcttaatatgtagtttttggaaaactaaaccctcaaagaaatagaatataaaatagtataataatgattattttaatagttttatgcagctttgtcagatttaagagaactgtaatgcccaaattcttcaatctttcaaaacttttattttttaaaatatataatgccactgtttatccaatccaagcaattctatgctatacacacgattgcttttaagactgttaaagtgacaccatctcaaatcatcttttcatattcttttttatggttttcttttttaatgatgtatctaaaaagtttaaagtcttgcttttgtagaatagtcaagagtacagaaggctgtggagtcaaacaggcctaggtttcaatcccagcaccaccactaccgatgcagtctggagcaagttactccactgctctaatcccccaagaacttcatttataaaacagggatattacctacctcataaacattatttaaaaatttttattaaatattatatgcatggcattagcaaagactcaaaaaataaaaactataattactccttaatgtcagcttattatattcaatttaaacccacctataatggtgaatatcttcaaatgatttagtattatttatggcaaatacacaaagaaagccctccccagtcctcatgtactggtccctcattgcactgtactcctcttgacctgctgtgtcgagaatatccaagagacaggtttctccatcaattactacttgcttcctgtaggaatcctgagaagggagaaacacagtctggattattacagtgcaccttttacttcaaaaaaggtgttatatacaactcaacaacaaaaaattcaatttaaaaatgggcaaaggacttgaaaagacattgttcctgctccaaagatgacggacaaatggccactaagcacctgaaaagatgctcaacatcatcaatagtcaggaaaataaaatcaaaaccatgagatgctaccacatacccattaggattggctattattaaaaaaacaaaacaaaaaaactcaaaaaatggaaaataagtgttagcaaggatacagacactgaaatctttgtgcattgctggtgggaatgtaaaatggtgatgccattgtggaaaacagtggtagttcctcaaaaagttaaacacagaattaccatatgatcagcaattccattcctaggtatataaccaaaataactaaaaacagggactcaaacagatacatgtacaccaatgttcgcagcagcactatttataatacccaaaatgtggaaataacttaagtgtctgttaacagatgaatggataaacaaaatgtagtatatacatacagtggaacattattcagccataaaaaggaataaaatttcatataggttgagcattaatgcaggttaatccaaaaatctgaaatccaaaatgctccaaaacctgtaacttttagagcctgacatgatgctaaaaggaaatgctcactggagcatttgattttggatttttttttctttcatctttttttttttttttttttttttggagagatagggtcttgtgttgctcaggctggttgaactcctgggctcaagcgatcctcctgccttggccacccaacgtgttgggattacaagcatgagccactgagctccatctgattttggatttttggacgagggatgctgaaccagttaagtatctatgaatattccaaaatccaaaaaaaaaatctgaaatccaaaccacttctggtcacaaccattttggataacggatgcttcaacctgtatatacatgctacaacacagatgaaccttgaaaacattatgctaaatgaagtaagccaacacaaaaggacaaataccacataattccacttatatgaggaacctaaaataggcaaattcaaaaagacgaaaagtagactacagattaccaggggctgggggagggaggattactggggactatttgacaggtacagaattctaatttgggatgataaaaaaaagttctcaaaacagatagtgctaatggttagacaacatggtgatggttgcacaacattatgaacacacttaaggtcactgaattgaacacttaaaattaactaccatggtctaggcgcggtggctcacacttgcaatcccaacactttgggaggccgaggtgggcggatcatgaggtcaggagatcaagaacatcctggccaacatggtgaaaccccatctctattaaaatacaaaatattagccgggcgtggtggcgggcgcctgtagtcccagctactcaggaggctgaggcaggggaattgcttgaacccgggaggcggaggttgcagtgagccaagatcgctccactgcactccagcctggcaacagagcaaggctccgtctcaaaaaaacaaaaacaaaacaaatgaaagaaaactaccatggtaaactttatgttatgcatattttaccacaaaaaaaaattttttaaaggtattatatggagagtcaacaatgcaagtgtacatgctggtaacaaaaagttattgacaaaacaaaataatttcaaaaatgggatagctctaccaactctattattcaagatgatttaaatgacaagaaaaatcaatcaacttataaataattgtcatgcatctattttatctatagtcaaaggcacacataaggaaatgggcaatactcaagattctaatggcctcatccacttctgaaaactgtggaaaaataatctaacagccagatggatatctctaaagagcaatattgtttcatctgcaaatcctgaggggcctcttttttcttttctaaaaagagagagaactgcaactataagattaagtaaaagaagggagtgggtaactttaacagaatcttgaaataaaaatctgattttcttctgacttttgggtaatacttctgctcaagatttcacacattctgccaaaacagtcctcaaaaaatatggtaaagggatgttacaatgtgaagccatgaaatcatgaaataagaagcagggctaacaacaggtataaagcataaacataaaagcaattattttcttaatgttccacatgtaggctatagtattaatgtatcttttttttttttttttgagatggagtctcgctctgtcgcccaggctggagtgctgtggtgcaatctcggctcactacaacctctgcctcctgggctcgagtgattctcctgcctcagcctcttgagtagctgggattctaggtgcacgccaccacgcccggctaatttttgtactgtttttttagtagagatggggtttcaccatgttagtcaggctggtctctaactcctgacctcgtgatctgcacgcctcagcctctcaaagtgctgggattacaggcatgagccactgcgcccagcctctaaagtatgtttagtttatgaattactctgtagaccattctatcagagggagaaagagagaaagaatggtcattacaaatgttgttagtaaagtatttcaaaatgtttacagtataaggagaatataaagatgtctaagtgcagcatgatcacaataatatgtgtttatgtatttatacaaatctactatgtgtttaaaaactggtaatatatacatcaaaatgttataaaggttatgtctttaatggagataatttaaaagacatttatcttggccgggtgcgatggctcatgtctgtaatcccagcactttgggaggccaaggtgggcagatcacctgaggtcgggagtttgagatcagcctgaccaacacggagaaaccccatctctactaaacatacaaaattacctgggcctggtggtgcatgactgtaatcccagctactcgggaggctgaggcaggagaatcacttgaacccgggaggtggaggttacggtgagctgagattgtgccattgcactccagcctgggcaacaacagcaaaactctgtcccaaaaaagacatttatctcttgcttatctcttttctttgtactagatgctatgttaaatgtttttctttggttttcaattttttaaagtatgaaaacctacatattagactataattttgtgcttatcttttaaagcatatggtattttccaaaccatctgtaataaaaattaattatctcaccagtcagaaaaaaaagatggatatttattttctaaataagaggctctttagtagagatttgagcattcagttgacatttacttaatttagcctattctcttattaaatacttgaaagaactcctatagatcacaaattaaaaaccattctaaagagtaatgaaaaagcaggaggtgggagcaaagcacagagtcttagagtcaacccattacccaggcatggctacagagcatgtaaagctgaccaaagactcttcctacctattgctgccacctcacattctttttttttttttttttttttttttttgagatggagtcttgctctgttgcctaggctggagggcagtgacacgatctcgagtcactgcaacctccgcctcccaggttcaagcgattctcctacctcagcctcctgagtagctgggactactggcacgtgccactgtgtccagctaatttttgtatttttagtacagattggccaggctggtcttcaactcctgacctcaggtgatccgcctcggcctcccaaagtgctgggattacaggcgtcaaccatcgcgcccagcctgtcacctcacattctttacttaccaatgtaggctgagtatccctactctgaaaaaccaaaatccaaaaatacttctaggtcctaagcatttcagataaagaatagtcaacctgtaatgtgggatattagtagtttatgtacatatttcataagatgcttccatggtgaatacaccagtgcgaccgagaaactgggaaagcagtcccctattcactgataaatctcattcctattatcttttccctaccagaccttaaaaatatcgatagcaaagttctgagacacattccgtttcaaagtaatctataacctactcataaataatactgttgattagaaataaaaggtttaggttaaaaattcagtatttttagagttaattttaactagggtcctcactcttagaagtgcaattagtcactgagctattttcagtgcaacttggtaaaaactaaagaagaaaaagtgttaaatgaaatacgatctaaaaagaatggataaatataaagagaaaacaaacgcaacaaaaattatatattaataaagattctgttccaacttcaggtcaggccataagaaacagtcatccctggtatacacacggcattggttccaagacccccccagcctctagtcctacagttggcccaggaacatccaggtatatgaaaagtcagccctccatatctgcatttggttgggaaaaaaacgtgtatcacaagtggacccatggtcactcaaacgcatgttgttcaagggtcaactgtatttggaggaagaaaaaaaaatatgcatcaatgtagactctttcaaaaaatttagagtctaaataaggtttcagcaagctactgcccacaggccaaatcttgcccactgtttttgtattgcccattagctaggaatagttaaatagctgtttaaaaaaacaaaaacaaaaacccaagactttgtgacaaagacccatatggccctttatagaaaagtttgccaactcctgctgtaagttaataactcttcacattatttgaagtattctcaacaaatattatttattctctttatatatttttttaaatttaccactctgagaaagtactggttatgaaaacccatctgattttaaaacacagagattctgtaatgaaactagttaataatggagcaaagacaaggatgaaggtgttacgtttttaattagtatttccagcctttcaaaaaagtaaacttttaaattaggtacataagttaccaaggttactaatttgtagccttaggaaactacgataaaataaagtaacttaaactaactcacaataaaatattaaatgaaggaaagttattccccatagtccccccactcccagctaaaatattattttttccatctacatagtaaaaaatttttctaaatgaaatgtactatactggcaagactgaattgtagacagaattcaaacatttctggtgacataataagcacaatatttttggaaagcaattacagtatttatctaaagtcattcaaatgttcatagcctttgacatagtaatgttactatgggaaattatgctaagaaaatatgtggtttttttttaaatgacagttataaagagattcttaacatggcatcctaaaatgtcttacaaagaaaatttacttaagcatttaaaactgacccataatcttgcaccatttacctatcttcaaaatatatcctacatccaaccacctaccaccaccaccaccaccatccccctagtccatgataactattttgtctcaggcaatctgcagcaattgcttcctagcaggtatccctgctgttaatctcacaatatagtctccacacagcagcaagtgatagtttataaatgtaggttagggctaggcaccatgggctaggcacctataatcccaacaccttgggaggccgagacaggtggatcacctgaggtcaagagttcaagaccagcctggccaacatggtaaaatcccatcaaaaatacaaaaaatacaaaaaaaaattaggtgtggtagtgtgtacctgtagtcccagctatttggggagctcaggtgggaggactgcttgagccaggaaggaagaaaatgaatgaatgaatgaatgaacgaaggtaggttagatcatgtcattcacttgctcaaagtcctccaatagcactcttcggtcttaaaaataaaaatgcaaagcactcttccttctctggtacctcctatgtttccttcatagcatgtattataatttgtaattatgtatttacttgtgaaattgtttaagtctatatcctctactaggctttaaactccgtgttggtagggctcacgcctgttgtactcaccactacacaccctctacctaacagtcttgaacgctataggtaattagtactgcctcttaaataagtgaatgaatccatttgatgtaaatatatgcagatactaaaaaatgaatggaaattttattagaattaagcagttaacataaatacaatttaacagatttttcaattatataatacaaatccttctcaaatattctgaagatactacatatttgaaatgaatgttcacgacaaatgccccactttcaatgtaacagtgtgcaaaggcagattttttaatctttcaacaatttgttttaaaatctatgtttcaatgttctcttagaaaaacaagcacatgtttaagataccataaattttatcaagacaatgaagctgttaatttttaaattacaatatatattaagaataatttaataaattttaccttcaattaaattttatataatatgtaaagttttatgtaaaaatacaaccaaaacaatacacacagagattttaacacatttatgggagggaagaaaataagactagggaaaagaatgcaggagtcttcaacaatattaacttttctatcttggaaaaaagaaagagctaaatcaaatgttgctaaatgttaagatatgaaagagctggttggtacacacatgaggttcattatactactattctataaagcactaagagtgcacccattttatcattacttaaaatggatttcatatttttaaatttttgttggtttgataagctacacatttttattgttttcataccaatttctttgaggagtaataatgttatataggttttttttcttatctgcatatttatcgccaacgtgtgtcctttgcccatgtggaattttaatcttcttttacactgacttgcataatttttttaatgaagtgtttcctggtttattaaatgcctttattttgaggaatttaaaagctaactcattcaagataagataacctcattaaccagaacatcaagtttgtcatttttccattataattaataactaaattattcagtgtgttcaccttttaacatactcgagtatgggttttccaactcaggcagtgactctgacacagagacatattccatgtatcaaaacaaaacaatatatacattccaagtatagattttgtttactatattgtagtaaacaaaaaacctaaagaaactaataacttttactaaaggtaatcatattactattaatagtaattacagcagtcaacatttactgagcccttacttatatgccagatactgtcataagcatattacaaacatcatctcatttaatctccatcttcattctgccaattccatgagatgctcttctcaatataactagaactgctgaaaatgtcaataatgtattactcggggatttcctcttgaaattgtatgttttcttaatgtattaagtattgtaaggactttttacatactgcttaataacacctgtaggaaaagatgagaaacttttactcaattaatgctcaagtactttacgttactcttccgaaaggttatttaaattcactgtagaatgatgtgttccgcactttccgtttataagccatcaaagacggttgtagactgtcagaattataatagggaagaaacagggaatttagggtatgtaaacagaggttgatgagttcattcccatctacccacatcagtctcccttgtatcatagaaacacttattgaaaatctaggtgtcacattccgtgtcacacattatatagtttctgacctcaagcaactaaggtgagtggaagagacatgaacgtaaataaataattaaaataaaatgaatgtaacaccatatgcaagacgaagtacaatggtggcacacaggagagatcaactttgtatgcattaagaaagacggggaggggaaggacattccaagcaggaaggagcaaacagaatgtaaaaaacatagaacagcatgttgaggacacagaaccaaggagctccatataactttagcttagaacagcggtccccaacttttccggcatcagggaccagtttcgtggaagacaatttttccaaggaccgagttgggggtgatttcaggatgaaactgtttcacctcagaccatcaagcattagttagattctcctaaggagtatgcaacctagatccttgcatgggcagttcacaacacggttcacgctcctattagaatctaatgctgccgatctgacaggagctaaggcaagtaatgctcacctccttccggctgtgcagcccagttcctcacaggccacacaggtgggtaccagtccgcagtccagggtttggggatctcaaaggcttagaggatctctaaggcttagaggccttagaataagcaccaagaagtgaaactggacaatcaagcaggggccagcttacggagggtcatgtgtatattaagtaaggagttttaaacttcatcctatacaaaatcactaaaaggtttttaaaataggaagggagatcagattcattactagcattatcatgacaaattatagaaagggacaaaatgttttggcccttcccagacactgactcatcatacccactcagattcaccagtagcagccaaaggcacctctgcagggattaagcctcagcgacaaggggcccctcctctgagcttccagttctgataaaccccaaatcttcccagcattccctgaatcttaggagtagtgcccattcttgatgttactgtgttacttcagtgtttttttgcctttcagtcttccaacacctaattagttctctgtgctgaaatatctagtatggtttctgctttctgaactagacttttgacttctataaatgttaaaaatgggtggaaataagagagagaagaagggggagggagggagagaggggagcagagactgggagatgagctacgaattattacaagaaatgacaaaatctgaactaaggcagcaacagcagtatggaccgaaaagattaaatagatttgagaaatacttaggtaaaattgttggtaggaatgtaaacagtacaatcactaccaaaaccacttggcagttcctcaaaaagtcaaagacagagctaccatataacccagcaactgtaccttagatatacacccgagagaagtgaaaacatatggtcacacaaaaacgtgtacataaatgtttatagtggcattattcaaaattgccaaaaagaggaaatcactcaaatgcccatcaaatgaacagataaacaaaataaggtatatccatataacagagtattattcagccagaaaaaggaatgaaggaatgatcaacaagcaaaaacatagacgaactctgaaaatatcatcctgtgtggaggatgccagacacaaaaggccacgtctgtacgattctctttatatgaaataatcagagtggacaaatccacagagatggaaaaattagcagtttttagaggctggtgggagaagggattggggagtggctgctaatggatgtgggacttttggggtgataataacattctggaattagtagtaatgactgcacaacccttgtgaatatactaaaaaccatgtacacttgaaaagtgtaaattgtatgctatgtgaatacatttcaattttttaaaataacagagcttaccgacaggggatgagtacaaaggggagggcgaaggaaaagatgagtgatattgggcatgttgaattccctgtactcatgggttgtcctggtggatatgacctgcaggcatcttgatatacatacatgtctggtgctcaggacagaagtccaggctagagatagacttgggagtcttcgatccatggacagccgaagaacttcacttatttgtgctatgggcttgggcaaactactttatctcacatcttctctaagctattgttccttcagctgtgaaagtaggtaaaactgcatacaggactttatacatagattaatattaaagaccatgaaaatctctttataaaatgaaaagtgctataaaaagttaactgcattattttatatactacacgcaggccaaaaagtaggggcaggccactggctactgagaactgttcagaaacagtatcttctccttacaaaatcactgggcacctacagttgaaataattttgcaaaactggtcaccatatttcaaaataaatataatggagctggacaaatcacagggaaggatagctacaactgaaggctatgaaggatttctgttttgattagggagtgaagatgttaaagagcttattttcatggcagaattttcaattaaaaactaagacattcactaaaagtaaggataaagaaaacaaagacttctttactaaatgctggatacttaaaattataagaatggtgaacattagcttagtactagagagaattaagtgtgtactactcccaagagaaaaaactagttcaaaaatctgaatgaactcaaggaaaatttatatgacaaattttgaaaataacgatataatgagcatacatgtgtaacctgttcaagtcagatggcatttgcccacaagtgatcacttgaagtccaggtaagaatgagaggctggaatgaccgtggatccaatcttaatgccaatataatgttcatattttatattatatacctctcatattatttatttagccttaatagcaatttccttaatccaagactacatgtgaattatgtaatttattgaggcttgaaaaataagcatgaaataatctaacggtatctgaaactttagtgcccttttctctctccaaaacgagtatttacttttcccccagcccaatggtataagcttattttaaaaaactaaaacacaacaaaggatgagggagtaattttgtttctagatgaaatcatactcaacacaaggtgctgtgacccagcttcacttacataatggacatttttgaacatcagtatatctaaatctacctaatatttccaacaactatgtaatttgtatatatggacataccataatttattcacccattctctattggtagacatgaagatgatttccatttttttaaaatcataaacaacactgcagtaaacattcttatatatacatcttaaacatttatccaattaaatccttggataaatttcaagaagttgaattacctggtcaaaggacatgtagtttacattttgaaacatatttccagactgacctccataaagtctgagggtctatactcccactacagtgcaaggcgcacacttctccatacccttcctagcagttatcattttaaccttagccaatatgaaagtacagaaatgttatttattgtttgaacttgcatcacattcatgaagtaagtgtctttttatatgttcatgttatttattttatttcttttttggtagacaagctatttatatctttagtaccccccatccctttttttctatttgtgtgtttgcttttctctaattcatatataagatagcttcctgttacttgaaccaaatggtttttctaggttttcatttgtcttctatctttgttaaagaaaacttaatttttatgcagccagatagctcagttttttcccaaatgtttgccttaatggtttaaggatactctgatgatgagaaaggagtctcacttttctcaagggtgaaaaatatttatccaaattccacaaataaggaaacctaaagttaaatcactcaatctatgttacttagataacactgcaagatccataatttaagaatgacattatcatttttatttcacaagtgtatagtttagcattaaaatttacacaaggagaaacagggtagaaccagggttctcactgcgggagaaagaaggtgaaaaatagttaactcttgatttcttagtaacatgcatttctaagctctgtgccttgaaaacggtctagaagcagtgacactgctgaggcgggcagatcacgaggtcaggagttcgagactagcctggccaacatggtgaaaccccgtctctactaaaaatacaaaaagtaattgggtgtggtggtgcatgcctgtaataccagctacccaggaggctgaggcaggagaatggctggaacccaggaggtggaggctgcagtgagccaagatcgcgccactgcactccagcctgggcaacagagcgagactccatctcaaaaacaaaaaaaaaaattaatagaaatagtgaaaataaaatatttgaaaggattaaggagggacacactacctaccttacttttttcaatgttttattttgaaaaaatttcaaacctatagaaaagtagtaaaaaatagtacagcgaatagcctcagcctcccaaagtgctaagattacaggcatgagccaccatatctggcttatttctactaatttctatattaagatcccaataatttaactgttccataacctacacattatgaaataataatggttaagagacgccagaaatgtaatgctcttaagtataaagcctctaaattaagtcatatataattagcatgattgcctagaaacactgctcttcaaaataaagtgggccatccatatccatgggtactgcatctacagattcaaccaattatggataaaagatattctgaggaaaaaaatccatgaagttccgaaaagtaaaacttgaatttgccatgtactgagtactacgttgaacccacatgaatgaactgatgtgcaggcattgtaataggtattacaagaaatctagagatacctaaaactaataagctccatgaaggcaggaatctggtctgttttgcgcctcagtgtatctctagcccacaggaagactgcatggtacaaagtgggcagtgaagaacatttctaggattaaggaattagttgtattgttaaaaccagaatcttaggagattccaaaccataaaatcattttttcctttcacttaattccattaccaacttccatttgtatgtttttaaatctttggatttataaaaacccaaggtagaaaaaaaccatgaccagtaaagttttatattcaggtcttaataaatacttattcttaatttgacctaaatacagtacctgagttttctgtttattctaaaaatcaggtgctcacaactattctacagtcctataaaactctacaaaatgtgcactttcacaatttgccacttctgaataggaccctcctatcatcccctgtaacacaccaccaagccttggactccattaagcagctcctgagtgcatgcaaagaagctcagagagccacactgctgccttttagtcccttcaacaaagtaagctcagtaagtgttaacaactgaaccaccctattttcttatatactgcctcgtttcctttcttagttcactatactcacctacttagttaggcctaactaatacagacagtaatctttatattaatattagcagagagcaaaaatgatacgaaatcaatcatataagacttttaaataaaacgaatatatttataaattgatgccacccataatttaaacagcgaaactacacaaacttaggatttcactgttacttgttataaagcaaataatttgaccagtagagggcactcacaaaagtggggagagcttcacagccttgaagagaaatgatttataaaattgctgtgtgtctctgattttaaaaacagaatgttttaatagaagactggagtaagctaacatatcattaacgtacaaaagttaaagtttaaatctttgttatacttgaaaatctaacataaaccttatgtcagggacatgaatttgacaatttaaaggatgtttaaagctacaggttaacatatcaaggtttggatcttaacaccattgaggtttggggtcagataaccctgttgtgggggctttcccgtgcactgcaggaagtttaatattaggttggtgcaaaggtaactgcagctttgccatttaaagtaatagcatctactcaatagatgccagtagcagtactctctccccaagttgtggcaaccaaaaacatctccagatgttgccaaatgtcccctggagggcagtcacccaaccatccctcattgattactaaagatatatgtataaactcagaagaatagcagcttacaaattacataaggcttttcttataccagtcttcagtatcagtttaattttacaaattttctctctataatctacatacttcattcgtaggtaaaatgaattctacaatgaacatggaaaaataaaaataaaataaaaattaaaataaaccttggtaaataaatactctacagctcagaacactaaagatgaaacaaaccaatccaatgattaatctggtcttccttactgaataggaaactgttccatcaaagaggggcataatacttgaactgaattataagtgccacaataaaagcatgctgatgtcaaacaattagagcctgggaaaaaatacttcctgctatatttattcttactagcatattatatacagtagatacttaatatatatttggtaagtgatcaactaatcattctgatctctgtaactacctacatttttttaaaacgagacttttcctcttccaccaaattttaccttagaaaaaaaacttcagggttttgataataaatgatctctgaactataaaggtatatatttctagccaagtattgtgtttgggggctattttgagttttcaataatcttgccctaataacgaggtatttcattatctctttagtgggcttcataaaagataacaatatatacttcacaatacaagtaaaggtgattatgtgcacagcctcgaatacaaacatactccatctatgtgtcatacctgaatgattttacatcatacctctgccactaagttgccattagatagcaggctaagttcaaattttggtatacttacaaatctgaattagtctccattagtaaatattttcttaatttgaaagatagctaattttcagttttaaaaagttatacaagagtacagtgcaaattctacttaacttggtctcagagaatttaaattgaaatcctaccacttattagctacgtatccttagatgagttacaacctctcagagacattattgaaagaaacaatagccaccctccttactatctcttagtgtaaattttgaaaaatctaaatcaccaaaaaatacagtattacttgatttaaatttttaaaaaatttatttccattttaaatgtagaaaaactgctaataattccaaaatgtgcagtcatatcctttctaattttctctctgacccacacggattggtaaataccaatcaaaacctgcaatggcagtgaaatccccatatcctcctaaatttttaactttttacaataacatggagtcagcatttccatttaaccaactatttaactactaagttctcctgcctttcttacagtttaactacaccaagaacttaatgtaatgtgtcagttccctcagagactcactgtaacttgggagataagagataatctcagataccttttcccaggtgactaaactacgtcagggaccgtcagtttcaaagttcacaggtaaccaatgcttcccagagtcaagtcttctggtttggcagaaatcataagcagagttataggtttaagtttataaactttttcagccttccgcccaaataaaggcttaactgttagctttatttcttcaacatttatattgcattttaacaatcattagcaaaaggtttcctaacccactttatcacattcatgacgtcatgctgtatatactcatatagcactcatgacctctgattggaaacaaagtgtaatggaatttctcagattttcagggaagacagacagcatttccagtaaaatcaccttccaaaatcccaggaaaactttcaggcataaagtgaattatattaaaacttccttttacatctgatttaaatagtagagtctgccaagtaaccctgaatttgcaatacagattaaaatgggtgcactattcaaacctcttcaaagaaacaaaactatagtacacattgaattaacttgtcaaaagtaaatatacagagactattgcataggcagtctacttcaattagactgttcccctttactgctgtaaattcttaaaattggaagccaaataaagttgtttctatgtttaaatcaaatctttgcaaataggcattatttctccacttttttatagtaccaaaaatatgtgacgtttccttatgattagttatctaatcaattctccaggttctaaactgcataaatatcttcccaaggccacccaatgccctcagaacttgcctcagcgcaaagtgtctcttcaagacactacacagtacagtacgttaataaggcactttgacctgttctagatttcacagcttggaacttgaagaaagttcttagaaatttttcagaactgatttttttaaattagtacactagatgtagaataaatgctaaagtattaggactgcttaacccagggtaaagaagcctaagaaacaatctaacaatatagggctatttcaaagacaaggcgatatgcttattttccatctccactgatgttaaatttaacatgaagatccaaattacatgtaaaatatgctaataaatatgttctgaaaatgagttaacaaggacagttggggaatgtcccctcctggaggtctttgagattaaataaatcctcatctgcttgggatggaagttctactccatgaccttcaaggtgtcttacaggtctttacttatcattctgctgctggtctttactttggtaaattttcattaaactaaaaaaatctgaaaataatcctcaaaaacatgataacaatttaaatttactcaaggaatttttttttaaatcctagtatttccttgagtaaatttaaaaatgacaacaaagcaaaggtaaagttggtaatagtacctttatataaaccacaccttaggcaaataattcattttgtaaaatttatccggtagttgtaggttctctaatgttgagaagaagataggaaaatactgctgatgaagtttaaaaaaatcaaccatcaaacaattatatttcactagtacaattaaatctaacctttacatatgatgtcacaataccaagaaacccataaaaataaaagttacaataaaaagattgtcttttaggtccagataggatacaaatttctaccctctcacgaaactctgaaatacacttccaatcaaaatgcacagagagtgaacatcatggaccctgacatactcccaaggaaagtaaagttcccatattaatggttacatataacttgaaacccaaggtacatttcagataacttaactttcagcataattatcttgtaataagtactcatgaaaatggtcagagaaacctttatctgtatcaaagaatggtcctgcaccagtaatatgcatattaaaacaagatttacctctattgttggatcatattcgtccacaaaatgattctgaattagctgtatcgtcaaggcactcttgcctacgccaccagctccaactaccacaagtttatattcagtcattttcagcaggccttataataaaaataatgaaaatgtgactatattagaacatgtcacacataaggttaatacactatcaaatactccaccagtaccttttaatacaaactcacctttatatgaaaaattatttcaaaataccttacaaaattcaatcatgaaaattccagttgactgcagacgtgtatcgtaatgaactgtacttcatttacaaactcctccatcgacgcttaagaaaaatgcataaatgctacatagacagttcttttatcttaaaatcaagttgttctatctaaatagccagactgctgttctgcggcggctaaaggctctcaaaggatcatatcatgacttcactcatgtagagacttcacagtgctctacaccctgtagcacaccctcacaaaagttgctgacagctatctccactcttattgttacagttttcctagtggacccccacctctaagtgttagaagtcaatatgcaacagctacagaaaaacttttaaagcatcatggcagtagttctcttggataaatattaacagtaagaatcagatgagagttgagagaatgagtgtcaaataaagctggattgtgtcatggggaaataaaaatttaaacactgaggcaaagaagaacaatatttgacgacattttaatgtgtgaaatatctctggggaaaataggagtccgaggttgcaatgagccgagatggcgccactgcactccagcctggcgatagagcaagactccgtctcaaaaaaaaaaaaaaaaaaaaaaatctctggggaaaataaagctaaaaaccaagagaactccgaattaactgttcagtacaatacataatcctgtatcaccgctgcacaaaaaaagataaagattagaaagccgggtgcggcggctcatgcctgtaatcccagcactttcagaggccaaggcgggtggatcacctgaggccaggagttcaagaccagcctggccaatatggtgaaaccctctctctactaaaaatacaaaaattaatcaggcgtggtggcgctctcctgtagtcctagctactggggaggctgaggaaggagaatcacttgaacccgggaggcagaggttgcagtgagcccagatcacgccactgcactccagattgggtgacggagtaagactccatctcaaaacaaacaaacaaacaaaaagattagagataaacactgtttttagtaagaaaacagctgttaagagatgcaagtgagccgggcacggtggctcacgcctataatcctagcactttgggaggccgaggagggtggatcacgaggtcaggagatcaagaccatcctggctaacccggtgaaaccccgtctctactaaaaatataaaaaaattagccgggcgtggtggcgggcgcctgtagtcccagctacttgggaggctgaggcagaagaatggcgtgaacccaggaggcggagcttgcagtgagccgagatcacgccactgcactccagcctgggcgacagagccactccgtctcaaaaaaaaaaaaagatgcaagtgaatatatctcagtaatcagtaatccatgtgactgttactctttgcttttcatacactgtctcccaagaggtgcatgaatattgacagattgtataacaaacaccatacagaaaataaaacatattttttagttagttgtttcaaattttttgaaataatatgaatgtttaatttcacctcctttccctcatgtaacacataattataaataaggagagaaatgcagaaaaaaatgggagtaaatgcacaactatttattataggatgagtagctccaaattaatgaatgtgcatatattgtagataaacactaaatatacacagcatcataattgactgaagacccaaaataataatttggtttcccaaatgataacatactaaccttactcctaagccctgccgcaaaaagcaccacaggctagaaaaattgtatcacacacggtcacggcatagttccccgccttactctgctctacctagacttattggctgcttgtctagggtgaagttaacaaccactacaaacatgtatcttatcccgtttgcctccacgctttatttcaaatgtaggccaaagcaattaggaatagatgaggagaattacactaaaatgtatcttctagctctctgcctaccccaacctccccccaaccagtttgcatagcctaaaacagttctcaaaatgtggtctaggaacccctcaggttactaagacttttctggtgtgcaagaggtcaaaactgttttcataataacattaagatgtcctttacccttttaactcccattctttcacaagttttccagatgtgtgatcataatagattgaatgcagatgcagatataagaatccatatcttctattaagccacatcattaaagagatttactgaagtgtgaaacaataccacttttctaagttttggttttgttttggaaaatagttatttttcataaaatattttattcatgttaccaagtaatgggcttattatttttaaatgaatacattttaaaaaattgttttaatttccaatacggtaaatattaataaatcccaaacaaatcaaagattttttttaatcctggattttttttttctttataacaaggtctcactatgttgagtacgctggtctccaactcctggcctcaagcgatcctcccgcctcagtctcccaaagtgctgggattacagataagagccaatgtgcccggccccttcgataatttttaagagtgtaggccgggtgtggtggcctgtaatcccagcactttgggaggcttaggcgggcggatcacctgaggtcaggaggtcgagaccagcctggccaacatggtgaaatcccgtatctaaaaatacaattagcccggtggcgggagcctgtaatcccggctactcgggaagctgaggcgggagaatcgcttgagcctgagagtcggaggtagtagcgggccgagatcgcgccactgcattccggcctgggtgacagagtgagactctctctctcaaaaaaacaaagagggtagaggggtcgttaaggccaaaaagtttactagcctaggaaatactgtggacagacattggattagagtttgtgtatatatatgaattcagagccacatgtatcttccggtttacttgtttatgcggtggttgtttccagaaaaaaaaaaaattccttgaatgagatttttaaaaccaaatcacatttaaatccactagagagaactgggttccaaaggagtcttaccaaatgaagatcatgggctgggaggggatccctcaccgagagttagaaaagctagtaaggagtggactggactcgaatccaacaattttgtaatggaagaaaattcatttttatttttcataaaactgaattaccatctaccatctcttaaaagcaaatatactgtggatggctacagtctcaaagtaaactattgttagcaaccatatttgatatctgtagtctataacatgcagagtcagcattttggacctcagtcacttcagtgacaccagttttatggttaattctgagctgataattacaaatagacctttcccatttataacttatttgtaaaatgatttctattataaacataacatatacattgtataacaattagaaaacctgtctgttttgatggatctcaagatttaagaaggcttagacttcagctataagatgcacatgccactgtgggaggccgaggcgggcagatcacgaggtcaggagttctagaccagcctgaccaacatggtgaaacccccgtctctactaaaaatacaaaaaattagccgggcatggcagcagacacctgtaatcccagttattcgggaggctgaggcaggagaattgcttgaatgcaggaggcagaggttgcagtgagccgagacggcgccactgcactccagcctgggcaacagagcagatggagaccatcctgaccaacatgatgaaactctgtctctactaaaaatacaaaaattagctgggcatggtggcgtgcacctactagtcccagctactcgggaggctgaggcaggagaattgcttgaacccaggaggcggaggtttcagtgagccgataccgcgccattgcactccagcctgggcaacagagcgagactgtgtctcaaaaaaaaaaaaaaaaaggagatgcacatgtttaagtctatttcaggcggttagctggtggattgctacaattcctctgtaagtttaaaaaatcatgtaagtgctgttttggagtactgtaataactcttgagatgtagaacacatctgcaaaatgagggtagtataaaagagacgaggggatgagggtaatacataagaaataggggaaaggacaagaacaggtaaattaaacttcaagtactatttttgctattgctgtctacactcaactagcaaggaaaaagccttgcttctgctctgcgggttttcttcgggtttaacttgaccaagcaaaacagaccatctgggattaactttttccttttcactgtaggtcacaggctctacgtgtagggtgttggccacctgttcttccaccatctctacctccacctcctcctttgtggccacagcaatgtcacagcccatacatgggggaggggagcattcaggaactcggaggcagatgcatttttttccaaacacaataacctcaaacagtggtctctaagcactttcctatgctcttccaaaacgtgacctcccctcttactcacacatcccctacacacggaaaaggaccactatccgtccagcctgcgctcgagggagaagtttataccttcgtcctagagatgccaaatgcagcagggaaggctggaccgaggcagccgagtgctggaaagggaggcaagaggtgcgggagcggggagagggggaggggaggccggggcgccgcgggagtaacctccaccgcaccccaccgctccgaggggcagccggcccggcccgagtttctccccagaagcctccagccgcggctctcggggaggaggaaggaaggggttccccgtccaggaagcagcaccagcggcgaccgcctccagcctcaccctcctcagccccgcaccgcccattcctcactccccgcgccgccgcgtccgcgcgcctcccccctgcagacccctctcacccagcccgccccgaccccgcgcccgcgccccccacccgcccctccggggacccctaattcattcactcgccgccggccccgcccggcgccggcaaagagggtcgggacccgggcaggggcccaggaggggtggtccgctccgtacctctctcccgcacctgggagccgctgagcctctggccccgccgccgccttcagtgcctgcgccgcgctcgctcccagtccgaaatggcgggggccgggagtactggccgagccgccgccaccttcgccgccgccactgccgccgccgctgctgcctccgccgccgcggcc

SEQ ID NO: 2558 - DNA, 45675 bp, Homo sapiens; identical to SEQ ID NO: 2557
  source 1..45675: mol_type = genomic DNA

SEQ ID NO: 2559 - DNA, 5718 bp, Homo sapiens
  source 1..5718: mol_type = genomic DNA
caggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggtgagtgggaaactggtgggggtacccagggcccagggacaccgacgggatcctcatccactcccagcccctgtgtctgtcctggctctgtccctgcctccgtcctgatcccagcgcctctgagagtccctggatcccagcaccttctgccctaagcaccccctgttcctgcctcaccagccctctctttcccaggctcctacgacagcacatcctcagataggtgagtccgccccagccgccctgggtctccctccacaccccatggcggggcagggctggggcttccatcctccatcttccagccccatccccaagctgtgtctcctttaccagtttgtatccaaggggcatccagttcaaacggcctcgtgagtacaaggagggtcccctaccttgggtgccagggagagggtcccctggtgtgggagtgagcgtgaaccttcagacttcccctgccaccttggggctgcccacatggccttgacctgagctgggagaggggagatggctcccccaggcctgtccagggtgtggggctttcaggggcttagtctgttctttgaggccttgacgatgtccggagtccttctttcaacttggttctgtgtcctcagacacggttgccccctggccacctgcctacccacctgtcacctcctacccacccctgagccagccagacctgctccccatcccgtgagtagctgctcagcccctgcccctccaaagctcagcccctccccctccaaactccactctctaccccttcacttttttggattgggggcccctttcccttttgcaactgctgttgccccctgagccccacctcaggcatgacccctgacctttgactcccagaagatccccgcagccccttgggggctcccaccggacgccatcttcccggcgggattctgatggtggtaagtgtggggaagggttcaggcggcgggggctgggaagaagataggcctggcctgagctgacttagtctccctctcaccctctctttgaagccaacagtgtggcgagctacgagaacgagggtgcgtctgggatccgaggtgcccaggctgggtggggagtctggggtccgtcctggactaggctgacccctgtgtcgttacccccagaaccagcctgtgaggatgcggatgaggatgaggacgactatcacaacccaggctacctgtgagtggccaggtgggaggtgggaggtgagggctgaggctgtgcgtccccccttgctcaccggcccttttcacttcctttcagggtggtgcttcctgacagcaccccggccactagcactgctgccccatcagctcctgcactcagcacccctggcatccgagacagtgccttctccagtgagtcaggcatttgtttttatttttaaatttttttagggataggctggagtgcagtggtgccattgtagctcgctgcagccttgaactcctgggctccagtgatcctcccaagtaggctactcggcctcagcctcccaagtagctgagaccacaggcgcatgccaccacacctagcttatttaaaaaattttttttgtagagatggtctcactatgttgcccaggctggccttaaactcctgggctcaagtgatcctcccacctcgggctcccaaagtgcttgggattataggcgtgagccaccatgcccggccctgttcttctgattttctcagctttctctctcttctttcctatctctgtgtcctttcctttatcatctgggagatttccttgtctgtattcttcaacccttccactgcaattttatttctcctatccagaagctctttctcgttctctggctgttctttttttatagcctcctgttcttgtttcatggatgaaacatctctaaggatgttaattagaggctgtcttgtgtgtctgtgtgtgtcagttttcttctgcttcctgcactgccctgtttcctttgagctggttttctcccttcctcatggtctcatcctgcctggtcacatcctctgggctttcctcaatgtccgggattctttagttttctgttgctttgctctctctgtatatacttgtcctgggctatcacttctataccctggctttgtttgccatccagattcccagtttgctctctcctgagctccagactgtatccaagtacttcttttctttcattcattcattcattcattcattcagcatttactatgtgcctctgctgggctaatgctgtggatataacagttaaggaggcagactgtcctgataaaatagctggctgggcatggtggctcactcctgtaatcctagcactttgggaggccgaggcgggaggattgcttgagcccaggagttcaagaccagcctgagcaacatggcgaaacctcatctttaaaaaaaaaaaaaaaattagccaagcgtggtggcacatgcctgtagtcccagctgctcaggaggctgaaatgggcggatcatctgaaccccgcaggcggaagttgcagtgagacgagatcatgccactgcactccagcctgggtgacagagtgagaccttgtgttaaaaaaaaaaaaaaaagataaaatagctaagattcaccgagggcctcctgcatgccttgctaagagtctgacatgtgttcactcactaatctgactgccctggggctcccgggcctgcccgcgccctcctgtgctccagttgtcccttttgtgggatacagggtttatctgtttaacagcactgctgtgtgacaggccctattttacagaggagaaaactgaggcacagagaggtaaggtcccttggctgaggttatgtggttggttagtgctggagctgggattgaaccggggcggtcttcaaaaacaaacaagaaacacataaaagaaccaaataggccgggcacggtggctcacacctgtaatcccagcactttgggaggccaaggtggggggatcacctgaggtcaggagttcgagactgacctggccaacatggcgaaacccagtctctactaaaaataccaaaattagcagggcgtggtggcgggcacctgtaatcccagctactcaggaggctgaggcaggagaattgctagaaccgggaggcagaggttgcagtgggccaagatcaccccactgccctccagccctctaggtgacagagggagactccatctcaaaaataaataaataaacaaaataaaagaaccaaataaccaggcgtggtagctgatgcctgtgatcccagcactttgggaggctgaggcaggtgggtcacttgaacccaggagttcaagaccagcctgggcagcatagggagaccctatctctacaaaaattccaaaatttagcctggcctggtaggagctgaggtgggaagatcatctgagcccaggaggtcaaggttgcggtgagccgagattgcaccactgcactccagcctgggtaacagagcgagaccctgtctcaagaaaaacaaaaacaaacaaaaagctcccaaataacatggatggtgacaggcgccatgaagggctgacatgggagtgagacataggcagtggctggcagggggcaggtggggatgggggtcggggggaggaggtgcctgctgggcctagtgtgtcatgtcccctccacacacgccaccaaactcccactgctccgagccgcactacatccctgctccccagcctaggggctgtgctggggcctgaccctttgtgagctctcctcagtcccagtcaagtggacctcctccctccctctccacagcccttgcccttgtccaggccaccatcaccatcaccaacaccatccttgccagcctggagtcccctctcttcattctgtggggctaatgggggtggctgtgtgggaagcctctggggtctaccgttggggagctctgcatggctgaggttgggggttctctgggaacctgtggccaagggtctctggtcacagtgccgaggtgggcctggcttttccacagtggagtccattgatgattacgtgaacgttccggagagcggggagagcgcagaagcgtctctgggtgagtgaccggtgcttgtcggtgcctgcccctgcaccccgctgccccaccatgctctcagtgtgaccagatcccaccctggggctacccacaccctctgccccctctgtctgggcgtccccttgctctctcgccctcctgacccctttgcgtggctgcccctccttctgatctgtccccacagatggcagccgggagtatgtgaatgtgtcccaggaactgcatcctggagcggctaagactgagcctggtgtgttctgcgggaggggcaggagctggggtagctgctttgggcttggggggatagcttgcaagctggagaccaacctcccctcccttacagccgccctgagttcccaggaggcagaggaagtggaggaagagggggctccagattacgagaatctgcaggagctgaactgagggcctggtgagaggcctgccctgtccccaccctgccctgggcccacaggctctactccttccctccaggacccccttgcccaaccctacctctggcttgtccctctgtctctgggtacctgctgaaccccgtcagcctcctgatccgtatccctccctgccctggtgtgtttcagtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaatt

SEQ ID NO: 2560 - DNA, 5718 bp, Homo sapiens; identical to SEQ ID NO: 2559
  source 1..5718: mol_type = genomic DNA

SEQ ID NO: 2561 - DNA, 5958 bp, Homo sapiens
  source 1..5958: mol_type = genomic DNA
gggcctccctgctcgctgcctccccgggtcctggatatggaggccacggctgccagctggcaggtggctgtccccgtcttggggggggccagcagacccttggtgagtgcctggggtggctcccgggcctcctcctgccccctccccactggcgggtggggtgggaagggggcgggtgcagccggctgagagcttgatgatttcctgccctcgcccggcgctcaccacagcttcctgccgcaggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggtgagtgggaaactggtgggggtacccagggcccagggacaccgacgggatcctcatccactcccagcccctgtgtctgtcctggctctgtccctgcctccgtcctgatcccagcgcctctgagagtccctggatcccagcaccttctgccctaagcaccccctgttcctgcctcaccagccctctctttcccaggctcctacgacagcacatcctcagataggtgagtccgccccagccgccctgggtctccctccacaccccatggcggggcagggctggggcttccatcctccatcttccagccccatccccaagctgtgtctcctttaccagtttgtatccaaggggcatccagttcaaacggcctcgtgagtacaaggagggtcccctaccttgggtgccagggagagggtcccctggtgtgggagtgagcgtgaaccttcagacttcccctgccaccttggggctgcccacatggccttgacctgagctgggagaggggagatggctcccccaggcctgtccagggtgtggggctttcaggggcttagtctgttctttgaggccttgacgatgtccggagtccttctttcaacttggttctgtgtcctcagacacggttgccccctggccacctgcctacccacctgtcacctcctacccacccctgagccagccagacctgctccccatcccgtgagtagctgctcagcccctgcccctccaaagctcagcccctccccctccaaactccactctctaccccttcacttttttggattgggggcccctttcccttttgcaactgctgttgccccctgagccccacctcaggcatgacccctgacctttgactcccagaagatccccgcagccccttgggggctcccaccggacgccatcttcccggcgggattctgatggtggtaagtgtggggaagggttcaggcggcgggggctgggaagaagataggcctggcctgagctgacttagtctccctctcaccctctctttgaagccaacagtgtggcgagctacgagaacgagggtgcgtctgggatccgaggtgcccaggctgggtggggagtctggggtccgtcctggactaggctgacccctgtgtcgttacccccagaaccagcctgtgaggatgcggatgaggatgaggacgactatcacaacccaggctacctgtgagtggccaggtgggaggtgggaggtgagggctgaggctgtgcgtccccccttgctcaccggcccttttcacttcctttcagggtggtgcttcctgacagcaccccggccactagcactgctgccccatcagctcctgcactcagcacccctggcatccgagacagtgccttctccagtgagtcaggcatttgtttttatttttaaatttttttagggataggctggagtgcagtggtgccattgtagctcgctgcagccttgaactcctgggctccagtgatcctcccaagtaggctactcggcctcagcctcccaagtagctgagaccacaggcgcatgccaccacacctagcttatttaaaaaattttttttgtagagatggtctcactatgttgcccaggctggccttaaactcctgggctcaagtgatcctcccacctcgggctcccaaagtgcttgggattataggcgtgagccaccatgcccggccctgttcttctgattttctcagctttctctctcttctttcctatctctgtgtcctttcctttatcatctgggagatttccttgtctgtattcttcaacccttccactgcaattttatttctcctatccagaagctctttctcgttctctggctgttctttttttatagcctcctgttcttgtttcatggatgaaacatctctaaggatgttaattagaggctgtcttgtgtgtctgtgtgtgtcagttttcttctgcttcctgcactgccctgtttcctttgagctggttttctcccttcctcatggtctcatcctgcctggtcacatcctctgggctttcctcaatgtccgggattctttagttttctgttgctttgctctctctgtatatacttgtcctgggctatcacttctataccctggctttgtttgccatccagattcccagtttgctctctcctgagctccagactgtatccaagtacttcttttctttcattcattcattcattcattcattcagcatttactatgtgcctctgctgggctaatgctgtggatataacagttaaggaggcagactgtcctgataaaatagctggctgggcatggtggctcactcctgtaatcctagcactttgggaggccgaggcgggaggattgcttgagcccaggagttcaagaccagcctgagcaacatggcgaaacctcatctttaaaaaaaaaaaaaaaattagccaagcgtggtggcacatgcctgtagtcccagctgctcaggaggctgaaatgggcggatcatctgaaccccgcaggcggaagttgcagtgagacgagatcatgccactgcactccagcctgggtgacagagtgagaccttgtgttaaaaaaaaaaaaaaaagataaaatagctaagattcaccgagggcctcctgcatgccttgctaagagtctgacatgtgttcactcactaatctgactgccctggggctcccgggcctgcccgcgccctcctgtgctccagttgtcccttttgtgggatacagggtttatctgtttaacagcactgctgtgtgacaggccctattttacagaggagaaaactgaggcacagagaggtaaggtcccttggctgaggttatgtggttggttagtgctggagctgggattgaaccggggcggtcttcaaaaacaaacaagaaacacataaaagaaccaaataggccgggcacggtggctcacacctgtaatcccagcactttgggaggccaaggtggggggatcacctgaggtcaggagttcgagactgacctggccaacatggcgaaacccagtctctactaaaaataccaaaattagcagggcgtggtggcgggcacctgtaatcccagctactcaggaggctgaggcaggagaattgctagaaccgggaggcagaggttgcagtgggccaagatcaccccactgccctccagccctctaggtgacagagggagactccatctcaaaaataaataaataaacaaaataaaagaaccaaataaccaggcgtggtagctgatgcctgtgatcccagcactttgggaggctgaggcaggtgggtcacttgaacccaggagttcaagaccagcctgggcagcatagggagaccctatctctacaaaaattccaaaatttagcctggcctggtaggagctgaggtgggaagatcatctgagcccaggaggtcaaggttgcggtgagccgagattgcaccactgcactccagcctgggtaacagagcgagaccctgtctcaagaaaaacaaaaacaaacaaaaagctcccaaataacatggatggtgacaggcgccatgaagggctgacatgggagtgagacataggcagtggctggcagggggcaggtggggatgggggtcggggggaggaggtgcctgctgggcctagtgtgtcatgtcccctccacacacgccaccaaactcccactgctccgagccgcactacatccctgctccccagcctaggggctgtgctggggcctgaccctttgtgagctctcctcagtcccagtcaagtggacctcctccctccctctccacagcccttgcccttgtccaggccaccatcaccatcaccaacaccatccttgccagcctggagtcccctctcttcattctgtggggctaatgggggtggctgtgtgggaagcctctggggtctaccgttggggagctctgcatggctgaggttgggggttctctgggaacctgtggccaagggtctctggtcacagtgccgaggtgggcctggcttttccacagtggagtccattgatgattacgtgaacgttccggagagcggggagagcgcagaagcgtctctgggtgagtgaccggtgcttgtcggtgcctgcccctgcaccccgctgccccaccatgctctcagtgtgaccagatcccaccctggggctacccacaccctctgccccctctgtctgggcgtccccttgctctctcgccctcctgacccctttgcgtggctgcccctccttctgatctgtccccacagatggcagccgggagtatgtgaatgtgtcccaggaactgcatcctggagcggctaagactgagcctggtgtgttctgcgggaggggcaggagctggggtagctgctttgggcttggggggatagcttgcaagctggagaccaacctcccctcccttacagccgccctgagttcccaggaggcagaggaagtggaggaagagggggctccagattacgagaatctgcaggagctgaactgagggcctggtgagaggcctgccctgtccccaccctgccctgggcccacaggctctactccttccctccaggacccccttgcccaaccctacctctggcttgtccctctgtctctgggtacctgctgaaccccgtcagcctcctgatccgtatccctccctgccctggtgtgtttcagtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaatt

SEQ ID NO: 2562 - DNA, 5718 bp, Homo sapiens; identical to SEQ ID NO: 2559
  source 1..5718: mol_type = genomic DNA

SEQ ID NO: 2563 - DNA, 94954 bp, Homo sapiens
  source 1..94954: mol_type = genomic DNA
ttcagtttatgttatgttcgtttattgttgtaacattttgttttgaacatcaaacactgcaccaaaatattagccattcatcttgcaacaattgctttactgtaactaagagtactgtactgatgatgtttacaattaactttggacaacttaaaacttattagtgacattgctgtctaataatcaaatacttcatcataggctgaacataattattaaaagagcaaagtttcccctccctttcttactttcaaacaaaaccaaaagagtagttttcatctggaaagagcacttacttcagggaaagactcaatttttaaccagttttattaaaccctggaagctctacaacacgggaaaacatcgaaattccccggaagtctgtttttgccaacttgtaaaaagtgaaagagctgacttccttgtttattctttaaagggttggcctgcacctgcagtgccaactgtggaagggctgtgtgcaggccccacagttgcaggggctgttccgggccagcgcttcccagtcatccaatctcctttgtccctcggttgttctgtgactttgagcagctttcattttaggacatcccatttttaagttttttctttttccagttgaaaactatgcagatgtttttagacagagcaaaacacaacacagtacccaaaaacggaggcagcctgcatgctccaggtctacacgagcacctcacagcctgacaaggggcagacagcaactcacacgggacgagcttcagcacacagacagcaaagcaaatacgagacttagactgaactgcaaagagggaaagggccatttcaccaatggagtaactgagagaataatgacttagagcccaatctgcctgccatctccctgagccgtcacccgtcactgaagatagcgcgagggtgatgcttcaactcaccatcctaagggtttgtgtacaaacacactcgagggcatctctttcacagaaagaacaaatgtcatttgtaccaaatggcaatggattttcagcacaaacttaatactttcctaacactacagcaatagtaatcatctactttcagcaagagggactcctttaaacaaggaaaaagactcacattaattagcctatgtacccactggatcaatctgcagcaacaaagtctagtgctagcagacacagggacagagggaccagctaccctcaacacagggccaggagagccgggtcctagactgaaccctctaagaaggcccatgtgtccaaagagaagagctgtcaagaaaaagaaactagtcaaaaactctttaaaggacaacctaaaaaggattaaagatgtatattaagatttttcagtaccatacatatgcaaagaagtcctactataagctcagttaaacacacaaagctctcattcttcctctaaatagaaggtagtcaagaggacacacagatggcatctatgaaataaggtggctgcatggctgctgtactagaattcacaaactgggaagaacttcatataaacagaacccaggatccctaacctactgtagataaataaactcattaaacaattagtccttatcaactatttaagctgggggaagctttgcatgggagaaggctcatgtggtcccttctctgggaacatgagccttcctaggttttgccactgagaactgtgtttaggggatttcaacattgtctctgcatccgacaagcactaggaaaatggctgaaatcagtcagggactttcaactctccaatctggaaaaataaccacccctatttctctatctctagatcagcattattttaggtgaagcaaactaaaacatgtagaggttccactacaacggcaggggcatgaagagttggccacgagaccaccccgagcgccaagcctgtatctgcagatccctctctgctcaggaaccaccacgtcctgtgttctcgccaatggagaccaagacctggggttggttctgggctcctgacagttctcttgatgttaagagtgcagctctgtcaacactcagcataccaaaagctctggagcagcttatggcacacctttccctggtgccatctcttcagacacgatgtgagctcattacaaccgcatcagtaaatggagctaccatgtatattttagtgaaaatacataggcacccgtgtccccatggggtctcacagggctaggctggggacactgctcggggggcagtctgctccataggagctccaagacccctctttgacgctgcttccacgggcccgattacagggtgtgatcccaaaagccaaagtcacacactgctggccagtgcctttaagcaagcttcactgtgcttccctgacaaatctgaatcacagaattttagaaatcctgtcccaaggcaagatgctttccaaaggcccacaccaggcagcaagcagagggattcagcgctcttcccaggaccccactcaaccgcctatctgcatttcggaggcctccctaaaagcagagttgttgggggcggggcggggtttggtctgttttaagacccaccttcccacttttattacagacatcaaatatatacttgtgagacctgttcttctggtgaggactaagaaattaagggctcgtggagttgtcacagatgagaggaggatgctctgtggggatctttccccaaagagggccaggtttatgggactgggctcagtggctctggtgcatgggccctgcaggggcgggggtcctgcccaacttggcccactggagcagctgaccccttcagtgtagcaggaaatgaggcgaccagagaagaaacgtgcacaggcagcttcagccagcatcactgactgggcccgcagcagttcagggaccctgacatctgaagacagccctggttacagaagccacctcaactgcccagtggaaactggaacacttcactgtgtgcagtgttttggtccactcttttttagctgcttttttcttcctttaaaatgatgcaatggaaggaggccccagctcacagcaggaaacatgtgtgcgacccacaaaggagggatcccaggcctccagccccaggcccagttcctcccttctccttccaggagctgagctgcagacctgccgagcctgagcagctggcctgggaaggcaaaggaggatggcgggaccagctccagaagcacccgtccccgctggggaaggctggtatctgaggtcagcagaagagccagctgccttcccttgctgtggggagggggaccaagccctgcccacccactgaggtgccgcctcaagacaggtcatccaggtccacttcagggatcgggtctcgccagtagcagaaggagctgaactccgggcagggaaaagcggaattctgctccttactgagaagggggaacacatgctccacgagctcactcagcctgtgatacctaagagaaaggttggggaagaggcacaggctattacttcaagatcggtcaaaggcacaagatggggggctgtgaagctgtcactcagattgctcaggtgggcaggttcagaggcaggcctcagtcccatcacagggctcaaactccctcttacaagtctaggataaccagagacccctcaaacagatattgtgaaagagagatacccacagaggagatgtagctgatcctttgatcagggcctgatctcaaggatcagggggaaaaggacagggtctgtctgtccccaactgtacccctggctgcagggcgccgggctgagagctgagaatgtacttacgatgacttgtttcctttggttctttcttgtattaattcacccttggggttcacggtgaatattctacagtctggaactccaacttgtgtgtaggcatagacatcctgcagaagaaaatagcaagcgggtgattccagggaggagaattcaggagatacttctcaggctccttgtgagccagaagcactgcacagacagactcgacagaaaacatgcggaggcggcacagtgcagttgccaccaaaactgagctttagacaaacctaaactacagagtggtgcttggagagtcagaaaacttgggcagccaccaaggggaagccagggtccctggcgcagaagaggccagagaggccacatcttctgcacacctgaggcccgatggccctgcagaagggaggcaggttgggaagtgctagcgaagggccagcactgaccctggctctggggtgatccaaggacgcagctcagaactgcttagaagaggagccggagctgcctgaggaaatggaatggcagccacagaaacgatggaaaagcgtccttcgtataaattctggggcagatctgcacctgcaggacctccccagttgctatagatatttggaatagatcaagtgaaaaccgaacaagcagaacagatgcctcattttgcttacaaaactgctttgagaattgggacgtggctacaccccacgaagtacatccctctgaatttcacccacatcagaacccagagcccaggagatactcacatttggacggtttccaaaggcagcatagaagggctgcttagacggggcaaacagattcttgatatcatttagacactcaattttgaacttctctggtttcttttctatcacttctctaagaaaaaaatacaaatacaatcaccaatctcaaaatggtcgttttccccagtgagtggtcctaaaattttagtgctcacaaccacccaatttcttcaaccctttgtaactggaatctttccttctccttctttgccagtctgataactaagaaaatttgagtgatgaagtttagggaaggagaaaacttgacggttcctagaacctgcctttcttcaccaggcccgccacatggcaagtgagcagtatgtggtaggacaccaccagggaccaaagaactgggagaggcgtggcggctccaacatctgacttctgttcccacacatccccccaccttgggcccagccccgcccacatgctggggcggtgggcagagggctgcctgccggagaggtacctgtggaaggcggagaacaagctgctgggggacagcatcagggggccccggggcaagattgtgcccttgtcattgacccagtgcaggtagccacgggtcatgtcggccatgccgatggcacgagccgagcagtacagaaacttgtagccattcctgaaagaaaacacaccctgttagcccacatgttctggctaagggaaaagaaaacaaaaaacaaaaaaaaaaccccacacttttctttcttttttttttgagtctcactctgttacccaggctggagtgctgtggcgccatctcggctcactgcaacctccacctcctggattcaagcaattctcctgcctcagcctcccaagtagctaggattacaggcatgggacaccatgcccggcttaatttttatattttttagtagagacagggtttcaccatgttggctagattggtcttaagctcctaacctcaggcaacctgcccacctcagcctcccaaagtgctgggattacaggtgtgagccaccatgctcaacccatacttttcttttaaaagatccaaataaacttcctctcatttactgtgaaaaccaaattctcaaatttagcaggaaactgcttaggattatagaggtttcaccttccatggaaaacgtgggaaaaaaatggaggtacaggcaactaaggattatgttaagtttgtaagtactgatataaaatgttcagcatctagtccatgaaagccagattagaggacagaaaaaaccttggactatctttaaattacccactgtgaagaaaaaatataggggatattatttataaaggcaatgtgcaagatgcaaaccactccatcagacaagaagcaaaattatacccaggtaactgacatattcgtaattttcatattatggtattctcaactaatgctgaagacactgagattcttcagatcaatgtaatatatgtattaggaacccacaaacgccatggcacggctatcttcccctcaaagggtgccccaagagagagcagcccatgcaagaactatttccctcatgcatgcgtgcactatctactcaaagaaatacaattttaaggctgggcgcaatagctcatgcctgtaatcccagcactttgggaggccgaggcggggagatcacctgaggttcggagttcaagaccagcctgaccaacatgatgaaaccccatctgtactaaaaatacaaaattagctgggcatggtggcatgtgccggtaatcccagctactcgggagactgaggcagaagaatcacttgaacccgggaggcggagactgcagtgagccaaggtcgcgccattgcacttcagcctgggcgacaagagcaaaactccatctcaaaaaaaaaaaaaaaaaaaaaaaaaaaaatttaaaatacccagaaaataaaccaaaaatgaaaatcagctatcttattaaattctagctaaaaaaataactgtcattctagttatagatgtaggtagtgcctgaaacacagcactgtgaggattaactgagatgacacaggttcgatgccaatgccaggtgcacacggctcccacaccatcaacaggaaaggagtgaggaagagcgggaatgcttcagcataaacacatgactcatgtggactgaagacttacaccattgttctatagttcttaaagcaagcttccagctcaccagagcgagttaacgtggggagggtacctactcattgatggaatggtagagctttgctataccctggtgggtccagtctttgcccagctgtgggagaatctgtcccaaagcatccgacctaagaagacggtagaaacaggaaaagctatcaggaatcaaacacatacagcgttttcctatttggttgactatcagctgccaataactaattggtggcgggacactcttgaaaggggatttaatcacagcttcaagcaactgcaaggccatcccatgcaaacgcacccactgaggtgcttctgaaagcggagtctcacgagcgccagatgtgtgtgttcggaggtaactgactgccacactttctcttttcctccgccccaatgtcaaggggcttgttttcatatcagaattgaaaccaaataactaatctttccaaaagtgatttttgacatttgttatgcaccctcaccatctcctccatgcaaaaaaatgaccccatgtggactgtactggggacgcctcagagcatatggcttataaaatgccttggctgagggcttcgagccccaggtgaggaactccccaccacacactgcctgcccctccctgagcacggggctgttccttgccacccacctgaaggattgagcttacttggttattgtcccatcaatatcagaaatgatgatcttgtcattccagttccacaggtaaatggtccctgcacagcgacaggtgccttgatactgggttgtaatactaaacacaacatcatttgggccatcgtggagcttcagttttgccttttaaaaaagcataagaataaagaaaatcagctgaaaacatagtttgaaacgatttaaaaatttacagaacaactggtgtctcggaatcccaacaagaggcaggatggtttccggggtcttagacacagcccaccctgtgcccagcgcagctgacaatgctgagggagccactgcctgaacagtattttggggttccagggacttctctgaacacccacaaagcaaaaggtctactactcttactccacacctgagaattactgctttagccacagcctgctctggtcccagcaagaccttttcataccgaaaatgggtcaaaggcagggtgtaaaataagaggagaaattgtgtctaaaatgtcatttctctattgctgtggctcctaagagacagtacctggctcagcgctgggttagctgtgtacgactgactctcaagagatggaggaaggaggtctggggtgggtggcaggacccaagccacaggttccccaggtgggcctgatagctcttgggggcggcggtcgtggttccactgtggataggcattgacacgaccatgccgtgtggcgtgtatgcagctggggacgtgtggacagaagaggatgtgcatcaaattaaaccattactaaaataagtcctactggacaacacagatcatgcaagactcacgatctggtctgaggagaggcggagagacttcttatatgaagttgtgctgccgtggctcaggggctctgtggggatggggtccactgtgatggattcttcgagctcctgtgatccctcgtcactcgaggagtcattctcggccggcctgttcaacattagcccagttacggaagaggcagcagggcattttattgatgagagcttttcatttaggatcaagaaaataaagatatcctaaatcttttctaggaatgggtagagttatcccttctgccattctcccatatccacagctctgtacgcctgaaatattcatattgttaactgataaggccactttcataactggcaagcacttactttctgactatgacctgctattttctgctatgcccagtgaatgctagaaggtctactgactcttgttgaagagggtatgtatgtttcacaaggcacaaatcaaagaaaacataatcgcttacaatgatttaacaaactccggctgggtgcggtgcctcacacctgtaatcccaacactttgggaggccgagttaggaggacaccttgagcccaggagtttgagaccagcctgggcaacatagggagacccagtttctacggaacatttaaaaattagccaggggtagtgacacttgtctgtggtcctaactacttgggaggctgaggcaggaggactgcttgagcccaggagtttgagaccagcctgggcaacacagcaagaccctgtctctacaaaatacaaatttaaaaattagccaggcatggtgtcccacacctgtagtcccagctacttaggaggccgaggcaggattgtatgagccgaggagctatgattatgccattgcaccccagcctgagtgacacagtgagactctagaaaaaaacaaaaactagtaagaaaaattttagacaccccttaaaagatataggatggggggcggtaaggggcaagaaaataaaccctcagccttagacactaaatgagacagccaagggctgggagaagcaagcatgcactggccgggggaggtggacaggcagaagcaggaacacggcgtatcgcgagcaactcctctcagggctgctcaccctaactgtccaaagaatgctgtttcttccaggaaaggaaacccacccaagccaacctggagattattttgtatgtctccctttggctccggatgggatgcagggggagcagaggcacctgggccaacatggctgaagcgttcctcacggccccttcccatacgctggcgccacggctccacaaggaggcagggtatttatttttctaagctggtgatgttttttagaaaagcagttgtcatctgctgagtggcacaaatatatcacagcatgtagtatctgcagaagatactcccaagaactaaacaagctgccaaaatcaacttagaagtaatggccctgctagagggcctgagtgctatgagccgggcagaggacagggcacccacctggcaccggccggctccttggagctggatggcaggtcactggctggcggtgcctcagattttccctccttggattctggcagctgtaacagcaagatgataatggcaacatgcaattttttccctacagataagccaagttcatcagcagccctctctaggaaagaacacaactgccttctgaacccacaacttaaaaatgctcaaaaaccagactttctctattctgagccaaagaattagaaacctaagacagaagtcatgtgcttctatgcaaatcactgtccctacagacccagaaggaaaacattttaagagcaccatttcaagtcacaaaacataatacaagcgacccaaacttgttaggtccccagcttccttctcctcctgggagtaactcaccacgtgcagaagggactgaaaggcagcccccttgctgacgtggacatgaacttggttcaggcaagacttcccttctgacatttgaaaaacaggtgagaactccctgaaccctctttttcagaaggtgttggggaaaaaaagacttgctctgctgcttgtttagtatggttctctggatgaatttctatggagacctggtggaacagattctggttatttgcatctggaactatgcaggcagacgataaccttctgctcctatctgataggtaatacagtgaagcagaaagagcacaggctctggagtcagactcaaggtcttgccccagctccgtctctcaccagttatgtgacttcgtgaagcacccaagtttccttacctgtgaaatggcaactcgaacatctctagtgctgagctacagtaaaggaccacttgggacaacacctgcacgtcctaagtgctcaaaaatggaaactgctatatggtaaaatagccctatacagtccaaattcctgtgcctgacaaaaaggttttttgaataaatgaaagattcatttctttcagcccacggaaacaatgacctctaggtctgttacctgtttggtcatgctttctctctttcgccaaaaccaccagcgaccagatttctttggcatcttgtctttcacccaggactcaactgtggcctgaaaacaaccaacctgggttagtctgggcaatctactggccacacagcacctaccttctatgctagcctgaaggacggggccttactatggaatgtgagaacgtgaccgatgctctcttcacacctcccagattcctctagcgtttttaacacctctgagagacagaccccgtcctgctttcatggcagcacagctctgtggcatgagaccaggcggtctgctatgtaggaccttaggggctgacaggtgggcaaatctcatttatctatctttggaaaatgtggttctcatgagttaagaggaccaactaggctgatgatgtcttcttgggggacagattaaaaaccaattgtgagtttgtatataacaggtatgttagccaccatctgccctaaccacactgatgtcaagcttctcttggctacatcaccttcttcttgctgcttcttcccatattaatgggagaaaaagtttttttcattcattccatatttaacttatgattagtaaaatctctcaacttttacagaccatcagaaactagtatttatgtctaataaaaatgaaataaagaagtggcagccctgctaatttcccagagtttgggcatgagatatttttagtgggtacatatgactttgatcttttatattaaatattaagctcaagtaaaactttgaatagtacccagttcagaaatatgcacatatggatttgtgtaagtactagacactgcggatgctttcggaaaggcagcagatggtggatcgcctcaccttaggcaagctcttctggaatacttgcaagctaaggatcatgggagctgccaaagcccagttatagtaactgtgagaaacaaaaattgtgcaaaaccattacacagtgaaagtgagcaagagagaggggagggaatcagggagggagggaggagggaagtgacatataaaattgcttattcttttcaataaagatgatcagctgaattttttgtcacatgaataaccttcgcttcaagcacaacttctctgaacagagaagccgtaaaatctatcaaacagagtaacatttcaatgcttcttttaaaaataaaattgaagctttactttcacttcaaagtcattgcccactggctaatttatatgagatgacaagttttataagaaggaacacttttataagtaacagttaaaaatggcacttgtaaaaaaactgcaagagtatttaacaattataaaagcaggagtatttaccgattatatatccttattacaaggttaggattgtctataagtccagggttttctgcaaattcgtgataagtaatgatatgctccatgaatttttctgcaatgtaaaataataatcaatttggttagagattacataaatccctatatgagattataatactctctgcattgcagaaattgaaggctaaaatcatctgtctaaaaaaactaatttttgaatattcatcaaaagcaaaatgtcagacgctttttttccccaggacaagaaagaacacttcttttctattctccttttccactgtctcccagtgaaaacaaacaaactagtaaaaagggacatgacagagactttcaaaaaaaatacatacagatgtggctagagagggacggaagacagacacagaaagacagacagacacacacacacgaaaactgtcgaagttctattctcagaggaagaaactttactgacaggcaacggcataactggggaatattcataggggtcttacagctttagcaagctacattatatcaaaacatatcttaaaattgtttgggccaggcacagtggctcacacctataattccaacactctgggaggccgatgtgggccgatcacttgaggtcaggagttagggactagcctggccaatacggtgaaaacccatctctactaaaaatacaaaaataaggcgggtatggtggtgccaacctgtaattccagctacttgggaggctgaggcaggcgtgacaatcacttgaacccaggagatggaggttgcagtgagctgagatggtgccactgcactccagcctgggtgacagagcaaggctctgtcttaaataataaaaacaacaacaaaaattacatgttacaattgcttggagaattaaaaaaacaaaacaaggcaaaacaaaaaaacctagaatttggctcaaggtctgtgaaataaatcccaagttcttgcagagtgaatgagggcttcccatgaatttttgtaccctgttcctaaacctgtattctcctagatctaggctaacagagaaactgctcacttggattgtttctccaggtaatgtgtgtattacttacatttacttgtcatttctgcctcttccaataaactctactagactaagtcaccaatatttaaaacaaaggtgtaacttttatattttacctacattttgtatttcgcattccctcgcatataattttttaaactgaacatttaagaggattacagaaagaatgtgacctatttaacttagtccctagaatgaaccattggccataacacactttaaatttcttgcaaaatataaagcaaacaaacaatgaagagacagggaagaggcataatgagcttcctgtgaccctggaaaggaaagacttcaggaacacatggtcctgagcctctggccatgcagtctgccacatcacaccttcagttcctctaagggagagggaagacaaaagatgacactagtcacggaaagaaaattttcccttagaagaaaatcatacaggggccacaggccaaactgagaaatactaagagttcagttttaaaaggaaggttaaaaaaaaatgctgatgaattgaggacggatgcacatggcactcagcccagcctataggcatcctgacatgtctgctaaactccctcctgattcctgagcaagctttactctcgtaggccaaccctccagccttatacagaaagtaatcctcctaatttttgccagaaagaccacgtactcagtggacaatcaattttctacaacttcagggccctatattcatgtctaaggcccagtgctttccagaagggcagctgggccccagttccacaaatgtttctgtaactttacagatgagaaaactggtgcagtgtgatgatcgcaccctggcagctcagaaaacagggcggcctgataactcccaacctcttaatttgaaattagagcctttaagggcacactacctcaaagccactccataaagaggtgtcaattaagaccttaagtgagggtataagggtctgacattacagaacatacctgttacctgcacaagatccctaaagaatgtaaatatcctgaaatggctacacggtaagttttaaccaagtgatgaccagattgctctctgaaatgaagatggggcacaaacacccaacgtaccttttgaaatttctccattttcactgaggcccccgcaaagggagagggtaacgtcaggcaagtccatggcagaatctgagaggcactcggtgccgctatctgcagctgcgcttcccacggactgtggggactgggagccagagagtgtgtcagactcgggccactgcctggaaccgggctccgattcactgtggacaggggatggggaaaagatgtgctttattacaactccttgaattcctagtttactgcatggttctctgggggctcaaaccaaataacacatccgctaaaaagaacggatggacctacaatcaggcataacttttcttagatagggtttagaatcatatcataaatgacatgaaagataacctaatatagtaccagtgagaaattaactgtgaatatagtaaatacgtcacaaaatcaccacggtcattcacaataatgcaaacatttcaactgtggcctttctgatttttaattaaaggagtaaaatagttataagtatttatttacatttccatgatgaaaatgacagggtaattaagaaaatctgctgtttggaaacctttgatcctaacgtcctagaaaaagctgtggcactttatacatcctgtagaaaattactgtagtccaaggctatattctttaaaaccaaatcttttctaagttcgcctattacctcacaaagaaggaaggagaaattaaacgagcaaattctctagaggcaagacccacctagaaaaagaaatgtattcagaaataaactggatgtaactgttattccaggagctaaagatgaggttactgaatattttcatttttcaagataaggcacagaagccaggtttcagaaggtgatcaagggaaaccttatgcaatgaagtgtaaatttgagaaagaataatcatgaatggcacagcaccttaagtctcacagtccccaatgcttactactctataccctttgaataggtatttaatgtcacatttgagatattgagaattttcaaattcacttattttattcaaaaagccagtatttttatgtgaattaaaaaaacagtgacccagaggtttactggctctttcaaacaaatctcatctttgagcagtaggtggcagcagactacagattatgttttaactaggtaacagtttcaaaacctgtttcccatttgaatcaacaaaaaaattcaggtttttggatattttttcctcttaatagccatgcacactcatacccacaaaattgagattaactggactgacagaatgttctcactggaaacacaaagtcagcagaactgttgttatactgggagtgaggggcaaggccaacccttctgtgttcaccacacctgtctcctctttctccggggcacacggcgaggcccccttgcagtcaggtggggccacgtgagcacatgactgagccgtgaatatggacggaaggcatacatggtgcccctccccaggggccctctcctatgcgatgctcattcctttctctgctgccagtaaactctggactctgagaccctatggggatgggagagcctcaaggtgaaaggagcctgtgttcctgaatccctgtgggcaaggcctccccctaaacaccaacacagagcattcttcacaggggcaagaaacaaaattccatcgtggtaggccaacgagatcaggagttccacctctacagcagctagtgttaccccaaccagtaacaacaacatctacacacatggggatgccgtctgactcaggatgccaccaaatacaaaagtgtgtgatttatattaaagtttagtgataattacaaatactgtaaatttggtaatgaagatgctaaggatcatgacatgactaatgcttacatggattacaagagtctcactcactatctttaaatatttatgaaatgtttcaagaaatagttaatgaggtaagaagcttacttagtgcatggacagtgactgtgaacagttaaattacagtagagtggagtaaggtatcatcaccttagttactctcctcactttttaaaagagaaactaagacatataccgaaggaataccaatataaataaatgattaaggcctgggaaatgtggggggaaaagtggtaattctatgacagcttatatttgaactttcctactgttaaaataaagccgtttcagttttttcaccttaaaaaaatccaactattacttcaaatgaagtagatatgttgagataaatttaggacagagctagaaaggagttttaagaactttcccaaaatacctgtaaaaaatttaaatagctttatatcaatcccatctttctattccaaataaaaaacaaaatatacttttcagtaattcatttacaagtgtttaattatgtgtgcctatggctcagtatattcaagtcatactttccgtggagaaaagttgtttttttctaaccacagagtagcagtttaacagaattcccctaagagtagaaatgaacttgggaaggcagtccaagtgtatcatatttgaggcccatatttgaagtaattcaaagggaaaatggtgcgggacagtgagggaggctgggtggcagctgtggagctgcaggggatgtggggacacggggcgcgggggcagtgccccaccagacccagacccggttcagaaaaggctcaggatctcagactcccaagaagtgaacacattctttggaaaacattttcaaataaagatgtgtttcttttaaaacacataataaaataaatgctaaaaaattttcccaagcatgttgagtttgtattaaccactacaggaaatgctaatcagaagtcatatacccttatgtaggtttaactagtatatctctcctcattgtattgaaaatgtcttcgtaagtaattattaatttcaagtcactatattgaaataagacacgcgctatttctaaattttccaaaacctgaagccatcatcagatttagctaaaggacaccatcatcttgttcctttttcctgagatgaaatgttttactctagaaataactagactatttcagagctgtccttcaataaataaggaccactctaccttttagggaaataaagagctgcaacttcaggttctagaccctttaagtcatcaaggtaaatatcatcaggtccctggtgttggcttcttttgtgaacacctgtttaaaaaaaaaatcagaggtaagaatttagttattcttcatttacagctctgcaaaacacacgcacgtttgcaaacagtaagagtgacaagcaggatttgaatagggttttaattttaaaggtgtcaaccagcctttttacttaggttggttcccagccatccatgccaatagaagagaagttcagtgctccatacatatactttgattttactcattctctcatttgctgttaattgagtaatactagcccctaaataatttatattttaatggtgaagtcttttttgtatttataggtctaagaacaagcatgaccaaacttaaggcaaccacctgcattgggaacgagggcattactctaaaaccatgaaggcaaggttgtctgggcacaggatattcacatggtgcccaagtatccaccctgcattaccttctaactacaaaaggacaaaaaatacttcacaatggatagatgtggcagataacatcttaaacaataatcacgttcagcattactattagtggtcatcatgagatacaatatgagtacccaatacatgcaataaactaatcttcaattcaaacaataactctaagcctctagacctgtactgcccactctagtgaccaccagccacatgtggctactgagcatttaaactgttgctaaagtgaggtacacaaaatgttaaaaatgcgtaaaacacactaagatacttccttaataattttatattgattacatattaaaattatattttggatttattggcttagatgaaatatatcactaaacttaatttcaccttattttacttccttaaaagtggcaatgagatgattcaaaattacacatgtgattcatattccatttctagtggacagtaagttctagagctaactcccagttaagaaaatataggaatgtcaccttcaaaaaaacaatcagacaaatccagaacgtgagagagcctagaagacactggctgagctctttaaaaggttactatcacgggtgtagagagggcatgagggtgtggatgggtgtaggagagagagttctaaaataaaaaagattacaagaaacataaaaatcaaatgcaacatgtgaaacctgatgcaattttggcttgggaaacaggccagctaaaaaaatattcttggtacaattagggaaatgtaaacatgaattcttcaagatgacaatagtactggggctatgcagagaatgttcacattcttagaaggtatatcctggcatatctaagagtgaaatgtcatgcctgcaatttgttttcaaatgttttattaataaaacactgtatgtggatgaatggagagatgtagggagagaggggttgaggagagagggagggcaaaaatgtataataaaaagtagaggggaaaaagaatgaggccaaaagaatagtaaaaaccactcagggttcctgtctctagtcagatcctgcactgtgtgctaagaacaggagtcattagttccaaaaacaaagcattcatcctaaaagaactggatttccccccttaacatttcttagagcataacaagtggctacaggcctttggtggaagagcaggtgccaagttaagccaccattcgctagatggttttatctgaccaccaacaccttcgacagtcacattctttcattttagataaattatttctgagtgaacttgaaggtccatacctaatatatattaagttggtttataattacctaatctttggtgctagaatttttttttaattgaaataggtaattggctatatatgatgttgggtaattttagagaaggtttcacactttcctaaaaataggatccaaggccagagttcagaatatgtatgttctgacccactgtaccaagtatcgatggttggctttttattttcaaatagtaaggatgttctgatttattaaacttgtgttccaaaagtgaggaagaactgttgaaccaagagttggatgttttctctacttattttgagacagggtctcactctgtcacatgggttagagtgcagtggtgcaatcacagctcactgcagtcgtgacctccctgggctcaggtgattagaataacttcttaaggtaatttttattttttcttattatttttgagacagggtctcactctatcacccaggctggaatggagtggcttcatcttggctcattgcaacctctgccccagggctcaagcgatcttcccacctcagcctcccaagtagctgggaccacagatgaacgccaccatgccaggctcagttttttatgtttgatagagacagggtttcactatgttgcccaggctgatctcgaaatcctgagctcaagtgatctgtccacctcagcttcctaagtactgggattacaggtgtgagccactgcacctagccttctacctattttagagggaaataatcagcaaaagaaagcacatactcataatcataattagtatgcattgatttttatctgatattactgctaaaaaacctacctaatttagcctcagctaagatgtttcaagtgaaaacattttttctctattctaattttttaagattctacttcactttactgacataccttatcaataaagtggttaattttactcatcaattgattacaactcattatttgttttctcagtaaatgcttctcaagaacccactgagtagcaacagtcaagagacagcagtgtgcaagtcaggccctgctccaactggactttccagggggacgccatggaaagcaattgtaagaaagtgagtgacgggcctgggcacggtggctcacacctgtaatcccagcactttgggaggccgaggtgggcagatcacctgaggtcaggagtttgagaccagcctggccaacatggtgaaatgccatctctattaaaaatacaaaaaatcagccggggatggtggtgtgtgcctgtaaccccagctactcagaaggctgaggcaggagaattgcttgaacccgggaggcggaagttgcagttagccgagatcacacaattgcactccagcctgggtaacaagagcgaaactccagctaaaaaaaaaaaaaaaaaaaaaaaaaaagtgcgacgggtttcgactggtgaatacaaatacagaggcagccatcacgttatgtggaacactgaaataatttaccatctaatttgagagtacctggagccaaattaaacaaacgattacctttcttctttgacggcgagtctactttagctgccggtttggattctgagggcgcctccgctaaggctgcgttgggaaggtggtcagcatctaacatagatgaaatctgagtactctcaagaggaggttcgagaagctctgccacagatgttgggtcgctcatctgtgtacccagggctctgggtttgggcttcactatggtacagacagtgtcttccatggaagcatccttctcaacttcactgatgaggttgtcctcactgggaattacccgaaaatgagtattttctgatggtgtaattgtagctgtcctaggatgatggtcagatcgttctcttttgctgacctaaaaaagttaaattgtttaaaaattaaactactttcagagtatttgttataatctatttcctaagctggcaatgtgttcattctatttttaacttaacacattcattaagtatcttagtttgtacatgtaaaaattccataataaagtgagaaaaactaataattgccttttgttcaatatcatgatacttataaatgttctggccgggcacagtggctcacgcctataatcccagcactttgggaggccaaggtgggcagatcacttgaggtcaggagttcgagattagcctggccaacaggatgaaaccctgtctctactaaaaatacaaaaattagccgggcatggtggcaggcgcctgtaatctcagctactcgggaggctgaggcaagataatttcttgaacccaggagatggaggttgcagtgagccgagatggcaccactgcattccagcctaggtgacagagcaagactttatctcaaaaaaaaaggtgtacgttaaatgttctactgtgaagttatactggagaagactgaggaaactgacaattttcagttactaagaagtagaaaatactcattttgggggagaaaactaaatgaaaatttcaccctccttggaccacatcaaggctctgttaaaacagtgtaaaagtggcaagtctaaattcgatcacaaatatatgcaaaatgtatattttaaaaacctaaattcaacagaagatctaaacattttctctctcaagaaatttatcttctcagttctttcttctttcattatgagctggaaaaaaaggtttaacaatttcttgtttaaaatttcagtgttggctggggatggcagctcacgcctgtaatcccagcactctgggaggccaaggcaggaggatctcttgagcccaggagtttgcgatcaggccaagctgatatagcgagaccttgtctctacaaaaaataaaaactaaaaaattaactgggtgtggtagcacacacctgcagtctcagctacttgaaagtctggtgtgggagaattacctgagcacaggaggttaaggctgcagtgagttgtggctgcaccactgctctccagcatgggtgacagagcaagaactctgtctccaaaaaataaaaaataaaaattcagtgtgaaaatttcagtttaagatgccttttaaaatgtccttataataattaacaatcattattattcagtaaatagaaatatacacaaaatactactgaaatccttcggttgcaaatatatagtccaaatgttacaaaaaatgttaactttgaatttacttttatgacatgagggcactatcatttacattcatgagagctcagtcagaaattgcctcctttacttatgggcagaggaattcgtcacttgtttaatcattaacacactttccacaggcaagtaaaccctagtaccttggtggactctgggaatccgccccacgtccactccatgtgagactctgatctgagcaggctctccgcaggtttcacctccagctctgaatcactcttaggacacgctgtctggggataggtgctgcaaagagaacaaagacacacgatgacttgaaagtcgggaaaccttcagtcttgctgagcctgacagattaaaagaaacaaatctgaatatcttgactttatcctgcatatataaaaactctatggaagggagcatcaattatttcttccacttgagttctttaataataataataaaaatgacaccaactagtatttaagaggacttaccaggtcctttgtaaacaaacactgtagattcataatctcatttgcttttcacaagaaatcaatgagaaagaagataattttgtaggaaaggaaaagcaggcaaattaacataacacctgagaatctgattgcagaataaacagttatgactatactttttttcactatattattcatttacagccaacagttgacactaaaagatgagaatttttaagaattgcagatgagtgggcacaatgtctcatgtctgtaatcccagtgctttgggaggccaaggcgagaggatcacctgaggccaggagttcaagaatagcctgggcaaaatagcgagactctgtctctacaaaaaaatttaaaacttagctgagcacagtggtgcgtgcctgtagtcccagtcactcaggaggctgaggtgggaggatcactcgagcccaggggtttaaggctgcagtgagctatgagtgtgccactgcactccaggctgggaaaacagagcgagaccttgtctctactaaaaagaaaaagaaaaaaaataactgtagatggctaaattccatgctgattatacagatctacaactggccaacactgttagagtaagtcagatcaaatttagaaacaaaataattattgagagaaaagattcatatttatgttacaagtaaacattcagttccttggctgtgtgagagaaatgggaaatatcattactacagattaacagaaaagctaattaatacatctccttcctctttcaagaaaccaagaaatttcaaagatacttacgtctctaaaggggaccaatctccatcagataaggggtaatgatccccagaatggaagagcaaaggctctttacattcttcttctttcaaggaagcatttgaagatcctctgtgaaggagaaaccaaagaaaggcaggaacgatgacattcttgtcagctttaaaatatcccccaaacctactgatactacaaacaatcaaaatgaagaggggcaaatgattactaactctctctaaaatatatgaaggagaaggggggatacaccaatgccacccactataaaacaccacaatcactattcacatatggaataaatagggggaggacaaaagagaaatgtgatttctcttttttccatcccttaagggtgattcaaaggctaaaagaaaactaaggctttatgtctatttcattcaatccttacaaaatgaggtaatatttcattgtagattttaagtaatcaaggatccagagaaatttagtaacttgctcaaagtcaaaaagataggaagtagttggattcaaaacaagtaagcccttattctttccactgctctcccctttctactgaatacatttgaaaatgtatattagctgaagacaaacaagatctatggctcaaaattttaacaataccctaacctcttaaaaccttgggactaattttcttctttgtttggcccaaggattatctgagaaggtttcctttacttggaatctacaagatgtggagatgtgaagatgataccaaaaatgacaaatgcttttaagattcataaaaggaccttgggtagggggttacactactgctgataagattttaatcaatttacttgttggtttctcagattttcagttactataactaccttgccatataaccttgaaaacatccctcagaagcactgtgggcccccgttttcatctttacttggaaatttatcatttgtcctgtctacttcagagtcaatgtgagagttacatggtgtagcatgttgaaatctctgaaaagtaaaaagaaaagcacaaagaaagactctggccaggtacagtggctcatgcctgtcatcccagcacttcggaaggccgaggcgggtggatcacgaggtcaggggttcaagaccagcctggccaagatggtgaaaccctgtctctactaaaaatacaaaaattagccgggtgtggtggcgggcacctgtaatcccagctacttgggaggctaaggcagagaactgcttgaacccaggaggcagaggttgcagtgagcggagatcgcaccactgcactccagcctaggtgacagagagagactccatcccaaaaacaaacaaaactctgcaaagcataaagcgccatattatacaagtttaaaggcttcttatagaaaattcaatgttctaataggacagataataaatgtaaatgagaatatccacatcacttagtttgctggactaaacacagggatagaaaaccaggttcttttttaatattactcttcttcctttatatcttaacttaacatactcttatttaccactaactctgacatgtaatagtttttccacatagcttaatcttttaatttaaggttttcctaactctggtcttctttctctagggccttactctggcataccactcattgaaggggagaaaacatatacctgagaaagacatctaggaaaaagtactctatttctcaataaaggaatatcaaaaggcaaattttcccctgagaaagggaaaatcaggtttgtgaatggtctttatttgcccactctgaaaggacacatcagcttgacccatcactatccatacgtgaaagtggtctgaaaagaacaatgtaaaagtcacacaaatttctaaccggaatttttatattacaaatattttacttttgggacatatttcactgcagtataaaaggtaagccaagaagaattcagcaaagcaaacaggatttagtaaaatattgaaaaagcgatcaggtaccacctgaattcacagccccaggaagacaagaggtggccttttttggtcatatcctgacaaaaatacagcccattagtctaggcccactacagtgacagaaaagatttatgctgagatccctttcagtcctaagattcctttattaaaatagaaattccagaaaccttttaggaactttcaaaatggcaggtatgccttagaacagggacctgcaaggcaaaccatgacagagtaacaaactaagcacgtgacgtgaggctatagtggagcgtacacagtagaatgtgaagaaaacagcacaagcactgattctgttttgctaatacatcagaactgagcaaaagatgtaaacggtgactttcagtcagggctgggggctcggaggctgaggttcacagccagtgtgaacagggcactccagccctcacagatgtgctacaacatcacatctttcaaattccgcatcattttctaagcctaacatttttccaattcaaaagctaacggaggttacatggatgtatatgactgccaaaatgcactgaactgcacacttacggtctgtgaatattgctgtatgtaaattatacctcagttttttttctgttttgttttttagagaaacaaatcaataagcattttttattaacttttttgacaaaccgatagtaaaacatatgctacctaacggtaactgtgtccctttatgtatgagtctaagataaatattattcagatttttatctggacaagaaattcaaaggctccttaagaagtaagaaaggaaataccatggtcactaatgtaaccagactaaatataaaagctgcgtgtgtgtgtgtgtgtgtgtgtgtgtgtgtataaatcaatgttttgatcaatgtaactaatctgaggttacaataactcactgcttcaaataatatttcaattacatttaacagattaagatactgtttaggggaagacagcctcagaaagaagtattaacaaaaaggcatattaatcattacctttaatcaaactaagtatcaacctttcccccaacccataaagacttcatgtctctaaatggttcctaaatcatggaatataacttgaaaaattttaaatacatctcccagtatcagatgtttatgtactccatgtgggtccaactttcactgcccagagtttcttgtcatggtagtgtaacatcatgagtctggttgccagatctttttgtttttatttgtaacagagctaaaccttttaacaattatattaactacaactaagttatttgctaatggtagtagaatgatatatatgctttattaacgaaaatagtacttctgtaaatttttctttgtaagaattccgcaaatgccaaggaaaagaaaagactcaaggggtttgggaaataaaccccttttaattttaaatctatgtaagtttaatttattcccaaactttctaagttcttccagagttctggccttcagaatatttcctaatttttcttcttaagctctgcactgcatcaaaacctatccaaacgatctaattctgtgttacctatatttaaaataaataaagcacaatatataatcaacactgtatcactagaattgtgaagctcttcatgactttaaaaaaaaaaactccaaaacaagctattttatttaacatgtaatagtcataaagcaactccatatatttagttttctgatatcctaatgtatttccacaaacttttttttttttttttttttttttttttttttttttgagtcggagtctggctctgtcgcccaggctggagtgcagtggcgcaatctcagctcactgccagctccgcctcttaggttcacgccattctcctgcctcagcctcctgagtagctgggactacaggcacccaccactacgcccagctaatttttgtatttctagtagagacggggtttcaccgtgttagccaggatggtctcgatctcctgacctcgtgatctgcccgcctcggcctcccaaagtgctgggattacaggcatgagccaccgcgcccggcctccacaaaccttttaagtctacaattttacatagttttccatcagggaggcaagatatatataatttctttttatatttaactaaaggttttaagagggcttagtctgtaaatcagtaacaattagtcataacaccatacaaacacatttaaatattcaggaaagaggtttttaagattattgcttagtcttataaaatggtgaattttaatcaaattgatacctctgtattcttatttatgtttcctatactcttacatcatactgcttggcaagtaatgtaagttttgacataatttaaaaattcaagtagttgtaaacaaatcctaatttgttaacaattcatatattcccctttacttactatactacctcagaattaatcctccttaaaaaagcaatcatcccacatagaaaaaactgcagagcttcatctcttccttaaatattttcaagtaccgtaagaacacaaatccatgaaaaaaactgattaaaattggacatttcattaaaattggacattcacaattagctttactaattatggaataatacaaagacataaaaaaagttccttaatatttctttgcttaacagagaaatacaaagaaatactgcaattatggttatgggctatttttcagcctcttcaagtacaggacacaactatggttcctaccagtagggagaaacgaataatcaatcttacataacacgaaagaaagatgagaggcacaaaaagataaactgactttggcttttaagaacctaatgttaaccctgaaatgccacattcagtaacacaacaacaaaacaaaagatgacagcagcaagccaccacttcacacagtattaaaaattctgaaatacgtaatagccttcctcccatctcccactcaatctgctgtgtcgtctttttgtttttcctgctttttagctgcaggcagttcaaggcttgcccactgcatcggttcagcttttctcatagtgatttcaatctttgttgcagtcatagttaataacttcgctttacatcaatcacaccccataatttcacattttgatcaaattccttctctccttcaaatacaatatgcgcatctaacaatgtgctatttgcttctactcgactaagttctggaagtgaatttttagcctatactgaaatggtaacttcacctccagtctgatgccagtcatgtctacatggaacaacttttttcccagcatcttttttagtccacatgtttctcttttgtacagccctcttggtctaagaatgtattaaaatcagaagtttttcttctacaacagctccagtatttcgtcccctcatggaaaataggtactccagaatgatatacacagacttcttctagactctctagaccccgatatgtctttgaacaccctccattcttacatgaggtcccaatcttaatttcatcattgtcttcttttcttattttcttcattccctgatgacagtttaagtttatcaagtgcttgttttagggaggcagatatttttaattccaaatttgtcattggttcatctgggcttggtctttttatcgcgtctactgtcttaggggcttgaatgtgttcctgaaattttggttttaattcagatagttccttctcctcagtagtcttgacctcaggtttgactggctcaggtggcttctcactattatgtctaccttttgtacagcctacaatgcttaagaaatcagaaaaatcagttgttcttctcttacagcaagaccaaccctttaatgcatcgtgaaagactggaacgcctgggtgatatgtgcaagcatcgtcggaattggtctcaggatcgaagcgctgaccgcagctccggttgtagcacagcaaggccattttttttcccactgtcacaggcaaggcccaaacaccgggaacagcaagaggatgcgttagccaatcccgtgttgctagcaccagtctccatacctcagttttttaaagtgagaaaaaaatcaattgaatgccaaaataaatagcctgaattatttatgtgggataaattataggtgcaacatgaattttaaactattcactggtagtatggaacagataagtggggctgctaaccaccataaccaaagaccactaactctgttaacaacgtctagcagcaaccttagcacagtacgagtcaacgaatttcagcgtggctaatgatctcagctggcatttggatacagagcatttcccgtaagacatatggagccctgcaatacttctctctgtgttctgtgtcagaaacgaaggagagaaaaggcagggagcatctgtaagatccatgtcaccctgagtgtctacactcaccccagaagaacatggagggttctctagaagccaattaccgatcaggagatgaagtatgcagatcatcagagcagtaggtgctatctgtgaaaagtcttaggctccctggatttagctcccagatatcacttttaagtaagtctgctttagtggattaaaagttgagactcctttctgatggtgtgatattgagcctccatttttgctattgctgggtatttgaaatatttccatcggtggcatgtttcatatatttgcactcaagattatgctagaacaccatccaatatgcagagtctcttccctccaaaaggctacatatgcctaggtgcaatgtttttaatctctctctcacacaaagacatccatccatcctctagaaggacaaacaaggcttctatgttatatttaagcccaacgcccatctttaggaagggagggagacttactaggtacagttttttaaagccgtgtatagtttaaagctctccgatttccagaaatgagtttcttccagctgtgctatagcaatctgctttaaagaatgattccctcttccatctgcctccttcaaggagcctcaattaaccttaattctattatcaacaaaattcttgaaaagtaaagaatttaaacgaaatgccatttgtcaaaacaaaacagaaacctattttatgcatttatcttctctggaaaaataatttcttttctaagtggtaggagctgaggagaatatgctataggaaagctgcaaattccgcaacgccacgtaattcctagtcctcacaactgcaaaagcaattgatttccttttctttttctcttagattttgaacacgttgtttcatatgctgttaatgaccgtaaatagcttccctcaaataatgtcagagtctaggtgctgagctgaaaggggccttttaaaggccccttcgaccctctcactttatagattaagaaaccaacgccctgagcgatgaagaggctactgttctacaatctataatgggcccagtctgtctaccttttagctcagtgcttatttcagaaaacaacctgaattttcacagatgtttacattttgttttctttttttaaagtcctaatttctgttggctatattatttaagcagattctattttaaggaaatttcatggaagagctcctccaggtggcagcatcaattattccatggtaacctaaagaaaaagcaaaacaccaacctcctgaaaacgactgcaaggccctagcttacgtgtgttgtgacatgcctgcttaccaagccagcaagctgctggcttagagataggctggcagccattcatacctgtcaaacacatcagtacacagtggatacagcctttcacaccatcaggaaaaacaaggtatgtactaatatttctgcaattggcttacaacattcgtttgcaaattcctttagaataatgattcttgtacaatttagtagggaacttggcatatgttttagaaattgttttaatttcccaagctgtaggttgttcaggaattctaaatgttgctctattatgtctgacaaaggacacaggtcaacaaaattctaagacaaaagcattacttcagtgctctttttggtagatcttggaagaattttagttggtaaaaatattttcaggaacgaagcacttctgggagcattacaaggctgatcctaataaaacttaagatgtgtaagcatttcaagtttttctcaaaagaatacgtttcttgcccacctacacattttagtatgcataagacaaaacttttaaaggaaattgtttataattttttttttttttttaaagacagagtcttgctctgtcacctgggctggagggcagtggtgtgatcttggctcactgtaacctccgcctcccaggttcaagtgattctcctgcctcagcctcctgagtaattagcctgccaccacacccagctaatttctgtatttttagtagagatggagtttcaccatgttggccaggctggtctccaactcctgacctcaggtgatcctcccgccttggcctcccaaagtgctgggattacaggcatgggctaccgtgcccggccttttaataatgtttttaatattcctgaagtcaagcagtagaaaagtaaaaaatctcatactttattctcctagtgaagagaaggacaaataacctttaaaagactgaatgaaggaaggaaaaggacaggaagagtctctttttaagaaattctggtactttttatcagcttaaatttctttgggaatcaatgatatttaaaagtagagttcagaacatttatgatgaaactcttctcagctagtattttgacactgacaaaaaaaattacctaaatttattgattcattcaggattttaaaattttgtaaatatagtgtactctggtttgtagagcttaacatacttttccactattgctttccatcttttgttgtttagttctattggagaaattctgcattctatcagaactgaaatcaaagtgttacatattcagcgtgggaggagtaagacagaacaccacagacatgacagctagtgagcaataaaacaagaggagtagaaaaaaatttcatgtattaaaaatggctatgttacttataatatcgaattgtaaaaaattactatcaaatatagatgtttaattctaagatttaaaatctagatttcaaaattttggaaaatgaattgttttacaaaaaaggattatactatgttattcattaatgcagtataattataatatactaatactacattaattaacactttttgctgggctcagtggttcatgcctgtaatcttagcactttgggaggctgaggcgggagagttgcttgaggccaggaatttgagaccagcctgggcaacatagcaagacctcaactctacagaaaatttttaaaaactagctgggtgtaggggtaagcacatacagtcctagctacttgggaggctgaggtgggaggactgcttgagttcgggagttcaatgttacagtgagctatgattgcaccactgcactccagcctgggcaacacagggagaacctgtctcaattaaaaaacaaaacaaaacaaagcatatttttttcctggtttgaccatttaaaacaaaagattggcaaataaaacacataccagattgagctagggtttactcttgatatatatttggtttccatagctagtgaaagaaattatttccctctattctaggatgaaaaacacttgaacatcactgttttccaggaagtagggtgtgacctcttttcgacagatggggtgaaaacacacaagtggaccagcagctcccgccacaaataaagagtctggaaatgcagggccactcatgggcagcagcttcttgtccagtcgtcaccaataaagagaatccccaccacggtcctagtgccaaggtggccactgagtgcaacaggtggaagaaaacggaatcttgaataagaaaacgtgttctactcccaactgctacctttcaaccccaagcggtgctgacatgaaaaatggcatataatgagctcttctacagagcaggtaaataagcagcgatcaagactgctcatgtaaaaaaataaaaatcattccttttcaattccaataaaacaaaactcaactcctcaggaaaaacataccaagcctaaggccactgggtagggaaatcccagagatgacatggtgtccaactggatctgctcaccgaggggcaaatcactaattcagatcttttgacttagaacttatttggctcctggaaacttctttatgaaaagaaacacaaccagtctgctacaaatgacatttcagtagcatatttatagaatagttgaaaggaacaaagaaactgcctttgctgcttgattccacaataaactgtaaagggggaaaacaagcccaaacctcacactgtgtatccataaaaaaactggcagctcctggcttcacatgaactctaggtacccgcacaagacccttcccaggctgagagtcctaccgtgctgcctgggcccccttgtcatcatcggagctcacgcctacatcacatgtgtcttctgcagcagcagatgcggcctgctcttccttcttactgtcctgtttgtatttctttctccttcgttttttctttttcacagaacttggagtaaaaattgtctctgtttccaagacgtgtgagatgtctgaactctgagatggtgtttcatctccacccgatttcaccaaaggggtgtcaatatctttaaagaactgatcttcagtaggaattggtgaggtggcaaggtaagcaggaagcttttccttgaggagaatggagaaagaaaagttatccatgacaaactcgacagtgaattaaagcagtaatattttgaatatataaattttcaccatggtaaaaaaaaaaaaaatacatattccctaaaggcaagaaagtcccactgaactaaggcactgcctactatactctgacgaggtctttcccctgtgaggcagctaagtaccagcccacttgggtacatgtaactgagtccatctgaaggaactgacatgccaagtcagcatggaacaccccaaagccataattaaagctaagcctattaaattcttcacaaagcaaagatcaaagcagcaacaaaaatctcaggaggtgttacaaaggactctctcaagaactcacacagaacattcagaacaggaaaaagcagaaggcagagattaaggacactacatcagacaaagggcagcaggacaggtgagtgacgcgaggatgcagtgatacagagcggccaatgcttatgttttgccaaattaattggagaaaggcaattagagacaataccgtgtaacaaatgacattagtaaatttttaaaccataaagcatttatgtttaaaaataagaaatattccttcctgtaggaattcaaaagaagaaaataaggcccaatatttagaagcagtcaaactcctaatactaaataaacgatcaagtctggtgttcagtaaattcatgtcttagccatttgtttcattcctttttgtatcatcagaggaaatggaaggtacataatagagataaaaattaacttcaggcagaacgtggtggctcacgcctgcaatcccagcactttgggaggcagaggcaggcggatcacctgaggtcaggagtttgagaccagcctggctaacatggtgaaaccctgtctctactaaaaatacaaaattagctgggcctggtgatgcatgcctgtaatcccagctactcaggaggctgaggcagaagaattgcttggacctgagggggaggttgtagtgagccgagatcatgccactgcactccagcctgggcaacagagcgagactccatctcaaaacaaacaacaaaaaaattaacctcatataatttaaaatactcaagcttttaaacaatagttctgaaaatgtataggtttctgtaattatttttttattaagcttttgaacttagctttgataaacatattaccctgaagctaaagtttgatttagctaggagaaatctgtgttcaccagaaacacacacttacagagaaattgtaataagatattctgaatgtccaaaagaaacccagatgagaggtcgtggtctctgactttgaggatttttaattcaatgatctttattttacttactgaaagctctttttgtttctggtggtatttcttagttctattatagcaatgtttgtaggatgaagataacctgaacgcctaccagcaagaaaatggttaaacaaactatggtatgtccatactatggaatactgtgcagctattaaaagcacagagttaggtttagaactagacttgaaaagaatgttgatgacatataattaaatgagaaaaatctgagagaaaaaaatcaaataaatggcaacaaactgggtttttggtcatctttatcctactctaaatgacgaacccctagaggaacagaggcatgttgtattcatagcatgtggcatagagtagtaattccaacatttgttggataaattaacaattttttattttaaggagaagcatactacacaagataaactctggtcaatgtagtcatatgtggaatagggagaaaaaggctggaaagttgacattttccaagttgtccttgctgagcataatttttagcggaactgtcagaataagccatgaaaacgaggttaacatcaataacccagtcctctcgcttacggtgcctgctgatctagaagttcagtgttatgaattataaataattttaagaaacatacaaaaagtggtttttttttttgacagatgtcatttattatgtttcattctgctctttgcctctgtctctgataaggaaaaatgttgcttaggccaagtaaatgcaaacaaggtattacaaagataagtaatgaagaaactagaaaaagcaccagtctgatcaagcttccccttcataaatcatagtgtttcaatgctgctttacctactggtacctaagttgttggtttctcaatcaaaaaatgataaacaatctcattttgctatcgtattttttggtaataattttctttgtaaatttattgtatcaaactgtaagttcatcttcaaagccaaaaaagtagtcctgtatccttaataacttgatgcttatcagttttgctatttgagactttattctttatgaagaatgatgtactgatgcctttgaaagaatttttaaaaagatgcacattacgtgatctgagttctttagtgagaatgtaaaatctattattaataaataaataaataaaaagatccacattgaatccatcaagaatccgtcgttaactagcgttcaaatcagtacatacagaatgtgtgtgctggggaggggggattttaacaaatcatgctcgtttgctagaagaagtcaaacatgtaatcacttataaaaggatataggccaattaatttaactctcttgagatcataataaattaattcacctgactactcaaggtgagggatgtaatatcccaaccaaaatggtaaacatgagtcccagtccaaagggcacatgtggataaacacatagccagaagagaaatgccctactcaggcagaactgaatgtattcaagtcaatatgtgaaccagaagcaacactaagtaagaaagctcattaaagctagaaagtgatgtgccttcccttagaaaaagtgcaagtatgtgcattcagcatgctccctgcaccctgaaactttgtatggagaaaaattcctcatcccttcagttcctttttgacagcttagttcttcaacatgaaactaaagcttgtcttgccaacaacagtcctctgtacaatcaaccataaaaaactgctaaacggtccgtctgggccacgtaccagaggcctgagcacactgtgtaaggagggtgtaacccatgcaaacttacatattcttcttcagtctcctcaacaaagaaagcttctccgttatcacccaacttcatgtgaagatccactgcactgccgttgatttctatatcaatctatgggagaaacaaagtatgacttaatgttcaaggagtctttccttcaagttaaactaaaccagaactctgagttctcaagtcaaacttagcatagttttgaggttcctagaactacagcctctgagaaacactgctacttgcccctacccaacccctaagaagccaaatggagctggcagagggagagatggacaaccaggaattgaaagaaagtgtttcaccatctatttttacaacatataaaaattttaaaattatttttcaaatttaaaatgggggaaatattattgtcaaacatttgcacactttccaagttatggcacaggcaggcctcacctcacacggttcagatacacacaagtttcaggaacctcagtatgtgagctgtgagcaactgcatcaagtacaacttcaccgacagctcttctgcccacagatcactacgtaagtaacaggtgacaatcagtgctgtgattggtcactgatgatggcggttccattttcccaagaaccaggtgaaacgatgggataagtaatatcatgtcaaaaaaaaattcaggtagacatatgcgttgggccatttttgtgtttgctataaagaaatacacaaggctgggcaatttataaagaaaagaggtttaactggctcatggttctgcaggctgtacaagcacggcgttggcatctgcttggtttctggggaggactcaggaaacctttactcacggtgaaaggcgaagtgggggcagacacgtcacatagtgagagcaggtgcaagagactgggggtgccacacaaaggtgccacacacttttaaaacaattggatcttgtcaactcagcaaaaactcattcatccccaagtggatggtgctaagccatccatgagggatctgcccccatgatccaaacacctcccaccaggctcacctctaacactggagttcacatttcaacatgagacttggaggggacatccaaaccttatcaacatattttgtcaaaatgcttgttataaaactcctatgtatgggccgggtgcagtggctcatgcttgtaatcccagtactttgggagaccaaggtgggcaggtcacctgaggtcaagagttcgagaccaacctgaccaacatggtgaaaccccgcctctaccaaaaatacaaaatcggctgggcatggtggcgcccgcctgtaatcccagctactcgggaggctgaggcaggagaatcgcttgaacccaggaggcggaggctgcagtgagccgagatcacgccattgcactccagcctgggcaacaaaagcgaaactctctcaaaaagaaaaacaaacaaaacaaaacaaaaacaaacaaaaaaacctcctatgtatgaataacataaccacactgaagtgaggaagaatggaactaaccttaccttggaaacagtattttgacttgtattataagtctaaagacatatttgatatgttactccaaacaaacattgtgcagtagttaatacattcacagagatttgagttagcaattctgaaactattttgtgtttcctaggattgagtaactaagcagatatactgacgataatcagaaccatgtttcctgttgaaagagaaaaaaattataaataaggagggggaaagaagcctgcgatggtggatgggaattggaggaacccgtgtgccctcatgattttcatatatagatgcaggggtgtgtgtgtgtgtgtgtgtgtgtgtgtgtgtgtacacgtgcacacatccacccatttcctggctctgccagcttgggctgcctagaagcaatgatacctcaggagttacgagcacgcctaataagcagatctttgttcgtaaatactattcttcaataaaaggaactggcgtaaaataattaatgccagagctgaggcagggaaagtagcttcttctggaacaccttctggtaccaggaaggaagggttcaaaaactgatgggagcatttcaaaggaactcaacttgaaggacatacactaacagtcaaactgggacaatctgagcaactaatttcatttttggaggctatccatttaaacagtgtagctgggaaaatagaagaatgcttctttaacatgcaaattcagactctaaactattcatacactatctcagaaaaattaacacttcacagcccttacttttagagatcaagtatgacatttctcaatgtgactacttatcatctttgtgtgactttaaatggagtttggtctttccaaaaattaaacctaacatcaaattatgctaatattggcaatacttaaaagaatatgctgtgaactcttcaggcaacaacaacacaaaggttttaaaaatattttgagagaacaccaagttggaacaaattcttcccaccaacgtgattattttaaaaaggacactaatttgatgtatgaaattctagtaaaacagttttaaaaataacccctcatttccatatagtcttacttcttacactgtggcttaattgtgctgaacataatataggactaagatgctgaaatgaaactggtatctctgagaaacagtcgatgtactagacttttgaactagcttaccactctttgggtaagaatatctcaaatgtcttttgggagtctattcatcctgtttcaaatcatatacaagctgagtgtctcaaatccaaaaatctgaaatctaaaaatgctcaaaaatctgaaacttcttgagcatttacatgacactcaaagataatgctcactggagcacttcagacgtcagattttcagatttgggatgctcaaccagtaagtatagtgtaaatattccaaaaaatgaaaaaaatgaaatccaaaatgctctggtcccaagcatttcagataagggatactcaacctgtatttctggtgtggctttagggagtagaggtgggctgttgtccaagccaataaatatatctctttcccagctacagaaactggtcccagagatatgtccgttcctttgacagggagactaaatactgatacttctgtaggaagctctctctccactgggattgatgagttaacagattgtgagcctggaggtattggtggccattttacattagagagaaaacagaagtggaagcagagagcagaggtggggaaagaaaaagggaattctgacagcaagcttttttgcctaagctagtagagggtaaatttctgttatcagcaatgaaaatagttttaatacactgggttatttaactttgataaataatctgaccaggcgtggtggctcacacctgtaatcccagcactttgggaggccaaggcgggtggattacctgagatcaggtaatcctagccaacatggagaaaccccatctctactaaaaacacaaaaagcagccaggcgtggtagcacgcgcctataatcccagctactcgggaggctgaggcaggagaaacgcttgaatcagggaggcggaagttgcagtgagcagagatcgccccactgcactccagcttgggcgacaaagcgagactccatctcaaaaaaaaaaaaaaaacaacaaaaaaaaaaaacagaaaaaagaaaaaaaaacttttataaataatcaagtaatcagctttttctgatatcaataaattttaaaatatcaagtacacatttaccttctaaaagtaaactcctaagttactaaatttactgggagtactgctgttctaccaaacaattacgtatcaatggcagtgggaaaattattatactacatctctctaaacagtggttttaaggtggtcatgatttcaaattcacttcataggtacacccgtatttgaaaatttggggtcttactttcacatcaatggccagctttccctaacccaaactgacttaaaataagacaaatagttaatgcaaattgccagtgtatctcaaagtaggcatgatttcagttttactctcacagtttttcagttttctcacaggaaagctgttttggtaaatcaaatggccaaatttcctcccaaacatattctttgggtttctgagatactaagggagtaggaggaaaaaaattctcttttcctgtgtctcatgagtacattcctattaaaaatgcaacgttttgacaagatagtaacacaacgattgtgtagcttttgcacaggaattgtattatttcctaaattagaggcacacagcaagcaggaaaaggtgttttatctacttggtcaccatttacagatgcatacatgcttataaatacatctgccttcaggttccattttgaaaggccagacactgatccaatgtgataaaaaacaatctcagcaaaaaaaaaaaataatgatgatgataccttatcagcagttttacaatagatccatacacaactaatgggaaatttcagtttgttgccaattcccccagaacaggtccagtctgaaagtactattggtgttaccacaaagaaagaaaaaatttcagagaacctaaactatggctaaataacactgttttgcaatggaaagtttctaagtccctaagtaaactgcaactgcttttgctttctaaagggtgactctgaacagaggccagaccacacaagccctgctaccctgaaatgtggttctccagtggaaactgattttgtaatacctagaaatgagatgtttttcctggaggaaaaaaagaaaaagaatatctagttttgtgaaatccattttctttcactctcaaaataacatttaagtttaattaaatagagggaaatttctatttaaagctcagctatataaaatagcaaaaagctgaaaataaatgttttcgacttacaccagtggtcctctaccacatacttttaggtctgtgccagaaaatggtgaggctcttttgttgtgctttaaaatgttgacaaagcctttctatgttatttaagtagatactgcgaggcaagaatagaaagagaaatctgtgtacctgccaagtgttattactagctctgttttctaatttgattgacatcagatatactagcaaaacttccagctgctccataacctgaagaggataagaaaaacctacacaaatatcttcttcctgaatgaatcttccctaaaacaaacaaaagtcaaccagcctatggtctgttggttagcatttcagtcaaatatggggacaagtcctggtatcaacaacagaatttagattacaaaagtttttacagctttgtcaaaacaaacaaaatgtggcattaattaatttcctttaaaaaaaaaaatatggccaggtgcggtggctctacacctgtaatcccagaactttgggaggccgaggccgaagccggtggatcacttgaggtcaggagttcgagaccagcctagccaacaaggtgaaaccccgtctctactaaaaatacaaaaaattaggggggcatggttgcacgtgcctgtaatcccaggcacttgggaggctgaggcaggagaatcgcttgaacctgggaggcggaggttgcagtgagccaagatcacaccgctgtactccagcctggacagcaaagcgagactccgactcaaaaatgtgtgtgtgtgtgtgtgtgtgtgtgtgtgtgtgtgtgtgtgtgttcttgattatacccacctattccatttacaattagtatgaaggtattagcctaagtatttaaaaatactatataaggtaaaggaaatttttctttttctaaatatgtctaagttcccccatctagtttctgttttgcttttctgagttgcaacatgtaagattattataataattttcagtttccctttcccttgaagagacttctgcagtcgagctttgtggttttcaaagtaacttcaaaagcaatacataaaggttgacttctcgtaacattgtctcaacatcattcaggttaaaaaaaaaaaaaggcctagaaaactcacaatagcgatttattcatagaggatgacttttctactccttgaggacactcactcactttctctttgaatctcaggatgacttttcctctccttgaggacactcaccactttctctttggatctcaggactcccagctttccaaaccgaacgtgaaaaggtgaacactgatagctgccatcctgctgctgtaccacgatgacatcaatgcacccagagagggtggcctggttaatgcccttgtagagttccttcacagtgacaatcacctgcccagccagctgtcccacataattcatggtttgagactacaagaaacaaaaattagatgagatgttaacactaaatttgtgatctattgacaaagaaataacagtcgtaacaaaaatgacactactcacttgtatgccagatttcatatcattagccttattaattttcaacctaacagtctcatgctaccattgtttctacgcatttccacacacggacctcccgagactattctcctttgtatctgagaggctgctccagccagggcctgaggcattccctttcctttctcagcaacctggatagtactgactgccattagggactttttccccaaagttcaggatcagcacagaatcaccaaagaaccctgacctcctgcccaagaccctttggaacctgcggctactgcatccactttggccatagcagccaaacagaaaaaacaaacatcatccccgggagaaaccagagattcatcttccaacagaaccaatgtaataaattagtgagagctacattttgtaaggaactattattaccagaatagtatggttcggacacatgctagattaaataaactctggcaagtctgcctgagcctagcccatttataacattacttctacggaaaaatcccttcaatgactcaatataactaactggaacatgcaatcaagttctacaaagttcaaagcacagaaaagggttttactcttgttcctcaacctcaattcactattcaaatcacaatcaaaaggtctgcaaggagttctccagaaaggctcaaaggagaggaagtacagctaaagccaggggtggctttattgccttggccccatccccaacttttccactaataaaaaccaaatcccccccttcagtcctaatgtcagattttacttccagctactgaatacacccccacattttattcattagatgctgacacccctaatattatgccaaagcacaattcagtgaaagccattctggggactggaatgacagagagtaaccaagagcccctccaatgctccagctaattcagaggccaactttcacccaaccacaggactgactgactgctctccaggctgtctgccataagcagctcgtggtttctctacacccagcttggaggctgccttgagcttaaaggtccatgctctgaaaagtttcagagatcatgttctgtgttgccaagtgagtccaaaactgaactgggagaaagaatgctgtcttcttgggaaaactcaggggcctccaggatatctgcctgcacagaaattcactctgctcttcacagatgagtggccacggcagagccctgattctaaattgtttcctgttcctacacgcggatgaatgtgtaatcaaggcccatcagttctacaccatgaagcatcgccatgataattttaccctggaagaaatttttaaaatattttaaaactaatgttaccaaggcccttaaatgcacccatagaaaagctggaaaacgcttgtgctgcaaaacttactcctaaataacaaaataagatgacatcctttatgtgatatcaaacaattataatctggtgatggttttggaataattgatttgacctcaatagctaaaccaaattaagcatgtatcaagtgctcaataatcatttattgaatgaatgaacaaatgaactagtaataaatgagactaaaaaaataagaaacataaaaaaaaagtgtggggaggaaatagtgtttcatcaaaatattcatataacatcccattatgtttttaataattaaattcctattttgaggtcactgtagattcacatgtggttctaaaaaataacacagctagatctcatgcatccttttcatattctgtaggtaatgcatattcacaacatgctttttacctacatggcacacacatgaattaaacagcatccaagcagtcaatcttggtattactgcttgaatggtggtggcaatgttaaaatgaattttattacaagaaaaaaaaaacatgttagaccttttcttaaaataaacaaaaaaatgctaacttttaagcattgacattcagccacaaacaagtcttataaacataaatgtgtaacaagcttccatcaactacagcataaaattcataattaagtgtaaccgtacctattcaagattattttaactaccatggttaagggatgtgctgttatatgggaaaacctaatgtgtaaatgccagttgctaaatgtagaaaaatacaggttgtcaaataactggttttctcttgacagataatgaaacaatgacatttatattgtgaaggctggtaaaacaaaagtaaagggaggcctgtagcttaacatgctacaccctgggtatgatgagcagctgtctgctagaagggtcaccccaacagagctggggaaagaggcttcctcaccgttagttacgtctggaggaaatgcagttgttcgtcataggcatgagggatatgttaaacagcctgctcttgaagcagaatctagtgccatataccttattcctacatgctagcccagcatagctacacaataagaaccaagtcagacctgtcctggtcaacacctgggaaagccacactctgaaccagcagcagaaaagatacacaatgatgtaacccaaatgtttaaaaaatatagcaaaataacacactataaactattcctcctattttatcatgaatgatgagggaaaatgtgggaggacaaaataaataatggagagtgacagagaccaaaggagagccatgcagaaagaaacaaacaagaagtcacagagaaaaaagagcaaaagcaaagacagaatatttaaccagaaaggcaggctcatttggagatgcccacacaaaaagcaaaatgtggaaatgaaaaatggtcacagagcagcatccctatcttgaggcttacgggcataaataaaaatattaaagtgcacttgctgattcttggaacaagaagaatacatccagcccattcttttaacaaataccaaaaatgcttctaacacatctctgaaatactctaacaataatcacactggaaacaactctttttttgaaagctcgtaacatcccaaattcttaaacttatacattattatctcagaactactttagaggtggtattatttctatttttaaagacaattaaggctgggtgtagtggctcacgcctgtaatcccagcactctgagaggctgaggcaagcagatcacttgaagtcaggagttcaagaccagcctggccaacacggtgaaggcccgtctttactaaaaatacaaaaaattagccgggcgtgatggcgtgcgcctgtagtcccagctacttgggaggctgaggcaggagaatcacttgaacctgggaagcggagggtgcagtgagccgagatcacaccactgcactcaagcctgggtgacagagcaagactccgtctcaaaaaaaaaaaaaaaaaaaaaaagaaatgagggttagaaaagttaagtaatatctatgacctccctctgtcccccaccaccaccaaattcatatattgaagccctgacgcccaatgtgatggtatttggagacagggcctttgggaagtaattaggtttagatgaggtcacatgggtggagcctccatgtgatggattagtgtccttctaagaggagaaagagacccagaccacgctctctttcctttcctcgtgagaatacagcaagaagtctgcaaaccaggaagagagcccaatcggctggcactttgatctgtgagaatggtaagaaataaatgtctgttgtttaagccaaataccatctatggtattctgctgcagtaccccaagctgactaagacaagtctcttcttaaacatcgcatgctatgctgcatttcagttttgggatcgttacagttgacagagactcactactttaccaagaagtccataaaaatgtcagagaactattatgtccactagaaatcacactgaatattaccacgctcttccaaatgaaaccacaacacaccaaagaatttatcagagtctcttctattctaggctaagcattcttgttccttaaaatatgtgaactgattgggtctactctgactcttatgacaattatttatgtccatctttaaaaacgatatttaaagacagctagacacaatggctcagatgtggcctgactgctacacagtgtatgtaatatacagtgtgctgtttaggcctaggtaccttcccatgggctagattaagtattgggagctccgaaggaaaagaagtacttattgattactcaaataaaaaagtgaagaaaaaaaaaagcagtagaaaataagcaactacaatacttattagagaccaaatggcccttcgcatataaaattcaatacgccaaattagtccttcatgcataaaatttgacagtgcccactatcatatttttcttatcaaatattttaaggtataaaaggacacacactggaatgaatggtagctttcaagatttcgttattcaccaaaagtttgaagatcagcttagcatcttttgctgagcatcaaagaaactaaaatgaataatcactatatggagtatggatttataaataaaatgggccaggcgcggtggctcacgcctgtaatcccagcactttgggaggccgaggcaggtagatcacttgaggtcaggagttcaagaccagcctggccaatatggtgaaaccccatctctactaaaaatacaaaaaaattggcctgtatcgtgacacatgcctgtagccccagctactcgggaggctgaggcaggagaatcgcttgaacccgggaggcagaggttgcagtgagctgagatcgtgccactgcactccagcctgggtgacagagtgagactcccaatctcaaaaaaaaaaaaaaaaaagcatcagtaaataggttcaaataccaatccccctcctacaaaaactgcttaaaattatttcaattatttgatgtgttcaatcaaaaataacttttgttaaggaaaagagtaatcagagataaaaggtagtttaaaaacaataaaaaaaattcataaattatcagcacaaaatggacacattctatttacttttattttcattttgagacagggtttcactgtgttgcccaggctggactgcaatggtgcgatctctgctcactgtaacctcagcctcctgggctcaagcgatgctcccaccttggcctccggagaagctgggactacaggaatgtgctaccatgcccagctaattcttgtatttttttgtagagacggggttttgccatgttgcccaggttggtcttgaactcctgggctcaagcaatccacctgccttggcttcccgaaatgttgagattacaagtgtgagccaccacgactggcctcaaaatggatacattctaaaccactattttaagtgtttcaaaatctgtttcttaagtttatctccaaatatctaatcggtactagtattgttagtactactaccaacgaacacacaactaaacttgttacacgtctctcatgtgtcaagtgctatgttaacctgtatgttatctcatgtagtcttcacagatacccatggatttggtattcccatttatatgtggaaactcgggttcagaaatatccaaggtcagcacactattaagtggcagagttaatattcaaactcaagtatgagcctagaacctaagcccttaattgcatctctaagtaacagaaatgctctaagtaaacatgataaaagccttcatgaagcctccagatttcttactgcaagtgggctgctttcagcaatctgagtatcatttttacttaatgcgacttgactacttaaagatgaaatgattacagggaatccaaagaagccatacttaccctccaagtctcctcacaccactactattaaccctcccgctggaccatggtccagtgttacaaagcagactcctgggagcgccacatgtcatgaggcttacggacagaggttaaaacagcttttaccaaagaacatgccattgcagctaactttctgctcatggacatgaggagtatgctaggagggaagagagacaccagatgcttcaggaaatagacaacaggacactgttacctaggatgtaggtaaacattccagcttgcccctgtgctcctggaccaaactccttcaggacacccatgattacggtttgcatttgattagcatgtaatatttttcaagaacttcctcaaacatacctcatttgattttcaaaaagagaatgtgggttatgctagcaggcattattaatttcattttaaatttgagattgagataagaggtgtctactattcactagaacccagttctacctatactcagggtcccaactttctccactacctctgacccatggcttaaatcattgggtctcaaggtcatgtggtgtccctgagggcaaaaaaaatctgagggctgaactcaggttatactaaatccctatggttttctcaaagaatcccagagtaacctagaggtggccaatatgaatctgggggggattctggatggtaaaaacttccccccaaaagtaagtgatgaaacgcaaaggtacccacgcagcagctgccgcaagcttctccccggtcagggagggcagggggtgacagtcccccaggggcttgcccacatcgtgtaggtgcttaactgagtcaacattttacaaaacatttacagtgtgcccaccagatgctaagggattacaaagaacgaaaggaggttacaacttagctagacagaagaaaggaagagtatacaacacagcgcagtctagggtaagttgaaagcagggccacagactcccgacgccaagccctgacggggaatccagcctttccgagggaagctgttctcagacatttaaattcaagcaaatgccttactttgtacttcctggttatttcttttccccgtcatagtagaatgccaatttgtttctttagttttgtattattttatattagctatctttaaattctcactttataaaacaagaaatagaaaatagcagccgcacaagaacaacctggcctaccccccaggagcacaaaacagatggttcattaaagcccatgcggtcttcctgaagctaagatggcccatgagaagtgctgacagctgagcctctaacactcaccgctcctagaccttcagtggagaaagagccccaaatgtctcctcaagaacacagcgggtctcctgctgccccagcagtgtagggcgactggtcaaagtgttctccttcatttctaggacgatttagtccctgtacagactctgtaaacgaaaacccagtgcctcccagcaaacttcctgaatacaccgagtatccagacagctttttcatcacaatgaaaaaggaaatctggaagaagccttacccgggaaaggcctctcgatgtaatcctcctacaggtttaactcagaaacaatcacaaaaaaagatgcccattatactggcctgtttctggtacagttcagttttcacacagtcaaaattaagcacctatttcatgccagtcactacagtaagtccttatgaagataaacaaaattctgccctcatcctctctcagaggaccttggttcttgaaagagatataacaaatactgtcttatataatcccttatgataatgctatttgggagactgttaggaagactagagaacaaaaagagaaaaaatctacttgggagagttaggtaaggcttcaagcagcagaaaatatttgttctagaagtgcaagtatgtgtaaagggctgaacagattaaggaaggaaggttcccagtgggcagtcccaggcagagagaacagcttatgggaaagtgtgctaagtttgagggacaagagtgagatgccacaaggcctttgaccctgtgcaagtttatcatgtgggcaatgggtgcaatcagtgcttcttctgttcagggaagcgacaggattaggtcacagggggaggatgaactagagaagaggtagctaaaggcagagagactactccagaagtcaccacaacaaattcaggcaagagactgcacagctctatggtagaagagacacacacagggagctgagaatcagttagtcttgatgactgttgcatgaaccaacttagagatatggaaataaaaagagtagacctggtggggaacttcctatcaaggttgaacttaaagaacactacttactaccacactgcttcaaaagtttgtgtacatgaaaatcattctgggtggttttaaaaaatgcaaatttctgactgttttaaagcttaagaactaattatgaagatgagccaggttagggaagcatagttccatgtaaaagtaagagctcttgctactttgtgctacttccaaaatcagttcaacagaaaactgactacacaaaggctctgagccttgggaattgtcctgtcctttgtcttttacagagaaaaagtacaggggagtttttgaatcgttctgagctggtgttgggcctcagaggactccctcctgagagaatgagatttagccaggatgaggtgtgctttggaggatctgaggttctagtcaattccccgtagatcacaaactctgtctttctaaatcagagcaaccccatcacctccactgtttgaagtcgcagtcagggaggtttttatatctaacttctttttccccactaaatgaggaaaactggcaaggagcacactctaggtcagtatttctcaaagagtggtccttggactgcctgcaatagaagcaagttttggtgcttaagaatgtaggttcattcatgaaaaatacgggaaagggggataaaaacaaatacacgctcatgaaccccaacccagacctactacataaaaagctggaaatgaggtcttaaaaatctgttacccacgattctgacagacacccaagtttgggaactaactctaggctctgttgcaagaactttctcctcttaagcctgattaagtttgttatgaagactaagttgttatgggctcaagttcacatcctgtcgtataaagatgtcaaggtctgataagtgtggatcagaagtggaagcaatagatagtaatagaattttagacattttaatgacagctgacctgactgttttatgatacttaaattctagaactggcagtgcttctgtgaaaaaactcagaaattctggcctgggaagactgcttgcctaaggaccccttccacaattacaaccaaatattactcaatatcaacctttgggatacgtaagaagaggggattttctgattcaatatttctgtttgggaatttaaacagacacataatgcaatggctagatctgaaggtaaaaacagggctccctggatttcaatgatttcagtgctcagagaggcaccgaaacacaagggtgggcccccagtagccatgtctataatacgggacccaggtcttggtatctgctggctgacaggggtgggaaacatctggcccaaacagatattcatgaaacgtatatggagagccaaggccacccaagactgggagggctgggctacctgagatgggatgcagaaggcccaccagcttggaacactgacaccccaggtggccctggctcttgccctcttggcatctctctgaacgatgagccagtcataagtttctttgcgtggttgttcagagtccatttccaatgttgccaacagaggacttaaatcagacaggctagatcctgactggataaagccacctggagccctaaaacaccctcctgcaaatatcagcctggcaaaactagcaagaacatgcttcaaacataacccagataacactttatgctacttaacaacttaatctgttgagaaaaaaatttttaattttttaaaaatgagaaaatatgaagctggccttaagcttagttctcagggctgataagttttaaattaggatttttggatctgtcaccatgttatttcctttgagggaatctgaaagctcagacttctgctcactgagttcacttcactatgatgatttcaacacactcactttctataaacagatgaactgctttgttggactgagtagggctcagaaaagggaagacgctttcccagtatagcaatgcaccctctctccgagtggcggcccagacctttactcaacgacagtgtctacttcagcttttcagcaggtataacttaaggaaggaccataaacatcacctatttcatcttcaaaaattaccagcccccatcttctacccaccccagtcatcagcccaataattttctggacaattcttcaaaagccaataccagttttcatcttaatctggtatttcgtaagaggagcaaggatgtttcaggttccctgggtaaggaggaagtgggatcaaaaaggaacgtacatccacaacagattgtgaatccccagagcacaaaggcaaagatcaaaaagatgataggggaggatgtgtgggctcagcggctgagaagaaagcagaggtcacaagatgggatctgttgctgtgagtgcccaaggccccctgccctctccctaccacagcacccaccacgcggcatgaacatttaggctaccttcaaactcttgagttccggtaaggaagagaaaagtcccgcaagcttcactgcttcctgaaagcttggcacagtgcctagcaatagtaggttcttaataagtggttttggatcaatgaatggaccaatgaataaatgaatgaatgaatgcaagacctagtgaacagaatcagcaaggagagggagaaatatacacagtgttgcgttttatctcactgacttagagtaaaattcaagaggtaagtgaagatacatataaccatgcactggaaaaaaaaaaaaaaaacaggctgggtgcggtggctcacgactgtaatcccagcactttgggaggccgaggcggggggtggatcacctgaggtcaggggtttgagaccagcctggccaacatggtgaaactctctactaaaaacacaaaaattagccaggcatggtggtgggcacctgtaatcccagctactcaggaggccgagacacgagaatcgcttgaacccaggaggtggaggttgcagtgagccaagatcgcgccactgcattacagcctgggcgacagagtgaaactccatatcaaaaacaaaacaaaacaaaaaaacaaaaacaaagaaaagaaatccatggtggaagttaacccaaagtcccaaaagcaatgcccatgtgttcagaccaatactttcctccagaagctgctgaagacctcacagagaaaaacttgcataaatctagtctatgtcagtgacaaaaatgacaccgcctcaggatgggtaaatctaaaaatatccccgtgagaacaaatgacagccaagtagatcattctggagaatactgagcagcgcagcagcaactcgcggcagagactgctggtcatcagaggaagtcagtgtgaagtcagccgaggcaggggcaagggtgccgtaactgcattattacagaaaacaaagtgaaacacaaccacaaagttatccatcttctactagtcagctgacttttacgaaaatgcccaatataattatgctacagagcacagcctttaaggaaaatggctggaaacaatagtttaattttcctgtgctcaataatgtaccagaacattaattttcttcagaaatagaacctggtacagagcaagaaaaactagtgttcaattttatcgttaaatttcaaaataacatgtgtggcttaaggagatcctaaaacggtaagcagcaccctcaaaagggggccccaactcccttcctcagccccgacaacattcacatggccaaacttgtttcaaactatcatagctctgtaaaactaaatggttcctgttcccacatttctctttaatgcttctcccttcatttcccaaaatgaaaataaaaccttgtcatgaaactttctgataatttaattcttgtctgttcccatcaaggctaaaatatgcccagttttgacctctgtacatgaggtgacagatgctgttacagggaacatttaacctgactggcaaatagagagaaatgcaataagtaaaatcattaagaactgtaatcagttcaacattctgtttataattaataatgaaagatattaaactattacttaagttaacctttgtgtaatggttatacctatcagcacagaaaaaattccagctaaatgttcatgccaatttagctatgaagttttaagattacaaatagctgtaccttgaactattcaaaatagatttttcttaaaacaaaaaaaaaagcatacactttacaggcaggaaaattaacccttttgtagtgtacagttgttagctgtgaccacacattgctgtagccaccactataatcaagatacagatcaatcagactgctctccaaaatgcccaaacccatctggagtcaatccctcttccccacccatgccaatcactgatctgctttctgtccctagtcttgccatctctggaatatcatataaatagaaccatacagtatgtacctttggattctggcttctttagcttagcacagtccacgtgacattaatcaatactgctgcatgtatcagtagtctgttccctgttaagtagtaccccactgcatggatgtatcaaatgtttatccattcactagctagaagatatctgggttgtttccaggtttcggcaattacaaataaaactacaggttgagtatcccccttatccaaaatgctcaggaccagaaatgttttgaattttggatattttcagattttggaatatttgcatatacataatgacccaagtccaaacataaaattcatttatgtttcatatacaccttaaacacataggctgaaggtaattatagaaaatattttcaattaattttgcacacgaaacaaagctttaactgcatcttggctgggacctatcaccagggcaagtgtggaattttccacttgtggcatcagagagttttggattttagagcattttggatttcagatttttggattagggatgctcattctgtactataaacatttgtgtacaggcatttgtgtgaacataatttcattttatttggatattttaaaacgggattgctaagatatctttttacaaagttgattttactggtattgtttagttgttgttgttgttttgttttgtttttttgagatgcagtcttgctctgtggcccaggctggagtgcagtggtgcaatctgcctcccaggttcacaccattctccttcctcagcctcctcagtagctgggattacgggcgcctgccaccacgcccagctaatttttttgtattttttagtagagatggggtttcaccgtgttagccaggatggtctcgatctcctgacctcgcgatccgcccgcctcagactcccaaagtgctgggattaacaggcgtgagccaccgcgcctgggcttctactggtattgtttttaaggaatcttcagtgtccttgggggagcctgttattagagaaatccttcctttgtaaaataacgtaactgttttttaagtttggattttcacatgtgggatttgcttaaaatgtaaattcacctctatactggtgaaaattcaaattcattttctcatggtcttaactttttaaacattgtatatcctcaacaaattacataagctgtaattcagatgttttactcattattcttcctaatgttagttacagggagatgatgggggaaaaagtggagagggcactaacttaccccttccaattgccattttaggctgcgtgcgttggctcacacttgtaatcccagcactctgggaggccaaggcagaagaattagttgagcccagaaggtggagagcagcctgggcaatgtaaggagactccatctctacagagaatttttttaaaaagtagttgggtgtggtggcgcatgcctgtagtcccagctactccggaggctgaggtgggagggaatgcctgagccagggtagtgaaggctgtagtgtgagccatgtttgtgccactgcactccagcctaggcaacagagcaagatcctgactcaaacaaacaaacaaaaattgtttaaaccccaaatgccattttacgtacctcatctgatttaatcctcacaactaggtgaggtaaatgttatattcattgtactaataagaaaactgaggcccagagaagcaacttatctatagtctagcagttacccagagacatgaccagacaaaagccctggtatgtccatcttaaatacccattcttgtttcactgaaacctaaaacagctcctaaaaatttatggaattttcaggctatgtgtgggtaggaatttcataaaggcttttagaaggctatgatgattcttccatatgctaccatacatgaaaaatcttaagccttttttttgagatggagttttactcttgctgcccaggctggagtgcaatggtgcaatctcagctcactgcaacttctgcctcccgggttcaagtgattctcctgcctcagcctctcgagtagccgggactacaggcgcgtgccaccatgcccagctaattttgtatttttagtagcgacggggtttctccatgttggtcaagctggtctcgaactcctcacctcaggtgatccacccacctctgcctcccaaagtgctgggattccacgcctagccaagccttttattatgagtagtcttacagatacgattacgttatgaacataaaagtgtgttttaaggggtatgtccttatcctaaaccttctaaaagaattgtgtagtaaacctattttggtggcgactattgataaccataagcaactctaaaataagccaggaaatctgattatttggcttaattccacatacaaaaggcacacaatttcagcaggttgctatagaagccatgtgcagtattttcagggttgactatcactgacattggtgggatacaatttttttgaattttatccaaaattcaaacactccaactttgaaacactccaactctatcggaagttttttctatttacacactgacctagaagtcaggaatttgtacgattcttccactatccaaattacagccccagactggaaacaaagtaatatattactataggttctatgtctagggaaggacatgttaaactttgctcatcccccttatttcccatctcatcctctctcacccattaaagaactttagttaatatcacagttaacattaacacaattagggaagtttaaaatgtcaagtaattacgtgtcctaattgtgttaatgccctggggtgaaggtctctcaacctgtaccatattgtatcctagtaaatgagggtaagaaccagccagatggactaccattgcaactcctgtagctaaggtggcagctactaaattaacaagcacatgcaggcccaaagttcacagtcagtactctcagtaactggggttgaagggtttcttatcaagaagtctgatagagcacctgctttagaaagcaagctacacgtggaaaaaagaatgtaggctgccttatcaaaaagaagataactcaaggactaaaataaatttggttttagtggaatcgtaagcctgtcatttgtctgcgtggattgtttacatgttttttaaaatgtttaacagcttccctgggcattcaacccactaaacatttcctgaggtgtgctcaatttctctgacaaatgtttataagcatactggccatgaaactgtaccacttcccacgcaaaacaggggacttactttactaatgagagctagctaggagtgacataaaaattctttttagtataagaagaaatgatgattaacccagttatggaaaatgatacttcaccatggaacagactgttcattaacaaagagtacttaactaagccgtaagagcctttggatccacagatatacatccaaaagtcatcgttccccaagactaattaatcacaaacagctggggctgggtgtggtggctcatgtctgtattcccagcactttgggaggccaaggtgggcagatcacttgagcccaggagttcaagaccagcctgggcaacatggagaaacacagtctccacaaaaaaatacaaaaattagccaggtgtggtggcacgtacctgaggtcctagctccttagaaggctgaggcgaaaggactgcttgagcctgggaggcagaggttgcctcctacactgcactccagactgggtggcagtgagaccttgtcaaaaaaaaaaaaaaaatcataaacacctgggaaagcttctaaaaataaaacttcctagagaggaagctaaaatgaaccctgtggtgctggactggaattggaggtctcggtatgaacccatggttttaaagtacatacacaggtaactagatgcacaagcactgatgtgtttatacctgagctagaaaacacactcaaatatcctaactctctgttaagaggacctagaatcaaggatactctcaaaacaatgtgcatatctatggctcagatcttgctttctgaatatcattctccaataaaaggaaccagggttccttggaaaagtggttgattcattccatggctgtgggcaggaaaatacaagataatgctggagcatctcgtggagtcagagactgggaaatgctcaaaatcaaaagagcaaacgtatgtcagagaaaaaacaggagtatactcccaagagctaaacacaggacaatctgagcaacaaaacaggattactagattacaattagctgaataaaatattcttgagtcctcactgatagaataaattaatatataagtgagaaatgacagctcttacagatgaattataattaatgaagaaaaaatgaagaaactagaaactcactattggaatatatcacagtattatttatggaaggcaagatccatcaatggatgttaaaaacagaagacaaagtttgaggagaggccgggctcggtggtttacacctgtaatcccagcactttgggaggccaaggaaggtggatcacctgaggtcaagagttcaagaccagcctgatcaacatgatgaaaccatctctactaaaaacacaaaaagaagccgggagtggtggcacctgtagtcccagctactcaggaggctgaggcaggagaactgcttgaagtcaggaggcggaggctgaagtgagccaagactgcgccactgcactccagcctgggcgacagagcaagactctgtcttttaaaaaataaaaaataaaaaaaaaagttgaaggagaaacaagataaacaagatgtctggatattctcaaagtattttccccaagatacacattcattacaaaaggaaaaaattttaactctatagtagagaaacctggaagacaccaccataatcaagtgatcgggaaaacttaagacacactgacctcagggactcctggtatgactcactgaaaaggacttttgaggtattttgaccaaaaacacacaacctcaatctaattatgagacaacatcagacaaaccgaagtagagacaaattcaacaaaatatctgaccagtgctcatcaaaacatcaaggtcatgagaagcaaagactaaagaactgtcacgattggaagagactaaggagacaggacaattcaaggtaaggttgggctctggaacagaaaaaggacattagtaagaagaatctgaataaagtctgtagtttcattttcaaaacaaaacaaaacagttattcttggcctccactactgccttcaattctgcttcagtctgtctgggaaatctgtattttcttttgaaagctccacagggattcactcagtgatgagtcagatgtgggcatcatcgtccttggggctcacttctcacccccggtgcacgttgcagtcactgaggtgcttggggaatcctcatgatcaggccaccccatctgcagattctactgcaagtacttttgaaagcctccaaatgatcccagaatgtagcacatctcaagctgtgcctcaggaccacaggtaggtggaatgactcccaaaccctcttgttttcttgacagtgaacagagctgaagaagggtggtgtagtagttcctgttcctttcctgcctcacttcctggcctcaagtgatctacctgcctgggcctcccaaagtgcaggattacaggtgtgagccaccatgcccaactgagatttttatttagatcctttcagagttgtgtccatctcctctaggccaggccagcagcctcactttttgggacacctaaaggcacagtgatgtaactaaggtgtgttttcccaatgcacgaagactacacctggatcacatctacaaaacagggctcaccaggcactctaacgcactgagtatgctgagtatgtaatcaggaccaagtatccaggcaaactcaacatggtagcattcatacagccatttgctggatatctgcccagctgtgttattcataaacccagagcagcaaaaaattccgacatattagtggaggcaaacaaaaaaaaattgatttacatgcatctactggactcagttgtagtacaataaatatttgctaaatgaagacaattttgtttcctctacattaataggcttagctatgcaatatacagtgtgtgtggaggcagtctgtgtgcatgtatgttttaattgtaaactacttctaaatccttccttactgaaaacagatgggggcacaaatataaaaatgaataataaataattttcaaatagccgaaacatattcatgtccacagtcccaaaactactcccccccaaattcctgagttcatctgtggcgagcatgctttgaaaacaaagactttcagagaatttactcccccaaactgcctaaccagtaatcttgtatggtccctcaatatatcctcttagcaggcctcagagttttcatttcagtgcacactgtcacttggctagtgagcctaccaaagcacacctgtaggtttactagaatcctcttcctccaatgcagctacttctgctgcgcttaaggaaccatcacccattcacagctcagtggcaagagcacaaacactcctaaaacttaggggagttaggagggaggaaaggtatcattttcaagcccaaagttactagctatggagagtgggagctaaaacatggcttgaaaatggaactcagaaaatgtttgtctcaaaaattttagcgaaacttggcccttatccagaaagaaagaggaaattcttgcattagcccttcttcccccttgttctaggactcagaactctggttgagttctctggctaattatgagacaggcatagcaacattatttctatgaggaaataaaattccactcaattaaataattacttttttgaacactggccatgctagactggaggaacacagttagttttagacttgttcacctccagttgttctaggaatctgggcagcaatcagtaatgacaacgtgttatggttccccaccaccaacctcagccccaccccaaatcctgggtggactaaggtttcctaacttagcatgatgcacgctgcctcgtatcatgtgccccacctacagggtgacttgccacctctgaccactgtttgtgttattaaatctggttgagctttttggcatcaaccagaggtgcccatgtcctttgataaatagctcacagagatgagaattgagggacactgccctcagggcttcctggagtcccctgaagctggtgaggatgtgaagactcaagatcaagtctcgcttccgctggagaagaggtctgggctctgtgccgggggttctctctaacaagaatggtcaggtgacctctagagtccccccccagctctaaactgcagaaaagctccaattctataagcatttctgaggattacaagtttggctaagaactcctgtagtatattctgccctaaatggggtgaaaatatggccagtagattattctgggacttcaggttatttgaatataaaataatttagctttttccttagcaaataaaggtattgtcttcacttgtttcaaaaaatatgaaaacatggtctttgaaatttcccaatttctaacaaagcacagaaatcttctcatggttttccaaatcatgatatgatacatttatattcccaaatcacaaaaccatgaggaaagactctttcaaaactgaaactgtcaccttacaaaaggggtgcccagaaaggatgtgatttgtaaggagtgttcaggtcacagaaggcctggaccctgaaaaccagggttctccctctaaccacacacacccaggttataaagtcaaactcctatataatcattacaggctactaagcagatatcagatccttatcccaaacgttagcattaagaaaactcatgcttctcatgggacagggaggtgactcattagacttcaatgttctaacggcaacataaaatgggaccgttaataaaatgcagcctaagcaaacacctcttgacctctttctggaaaacaccagcagacacaagtcttaagaacttcctgtgagggagagtttatgtgtgttagtgctacttaatatatgaatgtttaaagtatttcgtaaaaagtcagcaaggttctctattctcccttctgacctttacaacaaatgtgagtgagccaatatgtgtatacattctataatattacaatgttgatttcaaaagcaaactgcctcccccgtggtagcacctgactcttccattcatattcaaaccacgtctttccattagttcctgagaactctgagtaagtacactttcactaacagatccaaaagcaaaaagcagagtgtgataacatttttaaagataataaacatttgtataaccttaaaactaaaatcaagttatgagccacagattttagaaactaatttttgtctcactgattttatgcttgttttcataaaaatatccatccttaattttaaaaaataaccttgaaaatagtgtttccttcctattatttttaaaggaaagcttccacaggtagagttacactgtcctcaagtcacttgattttgtttctttaatgcagatttctgggacttacactaagcttacataacttgttctaagttatattttgtaacaagagagaaaactctggattaaagaagttcatacaatttatattttccccacatacttcaagcttacaaaaattcttgtttatgatcacagaagaaagcaactgcagccactctcatatatccaaatacaacgtcagcttcaaaatattagtttaccattccaaaaattatgactaggccaacaaaaactgtaacacttttatatgatttttactactacacttaaatgcaaagagaatgtgaaaccaaatatattatttttgaaacataatttttaaaaattctcagtttaaaacagcaacttcatttttttcctaggaaaaaaaagtcttttgttaaataacaacgaatagagatagcagaaagatggcatagtaaatgcaggagggcaggtagccaaagatttctgttcaacataacacttagaagttaataaaattcactacaacattacattttcctaagaaagggcattagtctttttcttttggtggatgccatccccttgtctctcagtagtgtccagattgagcaagcagcgaagggagcagggacattgggagatgtaactcaccaagataccaggaggggacttgtcatggtaaacatcttgagttttacttaatgagcctttacaaaccacctcatcttccttgtcatcttctaagtaaaacatcttgaaatttaactagcatgtcttttttcagagatgaaggtatataatccaaacagaaagctgctctcttgacaaactgagtacaaactgcttgcagacacagttatatggctaaaactgaaaggaaatggttcttaaaaaaaaaaaaagcaatgcatacacaagtttaccaatgagatttgctcaaaatacctcaaccccttctccccaaaggagataagcaggggcatgggacaggttgtgccatgtgtttacactgataggcaccaagacctgcccaatcacatgatggccactgcagcttccatcacacaggacagggattgagttaatgattctctaaaccaatcacatcctcattttttagaaataaaaacagctactacacatatggagagtgatcttacataagctaatcatgtaagggaagtaatttacagacattttccgagcagcagggagcttcccaaagtcagccagattacatgcctccaagagcccaactactgaacacttttcctttgtcagactggtgtgacccaaggtattttcacaattctgggagatatcctgctcagtactgtatataacaagcagaatttattaatttcaagaatatgataatgcaacactgtaaaattaaaacattcctggtatttccttggcagctctcagtaagtcaaaacatagtaattttaactgaatttttctaaaaaccgcaaacacacaactcacatggacaaacatattagatttctgaattaagatacactgtttttttcataccattgtctaggattgtgctgttcatcacaaacagccattagccacgtgtggctactgagcaatggcaatcaggccagtaccaactgcaatgtgctccaagtgtaaaatacacactggatttccatgactaagaatgaaaagagaataaaaaaactcataatttctaatatatactacatgtttaaaggatattttggatatactgagttaaataagaaattacatttacttttacctagttttttttttcccactttttaaaatgtgattactagaaaatttgaaattacacatgtggctcacattatatttctattggacaatgctgctctaaggccccgagacaatcttgagaacaaggtggggaaaaggccattcaggcaagttataggtaaggaagaactgaggacaactggattgttcatcattcctttaaagtatttagttaattcatcaacaatatactagctgatccacatccatttaaccttcacattaaacccttttctctgcatctaaacttcacaaaagacaaaattttcaaatgtttgaccaagtaataggtgtctggtgatgcttaatacagtaacatatcaccaaggttcatataataaaaacattaagtggcagaattaaaaaccaatttcaccaaaattagaaatggcaaaacttatcttgcatgcagcatgttttcctgcttgccttctagcccagcatagtatcgtggacctgcagtacaccaaagtgcccagtcacttgcgatctaattcaacacacatcatgtacacaaactcctacttccagaagagaattgtttaggtttttctggcctaaattttatgcaatgaataaaaatttaaatctcttcatccatgatctactgcagttcaggatccttggcatcagatggtagtgataaaaaccggatattggggtgctgccggtggagaaaaatggaagaagccagaggtcagcaagaaggggaggctagtaggagaaagagagattaaagagaaacctaagaaggtgaaaaaaagaaaagttagaggggcagaggaaataaaatgtagaagagatgagaaaatattcaactggatagcaggagaaggggaaaactgtaaggagggtggaaagaagaaagacaaaaaccatatccactttaaatgtgaggaaactgaggcccagaaagaggtcaggcaattagcccaatgtcactcaactggtcagcaaaggtgccagggagaagaagccccccagtttctggttcagtgcttttttgtgttatgccaagcagagaccaagaaagaacatgctggggatcagcaggaggaggctgacaagaggtaggagcaaaggcttagcaagtgaggcgtggtggagatccagcagggcagaggtcagcgggtagaattctgttcagcaactcttgcctacaatgcagcttacacaacaggtggggcacccaagccagtcatttgggggtttcctgatagtgtttgtattgtttccttgttttagctgatgactcccagaatgtcctgactgcaaggaacatgtactatggacccatcagaagtgagctcattttctaaacatctgtgttgccaacaggcacacacctaaagtttcctcctatggccacctgtggatcaccctgaccttcaaagctggtagccaaagttctgcttccacccccaccatctgcaaggtggcacttttcagtcttgatggataaatgttaaaaatcacaaccaacaattcttaatcatccctatgattttcaaaggaaaacgctactgtattgtcaaactttttctctacaggctaaaataaaaataaatgactactgaaaaaagctactttttacttttgtataacatcttcaatgatcttttttttaaaaagtgcatagaatttggaagtctttttcccaagacttaactctttcaaaaaaaaatagtctaacttagggaaacaaagctaaaatgctagttaggaaaaacagaatcctgttcagattccacagctttaatgatgctaagtaaaatatataccttctttgtttttgttttttctactactaatcccataagtatgtaagactaggtatacagggctttttaagagggtataacgatttatttaaaactttctagctagaatttgcttatctgaagctgtactaagctggttcaacagaaatacctttacaccacaagcatgttattttaccataaaacatgaaaataattgtactcccccccagtggccatactatggaaacacaacaccttgctcctggattaccaatgaagatgtgacaaaactaagttttgattattaaaaaatcatgaaaatattttataacctcaattacaaagaatttcataatacccaccggaattcctctatagtgaagaacctaagtgcatttctgcattttcaagactcctcatgacaaagggaacatgtaaaggaccatggctcacctgaaacaaatgttttcatttagagccaaatggctctcaccatctacaccaaagcatatgaagtgtttcttctcctaaatggaatcacttataattcactgtttatgaaaacaaccccaaagggactgacgttttattcaaaaccaagataaaattcctcttgctaccactcttgggtttttcaaacatttgtagtttaactgctcattgggtaatggttatatagtttactcaagttccagtgtttcataatatcctcatataatctcaaaattctaaacaagatagctagtggctggcaatttcactgaactgtgagtgaataaccaaatgcaaacagatctttccaggaacagaagagaaaaaacaagggagggtctcctgaggtcagacgcccagcttaaagtgactctcccaaagataaacttctttgaagacttgtcatttatctttaaaattcacacattttgtagtctattgtgataagtctatttttttaatgtaaaaaaaaaaaaaaaagaaagactaactggccaaagctttcttcttccaagttcaaaggttaatgcaacacatttactgtaagaattagaggatgctcagtgtacacatcgcagtttaaggagcttaggaccaaacaacctctgcggtctaacccttccaacacaaatgtttgaggtcaagcttttacccactatttggagacaagagagacaatactgagagttgcctggctgtagcagtcaagtgcatctgaacattaagagagtaaagctgaacagcctaatttaggatcagagtaattatggcctgacttgtgtcacaacttttggacaacattttcaacaaaataaagccaaaagaaatggaaaaccctctgttctgctcaggcaggactcctgaggcctcagttgcttgacaggggtggaggtcgggggtgaagagggggcctgttaattgcctaattgtttctgtttaaatgtctttttcttctcccatttcacctctgaatagcagtttgcacagtgatgacacccttaggtatacgattttctgttctggggttatatcacccccatttcattcaaactcaaaaaatcctgttgaaatgcaagtcttactatcatcaaattttaaaacactaaataattttcaaagtgtagtgctttaatcttttcagaaacaaattacttgttatagactcacaataacaggggtggctcagtgcatcacaacactgaggccaagtgaaggtgctggaagaagccagtgctgggttcctatactccagatcaaaaagtgagatagcttaaagcttgtcccccaaaaacagcaacaaacaacaaataaggtgagcaagagttgattatatcattaagacaatccaaagaaaatataagtgaaaattatcacaaaatgtatcggcatcatgtaggaacccctcatcctcacattccttgacttatttttttccacgtggacatttcaggtccatctttgactccaattttctcttccatagctggttcctcacaacagttctaattcaagattttctcgaccacctgaaaaactggtgatggttgtttaaattattctgttgctgtgatctctttcaattacttaaaaattttttatttaaaagatatttgtaatcagctttacttagtaaattactcttagtaattactcttcttcctgccaccttcttccatctatagaaacgaacggctgctgtaattttaagtgtacttagaatccaggagggtggatcacttgaggtcaggagttcaagaccagcctggccaacacagtgaaacctcatctctactaaaaatacaagaattagctgagtgtggtggctcacgcctgtaatcccagctactcaggaggctgaggcggaggttgcagtgagccaagatcataccactgttctccagcctgggcgacagagtgagagactgtctcaaaaaaaaaaaaaaaaaaaaaaaaaagaatcatcatgagtgctgccagcaggccagatgggtaacagtataaattacttatctgtagccttaaatgggtccccaacagaatctggcaaccctcctttgtttctgtggtcagctctctctccaaatttctggttctttttcaaacttccatgctcctcaacctgactatattctgccactctatttccccatcagaatgtacaacattccatattcttgaatgcaggctcatttatgctcttcaggagaaacggcaaaaatgactaatatactttgctatgagaataaagaatttagtttcacaatgtttagaaattctaatgctatacttaagtgttatgaagaattttatttaattggtgaaatttaaattaaaatgaaagtaactgaattcttaaattattacactcagtgaatctgcctacttcaatctaaagcttgactgagatgtgtaagaaaaagagaaaacctgaaacactgatactcagctttatatgtaagttatattctacacatacagatgaatccaattccagatggtgacggtaattgcaatctccagtgagggtaaagcctcaatgcactaagtagtaaaagaaaaggggaaaagttagtcagctttgctactctttcaagttaaatgctggtaatgtctaagatttaaccttgtaatgtcaagacacagataggattcaaaaagcaaagaggcatctgaaagttgcaacatgagaagaaatgctccctcttctaaggataaagcaccattgaaacagaacaagtgtgacatttcattttatttttcttccagactcaacatactttaatataaaaaagctctctcaggaacagggcatttagtttgtgtaaaaatcttcagcctttgcaacaaattaattgtattcaatttgaaaaagtatacttcaagtacaacataggtatttatattgaaatcatagaagaaaacacaatcctggcagccaagcactatttatttagtatttactctaagccataccctggaattaatcctttgcatatattatctctgatctacacaattctcatgaaagacagatttgctttatccctatattttacagatgaagaaatggaggtttagagagaggttatgttaaatatccaaggacaaaccagctagagctcaagatgtcttccacagtaccttcttagactcattatttaagctgaaattcagatttactatgctaagtatttctaaaatctcaaacattatgcaatgcatctaaaagaaaaaaaatgcctaggaataaatttaaccaaggaggtgaaagcttgtacaaataaaattgcaaaaatcactgaaaaaaaaaattaaagataacctcagtaaatagaaagacatccgtgttcgtgaataggaagactcaatattgttaagatgccaatattacctaaagcgatcttcaaattcaaggcaatccctatcaaaattccaaaagcctcaaattcatatggagttacaaggggccctgactagccaaaataatactgaaaaagagctaagttggaagacttccatttcttgatttcaaaactttcaaagttacagtaatcaggctgggtgcagtagctgacgcctgtaatcccatcactttgggaggccaatgcgggcagaacacttgaggtcaggagttcgagaccagcttggccaacacagtgaaaccccgcctctacaaaaaatacagaaattaggcaggtgtgtggcaggctcctgtggtcccagccactcgggaggctgaggcaggagaatcacttgaacccaggaggtggaagctgcagtgagctgagattgcaccactgcactccagcctgggtgacagagtgagactctgtctcaaaaaaaaaaaaaaaaattacagtaatcaaaacattgtagtactggcataaaacagacatacagaccaatggaatagacttgagagtccagaaataaacccaaacatttatggccaattgatatttgacaagagtaccaaatccactgcatggcggaaggaatagtctcaacggatggtgctgacacaactaagtttctatatgcaaaagaatgaagttggaaccctactttacaccatattaaaaaattaactcaaaatggattaatgacctaaaaccataaaactcttagaagaaaacatagggtaaatcttcatgatcttggatttggcaaatgattctcagatataacaccaaaagcatgagtaacaaaaactagataaattggatttcactaaaagtacttttttttgtatcaaaggacatgatcaagaaaaagaatcatacagaatgtaagaaaatatttgcaaattggggagtttaactctagaatatatttaaaaattcctacaacaactaaaagacaaatgattcaattaaaatatgggcaaaggatctagataaacccttcttcaaagaagatatacaaaatggcaaataaatacttgaaaagatgctcaacatcattaaccatccgggaaaggcaaatcaaaaccacaatgagataccaattcatacccactacgatggctatagtttctgttaaaaaggaagagagtggccaatggccgtgactactgcaacacacacctcatccatgactctccatttatgagaaagacatattgcagtggtaggaaacagagacagaatgtcaaagattactattagaaatggatggaagaacaggctcagagcctgactgacaaaataagggttgcacttcaacaaggaaagatacttcctacttcaatctctgttccccgccggcagggacaatgatactacctccctccagtcttctgggtcctcctcatcctggtatgatgccagcaccccacacggggccctcctcctgggatgatgccagtgggacctgctcctggaatgaggctgcccatgggaggccacatgccaatgatgcctgggcccccaatgatgagacctcttgcttgtcccatgatggtgcccacttggcccagaatgactcgagcagacagaaaggatagaggggaggcctccctatatcagttttatattgcttgctctgcttcaccaggagatcacaatgctgtgactctgggtgttttcttatcagtctgatacagaaaaggtgctcccccttcctattaaagaaagaatcattttggagtggagaagtgggacaaaaaaagtgcagtttttatctatattgtgaaatatgaaaataaaattgtcaactttttttaaaaaaggaaaatatatgttagaaagaaaactggagaaactgaaacacttgtgcactgttggtgagaatgtcaaatggtgtaaccactgtagaaaacaagtttggtcgtttctcaaaagctaaatatggaattaccaggctcggcacagtggctcacactggggcggactaaggtgggaggatcatgtgagcccaggagttagagaccagtgtaggcaacatagtgagaccctgtttctacaaaacataaacaaaatgagccaggtgtggtgttgtacacctataatcacagctcctgagaaggctgaggtgggaggactgcttgagcctaagaggtcgaggctgcagtgagccgagaccatgtcactacactccaacctgagcaccagaatgagggcctgtctcaaaaaataataataataaggccgggcacagtggctcacgcctataatctcagcactttgggagggggaggtgggtggatcatgaggtcaggaattcaagatcagcctggccaagatggcgaaaccccatctctactaaaaatacaaaaattagctgggcgtggtggcgtgcacctgtaatcccagctacttgggaggctgaggtagagaactgccgaacacaggaggcagaggttgcagtgagctgagatagcgccactgcactctagcctgggcgacagagtgagactccatctcaaaaaaaaaaaaaagtataatacaataaaaaataaatatagaattgccatataatccagcaatttcactcccaggtacatacacaaaagaactgaaaacagacatttgtataccagtgttcacggcagcattattcacaacagccaaaatgtggaaacaacacaactgtccatcaacagatggagaaacaaaatgtgttatattcatacaatggaatatcattcagtcatgaaaacaagtgaagttctgatacatgccacaacatggacgaaccctgaaaacatgctaaaggaaataagcctgacacaaaaggacaaatgtcatatgattccaattatgtgaaatatctagaataggcaaattcataaataaaaggtagattagaggttaccaggtggaggaaatggagagttattgcttaatggttacagagtttagagtcatgaaaaattttggaaatagcagtgatggttgtacaacatagtaaatggtagttaataccatgaaatcatacattcaaaaatggttgaatcttactacaattagaaaattatgcaatggggccaggcacagtggctcacacctgtaatcccaacactttgggaggccaaggtgggcagatcttgagttccaggagttcaagaccagcctgggcaatacagtagtgagatctcatctctataaaaaatctttaggccgggtgcggtggctcatgcctgtaatcccagcactttgggaggtcgaggcgggcagatcatgaggtcaggagatggagaccgtcctggctaacacagtgaaaccatgtctctactaaaaatacaaaaaaaaattagccaggcctggtggcgggcgcctgtagtcccagctactcgggaggctgaggcaggagaatggcgtgaacctggaaggcggagcttgcagtgagctgagatagcaccactgcactccagccagtgagacccgtctcaaaaaaaaaaaaaaaaaaaaatttaaatattagccaggtgtggtggtgtacatctgtagtactcagaggctgaggtgggaggatggcttgagctcaggagcttgagtgtgcagtaagccatgattgcaccactgcgctccagcctgggaaacagagcgagaccctgacggaggaagaaaaaagaaagaagaaaggaagaaggaaaaaagaagaaaggagaaaggaacaaagaagaaagaagaagaaagaagaaagaaaaaaggtaggagaagaaaaataggaattaaaattatgcaataaaactctaattgaaatgtaaagcaatgtcaatacagtccatagtttaaaatgagaatatatttgttcttggctataaatatcatcttctattcctatactgttacaaacttcctaggttatttgaacaactcactgaatatcattaaccctcaatttcctcacccaaaaagtgaatttctagataatttctatgtatccttctaggtaaaacaatctgacatttcgaaaactatggctttctgagcattcaactctactaagtagaaagcaaagtatttcccacaacttagtttttaccacgagcttggtgattccacagcaataacttcaacaaaaagttaacgtgtaactttcattttatgtatacctacacacaacagagagcttcttccttcagtcaaaaattacactggaccacaacaaatccacttctgatctcaacacaaattcctaatcttagcttctaaacatctagaagtaaccctagagaatatatatagcccatgagtagtttgtgccattctcatttctgagaacccaactaagctttgcaatataccctctttacagaaaacatgcaaaccagcagcatacatgtataccgacacaaccatacacagatttgtgctctgaggatccgatggaacccctctatggttagtctgcagaccccaagtaaaaaacctctggttctaaaccacactgctatttgaaagatgagagcatacaggtattgaaaaagtcaattacttcccagccaaagtagttaaaacatgctcaatctagccttacaccacacagtaacagcccttaaaatgaagcagtacagactgtacataaatgtacgcctatcattcaagaacttgcccagtgcctgtaatatctcaggtaccaatactgcctttagtcctgggtcctgcactttagaaggctctgtgtatcataaacccaaaatacaaaggcagtaagtgtttttcttcttcatttcagacctctaggaaagttttttgaagacaatttagctaaaggaacaggtggttatcacaagccaagctgccccagacctgtgccctggtcagtgtagatgtgtgcagcagacctatggtcaggctccctagggcagctggcaaaggacaaggcttctgcagggccactggtggccatggaggccgggccatgggggtggtgactggatttatagctttaaaaaaattttttaatgatatatcatagttggggaggacatataataatattttatacatgtatacaatgtgtaatgctcaaatcagggtaaatgggatatccatcccctcgaacatttatcttttctttggatttacagcttttaatagtttagatacaggttttctcagcctattgacatttttggtcagataattctttgcttgggaggtgaggagtgtagcagccctggcctccaaccaccagatgccagtagcaccctccccagtggtgacagccaaaaaaatgtctccggttatttctgaatgtccccggcggcgggtgggggcggtgtgtgggcaaaattgtctgcagctgagaaccactggtttaaacagatggtatatggccctgtattgataagcctgttctgactgggtccccacaaacatgttaggggtgggccggcaagcacatgacttggctgaatttagacagggagttttataccacagctctcccacttgatacagacctccaggatggaaccttcttcagtttcaggtcaacctaagcttcacaggcccccttcatatagcagggttcagagcacctgtcaggtaggactgctgtgaggatcccatgaggtggtgcctggaaaccaccagctgcttaataaatgctagttttcttttttcttctcattaaaaaagaactatgaactgaatagttccaagacctatgccacagtaagtgcttagcagatgactgttaggataggattctagccatcaaggagctatttaataatgagggacactggaaaggaaaacaaatgactttctaaatctaaatgcttcaatcatcagctctttgcatgttttaacttcccaaaccatttccctatgccttaagactcatccaactgaaccccactcttcagcctatttgtccccagtgtcttctcttcttccaagttttggtgtaaaactgtttagtcacatctacactctagtatgaatattgtcttttaaatcaatcacctctgaaggctacaataaattaattccactgatacaccactgtgtaacatgacatgagggctcccctttcttcctgaaagaactatctttaaatttaatttaggtgccacacaggataaaaatgagtgtcaataccacatagtcacagaactcttatactccaaaagtaaatatgattcatctgacatgcgtggttcatcagatgttgctttgaatggcttctggctatttccaaaaacctaatctaccttgaagggtaaagattttccaccgctggggataaaaggatacactgtgagactctgaaagcaatttaaaaaggaaggggtgtttcaaaatgttttccagaatgacagcatagatgaaatgtatatgctgtccctaaagtgcaaagtacatttcattgtgtaagtttctggtcatattccttcacagtcacattttttaagcagggtaccaagcttccttattacatgtgtataacggaggacaaaactgaagaattagaggtaattagctctatggacaaacttaagacttattaataaaatgttacggccgggcgctgtggctcacacctataatcccagcattttgggaggccgaggcgggcggatcatgaggtcaggagattgagaccatcgtggtcaacacagtgaaaccccatctctactaacaatacaaaaaattagctgagcgtggtggtgcatgcctgtaatcccagctactcgggaggctgaggcaggagaatagcttgaacccgggagtgggaggttgcagtgagccgagatcgcaccactgcagtccagcctggtgacagtgcaagacttcatcccaaaaataaaagtgttacattggttcttttataatgtccatcaattacatcatccaacctctccatttcaacaggcatggtgacgttgcagaaaagatatgactacatgcttacctcccaggaaaatatcttttttttttttttttttttttttttttgagacagagtctctctctgtcacccaggctggagtgcagtggcgccatctcagctcactgcaagctccggctcccaggttcatgccattctcctgcctcagcctcccgagtagctgggactacaggtgcccaccatcacgcctggctaattttttgtatttttagtagagacggggtttcaccgtgttagccaggatggtctcgatctcctgacgtcatgatccacccacctcggccttccaaagtgctgggattacaggcgtgagccaccacgctcgaccaatatctttatctatctattgagtatcatatatatcccagaataacagacccacatcccaccatctccaaataaagcatcatttggttctacaaaggccttgccaatggcaccaagtttgctatatttgctaatggtaaacttctgcataagaggtgccagaatcaacacatcataaatatgtacatttcatttttggaggcttgtatttttctttttcttttgagacagagtctcactccctcacccaggctggagtgcggtggcgtgatctcggctcattgcaacctccacctcccggattcaagcaattctcctgcttcagcctcccgagtagctaggattacaggtacccacccccacgcctggctaatttttgtatttttagtagaaacggggttttgccatgttggctaggctggtctcaaactcctgacctcaggtgatccgccggccttggtgtcccaaagtactgggattacaggcttgagccactgtgcctggactcatttttgttttttgtttttttttagtagagatggggttttactctgttggccaggctggtcttgaactcctgacctcatgtgatccaccctcctcagcctcccaaagtgctgggattacaagcatgagccactgcacctggcagaggcttgtatttttctaaacataacaaattcaaaggaacattaatgaagtcaaagctatagcagtcactttcaagacatcatcagagtaccaggccactatgcctataactctgcagtgtgccacaatgaaaccaagacagtgccccaattctgatcaaaaggtgacttctgctgcataaacaattcacaaaccttacatatggcatcaatcattgtttaatgactcctgtggggggagagcaggctcttccataattactaaaagcagtataactcaaaaagaaacaaaaagtcaccaattcatcagcttacttagctgatgtcacagaagtagcaggaggattccttaccccccatgccacagacttagtttttcaaacatctccaatttcttgcttttagctctcaaggatgcagtcccccagcttcccagagggaagtctgctagatcggtaagcatgaattcactacttccctactgtttcctttggaagtgcctgaagtgtctccttgtctcagttaaacagaacatggtgaccgtgaggcagagtttccagtgccaggcagctccaggcaccctgtgcctgtgttctgcagaggagtctttcccaatgtcaatcaaaacacagctcaagtttcatgccctgctttattaaattctgcatggtgcccactgggaccacaatggaatcttcagaaacgtaaggagaggtacctccctttcctggctctgggaggacacttgggtaaagggaaaggctgtggccataccaacagcactgctgcaatcaatgccaccaatcactcagatttaggctatttttaagtagttttgcaaaacaaatgccaagtaaggctgcaccagtgtgttatcacaagctgacttgcatactaagctacttcaacaagagagaaggacttccaagagcaacagcaagtcagcgaaacagcacttgaaagtcagaaaacaaggcctctttcactcactgatctgctcaacagcagtgtctattctattctgagagctggggatcaagcagtgaacttggctgacaaggtacctgcccttgtagtggttatattctaatgtggggagggagaaaacaacaacaacaacatatgttaggctgggacaactattataaaggaaataaaagagggtgctgctccctgaagagagggaggaagagcaggaagagccacttttaaggaaagaaaagcgttgtagagcccagaacaggaaaatacatgacagatttttttttaagcaacaaagctccaagaaggctcatatctgaaaaaagaaatagagtataacatggagggacagagcatgatgagaacctggctaacatgttcacgaaactatgccaggatatagatacggtttactttctcataagacactactgctgttctttctttagtcattttgccaaccttcaaatgactttagaaacaaaccaagagtgaaaatgagacaactcagatactgtcattaaacattcaggaacatgcagaaattttggcagtcacaagtctgaacaaaaatctccagttgtaatctaaaaattacttcctaagagtttctttctgatcattagtgaagataggtgtaactaaaagcatctttaaaaatattgctctaactagacatcctgttaaacccagaggatgtcacatgtgttatccccactctcaaaacccactgtttgggttgaagtatatcctccaaaaaagaaacgctgaactcctaacctctggtagctcagaatgtgaccttatttggaaaggggatctttacagaggtattcaagttaaaacgaggtcattaaggctggccctaatccagtaggactgatgtccttataaaaagaggaaatctggtccaggcgccgtggcccacgcctgtaatcccagcactctgggaggccaaagcgggcggatcacgaggtcaggagatcgagaccattctggctaacatggtgaaaccccgtctctactaaaaatacaaaaaaaaaaaaaaattagccgggcgcggttgcaggcgcctgtagtcccagctactcaggaggctgaggcaggagaatggcatggcccgggaggcggagcttgcagtgagccaagatcacgccactgcactccagcctgggtgacagagagaaactccgtctcaaaaagaaaaaaaaaaaagaggaaatctggacagagagacagacatgcacacagaagaacgccatgtgaatataaaggcagagattggggtgatgcatctgcaagccaaggaacgccaaaggctgccagcaacccaccagcagctaggagaggacgctaataaaaataaacatccaagaatgagaaagcgctcttggaaattaacacacaattgtaaaattaagacattctatagaagggttggagaataaataccagcctgggaaacacagcaagaccctgtctctacaaaaattaaaaaatagccaggcacggtgggtctcacctgtaatcccagcacttcaggaggctgaggtgggaggatcacttaaggctggaagttcaagaccaacttgggcaacattagtgagaccctatctctgttttgtttttttttttcttttaaaaagaagaagaggaggaggaggaggaagaggagaaggaggaagaggggaaagaggggaaggaggggaagaaggaggaggaggaggaggaggagaaggagaaaatgtagaaagcagatctcccagtaaatccaacaaggataaaggaatgggcaaaaggaggaaaaagatgaatatcagagcatcaatccaaaatggccccaatatctgacttgtagactttttaaagtacagaaacaggagaggaaaaaaaggtagggaaaggcaggagttggatattatcaaataaatcatacaagaaatttcctggcgtcagaaacatgattttccaaattgaaagttcccaccaggtgcccagctcaaaggataaagaaacacctgcactgttgtgggctccacctatggcagtcacgacagaaacatgctaataatagacaacgttaaaggctacacaaaggattccaaaatcaccatatgggcacgactacacaaagcaggatacacaccatgccctccatcagatgtacggcacgtagtgccagctacttccccaacatcatgagtgtacacagctacagatgattctacctgtggggagaggcctcaccaggattgataaatacccactacagtctctgggtgtttttatgccctctggcctgcggagactctggtgacatagggcctgctagccaggtctaagtaacgaaacaaggccaggggtaaggattcactgtgaagccaggtaaggtgggtacttcccgtgttccctcctaagagactgtgtctcgtccaaaaactgagatggcaaatcccaaaccaaggtgcttcatcaagagatggtaatgagatactttaaaaagaaacaaagaaaggtgctaaaaaaaatgggtaggggggaaaggataggaaaatggggaaaaagaggggggagagggagggagagagagagaaattaaaaagacttgagacttctcaaaaaaaggtaacttctcaaaagtaacaattctaaaggaaaactatttccattctagcattctatagctagcctatcagttgggtaggaggctcaaataaagacattttcagacacgtaagctctcaaagaatttcctccctgtaaaccctttctcaaaaagctgctagaggatgtgctccatcaaaatgaggaggcatgccaagagagaagacaatgtgtaatccaggactcagaatccaacacagaaaattactgggattcaggatgagtgaggtgttgactgcagagttctgtagtcctatcagaaactgggggcctgaatttgtgactggtactaagaaatgtaaaccaataaaataattgttgactccagagaaaagaaaaatttgaactggcaaagaaataaaaatcactgcatatgctcagctgtaagcaatatttagccatgaaaatataaacaatgaatattaagaaaattagaaaatggtattgagagcttagtataaagaattgtgcgtgtgagaggagggttatataagagatgaaccttcatcttgcagcgtaggaaatcaatagagaaggtctaaaatgaaaaaaacaagctacagtagtgtatgcatacaagcatggaatcaaatcccacaagcacagaaaagaaatgaaaggggcttttgctagggagcagtaatcagctgtgagaaagagaactggggtttttcataataaacctcacagtactatgtacttaaatgtttaaattacatataaaaataaatacttaagattttaaaagataaatagaactattatgtgatatagcctaatgaataagaatcacatttacagaaatgaaaactacttaagggaaggaaaataggaacaccaagcaaatataagcattgtaaggctttttttgttttgcttttaattaggaaaagttcctttccaactctcaggatcagcacctatggtccatctgacctgtaggtatgtctcattagtaagacaaaacaaacaaaccaggaaatttaaatacaacaaagttatctagttaattcacttgggacagggagatgtcctaaaacaaaagtcctatttcttgactgtcatgaagataccacacttacagggggaaggtccatttccatttgatgacaaggatagcactgaaagattcagccagcatttaaaaggatgaccttcaaaagaccaaaaaaaaaaaaaaaaaaaaaacccaccataacaacataggtataccagtacctacgtttttcaactggcagagaataacatttcatgtagttttataagctaagaaaattagtgtccattctaatgaaaatcaattattcaagcttatagaaaaacattagaggccttatgaactaatcagcagatttttaaattttagtcaaacgctcacctgcaatacactaggtatagacaactgtgctttctagacgtcccattctaaacacaaagataaggtccctcctacaggcccacacattaacaaaattcatgcagccatagatgaaatgatggaaaaatcttaaggattacatttataaacacatgttgtgcataacatttgtatacaagatttctaactttggcactatgagaataaagaaatttctttctgggtcaagaaagaaattctaagcaaacacattaaacaatgtttttctttgagataaaaacaagcttttaactaaacagtaaattctcacattaaaaatataagcccagagctaactccaagacagttcctcagactttcccacaatcgctcaagcagtactcccttctaagtccctccctgtccctgattcataaaaccctgctttacgcagaagcagacctacttgattcctctatgacactatcagctacttcgggacaagaggaatgttcattcattcacctttcgccctttgtcctatgactctctcaacactggcttctctggcctagtaagacctagaggtggatgcgggctccagtttaacatatgacctcatttaatcctcagaaccagcctgtcaagtaggtattgttatctccctattacaaaagagacaactgagtaaatgatacatcaaaagtatattcatgaatttgggaattcccaaaggtctatgagtatatttctatttaatgaaaggttcttcatcagagctgatgtatcattcatttattcaattacactaagtaaagcaccactaaaactccattagcggggagctcatctgcagatgtagttaccaagtgagtcaaatgatacagtgaagaaagcactagttcaaaagacagatctgctcaaaaagaattcagatactcacttgtattaggggtttccactggctaccaacaatgtgatgggacctggatttctgaactgttgcaggaagtcagggaccctaaacagagggaccagcaggagccgaggcagaagaacataaattgtgaagatttcatggacatttatcagttcccaaaattaatacctttataacttcttaagcctgtctttactgcagtctctgaacataaattgtgaagatttcatggacttttgtcacttccctaataatcatcttataatttcttatgtctgtttttactttaatctcttaatcacgttatcttcataagctgagaatgtacgtcacctcaggaccactactgtacaaactgattgtaaaacgtgtgtttgaacaatatgaaatcactgtaccctgaaaagaacagaataacagcaattttcagggaacaatggaagataaccataaggtctgactgcctgcggggtcgggcagaatacagccatatttttcttcttgcagagagcctataaatgaacgtgtaagtaggagagatatcgctgaattcttttcccagcaaggaatattaataattgataccgtgtggaaggaatgcattcctggggggaggtctattaacggccgctctgggattgtcttatgcagttgagataaggactgaaatacgccctggtctcctacagtaccctcaggcttactaggattgggaaattccagcctggtaaattctagtcagactggttctctgctcttgaaccctgtttcctgttaagatgtttatcaagacaatatgtgcacagcaggacatagaccctcatcagtaattctaattttgcctttgccttgtgatcttattgccctttgaagcatgggatccttgtgacctactccctgttcatacaccccctccccttttaaaatccctaataaaaacttgctggtttggggctcggggtcatcattacggtcctaccaatatgtgatgtcacccccagaggcccagctgtgaaattcctctctttgtactctgtctatttctcagaccggccaacacttagggaaaacagaaagaacctatattaaaatattgggggctggttcccccgatactgaacagaataaaagactggaagctctattcagctctgaaactgtttaacttaaggatccttctactcacagtccagtgccatgtaacccaggagtcacagtgtacacttactcaaatcaggaaccgtcaaaattacgagggaaaatccttgaagaaggcaccatgttggatactgacataccacgtctcacatagtcccactgagcccatttcctcctccccaacacctttagtcaccttcctatcaggatgagcccgagagcaatatttaggttgttttagggatcatgttgtatgagaaatacagcttagacattccatccagtctcagcccagcgatatgctcatgctgtgaaacacaggccaaagaacatcaggtttaccttgtccaactcattccaaagtgcaccaagtaggcatggtagggccacatcacctccccatcttcccggctggtatttctctccttgacacaattgcctttgaaaacataaataacccagagaaacccacactcctataaagtaggtgctatctctctgttaccaatttatagatgctgacatctataaagaaaagcttcagccaggtgcggtggctcatacttgtaatcccagcactttgggaggccaaggtcggtggatcacttgaggtcaggagtttgagaccagcctggccaacatggtgaaaccctgtctctactaaaaatacaaaaattagcagcgtttggtggcaggtgcctgtaatcccagctactagggaagccaaggcaggagaatcgtttaaacccaggaggtagaggctgcagcgagccaagatcgtgcatcactgcactcctgcctgggtgacagagcaagactccgtctcaaaaaaaaaaaagaaaaagaaaaagaaaagaaaagtgtctcggcagggcacagtggctcatgcctgtaaccccctcagcactttgggaggctgaggtgggaggatcgcttgagcccagaagtttcagatcttcctcagctgatatagcaagacccttatgtctattaaaaccaaaattaaccggggatggtggcacatgcctgtggtcccagctactcaggaggcacaggcaagaggattgcttgatcccagcaggtccaggctgcagtgagctgaaatcgtgccactgtactccagcctggacaacagagcaagacactatcttacacacacacacacacacacacacacacacagcttatccagttctacctaataaacgtaacaacaacggccaggtgtggtggcccaactcagcaatcccagcactttgggaggtagaaacgggaagactgcttgggcccagaagtttgagaccaacctgggcaacacagcaagacctcatcgctataaataacaatgaacaacaataatcataatgaagtaaaaacaaaacgctaaaattgacttagggatgataaagcaatgcacaggaactgtcagagtccttgggcagtggggcagcataggaacaaggcaatgtggggaggcaggtcatcgctaccacatggctgtggcctctggcaaatctctttcagcttcagggttctcacctagaaaacagcattattatctgtactttgtacagtggttgtgacttaagagagatactttacgtaaaaaacttagcaaaatgcctaaagaagttgttcaataagataactgtaataatgataatcttttacaaatattaaacacctcctcgaaatacctagtgttcctaagtagaaggcatcagcaccactttacaacagactaagaatgtcagtggatagactagatattaaagaccccaaaatgccaaatttctatatttcaaataatgctacctaggtaagttatttttaacagctaagccagttagaaaatcctgcaacagaagatcagtcctttcttacaaagcatttgttgaccgggcacagtggctcacacctgtaatcccaggacagctggcagatcacttgagcccaggagttcgagaccagcctgggcaacatagtgaagcctggtctctacaaaaaaatacaaaaattagccaagcatgggccgggcgcagcggctcaagcctgtaatcccaacactttgggaggccgaggcagggaggtcacaagatcaggagatcgagaccaccctggctaacacggtgaaaccccgtctctactaaaaatacaaaaaattagccaggcgtggtggcgggagcctgtagtcccagctactcaggaggctgaggcaggagaatggcatgaacccgggaggcggagcttgcagtgagcagagatcgcgccgctgcactccagcctgggcgacagaacgagactctgtctcaaaaaaaaaaaaaagtagccaagcatggtggcgcaggcctgtagtcccagctactggggaggctgaggtaggaggattgcttgggctggggaggtcaaggctgcagtgagctgagatagccccactgcactccagcctcagtgacaaagtgagaccttgtctctttaaaaaaaaaaaaacagcatttgtttaacattttaaataacaaaaacaaagctttatctctctctcaagtagtatttctctaaataactcttattctcgaatagttcatatgtaaattgacattacagctatgtcaaataggtacctattatatttagttagttatttatttttatttatcttttttgagatggagtcttgctctgtcgcccagggctgtagtgcagtggtgctatcttggctcactgcaagctccgcctcccaggttcatgccattcccctgcctcagcctccagagtagctgggactacaggtgccccccaccacgtctggctaattttttgtatttttagtagagacggggtttcactgtgttagccaggatggtctcgatctcctgacctcgtgatccgcccgcctgggcctcccaaagtgctgggattacaggcgtaagccaccacacctatccaggtacctattattaattttaaaaaatactgttaaaagagtttaaagaaatgtaatatgtggacagacgtctctcagtgtttacaaagaaaaaaataacacagcctcctaaaacaaacaaaagatatattatatcccctataatgcttcaactaagcccaaacattccttaacttatgttggctcataagaaaagcacattgttttacaaacaccacaagtttatagactcaactgtgaggaaaaatatccataacaattcaagcagctccaaatcagagcttctaattcatattaacgatctgatggttttgctggcacataccggagggcaattcaaaacatataatcaaatgatcagatgaccttatattgaataaattatttccaaatactttttaagagctgtttgcattctggacacctccctttccgaataagtttaaagccatgtctccagtgcagctgaacatacctatcttgccaggaaccataaatgtcatatcataatgcactgaatagatgaggacgatcttggtcagcatacaattctactgtttagtcaggggtatataaaacgtcttctaggcaaactgcaatcccatactaaccaatgaactttttgtttataattatgattccttttataaaaagagaccatcttattttaaatttaaaaacggatgcttaggctgggcacagtggctcacacctgtaatcccaacactttcggaggccaaggtgggtggatcacttgagtccaggagttcgagaccagcctgggcaacatgatgataccttgtcctacagaaaagtacaaaaattagctgggcacggtggcacctccctgtggtcccagctactcgggagtccgaggtgggaggatcgcttgagccctagaagcggaggctgcagtgagccgagattgcaccactgcactccagcctgggtgaccaagtgagaccttgtctcaaataaaatagaagtttaaatcaatattctaaggtcatttatccctttcattttatttcagaaataggtaaatgcagaaattcaatctgtcactaacaaagttactttgtaccatatattttttgcggagtaaaattaccagttccaactttaaagtttccgaaggatgctttccccatctttagctcctcccttcatctaatacagcttagtcataaccaccaaagccaaataatttttaaacctagatccttccttccttccctccttcccacttactcatgtatttatttattcagactcagggttctactgtgtcatccagcagtggcgtgaacatggctcactgcagcctcaactccttggctgaagccatcctctgaccttagcctcctgagcagctgggatcacacaggtgcccgcactaccacagctgtgtttttttttttttttttttggagagacagggtcttgccatgttgtccaggctggtctcaaactccagggctcaggcctcatacccactttaaaatcaacacatctgtccgggtgcggtggctcacgcctgtaatcccagcactttaggaggcgaaagcaggaggctcacttgaccccaggagtctgagaccagcctgcgcaacacagggagacttctctctttcaaaagaattgtttcggccaggcgcggtggctcacgtctgtaatcccagcactttgggaggccaaggcaggaggatcacgaggtcaggagatcaacactattctggctaacacagtgaaaccctgtctctcctaaaaatacaaaaaattagccaggtgtggtggcacgtgcctgtagtcccagctactcaggaggctgaggcaggagaattgcttgaacctgggaggcggaggttgcagtcagccgagatcatgacactgcactccagcctgggttacaaacaaaaaaacactagtaaaattctaaattcaaagattataaaaataagtaccattttttgtttgtttgttttttgagacagagtctcgctctgtcacccaggctggagtgcagtgacacaatctcggctcactgcaacttctgcctcccaggttcaaatgattctcctgcctcagcctccagagtagctgggtctacaggcatgcataaccacacctggctaattcttttgtatttttagtagagacagggtttcaccacgttggccaggctggtctcgaattcctgacctcaggtgatccgcccgcctcggcctcccaaagtgctgggattacaggcgtgaaccaccgcacccagccttcttcctcatttcttgttaacaattttaacataaactgacaaacctgatcaccgaaatacaacattcaaaggctttagcagaaaaagactgaattgcagtcagtgaatcaaattagtaaaaatgtttactttatcatcattttaatcctgaaagtgacattaagagttttatcttgtattaaaacacagtttacctcccaacagatttttttttcttctccttcctttctgactgagaagttgagcagagacagatgcccaaccccagcttccaccagcttcctgctgaaaatcaagagcaaggcagcccaccaagtggccccggcaggattctggccattccccactacacatgggttgccactgactgcttcatttggaccccagggtgagcaactccctcacgcttgtcttgaaacacacatgtaataagcgtttagtgttagtaatagtgtgttactaaaatgaagattcaagctgacagcaggggaggtggattccaaaaatcacagttaattaccaaagccgctaagccaagttattcaaatgtcttattaccaaggtatagccataaaacttactgctccaggctataataccttcaaactcttcaagttttaaagacacattatacataggattctgccaactggaggctatctaccaacttgtgagttgtttcatcatgaaggaggcaaatggtaggtcacgagactctgggtctcattgagaagtataaaaacttaccaagcagtgaagggtattggagagagaaaaacaggattttaaaatgaagattccaaaccactgcctaccaatctggcacggcaagtcgggcaaatacacactcaacgacagtcactggggtcggagtaaaaagaaatggatttaaattaaagatggaaagacttaaatcagacttaaagaaaagcctcttgatgtaaattgctaagcacctacgggagataaccaaatctacctgttaccactaatctatcaactaacaagacaaagcctccagctaggcgttactgtgctgatatatattaggaaataagtacccaaggcatagaaaaatcgctgacacagagaaccaagccataatgtaatattaataaaagtaaacatttgaccctttaccacctctaacacgtggcaccaccaggaatattcatccatgcctcaccattcagggaaggtaagtgagctcactcaggaagtgccaccgtcttccaggtcactggtaaggacaaactgcctgctgcgtctaccttcattcaacagacctcgaccgaatcgcatcccaaagccggctatgtgcttggaacttactgagcagctatggagtttggctttcaggaactctgggtccagtccttaaaaccaaaagtgcaatacagggcgatgagaacttctattgctacattctcctagcaataaagaagacaaagccccagctgactctattatttgcttcttaacagtgctttactatagtattaaagggttttcaaacacttcatttccagcttctcttaagcataatgcgtgcctattgactctcgactgtgccatcaaacgttaaaacagaacctgtcgtttcatttctagctttctatggctacctctatcaaaagttgggcatggagataccttaagtctggctggggcggttgctcacgcctgtaatcccagctctttgggaggccgaggggggcggatcacctgaggtcggcagttcgagaccagcctggccaacatggtgaaacccccggtctctaataaaaatacaaaaattagctgagtgtggtggctcatgcctgtaatcccagctactcgggaggctggggcacaagaatcgctttaacagaggaggcagagattgcagtgatcggagatcgcgcaactacactccagcctgggcgacagagtgagactctgtctcgaaataaaagagatacttcagtctgacataccacaatcaactacaatgtaattggagggaagagccgatgttggacggctatcacacgtggcttcacactgttctttttcttctctggctgggtacggcctgaggatgactgccctccaacaactgaggatgctgcaggaggaccagcccagcacctgtctccatcccctgcactgtgtggccggctctgccgcttctcccccgcttcagcatcacctgccacttcttctc

SEQ ID NO: 2564 - DNA, 144274 bp, Homo sapiens
  source 1..144274: mol_type = genomic DNA
gcgctggctgcgggcggtgagctgagctcgcccccggggagctgtggccggcgcccctgccggttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcctggaggatctgctggtgttcacgtactccgagcgcggtaatcacttgaaaataaactgtgcttttatttttgcaaactttctccccctccttacatttgcaaattttgtcctcctccccttgaccctgctcaaacccggactcttaaggagccgcaaactcccatatcctttccttagggcagaaagcagctgagaatttcaggaaggtcttcacctttttgacttttctccccgtttcagactaaaaaggagagggggtgctgtggattgtgactttgcttcttttccccacccacttgttttccagcctccaagttatttcaaggcaaaaatatccatgtgcctctgttgatcgtcttggactcctatatgagagtcgcgagtgtgcagcaggtaaaggcattgttttcacttcaactcattctcccttctgtttggaaggagacgttttactggcaatgttaatatagccgagagttcttggttattcccaaaatttggcttgaggaacctctgactgtgattttaagatgggaatattgttaaatcattacgcaatgtaaacgggatgaagagccccagtatgtgttccctgagtgtctttaagaagtaactttataaaaccaacagtatggatggtggtagaaggaggataaaaatgggttcggttttagtctcgttattggcaagatgaattcattagtgtttagacttgactattccaagtatcttcccaatacagagcatgtcctagatgagaagattatgaatagtttggaaaaggggaataattaatagtgataaaatgcaactttgtcactagcaaactcttgtagagttcagcactttttaaaattcaaagatttctagcctttagttgtagtataccttgtagtatctaaagaaagtgatgtcttatgagaccctcatagtttgcaactgttgtcatataaaatgcatgtagaagtgaaacttttacaatctgtaccataggaaacccagaaatttgctatgtatcttggatttttttttaaagggggccttaaaaatggtaattaagaatgatttacagtcaaaacaaaattataggccaaggtgataacttccttcggagcacttagagatttggggaactgaaatcagttttgtcatctgcatgttaactcatgcagagaaagagaattggactttgaactccttggaggtgcagtcagaaagccaatgtttcttaatggttgagaggcttgacagacatgaggcatctcaatctttaaagtggtgtgggtctatctttatcttgatgtttatctctgtatctagctgtatctagtctgggtgaaccatctagcttctttgatatgaggacatttacatctggaagaaatattttaatttgttttcaactgtgaaatattttccatctgactattatagattttcacgctgctatcaaaccaaaccaagaaaagatggaggcataataaagatgctgttcttttaagactcaaagtcggaattttgcctgtggaatatgagtcactttttgggcactggcctattgtgcttcctgctctgcacccacgtcatcccttcttacttgtctctgctttggtgttcagaagtgcctgattctggccaccttcattccctagactctgtacttgatagagtcactcctgcttgatactgctcaggacagtcagatcctgggtaggcgttttggtctgcagggtctagataaggcagtgctatacttgacaacccaggggagcctggaacatacttcctaattcttaattttagaaattgcccaagcctgagcatacttgtccggagtagttatgagtgtcacttagtatttctgcctagagagtaccagaggcaaagtatgctggaaaataaggaagagtttttttaaaagtaattaattacttttttggatatatcatagttgtatatattttggggatacatatgctatttgatacatgtatacaatgtgtaatgttcaaatcagggtaactggaatatccgtcacctcgaacatttttctttgtgttggcaacgttgcaatttctttcttctagctattttaaaatatgcaatgaattattaaccataatttccctgctatactattaaatattaacttaattgcttgtatctaattatatttttgtacacattaaccaccttctctttatccctccccatcctttcatttccagtctctggtaaccaccattctactctcttcctccatgagatccaccttttccgctcctacatatgagtgagattatgcaatattttatttctgtacctggcttatttaatttaacctaatgacctccagtcccacccatgctgttgcaaatgacaggatttcattttttatgactgaataatattccattgtgtatgtataccacattttcttttatttttagttaagtaattaatttagagacagggtctcactctgttgcccagactggagagcagtggtgtgatcaaagctcactgcaggcctgcaatcctgggctgaagtagtcctcctgcctcagcctcccaggtagctaggactataagcatgtgccaccatgctcagctaatttttttttctttttttactttttgtagagatggagtcttgctatgttgcccaggttagtttcaaactcctgacctcaagtaatcctcctgcctcggcctccatattttctttgttaatctgttgatagacatataaggtgattctgtattttaactattgtgaacagggctgcaataaacatgggagttcagatatatctttgatatactgatgttctttttttggatatatacccagcgatgagattactggatcatatgaaaattctctttttagttttttaagatacctccatactgtgtttcatcatggctgtgctactttatattcccatcagcagtgtaccaccattcccctttttctgcatccttaccagcatttgttattttttgtctttttgataatagccattctgcctgtggtgagataatatctcattatggttttgatttgcctctccctaatgattagtgaagtttaggatttttttttcatgtacctgttagccatttgtctgtcttcttttgagaaatgtctatttggatcttttgtccatttaaaaataagacttttttttttttttttttttttgctaattgagtttttttagttccttatgtattctggttgttaatcttttgttgaatggatattttgcaaatattttctccctttctttatgttgtctcttcactttgttaattattttctttgttgtgcagaagctttttagcttgatataatcccatttgcctatttttgttgtaattgcctgtgcttttgaggtcctaccccaaaaatcattgcacagaccaatgtcctgtagcatttccccagtgttttcttctagtagttgcatattttcaggtctgagatgtaagtctttaatccattttgaaatgatttgtgtatatggtgaaagctgtggatctagtttccttcttttgcacagccaatatttgattctcactgaaatctcactgccctcctggaaatattaccggatgttttactgtcatagcgaagtgagagtaagctgctcactgaggatcaaagagcttgtgacagacctaagactcaagtcttctcacaccttcaaaatctctttccatcatacaatctactagctgctgaattcgcaagctttttgtgcaagctagtaaaaagcaaaatggtttgatacaaatactgtggccatgctaggtacaatgacatcaatttaaattatcattggtcttaacaaggggatgtagaaaggggtctcctactgacattttaatactcacttaaaagtagtatttttccttcagatttctttatattattagtataattactgtaagtatcctttactgctttatatgttgaattagctggaagtgccaaaagaaaaactcttaatgataaatttaaggtattaaggtaaatttctccttcatttaatttaatagtaattcttaattactatttaaaataaagattaaggtttgtttctagatgccatttaacatgatattccagactgccagttttattttcaaagtttgtttcatattttattaatgtttcttcataaatgacagtctttagaaaattgacggttaagctaggtgctttatatttttcttttcctgcctatcttttcactgtgctcctaaattttacatctctttattctcaagggttcaacctttgaagaaggggagcaaaataaatgaaagtggctaaaattttttctttaacccctagactctttcctgttgtgcattaattacatgcttgagtttttagaataattataataaagtaaaactaccaatttaattgtattgtaactgtgcaagatgggaaccttctctcttagagagataagcttttaattgaatagattaatggatcaattgttacctctgctttgctgccagagattctatttaatcacagaagttccatgtagtgctggagagctcagttgcctgaatctttttgcaaagcgtttactgatactgttgcttcaccaaccaaaacaaacaggttttttccttgagtcagctttgtaggtacagagatgagtttggcatcctatgtgacttttttttttttttttttttttttttttaccaccagaagctgttcagaatgttattttcttaaatagttcggaaaaaagtcttgatgtattctatgaaagcacaaaaatagtcagtttctatgacagctggattgtcaacgtctgttcagcttacgtggaggaggatgtcctacttgagtagtataggtagaaatagctatcagaaattgccgcctttgaaagcaatttgaaattatgtaaaaggaagtaatgacaaaataaagcaatttatgtttaatctggaaaagatccaaaagtaatattgtaaagagatcttgagtaatcatttttatcttcctaaaatagccgttgtttactcccgtaagcgagtaagaaacttgtgccattattccttattgggtgcatatagatttctcaccttgtcattcaactccttgcaatattcaactttacttatgcatccagccttatcccaaaatagcctcttccctgtagcagcttccttatcatgtagcagcctactctcctcaccgctcatccgttcttatacaatctggcttaagctctacctcttcatattatattcttctctgagtaatttcaactcacactgagtcttactttcagtatttctattatattggtatttattacacatcacacttagatacttttccattagtctctagagggtacatatatgcactttctctttttttttttttttttgaccatgtcaagtatagttctatagtataatagaatgaattggagatcctttacatttagagagggaggagtctacagtaggaagaataggttaattttcatctccggtttgaaatcaggactttcaatttttttttcagaggtaaagagcaacttagtcaagttggcatcttgtaaacagactgagtgaagatatacttaaaatgcatctataatttcatattttatttcgaaatgtgaaagagcctactaggggtgtctgtgatctctagaccttatcaattcattctagagaaatctggagggagccattgaggagttctacctcctgtctattttatagagctctttctctttttctcctatcagatgtagattcaattgctaaaaatgccacgtttcttgcctctattattctagcttcattacttggggagcagccattctgataacttacattttgctactaaaatctccaacttcacctaatccttcattataagccacttcattttttcctataattaaaattttaaatatgtggaggaaattctgtcaggtagatatgacttaaaacctactaagggccaggtgcagaggctcacgcctgtaatcccagcactttgagaggccaagtcaggaggattgcttgagcccaggagcttgagaccagcctgggcaacagagcgagacccctgtcttcacaaaaaaaaaaaaaaaaaaattagctgggtgtggtggcacatacctgtagtcccagctacttgggaggctgaagtgggtggatcacctaaggacaggagttctaggctgcagtgatctatgattgcaccattgcactccagcctgggtgacagagtgagaccctatctcaaaaacaaaaacaaaaccaaaaaaaaaaaaaaaacaagaaaaaaaaagtactaaggatctggtatagccattcttgcacttaataatcttggtacaacctctaaaactattttttatagtttattttattttgccttatttagacaattggcatgtctatgttcttcataatttagaaattatatgtatttatatatataaattatatatattatatattatgtataaattaaattatatatatatataatatatatatatttgaaatggattcttgctctgtcatccaggctagagtgcagtggcacaatcttggctcactgcaccctctgcctcctgggttcaagcgattctccttcctcagcctcccgagtagctgagattacaggcgcccatcaccatgcctggctaatttttgtatttttagtagagactgggtttcaccatcttggccacattggtctcaaactgccggctgaaatgttgtattttttgtatgtctttctggtatgatttttggagaaaggtgtatcctaagaatacggcttgcttttgtttctgggtaagcattttagggtatcattttgttgtataaccattgtttacaagtgagataagcatctattccactaagattgaagagattcatgtttgactgagtatgctctattaacattctttaaaacatgtgaatatatgtctttcttgttttcaggtgggttggtcacttctgtgcaaattaatagaagtctgtccaggtacaatgcaaagcttaatgggaccccaggatgttggaaatgattgggaagtccttggtgttcaccagtaagtatgatagatatgtaaaacaaatggccttgagtatttatttgtacacatgacaaccttcccttgatacactgtgtttgcaatccaaggctactcctgtggaattctttaaaatacagatatttttccttgagtcaatgatttacatttatagagagctttaaactcagaagtttgatttagaaagcaaacatttaaggtaacatgtcagaagttattattttaataatataatcatataattataaaactggttaagttgtagatttttgatgagtacttttgaattcaaaccatgaagagattttggcttttaataatagaatcgatacaaaccactagttcttaaaaaaatgggaactgagaaaagttagttctgtaagtagtaatttgaaagttgatgttctactgtctttaaatagtacatttatatatatattcctatatatacagtaagtttaaactatggctttcagaaagagttaagaaagaggaaattaactttcagcacatctgtagccaaatcttgatagtaattttaccagctatgtttttgcagtttgcagcataatggcttcttagatgagactacttccttagccatcattaattaagaaaatattttctcaagaagaatgtgtttccaggaaaatacattttggatagctttgtttcttgacagttaaaaaatatcttctaagctactgaggaggctgaggaaggagaatcacttgaacctgggaggcggaggttgcagtgagcggaggttgcagtgagccgagattgcaccactgcactccagcctgggtgacagagcgacactctgtctcaaaaacaaacaaacaaacaaaccttttgtcattaactttaaatcttttttatacctaatatgacttttctttatcacagaaaaggaaattgtgaatattttttggcttccaatggtatatggtttatgaaaatttaatttatgaaaaattttcaggtgtttgtattgctgatcagtgtcaagtagtgctataaatttagacaaattagagctatgtgtttgtccataagtgaacatgtctgtgcttatacattttcccctctttgacaaatgtgttgctcttcttgttttcagtacataaagggtgtgttttggaaagagcatatttacaattaattggagttctcgtcttcaatctaatctctgtaattctatgtatcagttctaaagtatacagcatttgatgaggaattactcaaaatataccagtaattaggaattgtaactttaaatgtcccttggtttgggtgataatttccaggaagtccaaagatgagccagtctataacctcagggagtgtttgggaaactcatctagtcatattcctgtacaaaccaactgttcaaattaaattacataaaagtttatgtaggaaatttcattcactcactcacttactcattcactcactttgttcatccagtcattcatcttctattcattgaatgtttttgaagcctgtcctctgggtcagaaaccatgcagttgtgaagaagatagacacactgctgtctccagtggagtgtattagatcactcccagcaaaaattgattgtaaaacagatttctcttttttcaaggccttttccctccaaagacttaccagtactgaagaaaaatttcttccgtggtaataaagtcaggaattgtgggaatggtatagggagaggtaggggcagggtgattaggaggaaggctggcagagaatcgaagactggcttcattcaggtcctccaattgccaaatggagattatgcaacgtttcttgaatacatacaaaactctagatgtggccagctcagtcttcttccaataatgtaaagccaaacaatgctttgcaggaatagactagagattatattttgggattaataacatagggattaaaatcttatcttgaactaactaaacattattgatatgctaaattcactttttttttttttttttttttttttttttagacagagtctttctctgttgccaggctggcgtgcagtggcgtgatctcggctcactgtaacctctgtgtcccgggttcaagtgattctcctgcctcagcctctcgagtagctgggactgcaggagtacgccaccacgcccagctaatttttgtatttttagtagagacagggtttcatcatgttggccaggatggtcttgatctattgacctcatgatccccccgcctcggcgtcccaaagtgctgagattacaggcgtgagcaacggccaccggcccactactttttaatatatcattaatttctcttttaaaaacagtagcaatcaataatttaaatattcaaatgaattcttaatttatatacacaaactaacatctttattatatctctatattttaatatatcaacatgtctaagataatttataaatttacatcatatataaaaatgggtttgctctcgatgtatataaggcttcatgatattttgaatatggagttgggtgaaaatagtgaatctgaatatttgaatttgaatatttattggaaaataagtagtgcttttaactttttaaatgagacacataatagtcccctgttgatttttttttatttttttaactttattaaagtatagttgacaattaaaaattgtttatatttaaggtatacaattgatgatttgacatgtgtacattgtgaattattcaccacaatcaagctaattaacattccctgttagtttttataagcctggttcaggtttgtagaaagaaacaaacacacatggccaggcacggtggctcacacctataatcccagactttgggaggccaaggcaggaggatcacttgaacccagaagtttagaccagcctaggcaaaatagcaaaccctgtctctccaaaaaagaatgaaaaaattagcctggtgtggtggcatgtacctgtatccctagcaactcaggaggctgaggcaggaggattgctcacttgagcccaggagtttgaggtttcagtgagctatgattgcaccattgcattccagcctgggtgacacagcaagaccctgtctctaaaagcaggcaacaaaaacacatgagcttcactacagggaattaaatacaatgagagtaataaaaaataggtgagcaaaaaaaatgcaaataagcaaacttttgagtatgatatttcattcttatcttgatttctgtttttaactccagattgattcttaaaatgctaacagttcataatgccagtgtaaacttgtcagtgattggactgaagaccttagatctcctcctaacttcaggtaatatgtgtatatgttttttgtgttgattcaaattaaaaaaaaagttgataccattaagtaaatgtgtgtgtgtgtgtttttttttttttttttttgaagatcaggattagggtagcttgatttaaatgtcctaaaattgcatctgtttttagacctagtgatgggacagccataatataatctaaatatcagttatttccaaaattctttctgtttccatctcttctccttatctcttttctctatactttgcctctcaaaaatctcattcaatacattggttttaaacattaccttatatattatccccaaatctctgttggtagtccgatgtttgctcccaaaatctggacctacatctcatattcccccaggttagtggtcattcctgcccttgccattattacttctttctccctatatatctttaataaattttctataatatatgttctggagtatgccataatcgttacattttgaaaacacatagtattacttcttgagtatttgctagatgccaggcttcacaagtaaaatgcttcacgtgcttttaaacacctgaatctgaaaacaccccttgagatagggattttatctcagttttctaagtgacaaacactgaagtgcagagaagttgctttggccactaagaggtagaaacagggtctgattctccatgtcaggttccttccctgagaaaactttggcctggtagataatggacctgaaaacaaaaaatcttgaaatgatgcaacagttgtgggcattgctgtgctggacactggctattatataaggttccgagaagaaaggccgctcacagggagctaatcttgaagggctgggaggagtttccttccatgtaggggagggctttttaggttgagagaagtatgggtgcagaggcctgggaggatagcatgagagaggctggacgtgtgattgggaaggtttgaattgtcctcatcagtcctgctaagagatgtaaagaccatgctggagaaagaggaagatgagagtatgagggaaaaacaagaaggtactcaacatttcactacagctttttatgaccatgttgtatggcatgcactaagagtctttaaccatgatttaatttaacctcacccttgggaggtattttttttttgacggagattcattctccatttggcgatggacaggaagatgagggtttattaatatgaaaaatctaccaacactggaatatattgaagttagcctcatacagtactactactcctattccagtattattatttttattgacagaatagatgctgtttgtgttaagttttggattatgataggaaatgtttggtatagtaaaaggcaagagtgtgacatgcagttagtccaagtacgaagagataccaaaaaaaaaatgtttagtgaggagcagagtttagcatatttggagtgaagacaatgtgcggaaggaaaggagctgatgagatacatgtactatagtcggttgtgtgaaaggtcttgtttttcatactaaggatcatgagaagatcttagtagattccagcaagggatttgcaagaccacatttgtgttttagaaatataatgcaggcaataaaccagttggatagaaattggggactgtagagcaattaagcaactgtttttgcattctagatgagaatgcaaaacacaataggaatgaaggtgccttgttcaaaaggagttttgttcaaaaggaatcttcaagatgtgtaggagatattcttaaaggacttggtaatgaattgatttgttgcttggatagagaatgagaagagaaaggagggtggaagaaggaagatgacttaggagtttctcttgggtagctagtggattatggtatcattgatgaagacagggaacaggagtaggccaggtttggggtaactgtggaatattcagatgttgtctaagaggcataagaatgtatttcagatgtttggggcaagttgtctaggctagaagtactgattgagactcatgaaattatagtaaagtgaactgggagtttatctcatttataaagatctagagcttgataagtctaacatctagggcagttaagtagtttatcaacaaacaaacaaacaaacaaacaagaaaaccatgggtctacaaaccattcacagtcttcatgtaaaaattaattcatgtaaaaattaacacattaaatgttaaagcagctctttactcagagcatattattctctttaaaataggtaaaatcaccttgctgatattggatgaagaaagtgatattttcatgttaatttttgatgccatgcactcatttccagccaatgatgaagtccagaaacttggatgcaaagctttacatgtgctgtttgagagaggtattttaaaatgtcaaattccttaaagtatatataagaaaaaaaggcttatactgggaaaagtagaacacagttataataagaagaaggtttctaaaatcctactatttattaagaagtgggagttgtctgtcaagggtgaggaatggggttaattcagaagtattgcttgttttggtggggtgaatttcattcgtgggttataaatcatgcccctggagtagactttcttcaattgcttaacaaggcataaggtttactttgaaaactggatgtgtgggtgctatgaaagaaaaaataaaactgtgaagccaagcataggttacactgggattatgatgttgagtcatcaccagaaatcatagaaattgcataaagagcctgaaggtttacaaagtgtccttcaggaaaaagactaatatgcatttcatagcctggccctgagattgataactgagattattatgtaattttagagttggttggagtccttgtttagtctttccattgaccttaggaggaagtgggtcacagcagtgaagtgagcatcctgcctgaggacacagagcttgtgacagtacagttcaattagcaattattttaagagccccttttgtatcattatgagagccaactgtgctaggggtttagataagaatgatttatgtgggccctgtgtcagttatcagtttaccagtctaatttcttgcagttcccagaatgggatagatcacctgataactgttgaattccctgtctcctcccagaaggattttaaacagcttatagataattataatacacaagagtaaacaaaatggatgagaaaataggtgaagggacaataatataaagctagattaagtttactgtgtttctaaggtcctgcatatttacaaaggggtgggccagaaatttgtctgtttgcttcctatctgacaaagaaaagaggtaaatatcagtggttacaaagttccttaagataaaagtaaacctattattcaggagaagcaattggtctcatgggagatctgagaaacatcttcccatgggttttcctggatgagacaataaaggacatacattttgcaaggaatacaaagtgtattgcagcgagagtgactctgtcaaaagtcagaatagcatgggcctggtacccagctctttgataatcatacaccgtgaagtagaagatagtttacagcgagtacggaattccttcaggctgtcatgtataaatgttctatcttgcaactaagctttcgatgacaattaggataaagtttgaggttctattgtcttgcagggtctgtaatcttctgtgtggaaggttaggggcacattcttcttcctggaaggagggctagcatcactttatcaccatcgttgtttagtccatctaagacactggaggtagaccatagaatgttacaaagaagaatgttgctcaatagaaaaaccatcagtgctgagagggttatgactataaatgtagagtagaaaaatttctgatttttccaggagtatcaggttctccaggactcaggggtgactataaagttaattttcaaaatttgaaagtgtactgtggaaactagaccataaagtgagaaagttccatgatattcttcacttgttaggaaaacttaactgatttcacattatattatagggacactctggcataaaattaaaaaaaatgaatgttgatcacttagagtgctgtgttttctaacatatttctggcgccattctcaagctagataaactataattttatacatgtttttcaggttgttgcccaataacaatgactccaaatggaacttactggcttgatcaaatgactttaattgtgaaaattaatgatttatatttttgctgtctgatggaaaaccactaagacagagtatttcaaagtctgattacttgccatttgctcaagttgacaactcttgaactgaaacatttagccgagctgcccttcagcagcctaccattaatgcctcccttttaaatattgcaatatgtccagttccagttggccatctttattagtcactgtcagttttctctagaatttcccaaatgaaattgtaaataattttgtttttctgagaactgcttgctgactagcacttttacatttcaaaacatggagtacctaacataggccgaaacaaaattatttgaatctccgtagcttgttttctcattataacattcttaggaagggctgcttcacagaaatatattttttatttaaggagattacacttgatgtatctcacacaactataatgaatattgtaatttttgaataattaaactttcatatcatctttaagcttattcagtattttgtctttcatttttaagtctcagaggagcaactgactgaatttgttgagaacaaagattatatgatattgttaagtgcgttaacaaattttaaagatgaagaggaaattgtgcttcatgtgctgcattgtttacattccctagcgattccttgtaagtagcatttaaatgttatttattttttgtatctgaaaaattacaatatatctcattctgagtatattttaacaatatttttattatttagaaacttgtggatgctcaacccattcattcatttattcatttaattaatttacattcactgacattatactgaagttggctgtgggcttggtgctggagaaacaatcgtggaaaatacagatgtgttccttaccttttcagagcttgtagtacaatgggggacacagataagtacagaggtgattacagtggcagaagtgatggcagatggcagaagtacctagagttaggagatcaaataggaagtgaggcagtgtctcttagcaaagatttaataagtggagcttcctgtgcatgaaggtgtgacctgaagtgagaatgcaggcaaagtggcccaggcagtgggcatggttaatgtaaagatgctggagcaagagagagcagactgccttcaagaagacaaaagtagctcagtaaaggtgtggggttatgagtgtgcgtgcatgcatgcgtgtgtgccgctgtgcatgcacatccccaaatatcctatccgtttgtgtttcattgacagaggcaagggagagcttgataagaggcagtaaatgaggccagagacatggagtggagagcatgaagggcctaaaaagccacatgaaggagtttgaattttattgtgactcttgattagcattttaatgaggctttgaaatttagccacatttttcaccaaaaatattaatcagaagaaattaatttgatgtgtatgctaccaatgattgctattaggctaaaataatggttcatattctgttttgttttgtattaatggttcatattctgttttgttttgtaagtgaccattaacactttgtattttatgtattacttgtgtgggtttctacaggatatacatatgcatttatctagtgatattttcatcctcacacatgtgaagttttgaggattagagttaaacaatgtacctggtatgtaataagtgttctaaaatcactgacaggattattagacaatatgtattttatatgtgtgttgtatactatatgtaattgcatttatggtttcagatatggaaatcactgtgtcaatctgaaggtgtgagccttcggtgtaggcagagtaaaacccaatgcccttgtgaaagaatgcttttttttggtgatgtttataaaatcacaatgttttcttatccacaggaaattaaacactggaaagtgggtggggctgaacaataatagagaaaggccatggttttacatttctctgagacatcactgccaacaaactgaatatgtttttcattatactttttccttggctatatttattcatttatttatttattttgggctggaggtttttggaatccattgttttccacccacattggacataactccagtaaaaatgtgttgattcataatgcaaaagtcaagaaagtagcagctaaaaattaagaaatcaaaagtttttaaaacactgattctaactgaaaaacatttgcttttcagtctttaagtctattgttctgagtcaaagcagttcatttccttacgttgttaattttttttctatgtttaagcattgtaatatactttttgtgaaaacagttgattagttttggttgtgccaaaacaaatactaaaatgttttgcaaacagcctttttttaaacaaaaaaagaacagttaacatttgatgcagagatatacatgttttctccatgtaggttcacacctcacttcctttattgattaattgctttttctggtagagtctttctttcctttctgttttacctgtgtttgtccctaagacttatattttaatattatgcctcctctctttcgttctcccatcttttcttccacctattttggagccttcaggaagcttgattttgctgccttgtacattggttgcccttctggaatggaggaaacaggtcatagctgattttaactgttccatctggtgacatattcttgattttctttcttttggttggggaaaaaaaaacaatgcaaaagtcattctccaatggggttgagcctcgttaagaaatagaccctccacaatggttgaactagtttacagtcccaccaacagtgtaaaagtgttcctatttctccacatcaaaaaaaaaaaaaggtaagcaatataacatgagccatatctaataggacttcagaaattatctatcctatagttccaggatgacgatgatgatggttgtgataatgatgaagattgtgatgatagttatatgggagataaaactttaagcactttacatattaaattctataatattcaccacatctattaaaatatgttacattattgtccctattttaccaacaagaaaactgaccaacaagattaaacaacgtgactaagttcacacaacctgtaacagcagaatctatgtcaatcacaacacaattagcagctatttctgtggcaattttcaataaagatgtgtctggaaaaaaaaaaaagaaatagaccctccaatttatttatctgaaaacttatgaccaatacattacatttccagactttcattttcagtacttttcctttcattttcagtactaaaagtactctgaatttttcctttttttgatcttaaggctttaagccaagaaacaggaataaagtaaattttccttaatgccaaagattagtcctacaccccattatgttattaatgaacagcatagtattttttacagctacttaaagaacatgatgtttaaatttggaaatgcagtcattatgctgccatctatttacagtctatataagacgtctttgtatgcatatttgaaaggagaacatggttaccttattgataattatgatctctttaaattcaggcaataatgtggaagtcctcatgagtggcaatgtcaggtgttataatattgtggtggaagctatgaaagcattccctatgagtgaaagaattcaagaagtgagttgctgtttgctccataggcttacattaggtgagtttcttagttaatatgtcatcacacactgtatgatatacatatacatataaaacatatatatgttgcataataatggataagtagcatattgacatactttgaatgaaaatattgtaaaatcccagaaaaaataaattaaaacaaaaagaaaatactgtaaattaccaaactgttctgctgtgcttagatggacttttaaaaggagtgtcaaaaatagatgtgtagaatgtaaaagaagtattatcttaatcttatttttatagatgtagttctatagatgagtttttttattgttgaggctatatttaaaatataattatgtaagaattgatacatacaaaaatatgcataacatatacaatataaagcataatgcaaataactcactatccaacttaaatgttgtatattcccagtgggggaagctaccctgggcttcttcctgcccttgctttctctatagaggttaacactatccagaattttgtgtttacaaatcttttgtttataaatatgatttactacattttcatgtttctctaagcaaaattgttaatgtttgcctgcttttgcttcatcaaaatgtaatcatactgtatgttgtcttctgcaattttcaaatatcagtgctatgattataagaatcagaaatatttttgcatgtggttgcatgtagtattctattatttggaaataccacaatttatttttccatttttctatccatggacatttggattctttcttattttatgctactactatctgtgttaaaacagataactgaaaaagaacagttaacatttggtgcagagatatacatattttctccatatataaataagggttaatattttaaaaaatatttatttgccattggtatgtccttctttgtgaaatatgcaatctgtcatttatcaatattgttcacaggatagtctgtctttttaaaaccgattcatagattctggataataatgttttggtggtaggttatacgtattgaaaataccttcccttgaacatcacactctggggactgttgtggggtggggggaggggggagggatagcattgggagatatacctaatgctagatgacgagttagtgggtgcagcgcaccaacatggcacatgtatacatatgtaactaacctgaacattgtacacatgtaccctaaaacttaaagtataataataattttaaaaaaaaggagatgaagaggtagctgcaggttgactgagcaagggtcattgtctatttgaagtttcaaaggtatctctgaaaataaacacagttttttgcaagagtgaaaaaaaaaaaaaaaagaaaataccttcccttgacttgtagcatgtcttttcaccgtctttatggtggcttttgtgatatagttaaatttaataatcagttcctttgtgatttactcttttttatgtatcttgtttaagaaatcttaatctgtcctttccctaagataataaatatattgtatattttattccaaatcttactcgtttgttaaactgttgcagtttgtttttgtaaagaacccaattccccctctttttttcagtgtggagagctagttaccatcacagcacaatttattagaggttcacctgtttcccagtcatgtggtatataaatatgtaaacatatatgcttatgtttctgtccttggcgttctgttgcattaatctgatttgtctgaatcagatttaaatctgatgttaaatataacactatttaaattaatagttctgtaagtcctgatatctgaaaagctaataggtcaagtcaccatacattcttttttaggcacagcttgccttttttcttgggcctttactattccatgcaaattacaggattaacttgtccagttccttggaaaacactgttgagattttgactggaattgcacaaaatatgtggatcattttaagaagaactgacatctttacattataatttcttctatacatgtcttgcacatcttagtttttgctacgtatcttattttttattattattgtaaatggtatttctttttaaatcatatttttgaactgtgttttcataaagaaatgcaaatgattttttgtatattgaactaacctacctttctaaactcttcgttaattctgacaatttgtttctaaatgcacttaagttctctacctagcaattatataatttgtaaataatgacagtctgagttcttcctttctgcttcttatattctttatttcatttccttgtcttcttacatgagtcagaattattaatatagtgttaaatagagccattgatactagacatccttgtcttgctctttttcctgattttaaacagaatatttttaatattctcccatccaaaataatgcatcttacaagggtttaaacttttaaaaaaaattttgttaagaaattttattttatttcttctttgcttttgttttttcaatgtgggcttttaaatgtttgcttttatttttacaatgtgggcttaaaaatattaaaatatttaattttatcaaatatacttaaaatgtagtaagtcttttttttccttttcattatgttaatatgaagaaatacatctacaggttttctaatactaagctactgtgcacttcctgataaatttaacttggtcatttattagatttttaaaaacacttctaaaaaatcttctctgtttattttcacatataccaggtgagttttggcagcctcttgttttttcttttttaccctttcttttttgttaaaaacatccttttatttatttaatgattaatacatggctattttgtgttttgtatctgataactatatataaagttctggggagtctaaaccaactgcttctaggctgactgcctgtcagttgcggagccttgttttcttgtatggttgtgagtttctcttttattgagcatcctgaggacttaaattaaagatgctctttcagaggtgtttgccaggagtcagagcacaggactgacctgggagcagtttaggatatgatccaggcttaatatgggagactctggttgagaccttaccttgcagagagtctgaaactggtttgttgaatgcagcgccaggattcatgctttcccacaagactactctggcgttcaactcacagctcttgtttcagcttctttttgaactccctctgcccctcaacacacaccttggaaatttccttgatatttttgtgaggacaacaatgcatttaaaagtgagagtggttgctgaataataaggaatgatcgttaactgttggacattgattctgatgacattttctcaaaaggataaccaggaatattttgtacaaaattaggattattataataggcatttagtttttcattgttacaaattttgaggaaaatcattaatcatttgaaaaaactaattgacatgtctccattgtagcaacttgtattttcacttctagtatcatgattatatcccctgtgtaatttggaaattgattttagcattaggaaatttcctagtttcagttaaaatgaattttttgtaagctgaattctattttacatgcacaactttagtttgttatttctttccttgacaagcatttattgaatgttgttatatgactaaaactgtaagatgataatgttttaatattttcacatttctttcatagcttccaaagtgtatatatatactcacatacttcatatatatgaatctacttatatactgtatataaaaatatgtatataaatatatacacattgtatataaatgtgtatatatatttacacatgtatataaatatacatacaaatgtatataaatatacatatttatacacagatgtatataaatatacatatttatacacagatgtatataaatatacatatttatacacagatgtatataaatatacatatttatacacagatgtatataaatatacaaatataaatatatacatttatatataaatatacatatttatacacagatgtatataaatatacaaatataaatatatacatttatatataaatatacatatttatacacagatgtatataaatatacaaatataaatatatacatttatatataaatatatatattttttgatacgtacaactatcttgggagatgggatattgttattatttccacatttacagatgaggtcctgtggttcatcaatctttgtgttttattcaagattatgtaagcagtaagggatgaaatcaggctgagaacccaaatttcttcatccctaaacaaagtatttcttctaaacatggtatccatttactagtttatctctatcaggtgaccctttattcattatttttcatgagaaggttgtagttgtacaaagtggctgatatctgataatgttttaatctaattcaaagtcgatttcttaaatccaggtgtcagagtagcacactactgtacaattctctgtttcatgttttacaatttaccacagtcaagttacaacttgcacatgttacattaaaatgtgaattcaccttaatttcttgaaatgagccagaagaagaagtggttttgttttgtgatcagggaaatgctacttgactgccaaattgtctagaacagcacattaaagttgcttgattttatactgttaaaattaaataaaacatggcaactgtcatgtcatatgtaacttttgtattattctgtaactttttttgaaaataaaaagtgatcaaattgatcttcaggtaaagaatcttttttctcttgattatctcttagtggatgatgatttgttccatttaatgggtagagaatttattgttgctgttattgtttcaaaagtagctgaatgaaactcttaactttttcttcatagttaaaattaaaacctcaagtaaataaatatttaacgttttgccaaactatgtaatctaattatgggcttaatgcatttaaaggctttgtataatttgctacgtattttcacacaagttacctgaacataagtccagtcttcctgctgttttctgagtcacacagtgattcagtgaccgaacagctgttggcagtggtgtgggtataatagggaaaagagactgatggggacaacccaagtttagacaagctggtaaaagtagaagaaaatcttcttgaaaacactagtgatcactaagggctgtggagaatttttgcttggtgggtgaatgtggaagaggcaacagcatgggaaggtgttggtaaaggagctccatacttgcttaaactgccttttgattgtgaggccgttgatgaatatttagtttgggctttaggttttttatgatacaggatattttccatttctggctttgtatctcagagatcacttagttacacttatagatgaataggagtttcaattccttgttttagaaagaagcttggtaactgttagtgagttacaaataagccaaatagaagaaggtacatatttctgcagtatcaggtaaagtttttcctcataaggatttagactcttggatatcatattaattctcagaagagtgggtataaaaaggtatgggacttcttcctggggtgggttggaggtggtgaaatacctttttttttttttttctgagatcatcatagacaagatcaaataatggtaaacatgccaatgaattttctaagcactattcctttaagtgaaagaagagtgtttcagtaaaatgatttaatattgggtcttccaaaagatggatttaagagtttcaactttaaaagacagaaaaattaagttattttacacaatgaatattgtcgtgccgtgtgtcacagacatgacatgagagggaatcagagaacatacagttaatacaacgcaaactagtatcattacttttgctcaatcacttccattgtctaagtaagataattaaaggacagcataaaataaaatttcaaaactttactcaatcatattaagctattttaattaaagtaaatgttttaatgccattgaatattcatcaccattcaaaattattgatgtaaatagtgttatatgttaaaggtaatttaacttccatggatgagaattcagctaatgtttcacttaacttttaggtaattttttcaatatcctggtattaaacgaagtccatgagtttgtggtgaaagctgtgcagcagtacccagagaatgcagcattgcagatctcagcgctcagctgtttggccctcctcagtaagtaacttcactaaaaaggggattcttacagaggcatttgacatcaaatatgaacattgtaacaagagaatcatatgtacagatggaagcattcaatgccttttctgtcctgtgtagctcattttccagtagaggatactttcaaggaaactaacagttgtgacaaatatacacatctcaatgtagagttttgctttacatcattcttgatttagctttgtcattaagcagctaatctgttttaaaaaaatttttatttgtgcctgggcatggtggctcacgcctgtaatctcagaactttgggaggccgaggcgggtggatcacaaggtcaggagttcgagaccagcctggccaacatggtgaaaccccatctctactaaaaatataaaaattagtctggcatggtggcgggcacctataatcccagctgctcgggaggccgaggcaggagtatcgcttggaactggagggtaggagttgaagtgagctgagattgtgccactgcactccagcctgggcaacaagaatgaaactccatctcaaaaaaaataatttatttgtgttttaagttctggtgtacacgtgcaggatgtgcaggtttttcacataggtagacgtgtgccatggtggtttgctatacctattaacccatcacctaggtattaagcccagcatgcattagctatttttcctaatgctctcccttctccagtcccatcccctaacaggccccagtgtgtattgtccctctccctgtgttcatgtgttctcattgttcagctcccatttataagtgagaacacgcagtgtgtggttttctcttcatgtgttagttatctgaggataatggtttccagctccatccgtgtccctgcaaaggacatgagataattcctttttatggctgcatagtattccatggtatatatgtaccacattttctttatctagtctatcattgatgggcatttgggttgattccatgtctttgctcttgtgaatagtgctgtgatgaactaatcttttcaaataatcctcctctcgtctattaggttttttttttttttggtaccttcttcctcattttattatttatctggataggatggtagcattatgagacgtataatatattaaaaattatctttataattgaccaaggcttctcctaaagcacacctcattctgttggtaatatttcaaaatatggacttagagttggtcaaactgttaagtagataatatatataatgtttttatatatttttcaatttttttcaagctgagactattttcttaaatcaagatttagaggaaaagaatgagaatcaagagaatgatgatgagggggaagaagataaattgttttggctggaagcctgttacaaagcattaacgtggcatagaaagaacaagcacgtgcaggtaggactctcataaatattagagttattcaaaattatgttttccagtcatttatattttgacagatttcttttttctcccctaatccaggaggccgcatgctgggcactaaataatctccttatgtaccaaaacagtttacatgagaagattggagatgaagatggccagttagtagttttgattttatatgatagaaaatttcagttatattttaaatcaatacctataaaataccttaaccgtaacttttattgttagaaatatttttgatataggcatttagttttagatgttgctgcaaaatagtagtaggtatgtagtattttgatctcatcaccttcaggagttagaaaaggtagaatgagagttattattgagagatttggaatcaagggtcatttggtaattcatgaatcatggagaaagaatctttctattttctggctgatcgttttaaaatgccatattaattcatcttgggtgatagaaattgcagagccatctgtgatcttttcttctatggtgactagccagcaggttgtcaatatcagaaattagatttggttagagagcttcctatgatgagttcccaactgatgtgacagagttgacctgtcttctttcgagagggttatttgaagctgtcatctctggataactctttcaataggagtgccattcaaacatcataagaccggcactctctcccaaagatacaagctgtagcaaggagttttgtgcatatcaggtttgtttcatatccgtgagcctttgtgttttatggcaactgattgattatacttgtgctatttgcaatgggtatcctctgggttttaaatagtgaatgacttattttggaaacaaatagtagtattctatgtctgaaatcttgaccgtctatttgtttaattatctattgctgataagaagggaattaataacacagatgctacttaattaaatattttcattttgacaagaaacagtaattcttttgaaaactatgctaaattggcatcttaataatctcatgttgagcaaggcttttggagattagggtaagggagattcatgtcgcagtttataaatttcagttcataggatacctatttttcaatatccataagataactttaaaataaatatattattaaaacaaagaaaatatatttacgttatacatctttaaaacctaccttgcttctttacaattttcagtttttcctctcttgtttccattctcttctcctcactttacctttttcctcagcatctctttacatatctgctgagcttttttatttctctctgctgcatatgcttttgaaaaagcataaaaatactaatttgttaggatttaattaattcgagtcttaaaaaatgaactataattcactcttgtaagtggaggtggcatgaaatattgtttatatgctcttaattgttgttagagatatttgataatggcaagtgagaatttgagatagttatttaaaagattactactaacattttgtttgaatttttgaaagtttcccagctcatagggaagtgatgctctccatgctgatgcattcttcatcaaaggaagttttccaggcatctgcgaatgcattgtcaactctcttagaacaaaatggtaagcagtgggccatgttttcaaataaagggaaacacatttttgtggtatttttaattatagaagctatatactgtgaaaaatttacataatttataaagctatatattgtgaaagatatctctatgtgtagagatgtattgacatatggattatgaatatataggtaaaaggatgaagaataaaataaacatttgttgtatatttttccggacttctatgtgtaaactcacacatgacatatacaaaattttatgtattttgtagaaatgggatcatattatactcttttataaccaaattttatttattctcttttttatgttgatacatgtgtattctcacattatcattttatttttaattttttaaattaatttttgtttttagatatggtctcactctgtcacctaggctggagtgcagtaccatgatcatggctcactacaacctcaaacttttggactcaggtgatgctcccacctcagcttcctgagtatctgggactacaggcatgcactgccatacctggctaattttttgcagagatggtgttttgccatattgcccaggctggtctcgaattcctgggctcaagcaatccatctgccttggcctcccaagtgctgggattacaggcatgaaccactgtgcccggcccaaattataatttttaatagctttgtagtttttcagtgcttgcctgtattctgttttatgaaccaatttcttactgatgaagttttagtttgtgtccagtgggatgtttctggaacccatagtaaacaccagtgatcactttcctcctctgttttcctttatacatggttcctattattttcttgggaaaatttcatagaaatgcaactgggtagagagctattcaccattttaaaatctggtaaaattgtctattataaatttccacactatacttttttaaaaaatcgttctttaatgtaattcttataaatcttatagctttgtataattatgaagagaaaaatggcttgtatccctttagaaagacatgagttttaagattatggttcaggctgctcaaatttcttcccccataaacaggaatactgccagaaatccttaggtgaaaactcatcataaaggcattgggacttggcagcttttgcaggacatttttagagggcaaaaaatagagaaaaacactgaaagtcagagacagagaccagtgtaagcatcagcttttaatagagaaactgggtagggtggaaaaaaaataaagcaaccacctcatgcatgtttctttatattattattgaagtcaaataaagaggaaaatcatttcttcttcctcttcctcctttttcatctcacctctccaatggcactttaataaaacgcttggagtggccagggcactgacagacagacaggggctgctctcaaggataatgagtcaaaggggaaggagagggaatcgctgttctcgaatctctcttattctactgtgcagttaaagaggtctggacagggatttcactcctgaaaatgaggactggactttgtggcttctgttggggcacctttagagtggaggtagacttttactatgtacagacaacattgtgttggtgacatcattcataaccacctggaaatctcctttgatatgcaaatcaaacaaccataactttgtgaaatttcgactgcttcctattgtggtgtctgaggactggttacattcagagtccaccctgatgtctttgttcagttttctgctctttctagttccttacttctttgttcctgatcacctgtcaagtaaaatgtcctcagatccttttgtattgtctttggagttctgccttaataaagcatgaagaacttgagtagctcgttcatcaactttcttgggcaatttctcattgaaagacacttgggtgtctttgggtgtgcagagctgagcatggctttatgtttttagaaaaaatggctacattggcaggcagaagaactgcgtccttggaatcatggaggtcccaaggttgcatacattttgtgtgacatttttcctattcaattaattaactaatatttattgagctcccaagtgtgtagtgtctgtaggcacttgggatgcattcattaagtaaaaatcccaggctcatggagtttaaactgtagtagggaagataataagattaactaaaatatgtaatatttgaggcagttaagaataaaaaatgaagcaaggaaggagaatatgatatgttagacatcagaggagatgaagttgtgaataggcagccaggaaagaaggtgactattgagtaagacctgcagggcgtcgcatattgttttttgcctctgaaagcagttaatttcctgttaaaatggagtggatgagatcaagagtattacgtagatagctggtaaatgcgatagtgtgtaaaatgttctataaagtctaacgtgactttatgatgaaatttcttcttctaggtttattgcttgcaattttcaaaccacacattgggttactgtctaggatagtgattcttaaagtgtggttcctggaccagcagcatttgctgggggaacttgataaacagtgtaaattcaaggaccccatacagaccttctcaatcacaaaccctggagttgagacccagcaatccatgttttaacaagctctccaggtgattctgatgcacactaaagtttgagaaccactaacccagtgtcatttttgtcttttaaagtgtcttcttggctagaagctagccactttgggaaaggttattacaacttctgatgtgatcaagcaaagtaaccaactctttattgtatcttaatatgtgatattctgaatgtgtttaaaaggtatgagtttttcaggctctggcagtattttagaatgtgtatgtgatttctatttatttccatgttttgtcctatcttcttaagatagactacttattttaaaagcagtacttaagttaaaactttttatgtttctttttctgccactttcaaagtgttgaatcacagtgtgtaatgttggaactgatatttttatagcggcttcaagacaattgatatttatgtggaaacttgaagacagtaggtttatgtttagtgaaggaagtttattacaaagaggaaaattggccagttgtggtggctcacgcctgtaatcccagcactttgggaggccaaggcaggaggattgcttgagctcaggagttcaagaccaggctgggcaacatagtgagatcccctctctacaaaatattaacaaaaattagccaggcatggtggcacacttgtagtccctggtacttggaggctgagacaggaggatcacttgaggccaggaggttaagactgcagtgagctatgatcatgctactgcactccagccttggcaacagagagagatgctgtcacaaaaagaaacaccaacaaaaaaagaggaaaattattccttaatcattattgctggaatatagttactttccacaaatagtgaagtgccagttgtaaagcatatctatatgtttcctagactttggcattactttgtgaaaataactgtaattacttatgttctatgtaaatgctttccattcatttgtatatgatggcatatatagaaattataatgtttgtaaagtccactgggataaatggacaaagcagctgaaggctgaaagcaaccaagccttttacagccccttcattccccacactcccaaaaagctgagtgaatggtcgatacctccacatgcttataactcattcccagcccaccagtgtctagcatatctggttagtcttagctttatataagtgcagttatttgtgaacttgttttaagtattggaatacaatttaactttcattcttattttggagaccattatttaaacagatttcttttttcctgcaaaaacactcttttcacaatggacagagacacggtgattacattaaaaccatctactctatgaataaaaatgttaaaaccaaaatcccaacaaagggttaataaaggcaaaaaaaattggaaatgacatgtgttttaaagaaataaacatgaattatctttaagctgtcaatgaactataaattatgtgtgctcttgtatatgctttcctgtaaatttggactatattaatattctaaagcttatggtaaaattatgaaaatatgctttcatatctataagtaacattttaaaaaatctcagttaatttcagaaaaatactgttatcaaaaggaatacacctgaatgttttggagttaatgcagaagcatatacattctcctgaagtggctgaaagtggctgtaaaatgctaaatcatctttttgaaggaaggtaatatagattcattaacttgtacagaatatatcatattgggccaggtagaatatcaatatttcaagcatatttctaacaatgaaaagaaaaagaaaaacataagacacttgaaaactgaagcattttgcaatgtaatctcgtgtcactagtaccatagacttactttatctgaacactgaaaggaatggcaagattgtggaaacatgttgaaggtttgcttttgaacctgatgcttgatgttgactatattttgaaaagtggtaattgtatagcacatagcatacagcagtttttctaattattgtgtgtgtgaaagttataaaagataaaatcagtttatggctaaattttgctctttcacaacgaatatattattccttcatctgaatgaactttgtcttctcttcctgctctcaatccttagttagggaaaattttaactacatctagtccaagtgcagagatgctaagattatatagctggcggttagtggcacaacagagaccatatcctttgatctatgtgtggatggtggtggggcagggtgggatgaggtgggggtgaggggtggtaggtgtgggcagaactctcatgtgtaaaaaaaataattggcacagaagttgcagtgaaaactaattttgttcctggttttgccactaatttgagccaactgtttcatctctaaaacttcacgttcctcattgataaagaggaatgataataacaactttgaaagttgtaagcttagaatgtaaggattaaataaattaatttttacaaagggattaggataatgcctgctgcattttaagcactcaacaaattgtgtctattgttgttatactgttactaagtgtgaataaatgaagtgcatatagcatgaaatgtagcgtaactgcagacttgtaagaagtagggttacactgtttttaacatcagtctaactaatctatgtttatatatctttctaagctgtatttctcttatttaagtgttgtttttgaacactgagatgaaaagtttatcttaaatgttgattttaatggggccggaagtgtgcaaacctttacaaatgaggcaaaaacacagcggaataaactccagtctaggattctgtagattctgggcaaggcatttaatgtttctcgctgcatgctcttacgtaaaatgtgtacagttgcagccctggagattccgcattggctctgacagtgtgtctgcccctacagaactcatgtgagtcgagagactgataagtaaacagattattataatacagtctcagaatgcagtggcagtagtgtgtaaaagacgcaatggtaagagtagagtggactcagctggggttacccaaggaggggaggctccaatggagggatgtgtttaaactgggactttaagttggaaaagaaggaatgtatctcagtgtccacagaaccatgcaaagtgagaacatggttctgatatgcacaagtttcagttaacaagcaaagcaaggattgactgtattaaagttcatagtacctactgcattctagtcaagtgacatttgctcatatgtaaaagaaagaatagcttaaatacctgagagaaaccaagactgtaaaacaaattaaaaataattaaaaataccttataagaagtccagtgatgttaatctggaagaggaaggttcgtgtgatgtaaagaggccttgtcttggggtcagacaagtttgggtaccagccttgtctctgtcactttctagtgataagacctgaatatttaacctctatctgtctaagttcttcatgtagaaaatggggataataacacctacctgctgggattgttgttattgacccatcgtaggtcagaaggatgttgttagttttatgaagtgaaataattcccggattactatgaattctatcttatgagttcaaagtttagacaattaaaattatgtatgctcatactactgatttcaaatgcattttcatatagtctttcctgataaaatatattggttctgccctcctgtacttatttcaatttggtgtttataccattgaatcagatcagtctttcaataagcatgccaattttatatccccagcaacacttccctggatataatggcagcagtggtccccaaaatactaacagttatgaaacgtcatgagacatcattaccagtgcagctggaggcgcttcgagctattttacattttatagtgcctggtaagttacatagttgattgtgggaagagataacaatttaaatggatttttgatttttcatgaaatagcaatattctaggcaaatattaaaagactagtttctgtcgactaaatgtaaatctttctgttaaaccaaaaagaggttaaatatgatgcagaagagtcacttagattaatttttataagaaagcaatatgaattcagtaatttatttatacaaagtaactacaatgtaaaatgtggagcttttatttttaaggagggtgttcatctctgataattcttttctatttttgttgccatgacctgagttcaagctttttttctcttgtttgaattgtactattagctaattttcatacctgttctcttccttcatttctatccttttcttactctatgattgaattaatctttctccaatgtggcttgtactcatttacctcaatggcttccaccctccacccacctttaattgttactgacatctgttatcaccttatttgttctccaaagcccctttaaaacacctatgtctgtattcatccaacacatttattaagtgcttcttatgttctaagcactgtgatgctgttaaactttaaaagatgaattggaaaaaaagcacaactgtactattataggagcttagaggtagatggaagtgtaaatagataattaacaggcagcgtgagagaggcgatgatagatgcatatataaaaggctttgagaatatcgatggaggcacaaataatttcttcaaaggagtaggacagagattgtaatatttgaggtggaagggtagatagagctggcctggtagaaaggccaaggaagacatttcaagcagaagaaagtgcacatggtcgggggtgagtgaggcatggaggataaggagaggagtgcttggggatgagtgtggaaggaaaggctgaggcccaaagaaaagggccttgaatgcagtgctaaaaattttttgccttttaaaaatggaagccaacccaagtttattaaaattgtttgcagattgtagtgtcacaccgaaatttgcaactaaagacaatagcattgtggtgcagaggatgatagacagggagagagactagatacaaggagattgggttggaggtccatggtagtcaagtgagacccagtgaagggacccagcaatggaaacacagatgagagggcagattggacagatggttgggagatctgtttgatgtgacatcgtgatccctaagtatgagggatgatactttgttctgtgaagttcccaatcttttgaagtcatttttgctttgttcttttaaaatgaaatcttcctaaatctatcattttctctagttatataggtattttgtttctctgtataagagtattactcaatataaaagttttttcaaggacagagctttcttcagtcatttttttctgggccccccagtcctctggtggctattcaatcagtattttaaaaattgaatcatggtgtcctattcatagtttcagcttagttttgagacgtaatgtaacagatgtaattttacttgaaaatattattgcatgttttattgaattttatttttagattgtaattaaaaacaataaaaatgccttttgattatccttaaagttgacagccttattcttttgagggaggttttgggttttaaagataaccaaaggacactcaaaaaccgtttctgttagttaataaaataatactcttttagtccaaaagcaagttttgaatacagtatttcttttcttttattgttcttaaactgatcctgaaggaaaattgttagttaacaatcaatcagatgtattatgggtgcccttgaaaataatcacttgaggactgtacttaatgtaaaaaaatacattttataagcatatcagtatgtaagtacattcttctagtaggtaaaggcttaatcatttactgtatgctaacatattatactaccacagtacaccatactgtactgtacccaacgtaatgtaccatgccgtgcagtaccgtatcattctaggtatcaacaagtaactatggtagcaatactccagtagttttgaggttgaatatgattctggtttgaacatgttaagttgaggttcttatgagatacctaggtgtacatgtattcatttattagctagattatattcaggttttttagtggcaaagatgtacattatggcaaatgtgtataatttagggtccaattaaggatagcatattgcatctagtgcatatatcttaagtttctttcaatctattactgtactttttctcttctactttataataacttgttatatagacattgagctggttgctttaagaaaataataatgaagacccagttactttaataaaatatcatttgacttgtttcttgagttactgctagttttagaggaaataatgtgaaattctttaagaagggatataggcaaattgggaagtatatagaggagagtgattagggagataaaagcacatcaaaaagagcaataagaggaactgagattgttttatttgaagaagagatgactcaaagggatatgaaactctattcaaatctacttacttataaccagtaacagtaataataccaaacaatatggaggacttaaaaagtattaggcattgtttgaagtattttaagtatattatctcttctgattctaacagcactccatgaggcagatattattattattattattttggtattgtatggactacaaaactgaggcatagaattgtagagatttttaaggtcaggcctgatataacagcaccagattttcagcttatgcaggctgactccagagtaggcattttaaaataaatatttgtgcaacaatcttgtcctgaacaactgttgtatttaaagcactatgtctagaatccttaaggtatcgggagatgatgagattatggatactgctctcaaaaaaatttacagtccacacgacctaaaggactgttatgtagaaaggaaattatatccatttgaatagtaggacctcaagtgatagaacaaagactggagaagaaatttacaggaatgttcatttggtcttaatttaaggaagatgttaaataagacccattacatgtagcatgatgtttttactactcaggccagttttagtggtcacatcttcttaaggtgtaataggcagcctcagaagttactgtggtcttgctcactggaaatgatacacagacagtttaagggacttgccccagaccacacggcaagaggtgaatgtcagaacctctttgagtacattttaaaataaggactgaaagttggaggagggtggttatcaaggctgccttccttaccatagtattcccagcattaacaaaatccttggcatgtaattggaattcagatgcttcttaaataaatgaaaagcctgttgtagccagcttacagtttgcattaatgcagattattaaagtggaagatcataaatgattttttattaatatttatgtctataatcttaggtttggaaaacattattcattcataataattttaattatatgttacattaccacatttttgacttgtagtgtttttagcatagttcagctacagtgtagcttaataaagaatatgattttttaaaatagcaatgctattatatagcctttacagaacttctaaaaaatgacatgttctctaccaccttaatactgaaactcaaatcttattttttgctacgattattccagctactcttttttgtctatatttcatttctgcctttttatgttgtggtccaagtaactctgagcttttctcatgttgtccattgttgcataaaaatcttccagcatcttaaagcacagcctactcacacaaaaaagtgattgtttgctacagaaaatttcttcaccatcgtaattttttgctacttcaaattcagtaagcattcttacacattatatttattttatattcagtgatgaactatttttatagattccttaaaatttctggttatttatttgataaggaaacatgtactagaaaaaagtacaacacatatattgtgagattaattatgacaatttctagaaagtaacagtctgttcaactcaaatgtttataagaaaattctttctttatttatttatctgtgcatttaggcatgccagaagaatccagggaggatacagaatttcatcataagctaaatatggttaaaaaacagtgtttcaagaatgatattcacaaactggtcctagcagctttgaacagggtatgttgaatataagttttctgtatttatactattaactaaaatattaaatttggagaactaggggcgctttttcagtctaagttttctgttctccgtttgctatgataggaggaagtcatgtggttagagacataagatgacagtggggatgtgggaagtgaaaagatatgtactaagctaagtccagctaagtgtattatcaattatagatgtaggcaagattcttttgattgccagtaacataaatccactctagtttgctcaaccagaaagagaaccaaagagccatatatgcagctagaccttgtgagtcatgctgggtactatggctgctgttttctctttctgtcctctggctacttgtctttcttttctggtctcatagtatatggtttagcccatgaagacataccagtgttaacagtaaagtcttcggctgggcacagtggcccacacctgtaatcccagcactttgggaggctgaggtgggtggatcacgaggtcaggagttcgagagcaacctggccaacatggtgaaaccctgtctctactaaaaatacaaaaattaactgggcatggtggcacgtgcctgtaatcccagctactcaggaggctgaggcaggagaatcgcttgaacccaggaggcagaggttgcagtgagctgagatcacaccactgcactccagcttgggcgacaagagtgagacttcgtctcaaaacaaaaacaaaaacagacaaacaaaaacagtaaagtcttctttgattccctacgctccttttcattgttctccggagaaataacctctgaaatgatttggtatacattgtttccattttttagcatttacatatccatgttcctacattataattaaagtatccataaatcatactgagtatgaaaaagagaagaagggaattacatttaaattgtgtaatgcaaaaagtattggtggaattaagaagttttggaaattttgcataagatgaattggttctttattaaagatgttaagaataaagacataattagtgtgaacatttttataaaaggaggagcctatttaaaataattaatggaaatgattccatgtgatttgatatactttgatgaatgtcataaattaattaaagtggcttccagagagatctcccttaaaaattcattttaaattgaactttatactgtcactcactgcctataatatgtttgagtcatttatactcaaactttaatacaatccttgagtatggcaagaatttatgttgtaatgggttaaatttatcttgagaaatatttgttgaaaataagtatatggaaggaaggggttaggcatttagaagataaataaatatgctttgtactcttctctcctgaatctcataagccggttgttgatggctgttgtgaaaccttggttcttttctttaaacaagagacacacagcagaggagatgcagcatcgagtaatttattgcaaaagaaaaagaatattttgcaagttaagtgaggaatagacacttataccctgacagaattcagggtgggcttactagtaaggatgagacagcgtaaattggcactaggaagactccctttgtgggagttgtacatgatttttcataagtgggtgggaagaagtgttactagtaagcatattctaggttgtcctctgagtgaacatgtgcagtagctgtacatgcttgttcatatatcgcatgtctcataagtatctgaaatctccacccaggggtgtgtgttttactattataatgagcaaagggtcagtctgaggacaaggaaaatcaaaatgtgcatgctccccacgctacctgacttcaaactatactacaaagctacagtaaccaaaacagcatggtactggtaccaaaaaagagatataggccaatggaacagaacagagccctcagaaataatgccgcatatctacaaccatctgatctttgacaaacctgacaaaaacaagaaatggggaaacgattccctatttaataaatggtgctgggaaaactggctagccatatgtagaaagctgaaactggatcccttccttacaccttatacaaaaataaattcaagatggtttaaagacttaaatgttagacctaaaaccataaaaaccctagaagaaaacctaagcaatactattcaggacataggcataggcaaggccttcatgtctaaaacaccaaaagcagtggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatctagaatctacaatgaactccaacaaatttacaagaaagaaaaaacaaccccatcaaaaagtgggcaaaggatatgagcagacacttctcaaaagaagacatttatgcagccaacaggcacatgaaaaaatcctcatcatcattggccatcagagaaatgcaaatcaaaaccacaatgatataccatctcacaccagttagaatggcgatcattaaaaagtcaggaaacaacagatgctggagaggatgtggagaaataggaacacttttacactgttggtgggactgtaaactagttcaaccattgtggaagacagtgtggcgattcctcagggatctagaactagaaataccatttgacccagccatcctgttagtgggtatatacccaaaggattataaatcatgctgctataaagacacttgcacacctatgtttattgtggcactattcacaatagcaaagacttggaaccaacccaaatgtccaacaatgatagactggattaagaaaatgtggcacatatacaccatggaatactaagcagccataaaaaatgatgagttcatgtcctttgtagggacatggatggtactcagcaaagtatgccaaggacaaaaaaccaaacaccatatgttctcactcataagtgggaattgaacaatgagaacacatggacacaggaaggggaacatcacactctggggcctgttgtggggtggggggaggggggatagcatttggagatatacctaatgttaaatgacaagttactgggtgtagcacaccaacatggcacatgtatacatatgtaactaacctgcacgttgtgcacatctaccctaaaacttaaagtataattaaaaaaaaatgtgcatgctccatacaggggcaattccctactggagatagctttgcttaaatgagctggactacaatgcaaatgctgaaacttactatattgacagtaagattgccacagttgccgcgtcctgaggacatggttacttccttttaatacctatcctgtctcattgtgagaggattaacaactgtgcataaaaccagttgttctacatgagcacttaggagggataccagcattgtgaacatagtttaagtacgtagaggagggaacagttaagtttattcatggtgagtgttggtgaaaagtggaagaggtaccaaaacagccgtatagataactggttccagttagccaacattctctaaagttattagagaagcctaagtgaggtgtaacctcagcagtcgggagccaagagagcaagtaagtgctgtgatgtggagaaaatcactttgttccaactgagaagaaatggttgagcactgcttttcccccatgccagtactgacgcacagcctttcacttagcactgattatcgataggggtggggagttaaggtatggggaaacacaagtaacaatattttatttcaaaaacctctccactgtaattcccctaatccttcatcatggttgaggaaaatggctctaaaaaatgagagcaattactgtagctccaaaattctgtgattgcatgtcttactctgaatagcaattacaaagcatcagaggatttaggtccaaatattgcagacacaagaaaatgaattacattttaatacatctaaacttggagagcagagttccaaataaggtagaacttgagattcaactctgatttataaagcagagactaagaagagtatttataaagcgaatccatgtttggatacataaaagtgcaataaaattcaagctgaagttaaaatctctgtctagaacagcgatgttccatttatgcctgatccttttagcttttccacagatgaagactttgtcacctgttccagagagatatatttgttcattattgtttccagagagcaaaatggaaaataaactctgcacattttggccgcatctgtgttttatatgcggtgacactcctgttctcttcagtgaggaaatccagtaaagtaaaaccagtcttctgatgaaatgggcacaaatcaaagaacttgtgagcttcacaaaaaccttgaagcaaaatataccaagcttaaatattgaatgtattgatttcagtagtcaaaaacagagctcatctgcaaaagcaacaacaacaatgacaacaacaaattacatataagtaaaatttaaaaaaggtttacaggatgaatatacagaaaactatgaagcttaggggtagagaggagtagttgaatatatgaaaagatacatcttttttgatgaaggactaaatttttaaaaatgaaaattgatctatgtttatgaaccattagtaaaaataacaatagtattttctggaactaagtaagctagtgtaaaatttgtatgaaaaaattaatacatatgagtaatcaggagaattttaaaaaagagtgttgattcatatggcctaactccaaaagataatcaaatgtattatacaattttagtaattataatggtgtgatactggcactaggggagagagatcagtgccacagaagggtggctcaggaaatagactcaaataaaaatttgtaatgttatgatattcctcgactgcgggaggaaaatagattactcagttacttgtgttggaacaactaactcttcagccatttgggaaaagcaaagaaagctgaatatttatcttactccttttgccaaaacaaattacagatggatgagatttaaagtctataatgaaattggtatatgtacatattaaaagtttcaactataattgttattaacgtaaatgacaacggaacaccttgttggagggaaatttggtaatatctatcaaaattaaaatgccatgttttctgatcagcaatttcattctaagaatttttaatgtagatatacttgctcatgtacataaagattattagacatgaatgttcactgtggcatgattcgtaattaaaaatgtggcaacaaactaaatgcttacatggtaatcattcatgctgtttgccagatatttttatttctccaccttgtggtgattctggcatagtatttagtagttaggttgaagcatgtgactaattttggtcagggagttgtaaatggagggaatagctggtgagacatcttgcggaatactgtctcaggtaccatcgtacctgcagtgtttgagatagtagttgctccatcagtagaggtccctgagggactacaacaagcagagtcccctcctgacctgcaacacatatgtagcatgagcaataatggaacttattatttttgcaccctataaaattttgagaattgttactgcagcttaatttaatctttcctgacaatacaatacctatcaatagagactaatcagataaattataccatttccaaattgtatcatcctgcataaatattaaaaaacaatgaggtgagattcctaatgtgctgctatggaaaaatcttcaattttctatgtgtacgaatgtatttcccaggtattcgttttttccttcctgtatgttgacacattatgcacacttttggatgaaattaatatatttccaccgctttatgtcctctccctcacttttatcacccaattgtagcaaagtatatgtttgcttttatagctttagctatataaaattttctaatagctaagtttgtggttcctggaattaagatatctgaatttaaatctaacactactacctacagactatgcaccctggacaagtacttaatgtcttggttttgttatgtataaaatggagataataactgatttttcacttagagttgttgaatattttataagataattcatgaaaaagtgtcagtataatgcttggcacatagtatgcgctcaataaatgttaatgttattactattagatttaaaagtatcttttgacccctggctatagaagatgaggaaatcagagtatttgcacttctaatatctcctgttttcccacctacttttgttcaataaattaactccacattggcagggtagataatatttatattcagctttctaattatgctttctaagtttgtgtttatcttactcctaccgttatttggaagcagtcttcatctcaagtccttttgttactgttttttcactcatcttttagttgtctgaatttctttagaaaagtttaattccctgaatatttaatgtttatattttgttgttgtttttgcctttatatttggactcctaaaaaaagttttgttggttgtaaaatattgtttttttttccttgaagtgtttgtaggcatttcactgtgttctagtactgaatgttttagtggagaagtctgaggccagcttcatttgtttcttggatatttttgcccagtgctgaaaggattttttctcttgaaatccatccactttattagggtatatctcaatgttagtcctgggatatggtatcctcattctagctatacattcaacttttttcctggaaagttttcttgagttgcatctttatatacatatacatacacgaatacatatacatggtaaagatattaaggataaagataggtgctttataaataccaatttgatataattttggcatgaaaaaaagcctgtggtgcattctgagtttggaagtagaactggatatacttacttattactattgtttttaatacaaaaatggagacagggtctcactatgttgcccaggctggtctcaaactccttgactcaagcaatcctgcctcgacctcccaaagtgctgagattacaaatgtgagccaccgtgaccagcctaaatatctaaatttttctctttcattattttagctctcttctttggggctatcagtcatatgatgttggatctcttttgccttaatcttctaatttttcaaagactaatccagagaccactatctatcaccatgccattactcatagacaagggacatcattccacacatttagcttatttgtcaaaatcagagatgggatttataaaagaaaaagaataaagggagaaaacaaaacacaaattatctgggaatgcgagtctgttttcctttctttggctaatctacttacctagtagctaggaaagaggccagcatgagtatttttccattgagctggctagctcagtcattggagaaaccatttcaatatttatggattctctgaaaaaaacttggagagtaaaaaagcataggtggtaggatgctgccatccttctgttggcatctccagagtttcacttgaaaaacacctcctaagtagacactgataaattgattttaatccctatttgagcaccaatgcaatacattactatttcaagatggagcattagataactaaaggaaattctattgtgggcttgtaaatatcatgatagtcatacctatgtaatacatatatgtatatataaatattaatttttaaacatttacttagctattaaaaatcaaatgctcatatttaaaattattggtttattaatgcaccatcacatgttatcatgtgatactctgaattctctttttgcatagacaaatcagagattacctgctgcaagtcattagtcatcattaacctgtactgaaatggttagagcctaggggagttccaggtaaaaggaccagtaatgagtagaagcttgttagatgtagagatattgaggacagagataggtgctttataaatatcaatttgatataattttagcataaaaataagcctatgatgctctttgagcttgggagtagaagtggatatgtaattttcagggcgtagtataaaatggaaatgcacactccttgtttgaaaattattaacgattttacaagggtgacaacagagcattgaagcaagtgctctgtgagcatgaagccctgtgtgaaatacacacctgtgaagctggccttgcctgccaaacaggaatgctggtactgttaatcaaacagaaagttcagaatgacaatctgacttttttttgtagaagatactaaacttttggccttgaatatctgaatttaagatactggtatcaagccaaaagaaatttgggcttagaacttgaaagatttaaacttgtgctttgacttgtgtgctcacagctctctgtgtcacaatttttttcatctgtacttcgggacaacaatagtgtgtcgacatcacaaaggttttgggaggattaagtaggtgaatacatatgaagttcttaaaagaatgtctggcactgagtgagtgctacctcggttttggcatcgttattgtggtcattgctattgttattatgacttgaagtcatattagtgtatgaaatcccatccatgaatagaagacagaaagaactttgggcagggtttggaggtaaaagaagacattgtaaaggagatgggtaaaggaatgattttaaagactgagaataattaggggagtacgatgtcatggaaattaagggatgataagcaccaattaagttgttattggacttttttctttgaatggttcaaattcagaataataaggaaagaagtctgattatacgaaattaaagggtagggtgactgtggaggtagtgggagttgacttttctgctaataagtttagaaataaaggaaaaatggtagcttgaggaaagagaggagcgattaagggaaagtctctcgttaactcttgtttttcatctctgaggacagcgcttagcccaaggcctgacctgtgatcattactctctcaaggtttattccatggacagagctatctcatttcatgcttataacaaccctacattattagaattgttttagagatgaggaagctgagacacacaccaaaccagccttccaatttcactttgcacaactttgaatttctttatatttcttgaataaaagttccactttttaacttaccacttcttagcagtcattgtctaactgagtaattgttacttcattcatttaatggttctcagattcgcataatttgaacctaaatttaattggcctccaagctgatgtgcttacagaaacagtgacaggaaacaaaaatgtcaagggagactatgtattattaagatgataaatgaaatgatgtccaagctgagcaattaaagtgtgaagtagaaggacacagggtgagaaactgatgcttctcctcagcctctataaaaaagatactgaataaagataattgagaggcattaggggactagactgagaaaggattggaaatctgttcactgagagtacagaaatgaggaagcttggaaggcagaagattttggtcaaagacgtctggcttgaagctatttcagctctttggattatctgtggtggaggccatcacgtctttggagtggaggtaccatgaaactagtgtctgcaaaacatcatctaaatgaaagcaaaattcctgagaaggatggcactataatttttaaaagaaaagctatgagttaagcattcatatcaaggtagatgtttggagtgtattgcttgtgtgtgaaaaggcagagatgaccagaataagagttagaggtatgctgcgttttcttcttggttgatgagtaggatggcctggacaaagaagtgacctctagtaaaataccttcatagtgtcaaatcatctggaggaaattcagattaaagaggttggatgatgtcgtaattaagatcctgggcttttaaggtggacacatttatattcaagtcccaggcccaatgcatattagctctgttacttgagcttttatttctgcatctttaaagtttggcaaacctattacatgaagctgttgaggggataaatgaaataacgcatgcaaagcacttgcagtaaagactaattatcaatattttatttgttaagaggcagcattgcgttttactggtcaagtatgtagactctggggtgaaacatatttggtttggtttcatctctgcaatttatagtttgtgtagactttgagaatagttctcaatcattctaaccctcagtgaattcatcttctaatgggagtgatatcagtatggatttcatgagattatgaaaagaaaatgcctacaaagtatttattacaatgcctggcacagaacaagctctccttaattgtaaaaatgctaactcttattcttcataataaataaaagtaattaatgttatagaaaacaaaatcaaggatactgatttatatttggattacttgatttatattttgtcagtctataactggtcttaactaaggtaagtattaagatctcatttttaacagcgagtattcttttgattttagttcattggaaatcctgggattcagaaatgtggattaaaagtaatttcttctattgtacattttcctgatgcattagagatgttatccctggaaggtgctatggattcagtgcttcacacactgcagatgtatccagatgaccaaggtcagtacaatttgaattcaggatttagaatagatttttgtagggcattagctggtgactggatgtctttaaatatttttcttcagttttgagatttaaaacaattctttttttttattttcctagaaattcagtgtctgggtttaagtcttataggatacttgattacaaagaagaatgtgttcataggaactggacatctgctggcaaaaattctggtttccagcttataccgatttaaggatgttgctgaaatacagactaaagtatgtgcattatcttggaaagaatttgggaacttgtgcgaatttcacttttggagcagtttgtgtaattcccactttgcatgaatggggtattctagttaatggaaaaccatttatccttttgtagtattttaattatacaagcaaagaaaattggattgaatctctaaagatccagtgtttcattatgaaatctctaaagtcagcatggttattcaccatttatcttgcccataaaagttcagagaatgtgctaagaaatcccagctagctgagtttattcgcttagattttagataaatagaatttataaatattccaaagtttgtcactctctgggttttattgcaggttgcttacctttagtaattttgcttgttgatttttttccttgcagtgaaaaaatgtttttaacatttttcatcaagcaaaatttaaaacatgatatataataactgtctttgtaaggaattcaagatactggcctagagttagttcacgggagattaagaataaatttgttttgttttgttttttaattgtagcaaaacaaatagtttttcttcaagagtttctgccttggttgtggagtttgcaactttcataaactacaaaggaattttttttttttttttggagacagggtctcactctgtcacccaggctggagtgtagtggcagatttcagctcactacaacagctgcttcccgagctcaagtgattctcttgcctcagcctcctgagtagctcagactacaggcatgcactcccatgcctggctaatttttgtattttttgtagagatgaggtttcaccatatttcccaggctggtctcaaactccctggtctcaagcaatctgtcctgctcagcctcccaaagtgctgggattacaggtgtgagccaaggtgcccagctgactcaggaaatattttttgtaactggcagcattgaccaggaataaaaatacctggtctctaatctttgcacagacattatcagtaaatgagagaatatgtgtaaagttttttaaaaaattataaagttatgaacatacaaaattcttagattaataacaacaatgtgttttataactgcttttcataatgtgcctcaggctaggctgattaaaccaagataggattgattaaaagtaatcttagggaaagggaaggattttgtgccggtatggaactctcagttactctggattaattcatctaggcataaattttagaatctctatagtagagtttatgaactaaatctggcctgccaacatattttatttgtccagttcagggttttgctttgttttttgagacagagtctcactctgttgcccaggctgtagtgcagtggcgcagtctcagctcacatcaccctccgcctcctgggttcaagcaattctcctgcctcagcctccctagtagctaggactacaagtatgcaccaccatgctcagctaatgtttgtatttttagctgagatggggtttcgccgtgttggccaggctggtctcaaactcctgacctcaagtgattcactcacctcggactcccaaagtgttgggattacaggcatgagccactgcacccggccttcagttcagtgtttaaaagtttttaattcgaatgacgtactttctgcacatttgcatggcctgctctgctgtagcattcacttgttttcagagacctctgctctagaggcaggtggatcacctgtccctcagacatacataaattaaggctactttgcttatcaaatattagtattcgtagatactcagcatcataagagttcgaagtaataattttaatatttagatgacgtaagttaatttaaaatttttttgagatggggtctcactctatggcccaggctagagtgcagtggcacaatctcggttcactgcaacctctgcctcctgggcccatcctcctgggtgggctcaagtgatccacctcagcctcctgagtagctgggactacaggtgcatgcacgggtaattttaaaatattttttataggcacaagattttgccatattgtgcaggctggtcttgaattcctgggctcaagcaatcccacagtgctgagattacaggtgtgagccatggtgtctagccaattttattaatatgtaatattagaggtaataaaacattaaaaagttaagatgatccttggtggctttacccaacctaaataatactaaagtcaaaagcccaatctttcattaaaacatcacatgagtgaagaggacagactctggggatgtgcttaaggtggttctaaaaaagtaacggtgttctttataaataacttattattagaatgtaatcctcagagtgccctcagcgcttctcaactacactcaacataaatgaaatctaggagtccacactagcctttctgagataaacatttcggaagacagcgcaaaaagctgggggatatgctaggctctctagagaacctactgttcaatattataatacaaatttttactctattgacctgtttggatgtgtagttctgctgatccaaccgctttaatcctgtttaatatctgggtttcatcctataactatggctttagacaagcatctttgaaaaccaaatttgagggtattagttctttttcctgctttgctactgaatggtttgttaactagcattttattctctgtgcctgctatatttcttagtcatgagagagagagggagtatttatttacaggataaatactttaaagcaccaacccaatatatctatagttaaatgaacatcctaggtattgtttcatatacaaactctctctgctttatactgtttattcattttgcctgtaattgcttattttattattttttttcttatacttttagggatttcagacaatcttagcaatcctcaaattgtcagcatctttttctaagctgctggtgcatcattcatttgacttagtaatattccatcaaatgtcttccaatatcatggaacaaaaggatcaacaggtacagtgtttttcacttgcatcctaaatgttatgtatttatctgactctaattctcatttccactctttttagtttctaaacctctgttgcaagtgttttgcaaaagtagctatggatgattacttaaaaaatgtgatgctagagagagcgtgtgatcagaataacagcatcatggttgaatgcttgcttctattgggagcagatgccaatcaagcaaaggagggatcttctttaatttgtcaggtaaatattcaaggcctcacttttgtctttgctcagtattcttatagaatgtaagagccctgccattgtgtatctcttacttatatcatattattcttcactacagaaatttaccagtttattgcaattgtttgtgtcttgtagtagatttatagaattccagaagtaatagggtcctttaggtgttatccagtctaatctttcatttcatctgtttacttatcttgttaagttgataaataacttttcaaatgtgtcccttagtaggcatctctacaacttagtctccagatacactccacataacacatagttctaatgttttgataattttttaaccatttttttccatggttttagtttctttgcctagaaagttctcccctgagggctaccacacatggctatgcaggctgtggatggcacacttttgtcggtgccattcacagtgacatgagttgctgttggccaaagttgtgtaacactggtctttctttccttctctcttccctcctgaaccatgtaaacatatatctatctgattgttctgctctcccttcaaaatataattcaaattatctttctttaaagccctccccatacctccaaacctccaaacaaaattaagatttacttcttttgtcagtctatgaaaatatatacatatctcttgtatacttggtgagttgtgtgaaaataacagtgtacagtgttcatctttgtatcattcagaatatcgagctcattgctttacatatggtgtgtattcaataaatactaggttcattgcttatatttcagatttgtattatttgtataagtgttagagtttatactagcattcaggtagcactatgtctattttctagaaatttaatatttctaacaaagcaattatgtagtgatttaatacacattattaaataatcaataaagtactatgtttgccaatagtttactttttaaaccttactgtatttaatatccctactgtatttaatatcccacttgcctatggattgaaatcaatttgttgactgttaagattaagttaatactaattagtaatcaacataaaaagaaaaagaatttgtaacccattttcatgcattacgtttatgaattaaaatcacataaacaatctaattatttaaatttagtcaaatttcttttaagcaagcaacaattaaaatagttgctccgctttactaaagataattaaatttttccatcaataatttaatacatttttactgtgcatcttttgcatgcagattattgcattaattttaattgaaaataccgaagaactaaaaagaaacttccccttctaagtccacattaaggaaacaacatacctaaaagcacctgatacaactgtactacattccccacaggaaatcatttctactattctttcaatttatccaaatctttctacccaacaggatttttactttattcctctttccatattcttttggacttcatatgcttagttttatcttttctttttaaaacgaaatcttaaatccaaggattatgtattaggtttaaagaatttatcccagttgtcagaggttatttatatctagcaaacaataactgctgattaaatcttgtggatgagtttgtcgtatgtaccttatttgtgccagagcaaaataaggtaatcaggactatttattcatttaccaagaggttacatattgaaggactatctagagcaagggtggagttgtgttagactttctgcagagaatttgataatggaatgtacatgattggtagagaagaatatggaagtttaatactgggtatgcaaatgcatggataaaaacctcaaggtaaaactcatcaaatcacagtggaaaaagtatagtgaagtctgaataaaaataataagaggctgggcatggtggctcacatctgtaatcccaacactttgggatgttgaggtgggaggatcacttgagccaggagttcgagaccaacttgagaaacatagtgagactccatttctacaaaacaaaccaacaagcaaaaaaccatgtatgatggcacacacatgtagtcctagcttcatgcagggtggctcatgcctgtaatcccagggctttgggaagtcaaggcgggaggatcatttgagcccaggagttcaagaccagcctgggcaacatagttagacccccatgtctacaaaaagtcaaaaaattagctgggtatggtggtacctgcttatagtcccagctacttgggagtctgaggtgggaggatgacttgagcctgggaggttgaggctgcagttagctgagattgcaccattgcactccagcctaggcaacagagccagaccctgttaaaataaaataaaataaaataaaataaaataaaataaaataatataataaggctgaggtgggaggatcacttgagcctaggaggtcaaggctgcaggagctaagattgtgccactgtacagcagccttggtgacagagggagactctgtctcaaaaccaaccggtcgggtgcggtggctcacgcctgtaatcccagcactttgggaggccgaggtgggtggatcatgaggtcaggagatcgagaccatcctggctaacccggtgaaaccttgtttctactaaaaaaatacaaaaaattagccaggcgtggtggcaggtgcctgtagtcccagctacttgggaggctgaggcaggagaatggcgtgaacctggaaggcggagcttgcagtgagcctagatcgcgccactgcactgcagcctgggcgacagagtgagactccgtctcaaaaaaaaaaaaaacaaaaaacgaaccaaccaaccaaccaacaaaacaaacaaacaaaaaaccaacaaaaccaaacacttctatcatgctcattaccacctgggcactgctccaaatactttacacaatttaatccttacgacaacctacgaaaaggtccagtaggttctaatgttattcccattgtgcaagtgagaagctgaggcactgagggtttaaataacttgcctaagaacaagctcctggtaacagtgtgaaatctgcctccacagtgcctgctttaatttcttggctacacagcagattcatggtagtggtggtagtggtgttcattttctctaaaataacagtttgaataatttggttttgataatgcactgcatttattataaattagatgatcagagaaagattgcagggataagaaattatgcttttgataatctttagttatattcttaattttcttcattattatttaaatgtaaaaataaatatctgtgagcagtagtattttcctgtcatgaagctgaaattactttcataaatatgtgtgaatattctaaagagaatgactctgtaggatttaaagaaattaattcttatttttgctggcatttatttattttatcagattcactttctcatatatgtctctcttcatggcaccatatgcctaaagtcagcttggatagtttggatcctccaaggaaaattccttccacaaacatgtgcagcacacagtgctagataattaatagagaatataaaatgggtttcctgtttcaagatggtttgtaggtctgtatgtgtagggcattgacaagagagtaaaacataaatcaccttagtacaaagtaaggagtgaatggcatatcttagagaaaaaaaagttactgggctataagagaaggcatttgtgagtttttccctccctccccgcttcccttcccttcccttcccttcccttcccttcccttcccttcccttcccttcccttcccttcccttcccttcccttctcttccctcccctccccttctcttccctcccctcccctcccctcccctcccctcccttctcctttctcttccccttccccttcctcttccccttccccttctccttccttccttccttccttcctcttccacctgccttccttttaattttgctatgagcccttaaagaggattttagtaatttgctacttaaattaaatatatttgctagatgttgtgctaggcttcaggaatacaagttggattgcagtaatgtaaagccctttgcattctagcaagaaaacagatgggtatgtatgtttgctcagtgctacattaaatgaaatggatgggagccgggaggagaaatggtgtgtttggcctgagaggttagtagcaaggacttctctgcaagaaagtttgaagccaattcttcaagaatgaacacctttttgctgggtgaaaagtagaggaaggcatttggggtaatagaaatagcataaaaggtaatgaggtttgaaaaattacatgctgtgtttggaagaatgtcctggagcagcagcgttttagaaggtttttaaagacgatggtgacttgatcagagctctgtagtgctttgaggatgggttgaaggtgggcgtacttggagactggtgggcatttaattggtgccttccaaccacataaatgaatgtcccctcaaatcccttggaaacactttaattctagaaaattcaaaaattgtccccaacatctttttcctctgagttggtaccctggatctttgggtcttcttttctttccttttttgatgttttattttgggtaatgaaagtcacacaggttttgaagccagcagatttggcttcaaatccaagtctcagttgcttgctagctgtaagggacaaattatatatcttttctaaatactcatctataaaatgggagtaataattgctatggcataggatttttttaaaaaaaagattagaaatcatgtgtgtacagaatttagcacagtaactgatggatattatttctattacctgttatcttggtcttctagttgatagctccttgctagcgtctagctcctttccatagctcttcctgagtagggccagcatgcagtgccacagcttgctaaggcttctcctggattgctgagttgttctagtttttgtggcacctcacatgctaacccaccctgaacacatgctctgaaaacataacatttagaggaaggttgaagactgagagacaaggtatatctttgaggaaattcagatgcttgtcttgaggagctcaggaaagctagacacgagtaatgactgtcgtttgtgtgtggcattaataaattttacaatagctatgtccccatttagttattctatgtcacaaataaaggcaggacagtagtatttactgtgttaaggtactggtttcccaggtatcttacagtgagaagacagaagctcagaaagtgtaagcaatgtgcatatttggtggagtctggatgtaaacagagatcttgatgccaagcctgtggagctttgtctccatataatgttgtctctttcataataactgactgtcatgtggcagattattcatgctattctgacattgatggcattaatatcatcttattttcccaatctattcaaggatcagttttgccttattttattttgtttcattccaaattggagatgtagagaaaaatcacatgaagtttgatttgccagtctcctaaaaggaagaaaaatgtagatttttaatatacttaattttttttctttaataggtatgtgagaaagagagcagtcccaaattggtggaactcttactgaatagtggatctcgtgaacaagatgtacgaaaagcgttgacgataagcattgggaaaggtgacagccagatcatcagcttgctcttaaggaggctggccctggatgtggccaacaatagcatttgccttggaggattttgtataggaaaagttgaaccttcttggcttggtcctttatttccagataagacttctaatttaaggaaacaaacaagtaagtaacaaggagaatattttttacaattcttatttttaatagtatttttttaagtcactagtcttttagtggttattcatgccagtttgagggaccttaagccaaagatattgcaaaggtttggattttttttttttttggctatgaaatacttcaaaatgacatttaagttctttatgagatagcaaatagttatttataaaaatagagcaaaatagtggaagctttttgaaggggtactttttaatatatattttttattattaaagtaagatatccctgtttttaaaggaaatataaaattataaaaaagaaaataaaaataacttattttatctcttataagtaattaatatggatatttttcctaactttttatatgcttacatgtacctatgcattcaaatgtatgtaaaagcatacacacatatttatttggcatttttaacttagaatatactttatatttcaattgataatgcattttctttatactttcaagctcatgtgtattttgtacatattatgtgtattgatggtaagttaccatcttctgacactatttttatcttttgagctctctcatttgttcacactaaatgtgtttttagcgtgaaagctcccagctttccctgtgttaacttagtcccatgcccatctccttccccatggtcatcaaactccatgaatcaacaccttaaggaccatcttgcaagtaacatgtttgcttctctcatttttatgatgcactcactagcaaaacaccagttttggtcagtctaccagtctactttttccctcagtttcaccaagaaaactgagtgctgctagagaaaagtacccatccatgcaatttggtgcctttatacatcaaggtttccaaccgctcagtaggctccaaaagttccaatcaggctgaattttcctcggtttctcaaacacttcgtgtacccttacttccagtctttttccagtgttactctctctctacctagctctaaattctctcttcacctggctgtctcttcattcttcctgtctcagtgctatcaccagtctggaaggttctcttacatgaccctatagcactttatttctcacatatactaccattcaccacattatataatttaatttttcatttttataatctactttttggtaaattgttagtaccatgaagtcaatgtcaattttgttcatggttgtaaccttaccattgatactagtgttttgcacatagtagattatcatttagaattaagtattcaatattggcaaaaaataaaaattgtgtaatacattatgttgataagcatgtgtggaaacatgcttcatatattgatatgaatttaaattgtcctcttttgaggacaatttggcaatatctactaatatttttaatatatgtacatacttttttgacctcacaatgtactgttaggaatctatgatacagacattctcaatgtgcacaaaaattatgtacaaaaatgcacattaaaacattgtttataatagcaaaagagtaggaaaaaaacctaagtattccccaaaaggaactattcaaataaataatggtacatacatgttgtggaatgctttgcaatcattgaggaaaaaaaaacgtggagcaaatttaatgtcctgataaagattacattactccgtggcaaaaaaaagggcacagacagtgtttttactatgctaatgttgatgaaaatgcaactggaatatgatagttataaaagtttgaatatgaaataaaaccctccagaaatgggttccctggttgtctctgggtctttggaaattactgagacatggttagatcccatgtttcattacttaaactagtcttatgccaaaaacctgcttactttaatcttcaatatccgatggagaggaattgtgggcccattggagagggacagagggagatttatcattcactatattctctttgttctgtctggagtttttaccattgacacatcttacccagttaaaaaaacatagaattgtcatttgattaattggagggtataaccatgatttcactggcagctggtctgagtaaagaacactttgggtcatagctttcaaacatttttcaggtagtatttgcctaagtgacatatttgtgtgtgagctcatcctaccgggcttcgggataatttcccatatcataacatattactctggaaaaaggaaccatttgggtatatgggtatagtgtaagccatagtatcagttgccttcttggggtttatcatatgggtccaccacatatttacagtaggaatagatgtagatacatgagcatacttcactctgctactataattattgctattcctactgttgtcaaagtcttttagctgattatctacacttcacaggggtaatatcaaatgatcccccaccatgctctgagccccagggtttattttcctttttacagtaggaggcctaaccagcattgtattagccaactcatcactggatattgtactacatgatacagcagtatcatgtagtaatatttgaagtcattacagtagtaatatttgaagaaatcttcctggctgtatgtagaacaatgaggactcagccaacttattcttcatagtagagctaatacataatgtaatgaagttgtgagaagaatgttaactttgaaattccatcaggtttcccaatagtcataatgaatcactcagcaaactttataaaaataacaagatcctttatttagcagtttatgtgttctatgcattgtgctaaacattttatatgcatcatttcaattactctttttcatcaccatatactgtatttattatcatcttcattttccaggtgaggacactgatacccagggagctcatataactcacaaatggcatttctatgacttgaacacaggcctgtctggcttcaaagcctaggccttttcctgaataaagttagttccatagagattcagttttgctgtctacatgaaagcattgtgtacatggttatgtttttttaaaaaatatatgatctgccacctgttaattattcaggatcactagtgtaaggtgactttgaaaggaaaaatagaaatattctccagaagcatagcaatacgtaagaactttggtcctatgtatgtttatttttgcataattgttgatttctaagttgctggtgtatctcttattttcagatatagcatctacactagcaagaatggtgatcagatatcagatgaaaagtgctgtggaagaaggaacagcctcaggcagcgatggaaatttttctgaagatgtgctgtctaaatttgatgaatggacctttattcctgactcttctatggacagtgtgtttgctcaaagtgatgacctggatagtgaaggtatttattataaaaaaaaaccctttatgctttatatttacacactgacattgaacaataggacccaagacaaaaacctgacctaaatcatctggaaaaacttgagtagaaatgtgtttattatcgcaaacagttaagtttactaattttggttaaagtgatgggtcaaggaagtgtgtctctgtgcttctaaatgttatactaattggttaatggttaatattccaggaaacaaactctgactagactggaacgagattccacgctctgtcattgactagatcctttcgtggcttgtgtaagccccttaaccttgttaaaggtagtaatgtcgactttgcagggttatacataataattagaaaaaatgtatgtaaaatgtctgcaacaatgcttggcaaacaggaagcgcttaataaaaaaggtttttatctttactatagcttaaaacaatattaatattttaatagctcacttgagataactttttaaaaaattaatatggtgaaatatataatgacaatgattagggctgatgtatttagcattagcagtttggtaaaaatggagtgaggggctttcttattaatatagtatgattgaaaacactgggtgatagaataaggatatttgagagggcaaaaaatgagagttgttccaaaatattgtgtctcaagtcaaaccatttttaaaaatcaagtgtagtgatttatatacatatataatttatataaaataaaatgcattcactttaagtatatattttcatgcgctttgaaaattaacatattcatgtggtcattgtcgctattaagttatgcaatattttcattatccaaaaaagtttcttcatgcctcttcactgaaaacatccccttcccctggcccccctgacccttagcaatcatttgcttcctgacaatgtagattaatgttttctctagttttatatacataggatcatacagtgagtactcttttgtgtctgttttccaaaatgattgtactatgttctacccccaccagcagtacatgagcattctggttgctctacatccttgtcagtacttggtattttcaagttacttttagctgttctagtggaggtttaattcatttagatgtaattttcatttccctgatgactaattatgtagaggatgttttcatgttcttattggccattcttatttttgtgtgaagtgttgaagtattttgcttttaattgggttgtcttattatataagagttctttgtatattctagatagaagttgtgacaggtatatgtattgcatatttttttcccagtcatagcttgtcttttcattttactaattctatttttaacaaaacagaggttttaaatcttggtgaaatgcagttttccagtttttttcttttatggtttgtgctttttgtatcccacttaagaaaccttttcttagcctaaatttgtgaatattttctcccatattttctcttagaagtgttaaaatctcagctttggcatttaggtctaaaacattttaagttgatttttgtgtgtggtgtgtcaatgaagagttgacatttatttctttctgtatggatatccagttgttccaacattacttgttgaaaatattatataattcctcattgaattaatggaagctttgttctctttaattgactatttaggtatggttctattttagcattatttattctgtgccactgatttataccttattcttatgccaataccacactgtcttgattactctagcttaatagcagttcttgaaatcagatagtgtaagtcctctggtgttcttttaaaaaaaattgttcttattattctaggttctttgcatttccatataaatttttaatcaactaactttatgctgggatttttattgtaattaagtccatatttagattttatatagaatttatttataaattaaatcatattacctatgattttaatgtaatctataatatataattaatacataaataataatttatatagattatatctataaattaatttgagggaactaatatattaataatgagtcttttgacatattaatgtgatatatagttcaattagtcttttaaaatttctaacagtgtgttgtattggatgttttctgatactattatagatggtattgtatttgaattctaatttccagtagttcactgttgatatatagaaacataattcatttatttgtacatgaattttgtatcctgtaaacttactaagctcacttacgtgttccagtaccttattatagattctacaggattttctttgttcacaattataccatttggtaataaagacagatttgctttttcttttctaatatttatgtcttctttttttttcttgtcctattgcactggctaggacctccagtactatgttgaatagaattggtcagactgggcatcattccctggtttccaaacttagaggaaaaacatacagtctctaatcactaattatgacattatctgtagtttttcatagatgcccttcatcaaattgaagaagcttcttcctagtcatttttggagagcctttttttatcattaataggtgttgaaaaatgctcttcagcatctgctgaggtattcatatttttcacctttattttgttaatatggtcaaatacactgactgattttctaatgttaaaccaacttgcattcctggagtaaatctcacttggttatggtacattatcctttttatatagtattaaattttgttttctaaattttgttaagaattttgcatctgtgagagatattagtctgtagttttatacttccttgtaattatgggagtaatgctggcctcttgaaatgaattgggaagtgtttcccattccacaattttctggaagaatttgtgtaaaggtattttcttcttaaatgtctgatagacttcaccagcaaaggccatctaggttttaaatttttgtgaggaggagatttagaattatgaatttaataactttgatagatgtatgattattttaattttcttttacttcttaagtcagttttagtaatgtgtaactttcaaggaatatgcccatttcatataagttgccaaatttatttgtttaatgttacttatagcaattatttaattatcctgttagtgatttaattatcctgttaatctcttcaaagaatcagatttttgttatattgattttctctattgtttgtgttactttctcacggacttttgttcttatctttattgttcccttttccttacttatttttattttaattgactctttttatagattcttaatttggaagcttagaacactggtttttagaaccttcttattttgtaacagaaacatttatttaaggctgtatatgtccttataaatatcactttcactgcatcccaatattttgatgtgtcctctttctattcatttaaaaaaatttaatttcccaaatgtccaacaatgatagactggattaagaaaatgtggcacatgtacaccatggaatactatgcagccataaaaaatgatgagttcatgtcctttgtagggacatggatgaagctggaaaccatcgttctcagcaaactattgcaaggacaaaaaaccaaacaccgcatgttctcactcataggtgggaattgaacaatgagaacacttggacacaggaaggggaacatcacacaccagggcctgttgtggggtggggggaagggggagggatagcattaggagatacacctaatgtaaatgaggagttaatgggtgcagcacaccagcatggcacatgtatacatatgtaacaaacctgcatgttgtgcatgtgtaccctagaacttaaagtataataaaatatatatatatatatataaatttaatttcctttgtgacttctttgattcacgagttatttagaaggctgtcatttattttccaaatatttggagattttctggataactttctggttattggtttcagtttgacttttttgtgctcagataacctactctgatgatttctatccttttatatttattgaaacatgctttatggattatcatatggtctgtcttggtgatgtgccatgtgcaactgaaaagaaagtatattcagctgttattgggtcaaatcaataggccaaattgtttggtaggatttctcaagttttctgtgacttcactgacttttctttctatttattgtatttgatagagaaatattgaagttgtaattgaggatttgttggttgccttttcagttttatctgtttatgctttgtatattttgaagctctgttgtttgttgtgcaaacattaaggactatataacaaaggactatatataaaaataattttttaaataaagtaaccactttatattaatctaagtttgcagttagtatcattttcttcctctggaagaattcccttttacatttctagcgcagatcttccagaaacccatatgcagattactggagcactttttccataactgccccagaactcccagctatctcagtctccataaatgttgatctctatctcctcatctcaggaaagccatgagactgtttaaatttcttcttatgtatatggcccttaatttgtctctaagcagaaggccagagtgatcatagggctcacataatttgtttcccttctttcgggtattacatagtcctatgctgtctgttgcccagtgtctgtatccagtcatttaatatatttatccagttttcttgttgtttatgtgagtaggttaagttcacatttgttactctatcatgcctgaaagaactctcttcaagtatttttcaagaaaacattagaaattttaacataaaataattataaaatgcactatgctgcttgtacaaataatgtgctaatagacatttcacacacatataaagtgggataattatgataatttaataatctttataattatgtaattgttactaaattataaattatattttattaaaattcttaagcattaaaataatttaaactatagaattaattaaactttagcaatgaaccaggcaggaactgtttatatcaggatttatactgaatattataagggtggtatttggatatacagattttataatttggttttgacataaaatgaattctttctttttctaagataaagagtaggggaatttaaaatcataattaatttttcacaaatgcattcacattatttatctttaatatgatttttttattgatctttgttttcttgtaaatttattattttgaaagtactgccttttccttattttataaaacaattattgccagccaaatttattgtgtttattttaataccattccataaaagaaaccatgaaacatgaaattcaaatagaaatttattaaaaattgctgactgttaaataatttgtgtgattacaacatttaaagcaagatttgaaaaatttataagaaaaattcagggagttaatccactctctttcctatgctgctagaccctattccagcggtctccataaaaaaaattcagagaaacagaaagcagtaacagtgatcagattgcatacaaactttctgcacacacatatatttgttataacttatgtaaccgttgattgatttggctttttcctgctggactatgagctcctctgaggaatagatttattttttttctgcatatcagtatcccgtgcttacccagtgtctagtctgtaacagccattctataaatatttatgggtgaagaaaaatgttgttgaatttttaaagtgaaaaaccaacatggcttatcatctctattttaaagattttacaaagggaatggactgtgaaatttccattaataaaaataggtctaatcttccatgattgaactatgatagaaggatcttatgattgagtaagctttttgtattcaccttcatgttattttatcattttcaaaataggaagtgaaggctcatttcttgtgaaaaagaaatctaattcaattagtgtaggagaattttaccgagatgccgtattacagcgttgctcaccaaatttgcaaagacattccaattccttggtaagttaaattgtgcaattgtgattatgttgtgttttgctgctgacattctcttgataactaaaatttatgccaaagctaggaacaattggtagggatttccctgatgtatgaaaactataattttgagatttttatatatgtaatagatatgaaaacatattagatgtaaattatgctcaattcacatttgtagtcttttgagtatgcagggtatgaattttttggggcacatatatatatatatatatacttacagtacacttcaagatggttttcttctttcttttcagaactccatgtctgaaaagagcccaggctagacctctacctaatggtgtgggttggtcccatgaacactttagctagaaatctgatagtgatttctaagaaaccagacagaagtctgaaggacactgaacaagatggagtagcataatataattcattgttcatctatctatctatcatctatctatctatctatctatctatctatctatctatctatctatcatctatctatcaatcatctatctattttggtgtattgaaagtcatttaattttttagatacctttattattatttcaacctcttgtctgttttggaactatggaaggactatggcatatttgcatgaggagtctgataattctagttgaggaaattgggagccaccttattctcaggttcactttgaaagacctgttctaacctattctccaattttgattatagctgagtactaaaaatatgagggttgttttgtgttaattctagatcttaagatgggtgaaatgaatgactgtagttgaatcggttaaattagctgtcagtctttatatgctctttcgaatttatatataaatttagttataaaaagtagtttggttaatgagaaattatatggatatagctttttcactcaacctttctgtttttcagtttccttatatttaaaacaaaggagaaagagtagatgctttctaaggtcatttgagcactgaactggagttttcttttatcctcataattgggttcttagtttttacttgcctattttttcccataattataaataccattaaccctattaaaatttcatggttccttccttataaaaatgtcctcttctccaataaatgacagcaattttattataaattattttttaataggggcccatttttgatcatgaagatttactgaagcgaaaaagaaaaatattatcttcagatgattcactcagtaagtatttggatgtaatcataagtaaatagatattttgggcagaatgcagtgtttggttgaatttcctccaattattcaaatattcttggtgccagtttcatcttacataatcttcatatatatttacctaatgattccttccataagctatagaaaaatgaaacatacatttaaaaatttacctttcttgaatattatagaacacattagtctttttttttacaagttttctgaaatgtaaataacacctccaccaaggccactcttcatcctctcctccagttttctttctttcttttttttttcacaccacttacaccacctgattaaatgctttttatttactgttcatctctgccactggaatgtaaactccatagtttggttttctactgaatcttcagtgccttgaagaaagcctgattgctaggaggtgctcactaaacttttactacatgaatttaaattatttgcttatatttccattgtttgtttgtttttgacaaaagggtcatcaaaacttcaatcccatatgaggcattcagacagcatttcttctctggcttctgagagagaatatattacatcactagacctttcagcaaatgaactaagagatattgatgccctaagccagaaatgctgtataagtgttcatttggagcatcttgaaaagctggagcttcaccagaatgcactcacgagctttccacaacagctatgtgaagtaaatttaatttatccttgtaactttcaagacatttgaagagcttttgtatttatatctaatttgcataattaagtcgtttaaaagaacattctacttttgtgtcactgggtgataagtcccccgtgcctctggtttttgcacacatatcttagtctgtgtgatgttcaggagcatctttgagggcaggcaatggaaacagatctgattagaaaggaattccaggttctgtacggagtacatgttaaagtctgtcaagtgtatattgattatactttaatcatttaattcaagtaagacaacttcaacaatttaaattagattaggtaaactagaattagacctggtttggtagtactggctctgactcagctaccaactgtgtgacaatatgaacatgtcactccgcctgctctaatccttcattttctcatctgtgaaatagagattcaactaaatgattactgaaagtttttttttcagtttaaaataatgtgtaacttaaagatttttttctttttggtcaaagttcctgtcttgtaagaattaaagtataacatagtttgttgataggatagctctctgaaaattgactttgctcaccatttgtatgtactacagatcaaaatagttttgaaagccaaagaagatatcataaaagttaaaattattttaatgcaaatgtttaaattgttaaattctcaaggctgggcatggtgactcatgcctataatcccagcactttgggaggctgaggcgggtggatctttttgagttcaggagttcaagaccagcttaagcatcagcaaaatcctgtctctaccaaaaatatgaaaaattagccaggtgtggtggggtgcacctgtggtcccagctacttgggatgctgaggtgggaggattgcctgatcctgggaggcagaggttgcagtgagccaagatcgcaccactgtactctagcctgggcaacagagtgagaccctgtctcaaaaaaaaaaaagtcttgttgcaaatgcatttccccctttttaagcctaaaaaattaatcataattttgagatgttttaaaggcaacattacataaattttaagtatatttaagggatgttttttctctaaagtttttatatctggagacagagagaagaaagaaaggtgacccactcctccagccatgccctaatgtctaaaatgtgtctttctctcttctccacttctttgccttgctaaatacttcaagccacccagggctcaatttaactgtcacttcatcactctctgcttctcttcctttttccttctaccctccagccaacctacccacctagcctccatgtccataacacctgatgctttccacctaattctcattcggtcatccaatttgatttaaaatacctttgcccccactagactgtgaactctttgaggacaggacttgtttcaggcttgtttctgtctattcccagtgcctagtgagatctgacatatggtagaagtttagtacttactgaattgatttgtggaggaataaatgtctgaaacttggtaatccttcaattaatatttgttaaatgagcaagcaaaataattttgggatttagtctagttaaaacaaagagaattggaagagactgtgacaaggtgagacatgccggcattcaatgactggacaagctcagaaccttctcttagggaaatttcaaaatgacaccattagatggcactttgtttgtttgtttgttattgtcaaagggtctcatctatgttccttttataggaacatttcctgattaaaccttgggaataattttaaaatctttacttcagaataagttaatgagggtctgaaacaaaagcaggaattttgaaacaacttctggggctaagagtggttaataagcctctataatgatatcaaactctagagtttctcgtgtggataaatatattgataaataaagaagaccatagagaagtgattgattttggtattttagctctttgagagtattacgtacctaagttttaaaaaattgacataatgtgtaagtaggggtttgctattatcattataaaattagaaattgcttaaaaatagaaagtagaaatttgaaacaaaaagtttcgtaaaaaacaggaggttctaaaatgaaacacattataagtaactatttttatagttaaatcttaaatatatcaaaatatgtaaaatttctgacagcatttaaaacatattcccaggattatattgtactttttgttaaatcattaattcaaatatttgttgaggcgtattctgcttccattttgctctttctggaaataatttacaaaaaagctgaaggaagctttcaactctatttttgtgaacctgctttttacaatctacctgttgtaattttcctggttttacccatgctacaagcagagacgattgggccaattagtatactgaaattctgttgtggattgtgttttcaactttttgaaaattcttgatggttctagttaccagaggtgtgtaaggcagaaatattagctagacttaagttcctcagatggttcactttagaattttaaactattgtcttttcagactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaagggtaagaaagagctcattaaaaataaaagggttgcctaaatatgctgatgttaacaaaatatgctgacatttttatagcaatgagttttaacaacatggtgaaactccatctctactaaaaatacaaaaattagcccagcgtggtggtgcgcaccttataatcccagctactcagaggctgaggcatgagaatcgcttgaacccaggaggcggaggtcgcagtgagccgagatcgtgccattgcactccagcctgggtgacagaggcgagactctgtctcaaagaaatatatatatatatatatataatatatgtattataatatataatacatatattatatatatttattatatataatacctatatattatatatatactatatataatacttattatatatatactatatataatacttattatatatataataaaagaccgaggcaatgaatattacaacttttatcaactgacttacatttttacaactaatttttaaattaatgagtcctctttgatgctgttctttgaaagcaaattgtttttgatattttttctttaaagcatatgaatttatgcaatttaatcattatcttgtctcttgtgactagaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttggtaagtgttctgtgtgggtctcctccttaccaggccctctaagttgtacaagatgagtcatatatggaccctttagttgtggatttaaaagtggcatttcagtttaaatattatgctggatttaaaaaataaaattagcaggttggcaataaaacaaaatgctataaaactatgaaaagacatgaaagaaacataaatgcatattggtaagtgaaagaagccaatctgaaaaggctacatactattcgttcccaactataagacattctggaagagacaaaattatgaggacattaaaaagatcaatggttgtcaggggttaggggagggagagatgaatagataaaggacagaggatttttagggcagtgaaactgttttgtatactatagagggggatatgtgccatggtacacttgtcaaaacccatagaatgtgcagtataaagaatgaaccctgatgtaaactatggactttgagtgataatggtgtgtcaaatattggctcattgattggaacaactgtgccaaactaatgcaaattgttaataataggggaaaatgtgtgtggggtggtggtggtggtgagggaagaagggatttattgaaagtctctggactgtgtgctcaattttcctgtgtatctaaagctgccctaaaaatagtctataatttaaaaaaattatcacatttttattgtcagaggttaaaatgatagttacttggcctactgtgtagtaccctgtggttccctttagtcttaaactaaacatgcacatggctgcctgagctgggtaaggcatcctgatactgagatattgtttttcatactgaagtttcttcagcaactttttgtatgataaatatgattactctttgctgttgttagaaataaaattaatcatttaatggttttcaaattagtgaagttaatgtatattcattcagctcttgtgctttgcaagacattataataatgcaaattattatcatcacttttattaaaagttgtagaatcccctgccttctcttagcatatgaaataatagaggaaattatgttcatttgtatcctaaatgaacattttaattttaaggaacaaaatacttttatgacaataaacaggaattccccatattttatcttccttcatagagaatactcacatcttgccacccatgtgtttattctatacctgactcagtaaaataatttttaattctatttaatagcagaatatggcttaactacttattaatagtattttaatttgtcagagctttcagaaactaataatgatcaaagccatcttaatttggatagtattttcctccttttccgcgccctcccttcctcctaccctcctgaatattggccactttccaaccatgatcttgaaactggggatagagttgttgactcactcactagtaagcaaagcaaactcggtctctgtccttaaggaacttgtgattaagttcagagcacagacaaacattaagtaatgatggcataaataaatgtaattttatattgtggtgccttctgtggaaaagtttcaggatgctctgtggtacctcaggggaatctgattcagactgtggagtcaggaaagcatttctgtgcctgtgacatttaagttgggtctggaaagaggagcatccaaaaggaccttgaagcttgtgtatggtcagtgtgtcatctcagctgaatctcacaatgatcctaatggtcatacctaggacaggtatgacctctgcccaattgaggaaattgaagccgtgagattttttgtgtgatgcttacaggtgcatacaattaattatcttgttgtgaaagtttgaatggaccccagttcaaaatctgtttgctttgcactacacaatcttaatagtttgagaagtggtcttacatttgagaagatgccccatggaggtgacatctgagcaggaccactaaccattaaaaaataatcccatgtaaatggtgaaaccctgtctctactaaaaatacaaaaattagctgggtgtggtggcgtgtgactataatcccagctactcgggaggctgaggcagaagaatcgcttgaaccagggagtcagaggttgcagtgagtggagatcaggccacagcactccagcctggcgacagagcaagactccgtcaatcaatcaatcaaacaatcaataaatcccatgtaaaataaagttttagttctgtggccttatgagtgttttccatacagcatatgaaactcaagactctgaagtcttaagtggagaatcatttcgattcatttattttgcgaataggtgaggtataatagctatctttctgcttctcaggaagacagcttctaggagtgtcctggaacattttgacccttgaagattgtctagataaagaataacccatatttttaaccttgaaaatgctaataactaattcctcaatccgttttcctagaaacggtagatttgtagatctctcaagtgtcttagtgttcatctgatctagctacactcttttacagataagaaaagagactgtgtgattttctgtttcccaaattgtgtttcacagaattttatttcttggaggtacctcatactgcatttccttcttaacaattcataaagtaggccaggcacggtggctcatgcctgtaatcccagcactttgggaggccggggcgggcagatcacaaggtcaggagatggagaccatcctggctaacatggtgaaaccccatctctactaaaaatacagaaaattagctggacatgatggcacctgcctgtaatcccagctactcaggaggctgaggcaggagaatctcttgaacctgggaggcggagattgcattgagctgagatcacgctactgcactccagcctgggcaacagagcgagactctgtctcaaataacaataataataataaaataataaaaaataaaaaaatcataaaatataccagagtattgagaactcagatattttactttattttactgaatgtttcccaatctcttaagattatatgatcgaagaatacttttattaaataacacccattattattccatagaacactctttatgagctagtaccataaagaatttttgtccttataatatactgtattttagtaaagtgttcatagttgttttgctatagttatttaagagtaattctagttaatctatatggtatataataacatcacacataatttgaaatgaatattctaggaatttttactttgtacaaatgttgggtagacaaatttatatttaaatagctgtttagcttccaggttaaaaggttctggtaagtatagcatattattttattgtttagtggaagtattaaggctattaccttatttttaaaagtggatttttaaaaattgtcagtgtgagaatggaaatcaaattaagtgacacactattggtagctgttcttatttttgaatttaatggaaatctggttaaaatgattaaaatgtttatctcattttttttcttttagctgctatgcctttcttgcctccttctatgacaatcctaaaattatctcagaacaaattttcctgtattccagaagcaattttaaatcttccacagtaagtttattgttattttaattttaaaagcacattagctggaacagaacctttagaaacatgatttcgatttagtcatatagaggtaattgatttctaaacctactcaacttgatgtttttgtatgtatgaatgattttcactagataaaagacccaactcattacttaaaatggaaacttttatatttatttagtggatcattgtgtaaaaacaacttaagattgtttaattaattgctgtattagtataatgaaatgagattatactggctatcactttaacttttaaaattttaattgtttgtggaacttgatatgttgccaaaatacccttaactttcacattatgcttaagttatgtttgagtgaaattttgggggaagattaggcaagtttatgtagttccaggtttttgagatattttggttaattcatgaaaccagaagcttcctgttaactttaaattcaggcattaattggatcttgagtgtgttgtaatcttaaatgctattctaattatatcatacatgataaaccaaattcataaaaatatatgtgtaaatttatcttttcctttgttttcttgctgtcagctattccttcaaacactatggctttttagaattgacactaaaatgctgcttgcatgatgctgcaatgagctcttctgtgagcttatatttaggcaaataataattagaatttagccatagagagtgttacacaaacctataatagctaaattacgtctagctttagaatgtgtttaactgttctaactactctacagcggttcatctctttaatcttcctaataatgccctacgatagccactgttattatctccacttcataagagatgaagtaacttgcccagagtcatagttcttaaacactggtggttcaacttcaggctctcaaatcacatgcatactcatatgtcaataatgctagttttgacgttacactttattctcaccctggggaaaattatttgtgatgttatttcatgtattttggaaatactcatttggtttatgtcttttctgtgtattgttttagcttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagaggtaagacgattattgccacttaaaaaatatactttatgatttgcatcattacaaattatcattttaagtgatatttagcttctaaataccaatttcatgaaactagaagcttcctgttaactataaattcctgtcaactataaatccagatttccattaaatttaaaaataagaacagctactaatgatgtgtcacttaatttaatttccattctcacaccgacaatttaaaaaaatctacttttaaaaataaggtagtagccttaatacttccactaaacaataaaacaatatgctatacttatcagaaccttttaatctgaaagctaaacagctagatataaatttgtctacccaacatttgtacaaagtaaaaattattagaatattcatttcaaattatgtgtgatgttatcatataacatattatagattaactcaaattattcttaactgttacttaactatgacaaaacaacttagaacgctttgctaatacacaagatagtataaggataaaaattctttatagtactagctcataaagagtgttctatggaatagtagtggatgtcatttaataactataaattcaaaataagcattgtaaatatcaataccattcaatttttttttgttttttaaacaagttgtaagcctaccctatggtaaatggatatggtaacacagcataatttcctcaaaaaattacttttgtgatatacttttaaaggattatatgaatatatacataattatagatgaatgtgatgctgtgtgtcattgtatcaccaaatctctgtccaatctgttaacagactcttaaataaaccatttttctcaagttgttactggcctgtatactgtattacttgtttttcagctttccttggtacattcttaaatttctgcattccgccaccatgctatcaccctaatggatcaaccttttttgttttgctccattctctctgttgtaaatctgaaattgataatttgtttgtctcagaaaatattatttttcaagttctagcgtattgcctacaaaaaccaaaagaattaagtgtctgacactgtgaggttcagcaaaactgtgcatatattttgctacctgattttttgccagcaaatgagtgttttctattataaatatagtatatattgcttaaaaatttggaacagaaaagaaattactccaattaggatgccacctaaagtataagcatgtagctgtactttgagaacactaaattgcatgcaggtttgtagtgactaggtcttcttgcctttactgaaggagcagaatgaagtcacagataatggataaccaaatccattttgtggtaagaacttccttactttcaatgtcttgaagagatgaagtatgttaccaaaggagattgggttttttaatattacagatgagtgacatagattgtttgggagtaagtttttatatgtaagtttttatgtttttaaacacatactgacaacttatgacaaacctttggaaagttttaaaactctgttgaaaggttgtgcaagctgctgatggaatctgtgagcctttcttgtttcttatcacgttttttggcagagcacatttcttccttcccaccaacaggttttgcccttttttttcccattaagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggttagataatttttttctatttggttttactaaatttatttcagattttctactctctgtgactttgatggacatatattgttactatttagggaaaaataaatagtaatatttggcattaatatgctgtgtgtcatttgcctttcatttaatgaatgtgtttctgtggtgccactgtagagatttctcattcttcttagccagactaatgttgagagcggcttctcctccttctgtttcttttcagtggagtagactctaaaagaaaataagtattgctatttggtctctggttaccaattacacaatctaaagaaatacagcacagtataataacttctcacactgtatttcatatagcaactagttaacatatgcctcttacatcttaaagcattatagctactgacatcatgtgaaattactaacttctattttgcccattaggatgagtaatctactcaccttgatcagttttgaaagcaccaaaacttctcaagtatcactgtttctggtctttacactttaagcactttaaatatctttggtaatggattttatcctcctttttgttccctttcagcacatcggtcttattactttctcataaaatcctttgctcccttttccacagttactgtattaacgttgcagacctcagctctgtcatcacctctcaacttgactgtaatatccaccaaggcagagaccatggctgtgttcactcactattcaaatcttggcacccaacacagtgcctggcatacaattaatagttgtttaattaccagtgatttatacttactcattctcttctgcctaaaatctcttaaatttatatttaacttcatctgtttttatgaggaaggattttgttttctgaactcctgagcttgatttcattttaaaggagtttgttatcttttgtgctaattgtggctacccttcatcctacccaattatttttctctcttgaaactggaaaagatggtcatataaaaattggttcagttcttactaaacatttagtagaactagctttcagtgtattatactgtattatctaactaaatatttttaatatttaatatttaatttaatatataactaaatatttttaaacatgtttaacattttcagaaaagacagaaagacctagagcagattagaaattgtaggcatcatttgctttttgaagaaagacattttttcaaatagtggtgcattcttaagaaataaatcaagaaaggtaatgttgctttttggtcatatcatcaggaatgttggtcagattcttattagttacaggaatgaattgatcactactctgatgtaaaattcacttatgatttagtctttttctctaatttgaaactgtggcaacattttaacatatttcaaaatatatctttctctatccattatatttttgataacactttgactctactattagtttaaaggtggttttttagctacctaaacacttctatttcattcaggttttacattaagatcattaggaatgaaagctaacatctgctgatagtataatagtttatatttatttatgatgttatgtgatctcactatccatatatactattatatgcatatgtgatatacatgaatatatagctatacatcatatataccatatatgaatatatacacacacatatataatgtaactaatatgaccctattatcaagctttaacagtatacatatatctctaccttgtttctatgtcatatggactttgtgaaattttgaactttataatttatagggtttttcttttcttttcttttctttttttttttttttttgagactgagtttcactcttgtcacccaggctggagtgcagtggcctgatcttggctcactgcaacctctgcctcttggcttcaggcgattctcctgcctcaacctcccaagtagctggaattacaggcacctgccactgttcccggctactttttggatttttaatagagacggggtttcactatattggccaggctggtctcaaactcctgacctcatgatccgcccacctcggcctcccaaaatgcagggattacaggtgcgagccaccgcacctggcgtataatttgtagggtttttcatactatttaaagacattagaatatgtatacatgtatgtatatgtgtgtatatatagaggtatatatatattgcatatcgtattctaattagtattgcaaacatattttggccttttgattatttctggtgatagtgtaacatgttttctttggtgattttaccaaacattatcaactaccctaaaatctctagcaaaatatatgcattaacagtactctgaaagacatgtacattattagttatatgagatatgcactcttctggatactatattttagaatagtgtgacatgtaaaagaactcacctaaatctcaagtatacttttaagcagtttattattttatttttatctttcaaatactaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtatttctttctatagaattttaaaattcacttttaccatttgtttggaacagggattcaaaaactgagctttctgttctaatatccagaaacctggtagactgtatggaattattccaaagcccttcatttctcctaattttacccttgcctccagaatggagaagaacatggagggatatgttaggaacaatttggtgctaggtactttgatcggttgctgacaaatatgctaaaagtggtcaatcctagtaaaaacccagaatagttctctaaacatggtctgttgtttttctcttattagtatgctaaataataaatagtattattctcccagatttttttttaaaaaaggattcttgcctgtcgtttgaaagattaaaaaaatttgtctctaatctttatttaggtcgtgaggaattctatagtactcatccccattttatgacgcagcgagcattgtaccttgctgtctatgacctcagcaagggacaggctgaagttgatgccatgaagccttggctcttcaatataaaggtgatttgttctgatcatttgaaaatagaaaataattcatgtgtctgtgtgcgtgtgtgtgtgtgtgtgtaagttaatttattttgggcaaacaattgcttcagtctctttaaatactttcttaaaagaagcactaaaattttgaattgggaaactttccgagtaatgaagtcataacatgaaaattgtatgttccatgttggtgaatgttattggtaacctgaaactcttttatgctgtaaaacttgaaaatatatatgttcaactgttttttaattatattatttcttaaatgaaatctaaatttttctaatttaaaataagctatattaaagaaaagcaatctatatatatatatctcatcaactttgtactcaggggccatttagtgtgaaattcttcagattgtatcctttaagtggtcccagattattatgctgttacatctggaatctcccttttgttgcttttctatcttttcctttgttgtcttgttgtcagctattccttcaaacactatggctttttagaatggagactaaactgctgcttgcatgatgctgcaatgaactcttctgtgcataaagtccttaaaaagcttgtgtcaggacatttaaccatgtaattggctgcatacatgcttgttttgtaatttgggtattttttaatgtttcttttattaacttttttacagctagccaacgtgagcaaatagtacagtggcagtcatatttgcttgagtggcttttattctttcattgtagactccaaattggttgactttaaaacgaatttagaagattaaattcacagataaggaagagaaaatataaactatatgacgttaatttgatataatttgtgggtttatgaaatgcttattttatttaggagtgaataactcatcttaaggcatgaagatgggaaaggaaaactataccactaccgttatatatgccacctaaaagggtgaagaattgggttaagaaaggccaaaaatgactttttaaaatgtcgtaaggttacatttttttcttaggtttaaggaaaaaaggacagttgttcttttcttcttctgaagtctgctagtttctcttttccattcaagtgaatgtcacggaaagcaaatatcaacaggaatgtgagcaggcccagtttgaaagcaaacacaagagggttttgtgtctttccctccaggctcgcgcttcttcttcccctgtgattctcgttggcacacatttggatgtttctgatgagaagcaacgcaaagcctgcatgagtaaaatcaccaaggaactcctgaataagcgagggttccctgccatacgagattaccactttgtgaatgccaccgaggaatctgatgctttggcaaaacttcggaaaaccatcataaacgagagccttaatttcaaggtaacatggtaggctggtagagaaatgtaatttattgattctcaactgcctagaaatgtcagaaattttgagaagtgagcaactcacttaaaattgtgggttttctttccttgttgctgttagcattattaaagtcctttccattttaaaattatttatgccagacttcatttctaattcatagaaatgggaacaaaaaataattagaggaacctgagagaaactaagagaccgtttctgggatactgagaaaatgtttctgagagagaatctgagaaaatgtttttgatgccttttctgattcaacttcttatagtggtgattcaatcacaagggtaaaggtgaatactgaggtcttgggatcatctttcttctattattctttaactgttatttttccatttcctcttttcttttggaattcctgttttatggacatcttgatcttttgtgccactcattcatgaattttgtcactgtgattcccattccaatttttttccctccgtattgtgaggcagctgttttatttagtcatgaagaccactaacttggttttcagcagtgtctcactaattacttagttcatacaaaatgggctttttattttaggaattatgttttaaatgtttaaagttatcttctcgtaagccaaatttttataaaatgtaaataaatcagttatcagagagaacacttttttttttaaatacttggcagaaaaaagaaatcttcactgggtactacagggagtgtggtgtaaactgtactgaaaaatacccttgatagttccatatgacaaacataatgatgaatttcacttagtctgtcttggcttagctcaatagcactaatgatcaagatactggctgataaatagagtcctatttggcctgggcagtcccagcataattatgtaatagtgtcccactatattctcaaaagcattccaatttggatgataaattatatagtcaccttggttataactccatgctggccagttagcttagttctgttccatttatatagattatgtgtgcttcactccaaaacctaatgagccatttgtaaaagtgatggcttttgcggtgcccagggagagaatttgtatgtttgtatccttcaacacacatttattacagttattaaaaggttttattgatgatagatggtaatgtcatgtaaaaatgacatattatttatttgtagactttcctattctcttgttggacatgtaattagaaactaatatgacttaaagaaaaacaaatacacaaaatttattcatccaattaatctcttaatccaggtgttttttttttctgagactatacccatacttcaataactttgttgttactgagaatattttgagtttccctttttgtcattgttgtcagagaatgtatcatatctttaaaaagacttgttggaggatgagtttgttttgaaaaggcctgaatttagttgatgcaaagtcacagataagatggttcattaagctgtattaatactgcttttgtctaatagatatcattaccaataagtcagactagtttttcttttggcacttataaatcacctttgaagacaactttttacaaggaaataaaacaaatgctttgagaaataccagtattattgaaagaaaagtatatattgctaatggatgcagcattctggcataatggtttgaaaactcatttgattgctttgtagaagaatgactctttcagatgacccagggcctgtgagcctgccagaacttgaaaattctttcttccctgaggtgcttcaacctgaattcaaagagcagcttttaatctattagagatcattttttgtcctctcatttatttttcatatttgcctttgatcttagctcttctctaatctttttctgtctcaaccttattaacaggtgtctgtgcagacacttttaagttttgttttttggctcagcctgtcagttaactgataatcatgctgaaaggagaagcaggacaaaacagagttcaatgctgacaatactccttttaatcttgtccagcccattagcagagcaggcatctctgtgggccttgagacgtagtcccgtaaaactcatcccgtttctacttgatttgctttctttgagaactcttgtttatttttatatggaggtttcctgccttggattaaaacataaacctcaatctgaagttcaatttcatcttaatttatgaacgactaagagagggaacatgaaaagtggaggttagtgaaattatctctaattctctgggttaagagatacatgaaaacagtctcttgagtaaccatttgcaggtaaatatggaagtaatggttatggttgtctctttaagtttttagtcacaagtagaaaaagaccaagttaatttttttctgtgtgtgctgaatttctatttgtagtaagtgtaagaatttaagcagaaattctgattcgtattttcagataaaaagaatatgtaatttccataggtccagaaatagggagagtttgccatctggtggttcttaacggcactctggatattattaagagttgcatttctatttaaaattatattttaaaaaacgtttggaagatacttttattgtagaaactatcctcttagggccattctttaaaaaaatcttattttatatatttctcattttgttgatagtgattagattctaagagcaacagaacaatgatcatcctctcctatcagaatcactgatgtttagatgatttctcattttcccaagttcaaggttccatgaaaaacatagcttgagtgggattttatgtctctgcgtttcactgttgatatatatgtcctcccaatataacattttacaaataaccaagcacaaaatttaatattttaccttgaatatttaaaatataataatatccaaaagctcttgtaatttgtactgatatcttatactagcgtgtctgtttcacattaagtttaatgtcttaggatataaaaaatcttttttatggttagtgatttatcttgtttttttttccatggaatttctggatagcgagataaatatttccatactattttatttgatatttccaaatttgcctctgaatcaacaattttcctattttaatttcattgtacttgttccttacaacctaaatagctttttattatattttgattttatttaaaaatgtacttctgaataatatatctgtttctgtaaaaactgttagcactgaatttgccaaccatttgacaaatacacaaataaaatagatttttacggcttgtcatttgtaatttcatagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggtttgtgtttttcgttccttattttcaaagctcagctgtagtaacttataaaagtgtttctgaatcttttatagaatttacattcaaagttgagagaatatccatacggttctttaataggccactgatttttttctttttggaagatcatcatgtgtgttcatgacaaatcatgtatcatgtcataagaaaacaaatttagaaatcacctaggagtaaagcagtggaaagagtccctgagtgggagttaaaatatttgggttctagaacttgtctttactattcaggagctgtggaaccctgaatagtcaaatgacattcataatgtcaaatgagtttagtgcatgtgaaagttatttttatattgcaaaggggaattattgttggcatggtctaactgggacgcttggagagtcaatggctccctgagatgatgcagcttctgagtggaagatctagctctcttgcatcaaatattgatctcaaagatgaaaattctcaaagcaacttcagtgctaattgtgtacttgatcatattaccttgctagaaatgtgtgagttgtttgatagtactagagtaagtgactgggaagctgcttttgatccctagattctgttgtataaaaaatagcttcccgtggtttatgatctgttccttttccccatcgttcttaaggtatgctgagatatgctgtgtttcttatctgtatttgaaaataaaacatgtctttgtagtgtgtattcagcaagcgaaacagaaaattatgaatttctacttatgtgtgaaatatgctctgtaatgcatgtcagtgtctcaaatatgcttaaatatgatcattttatgtagtttaaaaatactccattataatattggaactttagaccataggatgcacagcttctagtcccagctctgtcactagctatgctgaaatttcttcacctgcaaaatgaggaagttggactagattttttctaaagccccttgatatttgttctagattccatgtttcactgtttgatgactttttactacaggagtccttcttcattttcaagacccagcactgcagttaagtgacttgtactttgtggaacccaagtggctttgtaaaatcatggcacaggttggtgtcttttatttttgtggcacgggggttatggtcaaagcatagaacagatggcgcccagagcattgagcattttagaatttgggtttagttaaggcagaaacttttgtgaatttggaaaactgtggaacatttcacatagaagactacttgaagagcttcatggaagaaggaaagatgtcttgagttcacttccatgacttggttttcaagccacatacagatgtttgtatcactctgccccatgctgctttactagatcctgatgatgtcattggtttggttactgaattagtcaattgaatgatggctttgtggaaatccttggggtaaacacatataagaaaattaggttgctgagcctgtgaaacctctatctagataacatggaggtgagttttgacttaagtgaaatgatctgagctttaaatgcttacgattttgaaaactttggatggccttggttatagctatttttttcttatatttcacatggaaaatgatttttttctccaaatgataatccattaccaatgagtttaattagttataataatccatctctgtagctttgacataaaagaccatttgagcaaaacatactacctcagggcttttcaaccccagcatgatgacattttgggccagataattctttgttgcacattgtaggatgttagcagcatttttggcctttatattcgagacgtaagtagtatcctctagctgtgacaagcaaaaatgtatccagacattgctaaatattgcttggagaatgtgaaaaattaccctagttgagaaacattaagctactgatttgttgatgagtaaaatttatagttttgcatgtggctgcccgagttcctaaaattattatatatttttatgttagaaatatctcttccaattaaaccataaaggtaattaaattcactcaggcagccttgaataattgttcctaaattccatctaaggaaaaaaaggaagctattgtgaagagagaactcagttgaggctaaatcctgtaccatggaactcaagagcatattgaaacattgcaatcagcaattatttgcagtgtgtcagttattactattttggtaggtatttttaaattagattttcagccttctgcacatatgtcatggataatgtgattttactcaattattaaatgataatggagacagtagtgtgacccagagcacttacttgagcatcagcttgacctacgtttcagtctctttaattacttattagctctgtgaaatttcttaatgcattaagcctttgtttacttactttttaaataaggaaaataacaattatcttctatattgcctccctggttcagtgtaagtgaggggtaaatgttagctaattttatattggatctatttggcaatttaaagaatgttaatcaggaaattttaaaaaattcagaactataaagaggtacttacgtagttttggaaagtgtgtcatgtatggggacaaataaaaaagatgtgtaggtagctgcatcctgtacagcaaaggaagttttaaatatatccagcaattttgttgtcctagctggcgcacaatagttatcaggaggtaactcaactccacatagtcaaggaaaagctaaagttgctctctaaagtggtgtgtttccatgtcactatggaacacttgaagttgcacacatgtgaacattaggatgggtatatcttatacagtagaataaggaagaggtttgcatcagaactccccttttaaaaaaatgcagattttcactatgactgcaataaaattcctgaagattctgtggagtaattaagttgaaactccatgaaagttcttctcattagcatagttataaatatgataatttaagtaaaaattaagttaatttgagccactcaaagttacttttaaagacagatttaaaatgtcaataaaatgataatttaaatttccgattaacctaaaaaagaagtgccatcatttttatttatgccaataaattgaaatataatgtcattttatcactaaggtttaaaggaaatgaaatctctaaataatcaagtgaaaccaagagcaacttgtctgacagctattagcaaaaataaataggagtattcaccttcatgaatcaaggcaagggccggaataatttcatggtgcagaagctctaatgagcccacccactctatgcgccccgagctgttaggtcactaaacttattaaaaaaaggtaccattaaggcagggagaagtttacaagactcatttaactgtatgataaaagagatatgaaagagacctattcaattaatcaggtggaacattaaaaagcttacatggcaatttaaccttgataaaaatacatgggagaaatacaaaggaatttggaaaattctctttccttgaataaggcatcagttagctattcaggttatgaggttgaaggaatgttaggagctcttttaaaggtgataaagtcaagataatgttgcagattttattcttatgtaacaaaccccctcgaaacttggaggcttaaaatgtgaacaatttatcatttctcgttcttctgtggcttgactgggctcagctgcgtggttctgctccacatggtattggcaagggttattcacttggcttcattcattaaactgagctggaaagtgcaagaaaggtacatgcatgtttttggagtattggtgcttctccatgtggcctatcatatggctaagttgggcttcctcgtggcacggtgatcacagaataattagacatctttcatggtggctggttaccaagagaaatgaagcagattttttctgtcctcttaaaggctaggccaaggactggcaaaaatattaattctgctacattctagtaaccagagcaaccacaaacctagctcagattaaaggggaaggaaaagagactctatatgaatagcacctatgtatagggatggaaatgatgtgtccatctttggaaacttccactataaatagtggtagcacgctatagatccactaggaaaatcaagcacaaactctttaaaaaataagtgtatcttagtaaaatagattagaataactagataataatggctaacatacatgaggttaatatgtgcttttcaaagattagctcatgtaattctcacagcaacctttccaaatggtactttattagcccctatgatacagatgaagaaattgattgacagagaggttgaataatttatccaacggtacacattcaggaagaggtagagttagaatttcaaaccaagtagtttgactccagggcctatgagtttatacattcatagggctgatattcaaatgagagaagagaagtaataaataaacatataatatgttgagtggtacagagtgctacaaagaaaatatgaagtgcagttggagatgaattgtcaaaaaaggtcttagcacttaaaaaacactaaaacagcaaacaattctctttaccacctaaactgtaagagcgatctggaattgctataaagtacacaacatgggagaagtcttaaacaacagtttttattatttataggcccattgcacactgtcattaaataccaatatgttcaatcaaccatgcattcattgattcaataaatactgtacatacaaaatagaaatacagaaatgggtaagacaagtccttgggcctaaggactttataacctggtatttcactcaactacatgatagcataaataatgtttgcttctgtttaagtattccttaaacattatagatctcccaaagaaaattaaatacaaacctctttttaaagtgaatttgacaaagcaaaataaattggaatatatagataaatatgctaaaatttgtcatatgtactttgcgtactttacatgtgttatttcattctcagggcaatctaagacagtcacttttattatctcattttatagagaagaaagctgtgcagtaaagaaatcaaatacctttcccaaggttacagagctagtagtagagcctggatttgaatctgggttctgactgatttttaactgccatgacaaggatcaaagctcaaagtgtgatctctgtgttagaaacatcggggttgctctttaaaaaagccgattctcaggcctcaacccagacctactgacccagacactgcaagtagaatccatcaaaatgcagtagttactttgagaatcatgaaactctgctacacagtctgtcttcctattcatggaagtcctctcctagtatataaatgtgaagtaatatttctatttcaaacctgtattgataactgtctggaagataattttcctgggaatatattattgatgagactgcaaaacagatgtgaggtattggattgatctttccattgtagctagggaaatactgatgttcattgtttcagtgaagttcaatgatttcctatccgaattaactcccttaatttaacaattttttttttttttttgagagtgaatgcccctctgggcttctaggccacatggttgctagagaaattaggtactgtgttgcacttgaaaacactaaaatctttctgactactttcactgagcaaagagacataaaatgctttaaatttgcaacatttcagaaaataaattttagtgattatttatgactcgaatctttcagattttgacagtgaaagtggaaggttgtccaaaacaccctaagggcattatttcgcgtagagatgtggaaaaatttctttcaaaaaaaaggaaatttccaaagaactacatgtcacagtattttaagctcctagaaaaattccagattgctttgccaataggagaagaatatttgctggttccaagcaggtaaagaaaaccttaaaaaattaattgctacatggaaattcactatctattcttttaattgtcaaactaactgtagtctataatagatgtattaaataaataaatatattttgcttctagtgtaaacctcctactgacatgtatcatttattttggaataaaacattgcatctgacactttaacaatatagtaaatcacttactttatgtgtatagttactagttggcttatcactgttgaaattatttaagaaaggtaaatagtggagattaatgtgtgtgtgtgtctgtgtttgtgtatgtgtgtgttcttaaacaacactgagagagtttattaagcaagttctgagaagatagtgagttttcaacagaattttaaaagcatttatggcatcacaatggatgcctatgttttagcctatactatggaaatttttcctactgctctaagcaactgggaaatttataaagtaatatgatgttgaaatgtgcaaattacattgattgatggatgcagccaattttaaaaataaatatacactttttttctaggacatgtatttttcaggatttatataagattacatttgtctatgcataactaattgtaataatttatgtattagtgcacagggattaccgaaaatatttcatgcatctacatctgagcatgcatttgaattggttattgaccactgaatttttggtgtaggaaaaatatgtagtgaaacaatgttacaaaaagattacaattgtttggaatgattaccttcattgactttaagcagtaaaatcatttgctcaacaaggttgggtgttttgtgaggctgtataaccatagtgtccttttgcctttagtttgtctgaccacaggcctgtgatagagcttccccattgtgagaactctgaaattatcatccgactatatgaaatgccttattttccaatgggattttggtcaagattaatcaatcgattacttgagatttcaccttacatgctttcagggagaggtaagtatctaatgaagacttattagatttttagagactattaatttagacttattaatttttagagaaattagggagatggcatatgaaaagtaatatgccattttctcagagtttacttgtttggaaggcagctgaagaattagaaaataagctcataaaaccttggagtaggcaatctaaagacacacaagcacatataacctcatctaatttgtcaggaagaaaattccttaggtgctcactcagatcttgactgtgattacattgtagggactgtaattatctcttttctgttgcacagccactaagacatttacaaaaaaagagcaaatccggtgtttataatgctaactctttcttctaaaataaatagagacattttggtactccaaagggaaaatatcattttggggattaaaattagctttacacaggtgttactggtttccaaaataaaccttaccttgattggaattaatcaacatataggtagttacattgcattaaaaagttcagaaagttttgcgtttagcatgatcaaaaacttctttttaaaaattatgaggatttatttatgattttctttcttcatctgtcgagcatattaaactgcttaacagcatcaacctgaaatggatcttaatgtgcaggggatttaactctttttattgtaaagttgtggataaaatatttaatagatatggatgaggactcatatcagtaacaacccaatactttatttcaaaatgaatagatctgtattacaatcacttgtgttgtgtgcagtagattttttccctttaacttaggaagcagttaataattaatggctccattttttagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggtaaggaaatcaatttgaatgttttcaattgcaacactaaagaaatttaaacttaaaaaaaaaaaaaactttaccttaaagctttgcgacagtatgaggtttagacaaggtgttgagctctgttttgaatcatgtaggctgtattcttttgggccaagttgtggaccacattgattctctcatggaagaatggtttcctgggttgctggagattgatatttgtggtgaaggagaaactctgttgaagaaatgggcattatatagttttaatgatggtgaagaacatcaaaaaatcttacttgatgacttgatgaagaaagcagaggaaggtatgttttgatacaacttacaaatgcttttaagtgatccttcaatacttatgaagtgacttttaataaatgtaaatattcttatccataagggatgagttgaaaaatagtatattcaattatagggacagttcagaaaactgaattatatttattaccaataaaatcttgtattctagattcagaaaatgttgatttgagggtttgaatgctggcttattgagcaacataacctcatctgtgaaaccggaataccaaccacatctatctcatagaactgttataaagattcaaatagacaatacatggacctaatttaccaacatgtctgccatataataacagctgcagcttcatgaatgtggcaaaagcagagagtagataactttctagtcagatgtctggtagtctgcagcagttcagaattctacaagtgaacgtaggaataagtttttaaaattccaagtagatagatactaagtgaatctttaaaatgttctcaaatttcctagagaaatataggattggttagaaagggagggattagaaattatagaaaatattccattattttttcacatcaaaaccacaaatttatgtatctccttaaatgttgtttttatttaaaaaatgttttattacttctcaggagatctcttagtaaatccagatcaaccaaggctcaccattccaatatctcagattgcccctgacttgattttggctgacctgcctagaaatattatgttgaataatgatgagttggaatttgaacaagctccagagtttctcctaggtaattctttttgttaatttgagaataaaaattaggatgtaattttctccttataatttagaaaatagatttcataattatattgtcatagattttactgtcttcatatatttgttataatttttgtatttggaatgatatattttaaaggaatataatattacagatctggaatttgttttgcacataatcatgtagactaggatcaagatgaggatgagattatcatggaagcagaaatatttatgaaatatatctttgtatttgccttaattgccagggatatgggaggcaaataagacagttttcaggtgagttaagtgaagcagccatattttataaaatgacagaataggtaaaggaagcacacctcagtgtagccatagcaggggttttatgactcagtgtgacaatgctgaattctcatagaaatattcattaaaagccttgaaattaaagtcaaaagtgttacatggtgacatactcaaatacttttttttttttttttgatatgctgaacaatttacatttcttggttccgtgaattcaatcagtgattttcagtagagtatgatggaaatcattgaattcatgtagcatgtttaggtgctcattgagaaaaggtgaagtcatggtaaccatgtttcaatattctcatttgtatcttgacttcctgcacatggatttttgggcctaaaagatgtttttaaaacatgctcatacacttcagaagatgaaaagtgtatgcattataactactttgggaaagaaacagtcaacatatgttactgtatgtcattctgtagattacatgtgtggtttctcatgtctctcagaataaaagctaatgtctttacaagacctgcgatgctgtgatctgtctggctcctcggttatcatttttaaaaaaagatatactttgtacaaatttttttaattgacaagtaaaaattgtatatatttatggtgtacaacatgatgttttgatatatgtatatgttgtggaatggagaagtttagctatttaacatatacattatctcaaatatttatgtggtgagaactattaaaatctactctcatagcaatttacaagtatacagtatgttattattaactgtaggctgacatactcaagttttaaacattcctgagagtcattgggacaactatgaaatgcattagattgatttaatataaagcatttgaagacaattttgaccttactttgtttagtttttgttgttgttgtgtgtatacatttaattttaatcaaattaccccagaaataatgcctaagatctgtcagtcaggacataatattattagcaaaaagttgtccaaaatttgagacatgatatttaaagctaaataaactcctttatacccctcttattggcattgattgggaagtttaggttgaatttaaatgctttggaactcaggaagttaatgtattagtaatagtgggttaacataaaatgctgaattgtccttgctgaatcctacatcttaaccccagacttcaaggtatacaggaaagtaccagacatggtgcatccttcctctgaagaaatcccaaactgtcagacacagatccctaaaatatttctttttcctgcattaaaatgtgtttcagatgaatggacacgttttgagtagtgtatgtggaaacgtcatttacaaagtctgtttagttggccaggtgtagtagctcactcctgtaatcccagcactttgggaggccgaggtgggtgtatcacgaggtcaggagttgaagaccagcctgaccaagatggtgaaacctcatctctactaaaaatacaaaaaaattaactgggtgtggtggtgggcatctgtaatctcagctactcgggaggctgaggcagagaattgcttgaacctgggaggcggaggttgcagtgagccgaggttgtgccactgcactccagcctaggcgacagagcgtctcaaaacaaaacaaaacaaaaaacaaaaaagcaaagtctgtttagctacccatataggaaaatgtttgtgattactctcccttctctagacccatgtcccataaatccataaatcccatgttcatttacagaaagcagtctagataggagtttctcagtctttgagctgttgccattttggcttggataactaactctttcttatcgagggtcatcctgtgcactgcagaatgtttggcagcatctctgtctatccactagatgtcagtagtatctccccttccctcagatgtgacaatcaaaaatgtctccggatgttgccaaagataaggggtggggttgaataccagtgatttaaacaaattaggtgtatccttctaaaaacattttacaggtagcgactccagcatctttatattagagtaatctggagaaggttatgcctctctcaattttccctctttccatttttatttgtagggcagcaatgcattcaggcttttggtaactctttttcccaagatagcagtaactattatgcagtgagtaatacgacccaccttaatagatatgaatagacttgttttgtgaatatattttaaaatataaatgtatgggattctgttcatgcgtctgagaagccacagggtacatttcctctttgtggagctatttatttttctggagagccaagacaggtatttccacttcagtggtgtgatttgaggggttaggaaaatttccttgccttcaattttctttccaacctagatgtcacaaatacataatagtagtccttaactttatttttgttttcagtcacctgaaagacatgacaatccatactccatattaatgcagcggcgattctcaaatagagaagggctttaaaaaattagaaatctctgccgggcgcagtggctcatgcctgtaatctcaacactttgggaggccgagatgggcggatcatgaggtcaggagatcgagaccatcctggctaacacggtgaaaccccatctctactaaaaatacaaaaaattagccaggcgtggtggtgtgggcggctgtagtcccagctactcgggaggctgagtcaggaaaatggcatgaacctgggaggcggagcttgcagtgagccgagatcgcgccactgcactccagcccgggcgacagagcgagactctgtctcaaaaaaaaaaagaaaaaaaaaaagaaaaaaaaaacaactagaagtccctactccaacttgaaatttggatgtatctccctagagtatgtttcttctctatgctgcattgcaatttttctttgttgttgatagttgtccagattgaggggaggcagaacaagatgcatctatatgtttccatctctccgaccgattctctcccttccccctctacttgctttctttctcttttccctcttctgtttacccgattctatttctgattccagtatgtaacagttccctctgaagctctctcaataccaacaatcctaactaatggtttttaaaagtcaaatattaagtactggagggatagaatgagagaataccaagactgataagatgcaaataatacttttaacatatttacaatctaatagaaatacaagacatgctcaaataagttaattattttaatatactctctctgagcataaaatataattatatatgctcattatagacatataaaaaataaataggtagaggctttccatagatgtgtaatttcaccacttgaaaattactatatttccttatagactgttttgtgtgtattcacttatatccatcaagtgactacatttcaaggcactatatgagaaccataaatattgtacaaacaggatttgctaaatgtcggtggagagtaacagtccacggggctgatcatggtcagtttgtgaggcaggcctccaaactccttggggattgagatgatggagtagcagagctcttcaagggtatggaggcctgaaggtacaaagcatgctcaggaaattttggctattgcggtttgtctagagcacttgttctcaaccttacctgctcattactaattctactaagtacagaattaaaagaagaaaaaaatctaatgaccatttcctcctgggactaattagatcaaaatctttgaacccagacattagcgttttaaaaagctcctcagatgtactattcagccaggactggggcagggaaagctactgaactccagccttgagaatgagaagtagaacaagaggagaactttaaaaggatttaggggccactatatgactatggagctgaatttagatttgatttagtaggcaacgcggaataatttgtttctgaacaggagagtgacacaatcaaagtggaatgataggaaaattaattttgcaagagagagagaatgagttggaagtaaggaactcagaaggcctcctgggactcagcagaaagctctgaggccaccaaatgggtgtggtggtagtggaaatggagaagaagggaatgtaaatgaggctacacagtggactgccactgttagccgtggggttagaccacagcaagagttaaaataattcttcaattttaactccagaagggcctcaaaaagactttttgtcttgttatcatcagctatatggaaggtagaataaaaactagttaggagaaaaggtaataaatgtggcttttgataggctgtgattgagttggaagggcataccagtgaaatcaccaacacaaagttggaagtgtaggaaagcacttaggaggtggctataagtgaaaatgtgaaaattctctacattaaagggatagatgaagtcacagaagtggatgacataattgagcagggtatgtgtagagggaagacgggaaggttaaggacaaaatctttacatatatctttcttggagtagaaggaagaggaaatgttaaaggagatttgattcaatgaaacaagtaggtcaggtttctattcaaatttacaacagatataattacaacagatataatttatttagtttttttcgcttggacagcttaatttaagtgctttgtattttcttttcaaaaggtgatggcagttttggatcagtttaccgagcagcctatgaaggagaagaagtggctgtgaagatttttaataaacatacatcactcaggctgttaagacaagtaagaaattcaataatataattatattaaattgcacattattaatctactggaactcttattttgcatacagttgtgaaaatgcaaaataatgaccacatttctacttaagtttaattatgcaatcctagtttgtcttttcgttgtggagtagaaagttttgtgttatttctcctgttgagaaacaaaacactgtatctgagaatccttataatcgtgatacatagtgtgttgtaaaactttttgtaagactcacttacactcctctttttactttagaaccttgctgttcaaaatgtgctccatggacaagcagccaggcattacctaggagattgttagaaatgtagaaacttgggacttttcagtgccatattattgttcctgatactccacagtagtcagactcctagctgcctccacctgcttccagaccttgaagcctagcaagctcctgacttcgccttctgttttcttcagagtatttatcttttacttttctggtctagggagagaatgatttttatttttattgaacatgacttctgtgtgttcagggtgaaagaagaagtttaatgcatgatctcacattgctaatttgattgaaggttagaaatcttaaactaaaactctcactgataagcttgcacctctcttttctggatttatccactttaataagaactgctattgattacttgctacaaagatggagaaagttagcatgcttatcctatttcctactccctgtccctgtccacttcctaaaacttaaaattggttgcattaattttcctgatatagtaacaattataacttggaatgattttcaaaacttttgtttttttagtataccaactctagacagcatggactgactccttgctatgtgagatgaggaaaattaacgctattctttctccttttcccatcaccttctcaagttctttaatttattctattatttttatgtagtgaaagtttataacatttatattctggtctgtactcataattaaattgttcacattttgtctatagtttggttctgagaacaaaaccaataaatgccatttatatatttttttatttgtacagaaccaaaatatttctacttctagataaagaaatgcaaccttctgtcactaacttcttttactaatagaatagtaacattccaaatatcaaagtcaaatggattctctattgttatgtatttatcatcaatttataaaaataaaggcatattttaatttggtcacatttttaccctgatttaaaaaaaaatttgtttttagagatggagtctcattaggttgaccaggctggtctggaactcctggcctcaagtgatcctctcaccttaaccttctgagtaccagtggtgatttattttatgtagctttttgaggttttctgattatatacatatatttttaaaaaacgtacttcaggaaaagatatatattttcatcatgacttcaagtgtttctaagttcttaatcatacagtttgtataacagaatctactttcttcttgaagacattcctcattcagcacatgacttactgctctaaacaggagagatggatttctaggctgcttgtgcagtgattaatctatgagttagtttcctcgccctctttgattactctcaatatttcttggattccatccattctcttggttggattgtccttagtttttgttgaagaatatcttcgagtaatttttttaagaaaaggtgtttgtgaggtaaatgttttcagtccttacatgttaaaaatatcttagttttgccctcccatgtggtggatatgtcatcacactttattttttaggaatctaggcttgaaacaattttcttcaaaatttgaagaaaattccattgatttttagtgcccactgttgctaatgaaaagtctgcagtcagtcagatgtttgctcctatctaggatacctttaatttcattttgaaaactgaaaatttgaccttttgaatttcatttgttttcagtgttctgaacctttacaagtatgtgtttgtgtgtaggttgtttttcattccatctaattcattattttgtgaaaaattgtcttctgtgtattctcttctattatttattatttcctccctaacatttattaatcatttttattgacaactactatgtaccaggttaggtgatgggacatatgatatatatatagtagtaagctaaacccagtcaaggctctgcttctctggagcctatatctagttacttatgattcattattgcttatcattgctccaagagtatatgttagatgacaagccttttgggtctatcatccatgtttgagttccctcttcaagttttatctataatttgtgttacttacttgactgtctcttacaggtttctaatattttttagaattgcatcatctattatttagctttctggtgaattttgttttgataatcatattttccatttccagcaattctttccatcccctctggttgttcctttgtagccatgtttttggataaaatgtccataggtgtttctgttcatgtcaattagaatttttttttgtattacttgcattattgcttttttctctgaggttatttgctctgtgggttcatcttgatctttctcttttatcttgtcagttttccaaattgagtagttttgggtgacttcgtatgaagtaagtactctattgattgttaaagaaggactgtattgattattaaaggtaactagaatgggcattcttcacattcatgtaggtttgcttgttcaagttaccactttctgaacaagaaggttagaccatagacttttaagggctgcatactgcaaagggatactctgttctttaggttacatgggcagggatcactgctgagaccatacctgccaaaggaaggcaggctttgctctctagatgctggacttgaaattgtttcccctctgcttagtgctgcattattttttttgcttcttaatctgctgcagagtatctagatcagggtgtccaatcttttggcttccctgggccgtattggaagaagaattgccttgggccatatataaaatacactaacactaatgatagctgatgagcttaaaaaaattacaaaaaaaaaatctcataatgttttaagaaagtttatgaatttgggttgggccacattcaaagccatcctgggccacatgcgacctgtgggccacaagttggacaagcttgttctagatacttcagactctgttctacatctcttcatagatcaataacttgcagcaatgagtttatcagataaattatgttcacttttcatccataaaaaaagtcatgggaggtactcaccataggattggtttaatccagtcactctggccaattttctttaaaattcctttaaccttggtatattggtttaattccttcagaatggcttttcccattgtgataaactggttccaggcttcacgagtacttattccaagtacagaaggaaagagggtacctcttttgagtacttgtatttcaaaggaatcaaatggcctacataataacccattaaataaatagatgtctctcagccccagtgagtcatctgtgcttttctcaacaagcactatgttcagggcaatgctttgtgctaattggctttaggcctttgttaccaaactgatcactgtggccctgagggtgctgttacttagaatattcccaccttttctgagaggctgatgttggggtcacttccccctgaactaaagtccaggggctgcatgggtgagggttgagtaactcagtactctaaggaggaaaggaaggggaatatacactgttagttaacagtggttattcctgtattctctcttgtttggattctactggggatttctttctttttttgagtctttattgacattaggaatgagagatagaaacagggtgagagaggaagtaaaattaaatgtgaattcttccatcttataccagaactcaactgtatttttggaatctatatatccttacttttcccttgatttattacaaaaaattcttagtggctacactaagtaaattttgtaacctttaaaaaatacatagttataatattttaagtactctgagtaatagaagatttcatgtgagtacaaaatatcctgggggcattttaattattagtaacaacagtcacactgtagttctagaaccaaattgaacattttatatatagaagcttatctgtgaatcaaatctgacataatctcttttaatgtgtaggtaatttcttatataaattgattttttggccttgctgtcagcatgcatttcaaattttacaccatgtgtttggggagctatggtggaaattagtacattaaaaatgtctacagagccaattagtgtataagcagggaggcaaactaagggaatggtggaagaaattaaaaaaaaaggggtgtgcataatgtgcttcttctcttaaaaaaaaaaaaagaaaaagacaacaacaaaaagaaagaaaaatgacatttgacggtcattctaccagtagtcatggggcagatctatattatactgtactattacgctgttttttctttgcaattagtgagttgcttttccaggatagaaaatttggattagacctctgtctgtgcctatgaaaacaagcagagctaacttaactccttctcatcagttctaaccaactgacatgggcattaaaaaaaagattttatctactaagcaaatatgatcacagtctgaagctttgttcttggaaaatcccctctcagggtgttcagcctttcttcttcagcttgcagaattctccatgtttcagtttcctgataaatcagtgggcgccgctactccacatctttgaagctggttgttaagaagcagtgcttctgcagcaatcacagtttaaagcatgaatcaatttaacatcacacaagctatacatttcaacagagttacagtttcagagtaaagtgcaatatacagtataaagcgaatctggaattcaagcccaacaatgtcataaaagaggctgtgaagtctcacatgatgtgggccacagagagggttgttgccattggatcttagctcaaatactaccacatcttcggagtggcctgccatgggccacccttactaaggcaatccctctgtccaagccaaaatgatatctcggactttttttgaattgcagagagattgttgcagccagggattgccttagtaagggtggcccatggcgggcctctctgaggatgtggtaatatttgagataagatctgaatggcaagacttcagccatgtgaagggtggagggatttctagggaaaggggtcagcacaggcaaagaccctatgatgggaagaagctgggcacagcttgggattgaatgaatgccaatgtggctgaagggtggtgattgaagaggagggggagacgagaaggtctggaaggcctggggcatgatcagatcaggtgctgaggccgtggaagtagatgggattttcatctaagggaaatgggaagtcattagagagttttcaggaggggatgatatgtatttttttaaaattgagcattatcctcggtaaacttttgtagtcgttaaaccagagattataagcaggttttacctcatatgccagttgcagctgattagtagtggctatagagaatcctgggctgagaaggatactgtggctaaccagaattcagtagatgagtttgacgtggcctgttagtatgactacactgtgtgcactgtttctgcattaaatgtctgataaaaacagagccaaaggaaaaatagaacttaaaaatttaattctgacagtacagttgacccttgaaaaacataaaggttggggtgctgaccccttgtgcagtcacaaatttgcatataacttttgacctccccaaaaaactgaaccactgatagcccactgttgactggaagctttactgataacataaacacttgattaacacatgttttatatgttatctgtattatatactccattcttaccataaagcaagctagagaaaagagtattttatttaaaaaatcataatgaagagaaatatatttaatcttcgttaagtagaagtggatcattataaaggtcttcaccctcatcatcttcacattgagtgggctgaggagggggaggtagaggaaaggttggtcttgctgtctcaagagtggcagaggtggaagaaaatttatgtatatgtggactcatgcacttcaatcccatgttgtccataggtcaactgtagtttcaaaaccagctttttattactgaaaatacgggaaaaaaaactcagagaagaaatggaaagtttgctatgatccagtcatacagagaaatccatgttcagcctgttgatgcactttaaagaaggagatacgtgggtaaaacctgatgttgaattactcttacatgattttggacttttgcaggagcttgtggtgctttgccacctccaccaccccagtttgatatctttgctggcagctgggattcgtccccggatgttggtgatggagttagcctccaagggttccttggatcgcctgcttcagcaggacaaagccagcctcactagaaccctacagcacaggattgcactccacgtagctgatggtttgaggtaagtaggtcatgttgttttctattcagtgcatgacaagtgtgatccagacttgctctcaggttctgagaacacttcccagtaacactgtgccccagtaacaatttataaacaatttggatgaaaactaccatttccctgatcaaattttgtaatttcagaaaataagagtatggaaaccatgcagaacctcatagcaagtagtaatagactttgaacccacaagttctgctctagaacccatcatcttaaccctgtactgatctgccttctataaaaatgtataagttaggcttcacagtatcaaagtaagtgtcaattacatgattccaatgaggaaagatgagtccatacttctcaaggggactagagtgattcatgttggattcttcggcatgaccatctcacatgtctcagaggcacacctaaccctgcatccagagcaagctttggagagggagcacactggagtggaaaggctgtggtctttgaagacaaaaggcctgggattcatcactattccacacatttagtaactgtgattttatatctctgattcccattttttaaatagtctgtgaaccatgactaatatttaatgcataaaattatgatgacttctgtaataattggagacattccagatgaaactcttgatgtcccctctgccattgctccccaaccccagtcaccctgttacacctgagagtcaccttacattcctttcttcctctctcatttcacagctaatccttcagcaaatcttttcagctctgccaccaaaatatatcttaatgcttctaacaatttctctcactaacgtctaaatctgagccagtatcatctctcattgcctactggtcccctgcttctacctctgtctcatgatagtcccattcctcacccagcctctggagtgatttttctaacatgaaagttggatcaggacttgttcctgttattacccctcccctgccttatttcttgggtacagtgctcagccactcccatccctgaggttccttgcagataccagaggctttatatctgctgttgatttcactcaggaatgtctgactcccagatgtgctctctacttattataaaggattatctgaatctttctgaatcctttcatttaggactctcagcagagaggatgtccgcaacgaccctttgtctctccagcccctataggactattgctgcctaggattctttatgttttcattttttaaaaacttatttattgtctgtcttgccatcagaatctaagtaccatgaaagaagggacttttcgtcttgtttgccattgtatctctagctcctaaaatagtaagccttcagaattactgtgttgacagtaggggaagggggagaaaggaggaaagaaggaaaacagtgcctggggcatagaagccaagcagtgtatgcaactttccttctcttctttctcttctgaaatgctatgaatatgccttttaggtagtatccagaaatgttccttcctgaaagggtccagaaactactgaaaactgtacagattatgaaatgaaacagggtgcagggatttggatttgagttgatgtttctgcttttgaacaccagggggaatcttgggttacattaatctaggtaaagtgcagaatagtctcctgtatttcagtgccctctttccttcatttaactaactctaggttctagtttttccctaattcttccacaaatccccaaagtgtttatttataaagtgaagaattgctattttttaacactgttcgaaacaccttatctctaaaatgacttattctagttctctgaaaccttactttaaataacaaatccagcagtttctgatgaagtaaatgaaatgtcagcatattttaaaataatttgcctaatttgttcttagcataatgccagaaaagctttctggattttgtatcacaaaaggctagtagatttcagtagctatcaatcttctaccagcactaagtatattttaaaaactcagcattaaggtttatttttccaagtatgtttcagcacaggaaataaaatcatgctcctttggagtcccttaaatgctggagctgtttagagtgacatacaagaactttcttcacgttacatgctctctcttcctccatcttgcttttaactgttagcttacttctccaattcaatccacttcgtttgaactctttatcataattctataaaacttatgaaaatacagtcaactgcattttctgtatgtttctgtgtttcaatatcttcaaaatggaatgtactgccttggtacatcacccactatgaatctgttatttctgttatatcccacagttgccaggccaggatacttgtcccatccaggccaaacaccttcccccgaaagcaagtatgcatttgtccaccaggtccttgactctattttacattatctttttagtcaattcatttatttttatgccactcctgctgtcttggttcagtatgtccagggaattatcagaatttcttttctaaaataaaaatctgtttatgcttgcaattccttgacagttctcaattatctgcaaagtgcatccaaacttcttggcatagcatcaaagatctttctgtatgcctcttgcttccctttgcggcccctgccaccccactgcccacactgcattctagccgtgatgacaggcttgaattttcagttatgctcatgtctgtccatcattgtatttgttattcctctctttccaccaagttgtctgcctagagagctcattttccttaagaatttcttcacaaaccatctctactatgaagctcaagtgtgtcatgaagtgttagcttctccaacttgtgtttcttgcagacactctgtgcaagacattgacttaggtgctaaagagggaaagctagatattatattgttcttgaggttgaaagcttacagtctagtaggagagtcaactttgctgtctttacctcagtgtttttctccctctgtgcttccctagcacgtggtacttacatatttctggaatcttgattaaacacctgtttgaggactgtctgagcacaatccttctggattgtgacaccctcaagggagcagagatacaaagatggctttgtatactaaatgactggccctcatagatacctagtacatatttgtcaaataaatgaatgcattctatttttggaataattctattcagaatcagataaagtttactttaagctatgaagaaagaagtctcttagcaactcttacaataatcacaatcaaagaatgactgtttaacttaatataaaccagtttgttttaataaaatatttgacaatagtcatggttacacaatgcataaattatggctaaattattatcaggaaggaaaaatctttacttattatttcaaaagctattttgctagtctattaaaagctattagaactgcacttcttaagattaaattctataattgaacattttaactaaccaagatattatctctttgccactgacattatttcaaattaagcttaactatttctttttagcctttggaaagtattctgaaagagtctgtgttctataaatatacttaaagaggcatgtcttataaaggatttggatactattcaatgatgtatgacttggctttagcttttttattcttaatctctcagcttttctcttcagcaggggaagagtacctaatggcctttcagtaatcccttggtaaatttttctttcaagcccattacttactgtgaaggtcaacttcattagtgtatttatcttatttttttcagcccaaaataggtatattgaaatgaatgggcctaatgtcaaatgtcccgactacatcctggaagagagagaatcttcagctgtattagttgatgcagttaaataatatgtactctccaggccctcatacaattgaaagttcagggtatcgttgctgctctgcttctaatccttccagaagtgattggtgctaggtgatggagtaactattaattgatataatgtgagccaaaaccaacagtcacgaataagcaaaggatttaaatttaactccattaagtcttgtgagaaattattttcaacataggttataacatacctgtgacatcacatgaaatgctgtagtcaatttgacatcatggggcagagaagacagagttggaaatcagaattttatagacatctaatgtgataataacattagtagctgagatgcggtaagctctttgaccatgtttccagaatggataagacctggttgagatgaaaactttacactgtttttttatattaactatcttttactctttgcctgaaatgtccaactctagttgctcgtgattgcgtgggtcagtctccagaaggttggactttaatattacccgtcatcttttccaagacaaaattgtattcattctaactcttagccccaaattttcttttttaaccttaatatctaacatgattaggtttatggtaaattatatactcaaacagaagaagagactaatagcaagcaaaagtcttatattttcatttgttttcatccaaaaagtagaaaatattttccaaacattgggaaacattttagtcagaaaaataaatatcaatgataaatagaatagagaaaaattttaaagctgagctaaacctctatgtggttttaggaaaatcaaaactattaaataaatggcaagtacaacaaaatcccatcaattcttatttaacatacttacattttgaaatagttaaaatattcatatgatcattgagagaattcagaattgcctttaagtaattgttcacatatacaaaagaaaagtctccaaaaattgggtctttgcctgagatagatttgtcttaaaattgaaatcattcacttatcagatttgacccttttttaaagcataactttgctgtgtaatattagacttatatgttttgatttccttctacaatatctcttaactttaagggacaaagtgagcacagaatttttgatgcttgacatagtggacatttatatttaaggaaattaggacaaaaattattataatgtaatcacatttgaataagatttcctgtgcattttctggcagatacctccactcagccatgattatataccgagacctgaaaccccacaatgtgctgcttttcacactgtatcccaatgctgccatcattgcaaagattgctgactacggcattgctcagtactgctgtagaatggggataaaaacatcagagggcacaccaggtaggtgatcaggtctgtctcataattctatcttcaggatggataaccactgacctcagatgtgagttcagaagagtcaaaaggaaaacagagtctatcacattgtgaacagaggtttattttgtgaaaaaatgcaagcatcacattgtgatttttatcattgtattttgtaggaaaaaaacaattgatgtaatttttcagggcaaaaactgaataaaaagaagagaatgtttgatatcaagttatatgttttaaagttagatttgtagattctttagatactctagaggtcataaaaagtaacagcaaaaactttagtctaggtattgttggcacttgtgaggcaaatcaaattcaggtccacaaattctttttcataattctgaaacccaaagaactctgaaaatcccaagattttttaaaaaatgactaatttggtgtcaaaacctaagcaagctgacttgttgcttattacaatctttatttctcatgctcagtgtgaatatgcatacattttgctgcagaaatatatacatgtttgagtacagggggctggccgtgaccctactgagggtttctgtacacatcactgtctaccctgtggaatcttacctccctttcttagttcccaatcctgaaaagcagttatggggccagtgctctgtacagacatgttgtctcagacatcagtttgagcaggaagtaaatcatttaggggttggcatttgtttggagtgtggggaacactctatctttagggaaactttatatagttagttatttgtaagtaaaattacaggtggctatacatcatcttgctgattgcaactcaattaaatcaccgtgcctggcacagaagaaaatatgctacaggatatctcactagggaaaaggttctagttcgtttcctgcgcactcaacttttgtacttagataagcaaatggccccagattccaatgcctggttttatttttgctccaaatacatatatactcttttgttttggatagttacattttagaagtagactgtgtattctcataaacacttcaaagtgtatgttctggctgagagtgtctctgtgttgttcaataataataagactaattatcattttttgagtacctgctgtgcgtcaggcccagtgccacgtatattagagacaagatctcttatcctcatgccagggctggaagttagctattagtttctcatttgccaaatgagaaaactgaggctcagggagattatgtaacttgcagaatatcactcagtaattggccaagataagaattcagtctaaatgagaaccagatccagagatatttggctttaaattctatagtctctcctaaaccatatgcaactctaacatgaagaagcttatttaatcttcactattaaaaaagtcaaaacaaaacaacagagccatgaatagcaaatattgtcaatgagaggtttggaaaaacagtcttaaaggatgaaattccatagacctgatatatttccacctggaaaaagtgggcatgggacagtgattttctcttgaaagatctgctcatttttgtcatgggacatgaaggtggactggaccactcagtttcttctttctgcatctcccaacccagtctttctgttcatggggtgaaaatctgttgttgaagccttgtctgcttaattggacagtggatctctcgggtccctgtgggctgtgcgcttgtacttgagctctgcttcttcactctgtggtctaggccagctagcagccagctgagttcaccttggttcagactcatggcctttcattttcagtatctgacttcctggttttgctgaaaacctgtctaaaatgtaatatccatctgattcttcataccaagccacacaattcttcctgatcccttttaatctccaatattgaatggtggtaacataaatatggagacagatcatgtcagaaacccagggcctaatcttttcttttctgcctactcttctcacaggctgcttagtactttgtaagctttttttttttttctggctgtaacctagattttctctttatcattactctatttattattgttagagcacttctgattatctcagccctaaactctgcctccaattttaaataacaataactcccactcctgctaatactgctactactactaccatcaccaaactttttcttccccaaagcagttctgtttgggaaggaaacagttccctctcatacaatttcagttatcttcttgtcttttccgtttaatgaatcttcctgttaatgttacatcttttaacatggaaacttctagagaaacaaaagacgatggatttgttaaaccttttgggtgtatttttatactaactcttactgcagcgtgtgcattatgagtgtaggtccattacggctgtattaggagcagaaccttccagagcatgagcgatgtgctgggcttgtgcttagctctatccatgagttaagtatctcaatccttaggaccctctgacatatgtgctattattatttctagtctatagatacagagactaaagtttagagaatataaaaaaacatttacaaggtcctatgggacaaaaactgtaggacaaaatgcaaacccaagcagcctgagagcagagctcctggtccagcactgtgatagctggggacgcagagacagaaacaatgcaattattgacagggaccatggtgctgtgtctgtccacattttgaagataattatggtttggatattttcacctttaaataacttggagagtttcaacattaactcagtcagatggatacatttatatcatatcctgctgggagtgacagttaattctgggtcctatggcaattgcacttttgactgagatgaatgctgactgatggctttaacatttaactaatgcgatagtatttaacacacccatataaatactatagtcttcgggtaaataaaatgttaccggctggacatacatgaatatctgatggagattatggaacatactctactcatacttctctgaaagtaaaaaataaaagatatgtttcagtacacaatgtgatatgtactcagacttaattcataaatttctcttatccttcatccgtggatcttttctttatttacttattgcgtttgttaaaatgcaggcttctctgaaaaattatttttaaaaatagtttttagacaatgaatcatattttctcaagtattttaacattgtaatcattatgataattatccaaggggaaattatacttattttttattcatttattcattcatttggcaacaatacattgaacatttactaagcatcaaactggctctaccacttaatagtggcatgatgttcatcaagaaattgttagtgcaatcaagaacactagaaattcattggatgaatttaaagaagcttttagaagggtattatattataattgaggcactttatgaatatataaataatattatgttttcatgctagagatcatgccaatgaagatatttactttgaaaaggagaagattagaagtttaaaagcatttccatattgaagtaaatattcatttccatatcttcacagttatctttctctgagttctctgactcattgtgaaaaaaaatcccaaccttcttcacagctctaccatcttcggattgttgcctagaggggtaaaaactattgtaaaaggatgtgtgcactggatgagaatttagaattagacgaaatgacccctagagtcttttcctgctttaagagcctgtgattccaaattctaacagtacatttatcaagaaaaaatatgctgaacatttaaatagtttttgaatagtacctagatataatagatacctaataaatgtgctcaatgaataataaataactggttaagatttaaataagcctccaaaatctcttccacattctaagaagggaagcataaaggttgttaatgaactagtgactgtgtgggtagctcattatttttaagtactcttgactttgctgttcattatctgtgtggccttaggaaaatacacacatttctgaaaggattatgtcgtttgtaaaatagaaagtccttatctgtctaccacagatgattcttatgcaaatcaaatgaaatgttcaataaggtgtctgtaaaatagtagagagagatgaattaggagctattgtgatttgtttacattatgtcacaggtgcactttattagggatatgttttatcttaattacacaattctttaacttagattttgagaattatattatggttatataggaaaatgcccttattctaaggaaatgtataatatatttaggtctgaaacattgtatctgtaacaatatagtatgtaaattatgctaattcacatgataattatatgtaattatattaatatattactatgtatacaatatatttacatgcatatatgtggggaaatgttatcagttagtgtagtaggggttatcatactcaaattcgatgtctccatccttccaactcttcatgcttttccagcatggtgaggactgctgagctccatcttttgctggtagtctctctgtcaaatagaactgtttccaaattcagtcatttgctccttgaaggctatgaattcatacttcgttatatttttctggctgcatatttaaattactttaacaatcatataagttcattgtaaaaattttggaaataaaaaggaagataaaatgcacagataattttagcaaatgaaataataattatattgggatgtatttcttcctagattttaattatgtacattcccatcaactttttattttgaaaatgtttaagcctaaagaacagttgaaagagtagtacaggctgggtgcagtggctcctgcctgtaatcccaacactttgggaggccgaggtgggtggatcacttgaggtcaggagttcaagaccagcctgaccaacatggtgaaaccctgtcactactaaaaatacaaaaatcagctgggcacggtggtgggcacctgtaatcccagctactcgggaggctgaggcaggagaatcgcttgaacccaggaggcagaggttgcagtaagccaagatcacacccctgcactccagcctgggcaagagagtgagactccatctcaaaaaaaaaaaaaaaaaaaaaaagaaagaaagagtagtacaatatacattcatactcatatacccgacgcataaattcattgattatttactttttgccctacttgttctttcttgctctctttgcgtatgaatgaatcattgaaattaagttgtagacatcatgccatatcacctctgaacagtgtgtatatttctttagaataaggatgtttacttacataatcataataccattatcacagctaagaaaattaattcagttgattttttccacatatttgataactttctgtctatccacgattatgtcttacatattcttttaatttatgtcatagcatatcatcttagaaagtgatccctaagttactgcatggtatacattgtttaaccatttccctttgtgattggatgtctttaggttgattatatttttattattatcacaaatgttgaaatcactctttttttctgaagaatttaaaagtaatttatctgtcttatggaataaaatatttatttccccttaaaagaatttcaggcatgaacccaagagagaaggcttttttttttgttttagttgttgtttttatttttattttttattttttgggtagaaggagcagagagacaagttcaggaaataatgagagtgttagaattttgttcaggttaaagtgagttggagtgaagtttagaaatctcctttctactcatctctcctgtttttaaaacactgtcctggaaatagttaatattaggaacgagaaaaatggtataggttttcctagtacactttatttcttaattatgaaattctacttaataacttaccattgaatgtttatccttattatcattcaaggtaattttattgaagattgaagatatttataataaagattgaaggattttattgtcctgtgtggtcaaccttggggggtgagatgttatgagacaggacaattaattgacttgatcaaggtaccttgttataaaaataacacagcctggtttagaacatctcttcctgactctcttatttggcatatagcctaagtgtatgcctccttggatgtatgagccctgatgttggtcatatttattattttatctgcttactttcagggtttcgtgcacctgaagttgccagaggaaatgtcatttataaccaacaggctgatgtttattcatttggtttactactctatgacattttgacaactggaggtagaatagtagagggtttgaagtttccaaatgagtttgatgaattagaaatacaaggaaaattacctggtaagttctgttttctctacaatgaagattttttttcttaatatcagcagcttcatttttatttaattgtagttgtatgcttaattccttaaacagatgatcattttttttgtttagtgcataaatattcttaaatcttgtgatatattaataaaaatcacctgaaaaaggtagcagttttaggctttttaaaaaatccgcaattaatattggtgtagttaatattatatttagaaacatagagaaggaaattgctgttagaactccacatttggtgatttttaattttcataaagaattactgtgtactcattatcctggaatgttttcgttttcttggagtgaaataatttacatgcaggaatggaagactgaatgatctataataataatttttcataagaatcggtaaatgtgtatttaatgttatcaaagctcatttggaatggttgtctcatgctttcaagaaattagaggactttgtaattcattccttaaccattactttagttctcaccacaaaataacattttaagtttatttagctctttctcatattttctgctttccctttcatttaaaaaatacttttgagtgtacacaatgtgccatgtacaggaaatagagctttatcttttttgggtataacttcaagatcatggcaaaagaaaacttattattaattggataaaccttagatataatctaggttatttcccttattttactagttttctagtgaaaatattcaggtctctgctgggtacagtggcttacgcctgtaatcccagcactttgggaggcccaggcaggcagatcacttgaggccaggagctggagaccagcctggccaacatggtgaaaccctgtctctactaaaaatacaaaaagtagctgggcatggtggcatgtgcgtgtagtcccagctaccaaggaggctgaggcacgagaatagcttgaacctgggaggttgcagtgagccgagattgcgccactgcactccagcctaagcaacaaagtgagactccatcttaaaaaaaaaaattcagttctgtgttctgcatcaaccagaataagctacgcctcttataaaaaacaaatgtgcacaaaccatctgtgaggacataaggattaaatgcttgcttactttgagtattaaaataaaaagtagaagctttattatatgagtaaaagtgtttccaaagtctatttgaaatgcaggtacagaatgaaaatctgttattttattaaatcgttatttgggtctctttttattccataaaaaaaaaatcttttccacatctcttagtggagatcaagttaacaaaattagctttaattttgtgacaagtaaatttacataaatataggattatggagataatatttttctttgcaatgtctggaccttttataaacattgagaggaaatataaccattcttacttatttagtatgctagcatgatgttttttaatgttttagatccagttaaagaatatggttgtgccccatggcctatggttgagaaattaattaaacagtgtttgaaagaaaatcctcaagaaaggcctacttctgcccaggtattcttaaagttttgttaatattttgtacagaacatcatttgcatatatgcatatatatataatcttcaaatatatatacttaaacacataaacacacagagacagaattaaaaatagttataaggcaaacctcctataattttcaccatcccaggcacaaaaaaaggacattgccaaaacctcacatgctcccatatgcctgtctcctcttctcttctttgaaatgcctgcccattattttgcccatttttctgttgactcttttgcctacaaatcaaatcagaaaaaaatttttatatataacatactaatcctttcttggttttatatgttgcaatttctttttcgagctggtggcttgctttttaaatttcttgtagggtgcccgttaatgaatggaatttcttaattttaatatatataaatttaacaattcttctttttccttcttttcctggttattcctatttggtcctgttgtagagcccatctttcttttagagctacaaaaatatttacctgcaatttcttcaaacattttaaaagtttgcttttgacaagattttaatccattggaattgacatttttatctgtatcccattcctttttttaatgtggaagactaattttttcaggttgatttactaaatggcttctccccttttgtcccatagatctgatgtgtccattttgtaatttattaaagataatgtgcatatccacgtgtacactgtcttccactgatcaactcatttatttttcctccagtattaccctgtcttaattcctgtagctttataatgatctcctctccctatttatttttctcatccaggaatattttaaccagtcttaggcttagcttttctatataaaatttagaatcatgctgtcaaatcttatgaaaaaccacattgtcgtttggattggtcttggattgaatatgttgacaatctggagatgatatccttatgatattaagtctttgtattctttttcttatttatttatttatttagaggcagggtctcactctgtcacccaggctggagtgctggagtgcagtggcaggatcacagctcaatgcagctttgacctcctgggctcaagtgatcctgtcgcctcagtctccatcagccaattgtgtgccaccagacctggttaacttttcctttaatttttttgtagagaaagggtctcactctgttgcccaggctggtcttgaactcctggcctcaagcaatcctcccgcctaggcctcccaaagtgcatgagcaactgcacctggccaagtcttcctattctggaatggcatgaattctctctgtttacttaggtcttctcaagcgtctttcaataaagttttgtaatgctacatacaggtcttgcatatcttttgctggattttcttgctgcaaattgctttaaatgcagttcatggcttgagatttgttttttaactgcccagttaacgtaaatctggtctatgaattgtattgacaacaagcttgtgagtagcaatttttcagcaaccttttgctccctctccccgctccctgcacagtcccagaacaactttccttatataccaatgaaggtggaaatgtggacaggttgatttctccttcttgtttatgctgaatatgcagtcctttggggtcccagctttataggtacagtccctttactaagactgtctatcttgggaaggccctagactccaacttctctcccatgggccccacaaagcatccaagagtatacatttatattatctcactttgtcttggcagacaaatgtcttcagggcaagtctggctttaggggtccactgacctctctggtttctgtctctcactgtgatttcggcctgataattccttatggtgtcagatcttcaatgtttttaatacattgtttttaaaaaaatcatttagcattttaaattgtttttagttggaagatttgcccaagtaaccttgtccaccatattatctgaaagagaactcttgtcatgttttacactgatacacattttaataaatgtgggttatctttatgttgtgagctcttgatttggtattataattaattggaaaagttttaactttaagtattctgatcaaaatagtcaagtacaactataatgactttatcaaatattacataatttttcttctacttggtttacttgttttttaatttaggttaccatcaatgttagtcacatgaacttttatatttatgtccacagtaaaaatttttcatagcttgttgtttttctttcttgttttttcattttcaattatacttcacctatacttaacagaatacttaacaaatatgtatatatatgacaatattaaaaagcttagacatacttattttatgtttaaaatataacatatactaggcaagacaggaaaactcatcacttttatgaaatgaggcacagacagagtaatgggctttcttggtgtctcctgagtggcgggcaggtggccatgtcacagctctaatcccagtttcctgacttctggttctgttttcttacggtgccttcacactgtctctccagatcaaaaacagaatctagagatgacttctaaattttgttaccaaagactgaaattcctgttcctttcaactactagaagctcaactaaattgttggcccaagggtttttctctcactggcggtggctctgcaatatagaattgcatgcagagtacctcctgactccgctaaaatcctgtttaattgacccttgagattttcttttcaagttaaaaaaaatactacacataccaaagagtatcaagcacagtttaaaaatacatatttgtcttttcatgtaattttatttgtagtttagattactaatcttggtgatctagttgggttccagtttaacagttttaggttttgcttgacagagctataacacttcagtctatatttgatttttcaagggaaatgagttaactcgataagtactgttttgttatctttaaactttctcaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggtaaatccaaatgctctttaaatctttcataatttaaagcatataccatttggaaagttacttaggaataaattaaataagagccaatgtaggattattattcaattagccttctgttagaacaagagtattcaagagcaaatgtgttttgctttagaatcacagcatatgtcttagctcagggtccctagaaacagagcctgagatgggttatcttgcacaagtgatttaaggaaagagaatcttagagagaagtagaggaagccagaaagggcagaggaaaaagctcagcagaaatgtggtttctgaagaggtccagcctcagtctctgcccacaaggagctctggaatatgaataggagcacagaattttcccactgccaggcaagggagccagtctttcattctcacatattgttcagtcattggctgcaatctgctgggaggtgggggtagtgtaactttcaaggcatttctgggcaagctgcctcctgtcatctgagggtattctgtgataaatagcacatctctgaactatagtagccaacactcagggtagctggggatggcgtacctgatggataaaggagatctggacatggctcctaaaagtggatcaatacattgtgttggcaaatataagataagtttctagacttcaaagacaacctagtattttgactgctgcctgaagataaatattgtgcctcaacattagttctgaggttaaacaatcttttttttttaattgatcattcttgggtgtttctcgcagagggggatttggcagggtcataggacaataatggagggaaggtcagcagataaacaagtgaacaaaggtctctggttttcctaggcagaggaccctgcggccttccgtagtgtttgtgtccctgggtacttgagattagggagtagtgatgactcttaacgagcatgctgccttcaagcatctgtttaacaaagcacatcttgcaccgcccttaatccatttaaccctgagtggacacagcacatgtttcagagagcaccgggttgggggcaaggtcatagatcaacagcatcccaaggcagaagaatttttcttagtacagaacaaaatggagtctcctatgtctacttctttctacacagacacagcaacaatctgatttctgtatcttttccccacatttcccccttttctactcgacaaaaccgccaacgtcatcatggcctgttctcaatgagctgctgggtacacctcccagacggggtggcagccgggcagaggggctcctcacttcccagaaggggcggccgggcagaggcgccccccacctcccagacggggcggcggccgggcgggggctgccccccacctcccggatggggtggctgcccagcggagacgctcctcacttcccagacggggcggctgctgggcggaggggctcctcacttctccgacggggcggctgctgggcggaggggctcctcacttctcagacggggcagctgccaggcaaaggggctcctcacttctcagacggggcggctgccgggcagagggactcctcacttctcagacagggcggccaggcagagatgctcctcacctcccagacagggttgcggccgggcataggctctcctcacatcccagacggggcggcagggcagaggcgctccccacatctcagacaatgggcggccgggcagagccgctcatcacttcctagacgggatggcggccgggaagaggcgctcctcatttcccagactgggcagccgggcagagggggctcctcacatcccagacgatgggcggccaggcagagacgctcctcacttcccagacggggtggcggccgggcagaggctgcaatctcggcactttgggaggccaaggcaggcggctgggaggtggaggttgtaggtagccaagatcacgccactgcactccagcctgggcaactttgagcactgagtgaacgagactccgtctgcaatcccggcacctcgggaggccgaggctggcagatcactcgcggttaggagctggagaccagcccggccaacacagcgaaaccccgtctccaccaaaaaaatatgaaaaccagtcaggcgtggcggcgcacgcctgcaatggcaggcactctgcaggctgaggcaggagaatcaggcagggaggttgcagtgagccgagatggcagcagtacagcccagcttcggctcggcatcagagggagacggtggaaagagagggagagggagaccatggggagagggagacggagagggagagggagaggaacaatcttcttatatggtttgaaggaatgagaattcacactgaaaaataatttttaattttagtttcagatgtcatcttgataggcaaaacttgtctgccaattaactcatttattgctgaaaattaaataaaattggcattgtttttaaaagtaatgcaagaaagcaaaaagagttatgttgataacagaatcctttattctgtacaagttctagttgcttaagcttaaatcaaatcctgctaagtatattttcttttcttaacaggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaaggtatggtagtgaatttgatcaatggggaaattacagatcttttaaacgactgaattgtgtgcataattgttattgcatcagcaaagattgttcatttttagcctattttcattggtttgcatatattaaagggaattgtggaaggtcacagagatatttgttgtttttctgaatacagatctagctgagacatttataaaataagtcaaccatttattcaggcctaccagccctgctcctggtattacctcaactgtggctctatctctttacttctcctcagatcaatgaatctttgtagggcctcttcaaggataaattctcattcattcattctttgaaaaaaaaaaaatatatatatatatatatatgaaacccattgtgtgccaggcttaaacataccagttatctaactaccaaattaagaaaaaaattaaataaatgaattaataaattcttaataggtgaaaatgacttagctcttatcaattgcagggttcttgtcccaaagaaatatatctacatagcaaaatttcaggtgtgagttgtaggttggtgactgtaatatttggggcaggatgatttccaggaggcattaagattataccctatatatttctctggtttaagttagtattggaaaaaaagtactagaaaaatgtgaagcctgttttttgtacctgaaatatcaactccactggcagtttcggagttgaaattatttgaatatggtcaaagaaaaatttcaatggatggaattgggcaaggacgactttattcaagcctatcacagcaggggagagagatcagactgaactaaactccactgaaacaaaaggtgggagagttttaagcgcaggggtgagctaatggaaacgtactggagcaccttgttggaaggaagtgggagcagttgtcaatgtgattaggccatctgtgtttgctaattgtcccttattgaaggtaggctcctactctcccacagacactggggaattccttccttccttccatccctccctccctccctccctcccttccttccttccttcttcttttttttttttttgaaggagttttgctcttgttgcccaagctggagtgcaatggcatgatcttggctcactgcaacttccacctcctaagttcaagcgattctctagcctcagcctcctgagtagctgggattacaggcgtgcaccaccaaacctggctaattttttacatttttagtagaaacgggatttcaccatgttagccagactgatctcaatctcctgacctcaggtgatctgcccaccgcagcctcccaaagtgctgggattacaagtgtgagccaccacgccaggcctctgtcttgataattacatttcaaaggaatggctcccaggtccttggaaaagacattcttggggtataaaactgggaagagtctgggaaaaggggcagagaaagaatttataattccaagtcttctaaagtaaatactctaagaaaagggaggttaggaatttatagttgagaagtctatctaaagtttaataaagtggaggagaacattaaggccattttagtcaacatacatgttctttttgtaacaatttcaacatttttccttttagcaaacaaaaaaattttcttttggttggaaccgctgatggcaagttagcaatttttgaagataagactgttaaggtaaatgttgaatgcattctacatctaaatttattttaagtcttttgttttatatatatctcacacccctcttatgggattataaactccctgagagcaagaatcataaattatgctgtatttgtattgcttcataaaatcttgaacacagtagatcctctgaaaatacttgctgattgactgtatattttatatgaatgaactaagaataaaatgataaatgacatctgattgataatattgggaatggaaataattcaatttgtacataactgaggcagataattccttataaatatattgtggaaaaaaaacaaaaatatacttaagttttaaatatggcttgccattaactttttcttaagcattgaagaaatcatttaattttcttttcttcagattcctatttagtcattaaagcattcatttctctatccatctattcatctttggttccatctattcactcaacttcctacccgttcattctcctattgccaaaaagcttattatctgatgagagacagggaagtagagtataacccttaggttatttcttttgtaatttttacatgggaaaaagaatagattgaatgtaacaataatatttcgaatatgacctaaatttttttatgtataatatttgtacatatttatggggtacatgtgatatgttgttacatgcatagaatgtgtaatgatcaagtcagggtatttaggatatccatcaccatgagcatttatttctctgtgctgagaacatttcaagtctcctagttattttgaaatgtttttaactgtagtcactttattgtactattgaacattagaacttattcctcctatctaactgtatgtttgtacccgttaaccagcctcccttcatcctccccttctcccacacacccatatcctcccaagcctctggtaactatcattctactctctacctccatgagatcaacttttttagctcccacatatgagtgagtacatgtgatatttgtctttctgtgcttggcttatttcacttaacataatgacctccagttccatccatgttgctgtatatgacatgatttcattcctttttatggtcaaatagtattccgttatgtaaatacacacattttctttatgcattcattcattcatgggtgcttaggttgattccacttttttttttagctattgtgaatagtgctgcgataaacatggggatataggaatccctttgatatactgattccctttcctttagattagtatcagtagtaacattgttggattgtatggtagttctatttttaatttttttgagaaatcaccattttgttttccgtagtggctatagcaatttacatacacaccaatagcatatgggcattcgtttttttccgcatccttgccagcatgttattttttgtcttttttataatagccattctaattgggtgaagaagatttcattgtggttttcatttgcatttttactgatgattagttaatgttgagcattttttttcatatatccattggccattactatgtcttcttttgcaaatgtctatttagatcctttgccaactttttgttttgttttaagacagggtcttgctttcttacccaggctggctcacagtggcatgatcatagcttgttgcagccttgaccttctgcactcaagtgatcctccaacatcagcttcacgagtagctgggactacaggcgtgtgctaccatacctggctgtttattttttgtagagatgcggctccactatgttgtccagactgatctcaaactcctgggctcaagcaatcctcctgcctcatcttctcaaagtgctgggattacaggcatgagccaccatacccagccctttgcctacttttaaatggagttcttttttttttttcctgttgaattgctttttcgagtttcttgtgtattctggatgaatagtttgcaaatatttcctcacatttaatggatcctctctatattgttgatagtttcctttgctgtgcagaagctttttagtttattatagtcccatttgtctaattttgtttttgttgcctgtgcttttgggatcttaaccataaactctttgtctagaccaatgttctgaaatgtttcccctgtttccttttaatagtttcatagcttctggtcttacatttaagtctttaatccatcttgagttgaattttgtaaatggtgagagagtggggcctactttcatccttctgcatactgatatccagcttttccagcacaatttattgaaggtggtattctttctcccatgtatgcttttggtgcctttgttgaaaattagttggctttaaatatgtgggtttatttctgggtcctctacattggtctacctacctgtgtttttgccaatactgtgctgttttggttactctagccttgtaatatattttcaagtcaggtagtgtgatgcctccagctttgttctttttgctcaggattgttttggctattttggctctttttcggttccactcaagttttagaaatttttttttctatttctgtgagaaatatcattggagctttcatgggaatttcattgaatctgtagattgctttgggtagtatggtcattttaacaatattaattcttccagtctgtgagcatgaatatctttccatttgtttgtgtcctcttcaatttctttcatgtttttcaggtttccttatagagatcgttcatcatctttgttaaatttactcctaggtattttattaattttttgtagctacttcaaatgggattgctttcttgatttttcagctactttgttgttgttgttgtatagatatgctactgatttctgtatgttgattttgaatcctttactatactcatttatcagaactaagagttttttttaatggaatctttaggtttttgagttttaattttaatatctctaatcatttaagatggaaagtagttttttgaaagcacagattttatggagttttgttctgtggatactcaatttgctgagtgtgttttcttttttttttggcaaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgtaagttattttttatctgtacaagtaatttatcattatacttttgttttttccttataatcattaataatactgttgataattcataaggaagatcttttaaaatgcataatttattttctatcataaaattaaactttcattataaaaaattttgaaaattccagaaagcagaagggtatttttaagaagtcactcaacctaatcacttttagggataaaatatgtaaactcattgtaatcttagtagtatttatcaatctaaattttttaacaatttttattatctgtgtttcaaattagacatgaaattggaagacaatcaactttgtatttcaccaaattcacggactatacatatgcaatttgggtaacttccattaagtattgattgtaggaaagatagacagcaagtattcttgcttgtccaaagttgtttctagatttgataattatacagatgtctactcacagccaagttagtgataccagtttcaaacaagaataaaataaaatattaatataaacctctttcaagtttgctttttttcagtggtattttaatcaaatctttgcagttggttcttatttatcacattcctcagtgataagcagtataggattgtggataagagcataaatcatagttcagatattgctttgccatctattggttttgtgaacttgggcaataacctttcacatcttcagtcatctcttacctgaggattgtaatattctctatctcaaagagatatttggaggagtaaataagaatgttaatatatggatcttaattaacataatgaccagcacctggtaagctgtcaataaacattagctattattattattattagctttgagtcacaaatccctaccttagggaatatcctggtttcccattatccatcaaatttcccaagattggcacttgggagtaatctttgactcctttgttttttgctccctttatccacttgaccctcctaattgtcatttgaatctttgtacttctcactgttctcagtgctggtaccatgggccagactgccatccattatctgtggccacattaacaagagcatccagttctcaccctctgattatactctcttcaacatattttcagcattgcagacagagggacctttctaaaatgtacatcaatctgatgcaattttcctgcttaaaacccttcagtggtatcccattgtcctttatatgaagtccaaattccttaagacagcctactgggcccttcataattcagtgcttgcttacctgtctagattcatattttgcaagctttttgccatctgtgctttacccaaactgaaattgactcagatctctaagacaacctgttattacctttcacccccaacctttgaatgtggtcttctccttacctggatgactattatgccccctgcctatttcagtccaagcaccacttgctctgagtggcaggttaggtgactttgtgcttccattgcatctaatgttttccttcacagtagctataattgtatttgttaaagtagtttctcaataccactaaatctactggctttcaacattggctgtgcatttagaaaccactaggtagctgaaaataatatgatacctgggccctacctcagaccaattaaatcagaccagttaagcctgggatggggatcagattttttttttcaggttctcaagtgattctaaagtatatttgaggttaagatatactgcggagtgcagtgtattataagttcccatgaatgaggatttttatttctgtctttacatatttatttactagtatgtggttaacatttggatcaactcattctcattctgtaatacccacattttaaaaaatgaatgtaaaaatgtcttttattatttttatttttcaaatttaattttagattccaggaatacatgtgcaggtttgttacaaaagtatagtgcgtgatgctgaggtttggaatacaactgaactcacaacccagaaagtgggcatagtgcttgataggtagtttttcatctttgctccccttcctgtaatttccacttttaacccaattatacaagcctgaaaacctttaaaaagaaagggcctccagtttatttttttatttcatagcacattttatgggattatggatatcagttaactctttaaagttccatataagatttggagcatagatgctttactagagagcatccataaagatcaagctctcaaagatgctcatctcccaaaagagattgggacctagatgcataaacacttaaatataaatatttgctctcttctgaacaagtatctcctgtggccttggtctctaccccacaaaacagacatcacatcactaatcaggggttgcctcatcatcagtaccctcatcatcatcagtacacaccgactgagaggcatgttgggtaatgaaagatgactgcctttgaagccggaagactccataggacttttggagttctaggtctgcaacatgtttttagtcctaggtcggcaagcatgatgttagtcataggaccttgagcaaattatttagcatttgtacatgtttctttctactattaaaaacattgagatttatcatattttatgtttttttattaaggatcaagcaagataacacacaaaagtattttataaaatacggaaattccatgcaaaactttgtcctaattggaactattttctattaaatacagcaaatatccaagaaggaattacctaaagcgtagtggctctctgacaacacatcatatttttacctccttttccagaatagaaagaaaagggggaggaaaaaaaatcttcctactctaggatatactaatgattgttaaatctttatggtattttcatgttatctatctgatttaaatgcaattttgactatttttacatattcctcgttgttcattcatactgtagtgccttcttctattcccccacttaacagactgcttgattatatcagaggtgcttatctgtgcaactgtttactggacgaggggtatgtagaaaatacattgtcctcatccttatgaaattacactcataatctagtgtgagggatgcactaataaagacaattttatatttaataaggtctataatatgacagtgacaccagtggggaaaagggactggttggtctattttgataggtcagggaagaaatccagaggagccgacatttaagttcatcctcaaaggccaagtaggagtttgccatgctgatgtggcccaaggtagccaatctgtttgtgaaatatgtacaatgccagatgtcttaggttgaaagggaaatattttaaggtgttcgtaatttttctttatgtttaaaaggggaaaatggcaaatattttactttctgtttatgtttggatgatgtggatttttgttttctataatttgactggcttaactgcaaagatatcccttgctttaaaatttgaagacactgcaactaaattttatttcagcattttatattttataactctaggtataaaaggctaacacttaattttctgagcattcatgaaacaaagttttgcaagaacattcaaaagttacagatataatatttccttcagaaatttagatatagtacaaaattctacaaagagccacatagaattgaaactaaaagtaagaccaaagtaaacattggacataatctttattttattatcacaagaaattaatataaagtaaccaaaagtaagtaaagtaccaaagcatgttatatattcaattcagaatggttagggaagaatatgaaataattgcaatagtctagcttgtttagttttcaaaatagtgtttttacattaagaactaatataaggttgtattacacgtagaaattttaagaagaaaacaaatagtgatgactttctatttttttttctctgtaggttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaaggtaaattctgtggtttttaattttattcccaaaagaattatctttgcacttcatgtgtcacagaggaaggatttttcttcctttctgcctctgaatagagaatttttttaaaatgcagaaaaaaatttgtaatgcttctcagcaccatcttttcagatcaagaaaattttgtcttcagaacataaaagaataggcacataatgtgcatagttttctcatggtattacaaagaatgttctcgaatgaaaatactacattattgaaaatgagcatattggagtctctgctagctttgacatagttctgtcacagtgtcaaatatactatttataattaaattatgggccccaggattatctgctctaaagaaaaagagtcacaaaataatagacaaatatggggggaaatgcaatggactgaccgaggcgctaaggagtggggatcaagaccccagaatgagagcatagtgcttagtctgatgcagcctgtgagtgacaaatccatagcaagcacattctttctgtgctggtgctgagaaacaggaccattttcaagcttatttgctagccactttatatttttattttgttttgattttaccatatagatctatgatactcttgagaacattttagattacacactatatctgtaaaaggatacttcaaagtttcctgtcttagattcatctgacagtttttctatggattgtgagaagggctcacagtttatgttcagaagggccaacaggtctccttgataaagggttccttacttcctgaagtaccaaaacgattaggattcttttatttctggacacttcatttttgtcatgaattagactattcactggttctgggaaaaaattcagtggtttgtatcgatatcttttacatgtgaatgactataattttatgttcctttgtaacattgagacttcatgtaaaacttttgactctaacttttttttttctttatcctgggcacatgtatgctatttttactgaattagatagctttggtatttataaaaattgtatccctcttattcataatttcctgaaaatgaagggctattgttatctttgataatttatgcttcaagtaaagaagtgtggctctttggcatctgtatttagcaaaatttgctttgtataattttaatgatgcataatggtggtggtgtcatgttttaataatttaaaatgttgtttatgttatcatatgtaaatagcatttatctcttaattggtggtaaaattattaatgtatactttatggttctagggaggtaatggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggcaagtttctttcctttagatatttttcatattctctaagtcttataaaatatgcctttattttacgtttacattttctctgaactttccagtgtcatatggatggtcttggagggtcacacagtgaaacataagactggtataaattgtgaatagggtcattacagaagtggagggagtaaatgctctcagtcccacaagagaagcagattactgcagctgaacactcagtttgggtcttacttgcttttttcctttttacctaaggcaaaaatgggaaatacatggtattgaatatattttactttttgagcaaagaaaataaagaaaatgtttgttttaatcatagtctagcctcccagcttgttaaagaatctcatttggtttttcattctataacaaatcttttttcttgcagcaatacatgctgaactgcacaacctacaaatattgacaaatcatattttactcaaactttgtctttttttgcttctatttttatatttaaatatgataaaattgtgatagcacataaaatatattttctgcataaatatatttgcgtcttcctttgataataatttgttttagaaaataacaataatagcatatatacaaaagtttacaaaaacgacactatggggtttaattctgaaaaaaactagaatttatgtaactttagcaaataatgaatgttttgaacatggtgaagaaaatatattcattgcaagtatatgtgaaagaggaacatgtgtttttctagcaccttcacctatttttcatttatagactttagagttgcacaggagttacaattagatgctcttaatgactgtaaactattaagatacatgtccacacaagcagagcagtaggtctctcaataggttgtctcagtagtcttattctaccaaagttgttgcattctctagttgaattgtatgtactttgggacccaaatagcttgcttataactgaagttatagtggaatgtctatgggttatagtttgattttaaaataaagatcaattggaggatagcctacaaggtgctgcatgagctggcttcactgtacctctcctgcctccatcatctaccacattcctaccagatcttgcttgtctagatgaacatccagttcttctcaattactatgctatattttgcctcagggatttgcacatgctgtttatttctttgcttagttaacatagctttttttcatgcttatttaactcatatgctttgaaatgttagctcctgtgtcaaaacctctgagaagccaacactgattaggtcaaagttcccgctttgggttcccataacagctttcttgcatagttttgatcatggtcatatttttttttcattaatgctagtctcttcactagaatataaactccaagacggttgggttagtgtgtttttgtttaccccttttttcccaggatctagcctagggcctacatagaagacttttgatgcaaatttgttgaataaattagtgaatgatttgaaaagaaaatatgatattttgacatagtatcagtatatccatccatctaagtgtccatctaaatactcatatttgtactaaatactcatatttgtaccttaccatatccaaagaacttttcacacacattacctcgtttaacattgtaactttgggaagggtaatgtataaatactgagcctattttatagaaaggttaagctgttttctcagactcacataattaagaattgcagcaaggagtggatcacagattttgttattttttaaaaaaatgctggtctttattcaatataattgaagggtcacctagaaaatagaattgtgaattcagttccaaggtatttgtgtcttaaactatgaacaactttacttttttttcaggccagtttaatatatagttttaacagaaaacttacatattttgtttttgtaaaggaagccttaaaaatgtcatgctggtattgggctacaaccggaaaaatactgaaggtacacaaaagcagaaaggtaacatttagaaggatactgttttccaaacagggcaatgatgtgaatgatggtaacatattatgtgtttcataaatttgtagaaaatattacatatggtataatcaggaattttaattggtagtttatagtgtaaagaacttagacataaattttcaaaattacaagtgatatgaagtgttaaatatttatattttcagctgaagtagaggtgtcaatcactagctcaaccttaaacgaaatgtgaatattttttacaacttatctatatctacataatgtctaattttgaacagtgtttgaaaaagcttttatttcttttagaatatgaaatgttaatttattaaatgttgatactctatttgaaatttaatagtttctataatgtattataaaacttttccaagtatagttttttataaataataatttagtacattagttatagctgtgtttatatttacatttatctaagtcaactaaaaatacatgagccaaactgaaataaaataagaatgttttatgatggatctttgaaacatgatttcatttttttctttttctagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaacctttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactttaa

SEQ ID NO: 2565 - DNA, 53927 bp, Homo sapiens
  source 1..53927: mol_type = genomic DNA
gcctggaaacatttgtcatcaccccaaactttattgcttacaaagagttctctacaacccagactctgcagtaccaaggctgcagttctttatgtgctgggggccggggctctctccccgggagcagtctgactcaatgtggacagctggacaaaggctgtcttggcaagatgtgggaatgagcttctcccacggagtctcggcgtcccctgccccaggaggttgaggctagcagacaccccctgacgattcacagctgatttaatgctacgtgagtcctgagtagctcccctgggagaagaggctaagctggggcaatggggaagggggtgctattcttagagaaatctggaagaggtttgaggagtcacatgcatgtggacagctcaagactgtgtcccttcaccccatctcctggcttgctatgctcctacagtgtcactgccctgccctgccctgccagagggcagccatgaaagtgctttgaggtcatcagagtgcaaagtgccgtcggcagtaccctctggccaggggcagggcagggtgagtgtcagtgtgatgctgagctgtgctctggggaaccagcacgctggacactgatagtggggctggggcgccggagcgtctctctctgctgctttccttagcactgatcatgtccatccacagactgttcctgtcaggcatatcctgcatcacccttcacctttacagatgagggaactgagtgccagcgagtctggggcagtgctgggcctgaaggggctcggggcctgctgctctggggaagagtggtagccagcagcaaaggggcacatgtctggggactgagaaccacttcacttacacaccttctttggtccttggctgaaccagaggtcaactcaggacctgtgttgcaacaacctgaaaagtgtggtgtattctaccagggagccttcccagggtcaggcattcttttcccctacacccaaaaggggtgagctggccaggtgaggccaggcaaggggtttagagggcccccttaacctacgggcgggcatacctgctgacctggttctgcactgaacctgagtttgggcccttacacacttgacactctcacagcagcctggagggtgaggggccgaggggctcgcccaccccttctgacccaggctggaagctgctctcccctgtctgccagcaaatggtcactgatccaagcgggtcaggccaactcgactggagcagggcagagaagatcctgtttgtttcccgaggtaactcctgccatcctcctctgtctcttcacgtggcggagtgttttctcagcagggtggggcagggctcaggtgtgaaatcctgggaggcattctgcttgcccccaccttgctgctgcgaggccctggtcccactgctgagccgggggctggcagatccctgggaacggctgagcctgtgtttcagggcagcatcgtgcaccgagcaggaaggctgcttccggcagtgtggagccggcggtggagggcagggttagggcctgttctccagctggccatgcttgaccctccagctccaggcgaagctgccatcaggggccagtgtgcactgcaggtcgatgcccgagtctggcacctccatgtcgtagcgaacaggctgcccgtctttggtgaccaagctgaaggctgcagctgggatctaagggtggagcaaaccagtgggctgagatcatggcatagggctcaagccatgtagaaaggtaaagacatctccttccagccagaccggcagccctaagggcactgcctgtctgtcattccacgggactcagagaatcccacccggctcaagtgtaggtctggaggacctctttgtcaccactgccagccttgctttgaggccctgggaaatgctttgaggtcctgggggacgttgaaggccaattccaagtattccctagagtgccattctacttctttgaaagctttcctcctggagggtggggccagctgcattggcttctgggactctgcccgtcagagtgtacctgccccccttacctggctgctgatgccagtggcgatgtctcccactttgacccggtggaactcccggatgtgcaggtgttcaccattaagagactgtatttggactttcacacctagaaggcggacaaggtgatagtcaggagagcggctgctggctccccaaggaccagggtcctggcaggggctgggggaacgtttttgttaaaagtcactctgccctatgtagggggagcaggtctggctgtgatggagcagcagagataaaatttaggctggtctaagcacagctgcatttttttgtttttgagacagagtctcactgtgtcgccctggctggagtgcagtggcgtgatctcagttcactgcaacctttacctcccgggttcaagtgattctcctgcctcagcctctcaagtagctgggattacaggcatgcgccactatacccagctaatttttgtatttttagtagagacggggtttcaccatgttggccaggctggtctcgaacccctgacctcatgtaatccacctgccttggcctcccaaagtgctgggattacaggtgtgggccaccacacctggtcacaaagctgcatttttataagaaaaaaaaaattcaggctggaacagccctcatattatatacacctgctagttcttcctggccgtcagcacctgggatttggcctgtgcattgctaagagctggggctggctcctatggggaagtagtatttcaacttggatgcaaagcagaaaggaactgaacacaaggattcttaaattagattatgggcaatttagattgttgcctgagttgaagtggcctttggccagccatggggccctgatgccatgagtcacacttgccctggagagggccagggaactccaagctgatgatgcccttgttgtagcaaagccacatcataacctatgcaatcaagcttgaaaacgaaggaattttatgttgtctttctcatctgacctcaaatcccagagggggattccttttgctgagtttttgattaaaatgctcatgggtcctgttccttttccctttagaagagattaattgctcattttcctgactccaggtcaagagactgctctcctccccaagctaggggaaccttctgggactccatcaactgacaatgaggggataatggtccctcactgccccatcaggaaaggctcatgggtgattgggacctttgcttgaaacccaacttactggccaggaacctcaagttctgggaccaggcgccttcctccctcccactgtgccagaggaggggagacaaaatccctcaatggctgtctagctccaggcagatcagctgccacggggactgctgagcaggtgggaattggactgtaccattgaaatagcttggggtgtcggtgggccgcccccgggccagcaccatgttccagctggagcttcgagcctcggcctggctgctccaggagtgtacgcctgagctcagggtgtcccgcgagctttgagaggcctttgatgggttctgaaacaacaggattgggtacgggctcagggccctgggctccaggatccatctccggcttgggtctcatttggggaaaaggggcactgctcatgccctcagctggaggagggtaagggttgcctccatgggggacgaaggcctgcctccccattatctctggtggcaaaacacattccctaatcccagaagggtagattcccatggtttctctgactctgaaccatgaccacctcccccaacctagtgaggacccccaccagaaggaaggggtgacccccatcaccctccctttacccactacttgcacagtgtccattcactagctggacgcaaagctacttgctctgtgccagggccgggaaaaccacacccctggagccatggctccggggccacaaccgactcaccttctcactgtcatccgacagggagaggctgtcgatgctgaggcacgagagaatttgctcctgctcctccagagaaaatggctgggacaggctgttgaggaataattctgcagggaaaagtggaagatggctgtgaaagactgggaggaggctggctgtgttttcaggggttcttcctgcacagtcggtagaagctgagctgctggggaaggggctggaagaaagcccacaccgcaggtaaagagaaacaccggcctccgcgggtggcccagggccagtgctcagggccccactgcagccacggctgcccgtacctatttccagctgctgcagttcctgctccgggacggttgctttccgctctggtgagctggggtttctggcaggggctggctccagggaggacagaggtaagggttcccacatcccagactcctccttgctcaaagtcaagggaggagacttgtttggctctgggggctctggtgggagaggaggctggagcttaggggctctgcctgttgtctcctcagctggccggggccctggggcccttggcgaaagctctctcggctgggcatggagggtctggtggtaattggcttgatttggcggtggatgtcttggttctttatattctcccctccaagggctcttcagacctcccactagaaaacagagagtacaatggtgaggggaagcgtgctgtgcacagacagcggtccaggcaggagcggcctctcctgagtgcagaagggctagaggcaaacaaaggggaggacactgccccgggccaccatgggaggtggctccagagggcagcatggtggtctccacaggagacttcctcaataaaatggtcccaatatgacagggataggactggatttctgtctttgattctgtttttcttctaggtatcagtagcaaattcaaaaactacagaatcagctccagaggactttgttaacaagaaagagaagattgaaaacagccctggggctacaccaactcaagagctcccaggcaaagtggcatcctggacccaccatctctcctaccccatcctcagtcggtacttccccaggcaccgtttgttctggcatggggctagttcagccctgggaccaccctcatccttataactaccagctgtctttggtgaggtgcaagatctctctggttttctttatttcattttcattcctataatcacagccttttttgtgcccatccctcaggtgacattctattatgtttgatgtgtcatttttgatttggttgtgtccttgcaaaatgtgcgttgttttatttatcaatttatttttatttttatttttttaaagagatgaggtctcatcatgttgcccaggctggactccaactcctgggctcaagcgatccttccacctcaatcttctgagtggctgggactacagatgtgcgccaccatacctggctattgatcaatttttagtttaccaaacaggcattatgttctgggtcccattctgtgtcgggttctcttttcactcggcaccatggctttaggatccatccatgctgctctgtgaacgccgagttgctttaactgcttggtgctccatgaggcatccccttttgtgtctctgtcctcccagtgagggaccccatcgtaccctactcccctcccacaaaggaagctgtagtgcgcgtcctcaggcgtgtccccatatggatctgctggcattcgtttgtcagtgcacccaggggtagaagtccttggtctcagtctgcagacgtctgcctgagtgcagccaggtgcccccccagagtgggtagccttgtccacatgcccatcagcagcacctgaggggtcccaacagccctacatcccaccaactttctgcttttttccagtcaaatggctcttgagtgttacctggctttatttatttatttattttttgagtcgggtctctgttgcgcaggctggagtgcagtggtgcaatcatggctcactgcagcctcgaccttccaggctcaaacaatcctctcacctcctgagtagctaggactacacgcatgtgccaccatgcctggctaatttttaaatttttttgcagagaaagggtcttgctatgttgcccaggctgatcttgaactcctggcctcaagcgatcctcctgccccagcctcccaaagtgctgggattacaggtgtgagccactgctcccggcctgtctttattttgtattcttggattcctagtgagtttgagccccctctatacatcataacccttatgatactagtaaacatatattttatctttaaccccatttctggcacagaactcctaaaagccttactctccaaaatgatctctttctgtgtactaatggattgactgaaggctggcagcccctaggtagcttcaagatgggggctggtcatcagagagacataggcaggattagagggttgggactttcatcccaccatcccacgtactgggagggaagggggctaaaggttaagcggttcgccaatggccagtgatttattcaatcatgcctacgtaatgaagcctacacaaaaacccaagaagaccgggttcagagaacttctggtagctgggcacatggaggttcctggagggtgccaagccctggaagctctgtgctccctcccacatgccttgccctatgcatctcttcatttgtatcctttgtaatatcctttctaataaactggtaaatgtaaggaagtgtttctctgagttctgtgagccactccagcaaattaatcaatcccaaggagggggtcatggggtccctgacttatagccagttggtcagaagcacaggtaaacacgtgggcctgagactggcatggctagggggtgcagtcttggggatcgagccctcctgctgtgggatctgatgctacctccaggtagatagtgttggaacagaactgaattagaggacaccaagctagtgtctgctgcagaactgattgctggcttggtggggtggaaatccccacacatgtggtcacaggagtcttctgggttgattgtagttgagtgggagaatggaaaaagcacttcgagtttgcgtgtgagttttctctttcccatctcctgagcgctgcctctgggtccaggcgtggcactgtcgcaatctcccaacaaccctgaggctgctgcacccccataatccagagggggaaactaaggctctgaggggtgccttgctctggacctgcgcccacctgcctcctctgtccacctctgtcttctgccccccgggtcagccagcgtggggctcttcctaccttgctgtagtgcccggttcaccttccctcccagctccgctgcagacacgcggtggatgggctctttcctcagcccctcttggatggcctgggctgtgagaggggcgcaggagggtgggatctccctcacaggcggaggctcgctggcaatctggggggcaaaagacaacaggtgaggcctgccttccctcatttcctgatacccggctgttattgctctttgcgcaactcccgccggcccctgttcccgctgtgctggggtctaccacaaggaatggaggggtctgggctacagtgagggcacttttcccaggaaagggacaaatggagccagtaaaacaggccagagccaggcagcaagacgcccacagcctccaggcccggcccgttaggaggcaggtggatggggcccagggtatggacagaagagagttctcacctgccatgaacttggtgagcctccgcagctggatctccccttgtacccccagatttgggtggcaagtatttgaattaggatcccacatggatgaccaggcctccccttgctccatctgccaccgcagagcagcccctccagcctgcagcctgggccccagggccctgcagctccccctgttggccatgctgggtgccgtcaccgaccttgaggcagagcggccctcggaagaactgagtccaggggtggcagccgttgagcatgtgcagcatcatacagcagctgctccagacatccaccttggcgtcgcagctcctgcccagcaccacctccggagccatgtgggtctctgtgccagggatgtagtcccctgagaagggggatgagacataaagttacctggaatgctgatgggcaggagcctaggcaatggccaccctggttaatcctcggggtatcttacatttgtcactgttaaagtactttttattttattatctttttagttctttgagatggagtcttgctctgtcacccaggctggagtacaatggcgcgatcttggctcactgcaacctccacctcccgggttcaagagattctcctgcctcagcctcccaagtagctggaattacaggcatgagccaccatgcccagctaatttttatgtttttgtagagatggggtttcacccatgttggccaggctggtctcgaactcctgacctcaggtgatccacccacctcggcctcccaaagtgctgagattacaggcatgagccactgtgcccggacatgttaaaatactttaaatatagaaataaagtctccaagtcagacttgtagggaggagctaggcggggactctgctgggaacttgtacaaagtaacagagcatccatgatgtggactctgccctttggaccaaacccttaaagtgttttttaaaaatggggcaggggctggacattacaaattaggttgtagaaggctagtaagtaataccagtaagtaatacttcttactagtaagaaatactagtaagtgaaatttaaaaattgtaatagaaaacttatatgcgtaaaagactgaaaggatagatggcagatgtgaacagtggtttttttcctggtgatttgtatttgtaatttttgcttagctctactttcttcaacagatattagaaaaaagggtcaggcagtggctcatgcctgtaatcccagcactttgggagactgaggtgggaggaatgcttaaatccaggaatttaagaccagcctgggcaacatactgagaccccatgtatatctacaaaaaacataaaaattgagccggacatggtggtacatgctgtggtcccagctactcaggaggctgaggtgggaggatcgcttgaaccaaggagcttgaggctgcagtgagctatgagtgagctactgcactccagcctgggtgacagagcaagactctgtctctaaaaaataaaagttaaaaagaatcagaaaagatacatttttttttgtaacaagaaaaagcccactacagttattttaaaagggcttaaaacaacacgggtggaggtcaagtgtccacattcaatttacatcttcagaattgccaacatagtcctttaacaacacacaatcatatacttccaaagattctttttccgttggtcaaaatgaaatcattttatccttaaggctatacatgaaaaacgcagggcacaaaattgtgttataatggccctaactaggcacagggaaaacaacagcctggaaggagttatttaaaatattcatgattcggccgggcacggaggctcatgcctgtaattccagcactttgggaggctgagtggggcggatcacctaaggtctggagtttgagactggcctggccaatatggcaaaaccccgtccctactaaaaatacaaaaattagctgggcatggtggaaggcgcctgtaatcccagctactcaggaggctgaggcaggagaattacttgaacccgggaggaggaggttgcagtgagctgagattgtgccactgcactccagcctgggtgacagagtgagactctgtctcaatgaaaacaacaaaaaaatttgtgattctctctctgggtaagagacatggtgagaattctgttctctgcctcttttatatgcttaactctatacttcacagtgggcatggattatttcaataatcagaggagttaaagaaagatatttcactgactttagagcccaggccccttggtcagcctgcccactgtgcttccagccaaccgtgctcagaggcgcaggagagctggggtcacaggctggcagtgcactcccctgcaaaggccagacaagaggtaggagccacggggactccaaggcagaaggcctgggacctacggagagtcaaccagcctttcccttctcttccctgtgtacaggagcatcgacaatgagcacctgacatctattatcacatttacgcgtaacaaagaaacccctgataatcatccaggctggttgcggggcttaaacacacaggtggacctaagtgttcacacctcaattcccattctggaaagcatggaaggcatttggcgaatgaatgcattggggggcacggcagttggtggggggccttacctgtgagcaaggactttcccaggccatcaggttgaagacacacagcatggccaaagtcacagagggctgcgtggctcccatcgctggacaggagcacgttgtcagctgccaggccgccccggggaggaagaggaacaggtgagtcatgccgggtcccagcccaccctggctcggtttggcctgccctccagtgatgtaattttctggctgaccctacgtggcagctgctgcttctgattagtttcattaatcgtggaggaagggaggagggtatcaattcaggctagaggtaggcaggatctctgagggcaaagggacaggagcagggtttactcgggaacgctgccactctgctcgcctgcgccgaccccataccaggggtcaccagtgggtgggagcttgaccttcggttctctgtggccaccgtctaccagaaactacagtgcttggctaaggggttggagaacatcattccccttcctacaggcacagtcctgtcagcctgactcagggcctgctactggggatgaccaggctagcccagaactgagaggagatcagacaggatggtgtgagagaagagcctgctggggatcagggccgtggggcctgggccttacctttgacgtccccatgcagaatccttcgtgagtggaggtattccagaccctccagggcctggcccaggtagtacagggcccggtcctctgggagacagccctgctccttgaccagctggcccagggagccacctaggagaccaaaggccaggctatacatgggacttgcccgagcctccatgccagccaagggcaagagcacagggcaggcagtggaaagcagggtcacagggtcaagaggttaacaatggatagatcagtgaccaaggccaacttgggcaagactcaggggggaactcttggccctgaatttggagaaagagtgggacctggctccttaccttccagcagctccatgaagatgttgacccaaggcccttctctcacagctccatacaaagggacaattctgggtgaggtcaatcctgcacatgccatcagctcctctgcccgaaatacttccagccgcacctgcaagggcccagaggcagctgttaagacagggtgaggggaccagagctgggtccctggcatcctgtcagcaccctagtgctccacacacagaggctgctgctgtttccagtggtgatgcaggggcctggggggcctgctggaccctcagaggctaaattgtgtatcccgtgcccttggtatcaggagcaacttcttgtacttaattaaagttctggagtgctgcctgtgtgcaaaaacagccacataaaaactacatccgcaccgggcgcagtggctcatgcctataatcccagcactttgggaggccgaggcgggtggatcacgaggtcaggagatcgagaccatcctggctaacacagtgaaaccccgtctctactaaaaaatacaaaaaaattagctgggcgtggcggcgggtgcctgtagtcccagctactcgggaggctgaggcaggagaatggcgtgaacccaggaggcggagcttgcagtgagctgagattgcgccagtgcactccagcctgggcaacaaagtgagactccgtctcaaaaaaaaaaaattaaaaaaacaaaacaaaacactacattccagccgggcgcggtggctcatggctgtaatctcagcactttgggaggctgaggcgggtggatcaaggagatcgaggtcgggagatcaagaccatcttggccaacatggcgaaaccctgtctctactaaaaatacaaaaattagctgggtgtggtggcacgtggctgtaatcccagctacttgggaggctgaggcaggagaatcacttgaacctgggagtcggaggttgcaatgagccaaggtcgcaataagccgaggtcgcaccactgcgctccagtctggcgacagagtgagactccatctcaaaaaaaaaaaacaaaaaaaaacccacaaaaaaacaaacaaaaaaacaaaaaaccccctacattcgtcatcctggctgctggcacgctgtccgccctcaaatctgccaaacgcagaacattttttcctccagctaaatttctgggcaatttctaggatgtgggaccttttgcttatcaacatccatgtctactctcagaagctgggtttttgacttatctgactgtcaagaaccaagatttggactccatcgggtgcatttttttttcttttcttttcttttttttttttttttttgagacagaggtcttgctctgtcgcccaggctggagtacagtgacgtgatctctattcattgcaacctctgcctcccgggttcaagcaattctcctgcctcagcctcccgagtagctgggactacaagtgtgcgccaccaggcccagataatttttgtattttttagtagagacggggtttcaccatgctggccaggctggtctcaaactcctaaccttgtgatttgcctgcgttggcctcccaaagtgctaggattacaggcgtgagccaccatgcccggcctcaacacttttctttcccggaggactaaaacatccacatagacagagcagtgtttattctgtttgcagctgtctcccagcatctgggaacttaaggaggcttctgaggaggcttctggggagtggccaaggccactcccactgccaaatggcaggtccgggatcatccactcctttctgcagggaccagcaacttggtgggaggaaataggccttggatataaacatcttgggcttagatcctggctccgccttttaaaacaaggcagcagacttcccatccacatatttccacatgcaaacagcagggacggtggtatctgctcctgggtagagcaaggatttggaaggatggtaactgacaccaggcctggcaaccagtgggcactcaggaagtgctagctccccaattcctccagctcacatcagagaagctgatacttagactgacttagaccttttttttttttgagacagagtctcgctgtgtcgcccaggctggagtgcagtggcgcaatctcagctaattacaacctccgcctcctgggttcaagcaattctcctgcctcagcctccccagtagctgggattacaggcacctgccactatgcacagctaatttttcatatttttagtagaggcagggtttcaccatgttggtcaggctggtcttaaactcctgacctcaggtgatccgcctaccttggcctcccaaagtgctgggattacaggcgtgagccactgtgcccggcctcttagacttctttttttttttttttttttttttgagacagagtctcgctctgtcaccaggctggagtgcagtggtgtgatatctcagctcactgcaacctccgcctcctgggttcaagcgattcttgtgcctcagcctcctgagtagctgggattacaggcacgtgccaccacatccagctaatttttgtatttttagtagagacagagtttcaccacgttggccaggctggtcttgaactcctggcctcatgatccgcccacctcagcctcccaaagtgctgggattacaggcgtgagccactgcgcacggcctcttaggcttcttcttcttttttttaattttatttattattatactttaagttttagggtacatgtgcacaatgtgcaggtttgttacatatgtatacatgtgccatgttggtgtgctgcacccattaacttgtcatttagcattaggtatatctcctaatgctattcctcccccctccccgcttagtagacttgtcctccttcctagctgctgatggttctcaagtaagccttgagtagcatcgccagggggcgctggcagtaacagaaccagcttggaagcgatcttcacagacttgctgacttggcaaacagccctgacactgtggggtttttggacttttgcctatcagtggaaaatgtcgcccttctggttccctaatatctggtttggttaatcacctcccatgaactttgactctgccagtgtttccagctctaaaaagcctctgaacctgagttggaactaattcaacaacaggacttgttagcaaatgtcttcagcctaaccacccccaaactgagctgaggcaccccggggcactgcagataactcagaagggcgccaaatggatatctgacatttgagggaaacggccaccgcagtatctgcaggacaccgcgtgaactactcgctcgagacagttcagcttcaaagtacgatcacgcacgtgacattccctttgataatgtatctctatgaagctatgtttttgcaggtcactgtgattaaaagtacttcaaggagaaaatgtgggatatgaaggtggtggtgtcctatctgatttcaagggttgagatgtgcaacaaggcatacatcccgttaataatctggcggtttggaaatggaaggaccctttttctttcaacttatgtcacgcttttcaaatggctactaagttgttaggataaagacttattattcgacctcactgcttcataaacagaactgttgggtatttgttttggcctgggttgccctgaaacaatgactgagatattaacagggctgtgatccaaaagagttggggaaacttggctttaactttgcagaaatctgtaagtcctcttagagtgtcccgtccatgctaaaaatatttccaaccacccagaccaaagaggtgggaggagatacttcaaaatacaaggtgctttagaagtcggtgccagaggagaaagcagcccagccttccaggccaagctggctgcccgtctggccacccctcctctctgaacttccgtgttcctcatccgtaaaatgagggggctggactgcgatgaggatattcatgagaactaagatctaatgcccacttatcatttcccaggcaccggtaaagccctttctaagcattagttattcagatcttacaatagcctgtaagctggtgggatcattatccccattttatagatgaagaagctgaagcctgggcaagtaatttgcccaaggtcactgggtataagagatcacagcagcgcttttactcgggcaagcctgactccagagctgccagctactctgcctcctgaaggcctttccatgctgaactttttttttttttttttgagacaaggtctcccttggttggccaggctggagtgcagtggcacaatcacagctcactgcagcctcgaccttcccgggctcaagcgatcctcccatctcagcctcccaagtagctgagactataggtgccatgcccagctaatttttgtagagatggggtttcgccatattgcccaggctagtcttgaactcctaggctcaagtgattctcccacctcggcctccaacatgttgagattacaagtgtgagccactgtgcctggcatccatgctaatgttttaaaatacacttaggactgagcatccccaggtggaagcactgtcagcaatgagcctactgcctgatacagaagccacttccttcccctcaattgcctgcacactgaacactggggatcactttttcctccttgaacttccctcttgttttctttggtattcttttttttgaaacggagtttcgctcttgttgcccgggctggagtgcaatggcgtgatctcggctcaccgcaacctccgcctcctgggttcaagcgattctcctgcttcagcctcctgagtagctgagattacaggcatgcgccaccacgcccggctttttgtatttttaatagagatggggtttctccatgttggtcaggctggtctcgaactcccgacctcaggtgattcacccgcctcggcctctcaaagtgctgggattacaggcgtgagccaccacacccagccttctttggtattctttttttttttgagacggagtctcattctgtcgcccaggctggagtgcagtggcatgatcttggctcactgcaacctctgcctcccaggttcaagcgattctcctgcctcggcctcccgagtagctggtggcgccatcatgcctggctaattttttggtatttttagtagatacggggtttcactgtgttagccaggatggtctcgctctcctgacctcatgatctgcccacctcggcctcccaaagtgctgggattacagacgtgagccaccgcacccagcctcttctttggtattcttatctgttttattccatcaataaaaaaaggcgtaagagcaattctataaattcttttgaagattccaggaatgtaaactatgtgaaaggggctaccacagtactgtgcacagatgtccaatgaatattagagggtcccgccttattttctcacctctatcgaggtattttcctctgatccttgtgctattttccttctaaacacgtgtccaggactgaaggctgctcacctttaccccaatataaatgtctatcccccattacaactcgggttccttcaggtcaggcctgtggatttcacatctctgtccccagcccctgcacattgtctggcacagagcaggtgtttggtgacagctgggttgacttggccagggccacattatcccagatcagcagcagagccaaagcaaagctcccagaactccacacttgagccagatgttctaaaaggagtgattcttaaccctttttgggctacagacccctatgaggatctgggaaatgatatgaattattctttaaaaatgtgtgattgcccatacatgcaacacagaaacacttttttttttttttttttttttgagacagagtcttgctctgtcgcccaggctggactgcagtggcatgatcttggctcaccgcaacctccgcctcctgggttcaagcgattctcctgcttcagcctcctgagtagctgagattacaggcatgcgccaccacgcctggctaactttttgtatttttaatagagacagggtttctccatgttggtcaggctggtctcgaactcccgacctcaggtgattcacccgcctcggcctctcaaagtgctgggattacaggcgtgagccaccacacccggccttctttggtattcttttatttttgagacggagtctcattctgttgcccaggctggagtgcagtggtgtgatcttggctcactgcaacctctgcctcccaggttcaagtgattctcctgcctcagcctcccgagtagttagtattacaggcatgcgctaccacacccagctaattttttatatttttggtagagacggggtttcaccatgttggccaggctggtctcgaactcctgacctcaagtgatctgcccgctttggccttccaaagtgctgggattacaggcgtgagctactgcgcctggccgacaaacactcttttgaataaatttcctagaattcatggatcctatcaatccatccactgactaggataagaacttctacatggccgttaaaaagcataagagagttgtatatatgccaataaggaaatctgtcatattattgcatgaaaaaaacatggtacagaatagtccctagagtaggatcccatttcttgtggggttgggggacagggtctcactctgttgtccaggctggagtgcagtggtacgatcttggctcactgcagcctctacttcctgggctcaagcgatcctcccacctcagtctcccgagtagctaggaccacaggtgtatgccaccatgcctggctaattttttttctttgtagagatggggtctctacaaagaagtgctaggattataggtataagtgccgcaccgcctgatctttctttttttttttttttttgaggcagagtctcactctggtgttgccaggctggagtgcagtggcacaatctcggctcactgcaacctctgcctcctgggttcaagcaattctgcctcagcctcccaagtacctgggactacaggcacccgccaccacacctggctaatttttgtatttttagtagagatggggtttcactgtgttggccagatctcctgaccttgtgatccaccacccttggtctcccaaagtgctgggattacaggcatgagccacaggcctggcctgatcttacttcttttttttttttttttttttttgagactgagtcttgctctgtcacccaggctggagtgctgtggcgtgatcttggctcactgcaacctccgcctcccaggttcaagcaattctctgcctcagcctcctgagtagctgggattacaggcacctgccaccacacccggctaatatttgtatttttagtagagatggggtttcaccatcttggccagaggctggtcttgaactcctaaccttgtgatccacctgcctcagcctcccaaagtgctgggattacaggtgtgagccaccgtgctcggccctgatcttacttttaattgcaaacaaatataggctcattataaaagaatgcaaatgataccaaaaaaagcaaaagtctccattccccagtcctattctcagaggtaactgccctttgacagatatctttttagacttttgaaatttcttttttatttctattttttactcttttgtagacatgcgatctcgctatgttgcccaggctggtctccacctcttggcctcaagcaatcctcccacctcagcctcccaaagtactgggattacaagcgtgagccactgtacccagcctggactttttatgcgtgtataaacaagtagttgtttcttctattaaaatgggatcctggtggggcacagtggctcacacctgtaatcccagcactttgggaggttgcccaggagtttgagtccagcctgggcaacatagtgagatcctgtttctacaaaaaataaaaaattagctgggtgtggtggtgcgtgcctaaagtcccagctatgtgggaagctgaggcaacagggttgtttgggtctgtggggctgaggctgcagtgagctgtgatcatgccactgcatactagcctggacaacagagcgagatcctgtctcaaaaaaaaaaaaaaaagaaagaaaagaaaaaagatcaaacaaaaccttaaaaataaaaacaactgcatcaaaccctggacctatggccaatcagcatctagatcaggaggatgaagggagtgctggcactgccacgtgacaccttacacactggattctccccaaggagcatcaggggggcacagacttgctctgatccgatgtgcagcctgacctctgatgcctgatccacctcccggtccccatctcctaatcagggaactgtttctcctgctcttccagctgaaaaccctaaaggacaccactgccttgagggaaagcaggggctgtctgcccaaccaatggcagctgtgcaggctgccaaagagccatccccactgcattctccggggtgggaaggaagtggttctgtgagtggcagctctggtgggcttgagctgcagctctggtgctgagaagtccatgccttgtgcttggagcttttccaactgccttgcagtggatgcgaggggcgagacatggagtatttatcctcttccactatattagggttgtttaccttgttgcctgggaggactcttgaggccctcagcaggggaacagctgagaagcccagtgactaagctcccagcactgggtgcgcgtctcttcacactctcacactctcctcccaccacctctcaagagggacagctgagccttctccggtagcctggggaggggaattgcagctgagcaggtcaggcacgtggccttggcctcccccagtggaagacgatgatccacactggcaagaactcggcaagaactcagcacgcactcagcacgtgttgccagtcaggggtggtgagggcggagttttcgtattcgacacagtgtgtctgaagtttggggtggtacctgcagatagtcccctcactggtctcaccatccagcccaagtacacaccagggaagccgggtttattcacatcccagctgtctcctctccccttaaggccacaggcaccctggacggtggtggcagcgtctgctctgaatggagccagcgtgtgccaggcttttgtgctctggctacagtgagcatttcctgtgtcaggttggtgctccaaaagttttggattttggagcacttcagattttgggttttcagattgcggatgctctacctgtatttgttgcttttctttcggggattggagtgtctctgacataagccacttgaaacaaggtatatctcagagcttacttcaccctgcccagagggccaaggggatggtccacagaaacgcgccttaggtcctggtgctggctttgaggccgagagctttgactggggacaaggtggcttccaatcaagatgatctgagagttgggggtgggggaaaggttggtgacagggagaaggaccgacacctgtaaggtctgtcggtctgcagccgccaccgatgctccctctgggcccggatagtgtgatctgacaggaggaggcctcagctccaggcccagcatgccacactgtcctctctgctctccacttctaacatcagtgagatgaaggggtgggaggggtgattcctgtcttctgtctctactcaaaactctaggacaagaagtctatcttcttccctcttcttcctgaagagtggttgaaagccgaactctcaggtcagacagacctggtctgattcagggctcttgccacccggccagtgacttcctgtcttgccaagcttcatgtccccaacatgtctgtcttgcaggactgtggcacgcctggccaacagggggcacagctccgactctggcagatctgcccactcccactgaggctggcttcctcctagaagcaccccacaggtggaggctactgctttcctatcatctggcccaggtcaggggcggcctcctatgtggttcaggggttttacctcagtgtgaatttcatgacgctccaaccatcttccacgttgggacttgcccctcaggccctggctgtattgagacaccgaggccacgtgtgtcctctcacactgcctctcacatacacacatgccaggggcagcagccaggccaggacacgtgacaggctgctcccttccagttccagccgacctcaggtggctagtgatagccaagttctgttcacaagtcagacccacggccaccctgcgactgtcctggacagaaagcagagggaacacaccaggcccccttcctggcttccctcttcactcagcccctgagccctggcgtacctttttgacagcgcactggaagccagtctgcttgtcctccatcctgtgcacctctccgaaggagcctctgcccaggcggagctggtgcgtggcccagtggacttcttctcggtactcataatccactggcttgagtttctggggttggcaggagagagaggacagtttcagtggccagggcagcagagggctacagggctacagtgaggaagactctccagctggtgaccttgccagggctgctgagctgagccctcacaaccaggcagccctggggcgaaggcagggatctgagccgggcagcaccagagagggggcagaggaatgaagtgaaggcgagggaagggttcatgggctgcggccactgatccttgtgatgaaaaacatcccagacttgtgatggtgagacagaaacagaactgccaatcaccttgacaatgaaaaaacaaaactcaggagctagaaggtggagggaagggaggaacagtgaagaggggcgggggtcaaggatgatgttaaaagtggatggaggggccaggcatggtggctcacgcctgtaatcccagcactttgggaggccaaggtgggcagatcacttgaggtcaggagtttgagaccaccctggccaacatggtgaaaccctgtctctaccaaaaaacacaaaattagccaggcatggtagtgcacacctgtagtctcagctactcgggaggctgaggtgggagaatcacttgaacttggaagggggaggttgcagtgagctgttatagtgccactacactccagcctgggcgacagagtaagactctgtctcaaaacaaaacaaaacaaaaaaattaaaaaattaaaaagtggatggaataagacagtgcagtggctcacacctataatccgagcacttttggaggccaatgtgtgaggattgctttagcccaggagtttgagaccagcctgggcaacatagcaagacctcatctctattaaaaaaaatatagctgggcgtggtggtacacgcttgtagtcccagctactcggggggctgaggcaggaggattgcttgaacccaggagacggaggctgtagtgagctatgattgtacgactgcactccagcctgggtgacagagtgagactctgtctcaaaaaacacatttattaaaaaaaaaaaaaaaaagtggatggatggaataaaacccggaaatcaaagtttgataaaatcatttaaagttataaaattatttgggaagttaacaagaggaaaaagggaaggaggtgggtggtgaaaacaggtcccatcctcatcttccgtctctgggggccatgataacatctccagtggctcctggctgattccccttgtcctcagcatgtgtactattaatgcagtgcccacattcagcaagcaggaggtgaccaaccagaagaactcagaacagaagacgctaaaaaggctgtgagaagtgagattggcggaataagagatgatacttttcatccacaatgagcactgtcctactgtttgatttgtcaccacaggcaagagtgactctgataaagagagaaaagcatcccccaggttgctggtagagggacatatacaggtgccgggggattagttacctcagtgagcaggacaccctcgttgtcctcagttttggggctgggctcccgggatctggagccccttgctgcccaggtcttggccaggctggtcaggctgtgggcctggcctgagctcacgctgccttgcagagcatgcactaggtattcctccacagaaaacttctcatgggcaccacgagacaggcagctgggctccaggtgtgggccaggcaggggctttggactgtctacacaggccagtttgctcaggtgtgggtcaggcaagggtttctggctgtctacacaggccagtttgcccaggaaggactccagagggtgaggtttccagggctggagagggtggaatgggaagggatgaggcagtctgctataggggaaggggtgcgtgggcaggggcagggggcctccgtcctgggggtggtgcagtttccacacgtggttcagacattgcaaggggctgatcagtttgtggagttctgatcgaggcagagccgccgtaggccctcgccaagctgcttaaaacagagttgcccaaggcctggttccttcagaggcttggtgaactgcggggtgtttctaacatatggggcgccgagtggagactcatcctcctgcggggggaaacacagctatcagcacagagggccagggcccagggacaggctccaatttcaaggccccatgaacctggggtctgggcagtgggtggagggtctcacctgcactgggatggtgcagctctcctgctcaggggtcctggggaggggtttggccaaggccactcctgcatgagccagggactttgagctcttcttcttccgtttcttccgggctttgctgcgacgctttcccttccaacacacacgggccattttgccctctgtagcatgggccacattgttggggatctgatcaagactctcggactggctgtcacaaaagggacagatttgcatattgagcacgaggaagcaggaagatggactggtccagacacttgtatctggactcctgcagatccaaggtcaaatcccaggttgccattccttgtgtgaatgcggcaaggtttctaaatcccaaggaacctgttttctcacttatctcacttataaaatgggtttggtattttctgccatacagggtggaaatgaagtttcaataatttagttcatttaaaaagcccagctcagtgtctggccccaaggcaagctgccgagaagctgtgcttgttactatggtgatggggtacagactcagcacttcttggggagagtcaggggagcagacacggttcgctcactgctctccaaggtgagctgcccctggagagttcctaggagggggccacgctcatggcaggcctctcagctctgactgagcagagcttgtttctgttgcctccggatggaggaacaggtaaggctggtcacctccattctcacagttcctgggggtccctggctgctgttgaaggtgaacagcctgggctgctgcctggtactggggagcctgcccttctctgctggcctcggggctcatcactgccatggctctaactggactgggatccctgccaagtattaaaggacccggcaacagatgggttgctgcagaacagctgtggagcagatcatggcctcagccaccctcccttggcctcatcttctgcccccatggagaaggcagactcatggcagtcctggggaccactggaggcctacaggcttctcttggacagctgaaagaagtgtgtctatcagaggctcctaccctgggccaaaaggcacccaggacagcagaaggaatcccaccaaactgagcatttcttggttccaaggcagccagctgccctccccacaatcttatcactagcaggttccaaactccaatgatacaaaacctgcctggtgataggggaaggagctgtttctagcttgaactcttgtttttttttttttttttgagacagaatcttactctgtcaccaggctggagtgcagtggcacaatctcggctcactgcaaccttcgactcctggattcaagcgattctcctgcctcagcctcctgagtagctgaggttacaggcatgcgctaccatgcccagggaatttttgtatttttagcagagacggggtttcaccatgttggccaggatggtctcgatctcctgacctcgtgatccacctgcctcggcctcagaaagtgctgggattataggtgagagccattgtgcccagcacttgaactcttgtttcaaaaaatcatctgtgggggaatgcagagcctgggaacagactcagccccaccctggcttcctttctaccgggccaccaagtctatctgtcccctccttttctaccgcccgcatccctactcggtgcatctcccaggagaaaaggcaccagcaggtttctcccatagaggacagtggaaggccccccccaccaacccggcctgcgctcacggtcacgcaagagtgggaagcagcttctgttcccagcaccctccctgttgatgggaaacgagggggtgcattaaggactctgaggagaataaaaataaaatgtcaagttgatgtggcccagaggcagtcagccacaagctgtgaaaagcctttgaaaagcttatttggctgagagagcggctcagccaggaaagcctgggtgagttccaggagctgaaccacaggtgctgagggagggagcccggggtcagcaggagcggcccaggcaagtgctggggacgagggcgctgggtccagtccccaccttcccactcaggcttgtctcccctgcttacctgtactgtttggacccagcgatgaaaatgcgttctgaaaaggtggggctgaactcttggctattctcacctaaagcaaaaggagttggattagcagagaggagaaaaaataggaatttagcacttaggggagagacattttacagagatcccctctggcgcctctccttcccctcctttccagacaacccctgtctggcagtcacctccccaccaatgcctccttcccgcactgtctctccccagcttctcagcttactggtcaagagcagaccacggcctcagccacctgctctgaaatagccaagcctatattatggggatcacagggcgcccgcctcacttcctatgaagctgaagtgagatgatctacagaaaatgctcaacacagtgcctggctcataggaaaaacagctattaggtatttatatatgtgtgtacatataagtgtggatatatgtgtatttttttaaaacaattattatgtcactctctgtattttagtttttattctctcatctctcctcaaaaaccaaccaggaggaagtgggagacgagggcaggatgtatgcgtgtggagaaatgacagcatggctgtccagctctccaggttccaccccaagaagcctcccgggttgagggaaggcgttggagagagaggactcccggccctacccaggcctcgtgggagtttctgtctccaagggaagccaccattactagtcatcataaggtatcatgagtagaagaagaaaggaccagactaggtctcaccctgcagcagcctgccgccccaggactggcccagcaggctcaagagcacggtgctcattcctgggggtggggccacctctaggtggaagatggtgaaggccctacaggccccagtggggctttccaggagacctggcctttcctgtctggagcctctccagacactggggctgctcaaggtcacagcagaaggttgatggcctgcttgatgattctgcagagtcccgagtgctcgtctgttacctctcttcccctgctccagtcacgatgggcacagtctccccttgccacatccaccatctgtgcacttttacaaccccactttccatgattctcggcacagacctctggttgtgtctcatgagaatcttatctagcagtgacacagacctctctcctccatagggaacccctgggcccagctacccacctgcaggcccacccacctgccccgtgcccacaacaaccctaggcccctacactcagcctgggcgatgatagagatggcagctggccctgcctcggagccttccttggctgtgcccttggtaatcacgtcattcaggatctcccactttccgcagaacacagggctcttctccacggcctcaagcttgtagacggagctctgtttcttccccagtggcggcgtcttctccttggctttggggagttccttctgctgccccactgctgagccaggggcacctgggcaggccatttccatcactgccatctcccaggcttgtgctcatcctgagagagaccaaacacagagcaggtcacttagaatcccagacctgggagaacacaggtcagccttgggttgggggagaaaggcaggggcaaagggtctctgcctgtttatgtgtgcctctgccacacatactcatcctccaaacatcctcaatggtaacagagtccacctctcaacagctacacgttccacacggcacagtcccccggtcctcccagtaccacaacataaacagcctccttcactgtgtccagcaaggatgccagcccactccctctaggagagctgtggcacaaatgtctgggttggctctttcttgcctttatgatggctcgatctttttctgttgttttatggcaaactttgtttccccaggacagggtggtgaatcccagactccaaaaccatggcctcactgaccccacataagcctttggagaggacctgttggcacacaccatccacagcgacttttctccaagtggagagaagcaaggttctattctgttccctagtaggaggtagatatctgtgtgtgtgtgtgtgtgtgtgtgtcctacaaagtctaaaactcagcatgcaaatggtgctcagcacgtggttccttgcccaatgcgtctgtttgtggctctccagaaggaactaacatgcttcctcctctaatgtccaaactcattggctgaaaacttctaggtatcatttttcattcaggcaacatcaggagtagaatttatattcaaggccctaacacgaacctatacctctagaaataaagaataaagcataagaattcacgtctctctgggttctgtcttgcccagccctaggaagctgcaaagaagagcaacccagagttgccaacaatctgtgcaaacagcctgcagactggaattggcaaaaaagagaagagcactgatttgagactgttaccatttggaaacctttttaaaggctgggagtttttaaagggcagggcccctctcaggcatgacttgctttagaaacagcctgagaaggtcccaaatgcagacagatttttaataactgctctctgatggtaggtttgtcttaaagctgctaccagcagaaatcatcttccttgctataactctgtgaaccctggatcacttctctgcttctggggcagacaggtacaccatctgaagctgaactctaaggcctctggccttttgccctgtgaggcctgaggactgaatgagatggtgggaagctgaggtactaggttgaagcattcctccttctgaatctgcctcactggtcttcccacctcgatggctatgaaaggctctgccagcttggctggcgggtgtggtggggtttgttgttcactattgattagttccttgcatctctgtctttaagggtctcctagctctgaacttggagcagctccagcttcctgcaaggatgcctggatttggtaccaaacgccagatgctgaggaggctgaatgggtggcctcactgttacctgaggatcttaagaagtctgagggggccggacatggtggcccatgcctgtaatcccaccactttgggaggctgaggcagaaggattacttgagcccaggagttcaagatcagcctgggcaacatggtggaaccctgtctctacaaaaaaatacaaaaaattagctggggtagctggcctgtagtcccagctactctagaggctgcggtgggaggaatgcttgagcccaggaggttgaggctgcagtgagctgagattgcaccattgcattctccagcctgagtgacagaataagaccctgtctctaaaagaaaaaaaaagtctaaggggtgttctgacatccaattaggcaaaagcccttcaaggctggctatgcttcttgtaactgtactttcatcccacctcacacctccccaccccactctacctccaaaaaagaaactgacctaagcccagagccgatcccactgttctcagcctctttaccaggggaaatgagatcttaagaacagaccaaaaagtctccaaacctaacagcagtagggaatgctcacagggagctcgatgtgagcgtgacctcctcatttctatttgaagaagctgaggcctaattcagtggagacttgcccaaggtcacccaacccacgtgtgacaggacatggccaggatccagaccctaggttctttaggctatgatgcccactccccaagctcctgggttacaggcaaatgcaggagggcacactaaggtcctccctggtcaacaggctcctgagggaagaggtggggccctgcacacagtgcctccccagtgtatagcacaggggccacagaccacgcaactgacgctggctgaacgagggactcaaaggacaaagattgcttttccataacctttggagacaggatgatcccgaatgctgaggaggaagagagagtcctgcctgatgaatgagaaaaatgaggccaggtggtgcagttgctgctctgaggggcacgtggctattagagatctggctgtgtgggggctctgatagcctgtctccgcctggcatggcccaacggaggcttctggataggtcatcctgagctagaactcctccagagggggtgcagggcatcccgagtcccagagttgtcctttcatattggtgttaggtaggcagctgtccagcgcccctctgtgagcacaccaggctcccctcttcccagagaagtggaagctgaggctgaggcagccacgctcagagactcctttgcagttccccgatgactcatccaacagcctggcaggcagacagtaacaaggaggctgttgagaagctgacccagcagatggcagctgaacttgtgaaggacatggggaaaacaggctgaccctcacctctcaggggcacaaatcacggcctgggagctgtaaagctcctcctgtggctggcttttctgtgccacatcaccatgactcagaccctcaccgacagcctccaagttcaagaggctattcttgggacactttggcctgacagtggctctccccaaacaccacctcccacacagacacacatgcacacacacacatgcacacacagacacacacacatacggatgcacttgctccctccctcctttcctaattctatctggactctggtctacaaaaatcatggttctgtactaagtccaggactactggccagggggccttcccagccctggactttggtctctggctgtcaccccagctcatggccctaacactttgccccttctccctcctgcagcgtgtggggaggacgaagtgggagccagttatgtctctgcctttgaaggcaagtcaaactcctgattcattcctcagcctagacactctcctcagcttattcacgccccaaaggcattgggccctctactctctgcataagagttgaggacacgagcagtggcaacagccaaacccacatggctcacccataagcccaagaaatcagaagaggaaaggaaaggagcagaattcactccatattctttgaggcctgatgcacagacactgttggttctttcttctgtgatgcctcagtgacctcctggagaagcctgggggataggaatgatctggacagtaccagatcaacctctgggcatagctgtatgaggagttcttaatctaggttcaaggatggattcagggagaaaaatgtaatttgcatttttccagggaagacttggtccatagctttcaacagattctccaaggatctgccattccccagaaggttcctctagtctccctagaaaatcagggccgggctaaatgcctgattctggctctattcttccactccgaggaaaagctctccaatgcagcagtttccaatctgaccacagattagaataaccagataagttctttaaatgcattcctcctaggcctgctgaaccagtcactgggcattaggcccagaatctgtacttttgacaagttctctggatgattctgatgccaaagggccagagactgccacctgacccctgctctgtactcaaggcgacactgtccaaaatggtagccactagcaacatgtggctatttacatttaattaaaatgaggtaaaattttaaaatcatttccttgttacactagctaccatactcaacagtgcagacagagaacatgtccagcattgcagaaagttctattggacagtgctgttctgaggtgatgagagcggtgttttctctgacagtaaaatttctgttcctaggattctggggcaggaatggggtttacagtaaacaaatttttgattcactggaagatacaaaaacaatgttttaaatgttaatcttcacagatgataacctttttagaatatatcatatttcattcagttccctgttttagcaagtacaacatagtaaaaattccagactgggaaccagaagctatgggttctagccttaacaatttttttttttttaagaagagcagtgggaccatttttgtcaaatgaaatcatacctcatctcccaataactaaaagaaccagatgcatgcaactggcatgtaactcacatttgaacccgctgccctggctgaaggagctccacatgctcagtgtcccttcatccaccgaggacctctacaaaatccctagttctccaagaaaagagtttggaaaccagcggcctaggaaatcttttgaggttccttctagttctgagaatgtagcccatctgtcaggattctttgagggctggacaactccaactcagaatactaactgtcgatacttacaaagtacctactgtcatctcattttcagacatgaagatatggcttagggaagtgtagtagcacaccaaaagttacgcagttgcaggttgcagaggtggggttgaacctagactgctgcctcctaagccgacatctaaaccttgagctagccacttcttttaacttctctgagtttcttctcttagctccttcagagctgttttgaagaccgaatgaagacgagtacatgaaatgccaatcaggttgcctggccaacagaagaggctaaatgaatgttcattcccttgtctgtcaccaggctactaaaagccatcactgagaagatgggacttctctgtttcagcaccatatagccaaggtatcttgagccttacctagttcatgcaatgcttggagccttgattctccatacacgaaagggaaataaaactctgtcttacagggccagcttgaaaatgtctacaaggggccaaggcaaatccctctcatgactatttcatctggaagtaaaaacttgtccttctctgaatgcccagaggggataaatagcagaagtagaatgactcaacttccttaataagatattggttgaaaaccaatcttctcccaacttcctcttttaagtcttcagcttgcctggccaccaggccacaataggcaaacctctgcctactcaaagtgcggggctgggctgggtgcggtggctcacgcctgtaatctcagcactttgggaggccaaggcaggaggatcacttgagaccagcagtttgacaccagcctggacaacatagtgagacttcatctctacaaaaaattaaaaaattagccaggcatggtggcacacgcctgtagtcctagctacttgggagcctgaagcaggagggttgcttgagcctgcagtgagccatgactgcaccaccgcactccagtctgggcaacagagcaagaccccatctcaaaaggaaaaataaagaaagaaagaaaaggaggggaaaaaaaaagagggaaccaagggcaagtatcaggcagagcaagctggcctggcaaaacagccatctggcgaggcagactcagaagtccccatacatgctcatcctgactcccctttctaccctttctgcccttcctacagcccttcccccagtttgttccagactgattccttcacttgcccgagcagggcagcactgggcaagcctctgattctcttcttctgcccaccctgttcctcccatagggagtggctgcttgccttcctcccttatcaatgtctgcccagatctcacctatcctttaaggcctatctactcaatgaagccttttatggtaggcttctgcatccaccctataaacattcaatgagtgtctcccaagtgccagggaatgtaatagccactaccgtccataaatgtcttctgtgtatggggcactgtgccaggaactctatctgccttgttaatgcattccacaccaaccctgcaaggttggcaatattatctccaattttacagatgaagaaattaaggcttagagaggtacattacctacaggaataaatgaggctcaatttatacagttagagcatccaacatggagttagggctcaagccaggacactcttggcccattctcttaggacccaaggatctctagttccttcctagaataaaatctggttggcagaggcatctagaacatccaggaactgagcagtattactacccatgtggatattactacccctagcatctgcccatctactgttggtaataattccttagcccaggtagacaggaagcagacgaagatcccttactgatgaggggtcttgtcaagtcagggctgaatcagccatcaatttgtcagacttttagttcagttacgccactaaatcctgttatgttatgtgttatgacttaacttgatggttttaacaggtcgtttcattttcttgaaacaatcaaacaaatgcacatctaatacacacatacacaaacaggagttctaggtaaggtggcactgccttcactgaaagaaccactgaaggatgtactttgcaaagaaaaaagtaaataggaaaaagaaacaatggtaggcacaggaactcaaacaatatgttggtcaatttaattaacagttgaatatgagaaattggtttaaatctttttttttttttttttttttgagatggagtcttgctctgtcgcccaggctagagtgcagtggcacaatcttggctcactgcaacctcagcattctggttcaagtgattctcctgcctcagcctcctgagtagctgggattacaggcatgtgccaccacatctggctaatttttgtatttttagtagagatgggatttccccatgttggccaggctggtctcgaactcctgacctcaggtgatctgcctgccttggcctcctaaagtgctgggattacaggcatgagccaccatgtctggccagtttaaatcgttttaaaacatgaaaatctagacaccaacaataaggaagatgggtgaaatgggttgttcaatgggtaaaaagtaacatgatccttgcctttttggggactttatgtacaacaacttttaaattttattagaaaaaattacagttagtatgtatgttgatttaagagtaatgactaaaataatagaaatacaattcagaccagaagaataaaggaggaaaaatagaaaatgctgtcaatctgatacaaggcaaggcaaggaggaaaaaagaagcaaaaaggacaataaatataaaataaaaacacaagatggcagaaataaggcaaaatattagcatgtcattaaccacagtacatgtgagtagattacaaaacagcaaaccagattggattttaaaagatccagctagatgctgactaaaagaaacaaaacaaaattatccagaaaagttggaaataaagacatagaaagagatgtgccaggccaatattaaccacaaagaagtaatattcgtatcagacaaaatacttaagacaaaaagatataatcacttctaggcacccgataaagagcctccaaatccaatgactggaggcaggctgaggctttatgttgagtaaggtcttggccccagagtgtcctgtctagctgcagagcaaggatcttatgcgtggcagttcctgggcatgtactaggtctgctgggtgttgggccccgtgctgagtgctggcagtacactgaggaagaagacactgtcccttgaggatcttacagtctactgggggaaacagacaagaagtcagaagagttcagtacaatacagggatgcaatgacagagatagacacacagcagatgtgacgggaacacagagcgacacctagtccagcccaggaggtgatgcctgagctgagtctgaagcagtgagcaagacctgcccaagaaaaaggagagggtgttctgggtagaggggatggcaaaaggtaaggcacagaggtgagtcaatgcagcaatcaccagcagcttgaagttgtcagtgagtaaagcgtaagtcaggcagtcccaggagaggaggctgcagatgaagttcagctatcagaccatggacacacgcttgatcctcatatacccccagggtttaaattctcagatgagtgagcggggtataattccacattcctcccagactcttgggggtaaagttccagatggcagaagctgcagagtaggggcagatggcactggccaggcacagtgcctcattcctgtaatcccagcattttgggaggctgaggcaagaggatcacttgagcctgggagtttgagatcagcatgtataacataacaagactgtgtctttatgaaaataaaaaaaaagaaaaaagaaaagaaaatcctgccattggtacagaacccccaccctggcctgggctaacaatctgacaagtgacaggcttctgaaaggcttgcttcactctctccctcaggcggagaaggagaatggccatgtgatccctgggacatagaaacagatgtctgaggaaggaggaaggggccttactggggcctgcactcaggcactgtgagtgaaacgcagctggaggaacctcagaactggactcattggcctgcttgaggcctgcttcccaggagagtaatttctgaataagcatttcccattaaggaggatatgaaatgtgaaggtacattaatcattaaaatcttacagatcaattattaaaaagaaacaaatctgacatgccctcaaaaactcagtctcggccaggcatggtggctcacgcctgtaatcccagcactttcggaggccgaggcaggtggatcagttgaggtcaggagttcaagaccagcctgggcaacatagtgaaaccctgtctctactaaaaatacaaaaattagccaggcatggtggcgcgtgcctgtaatcccagctactcaggaggctgagatgagagaattgcttgaacctagaggtggaggttgcagtgagccgagatcgcgccactgcactccagcctgggcaacagagcgagactccatctcaaaaaaacaaaactcagtcttgctgccaatcccacaggtcaaactgcagggtaaatacaatttatggggtaaagtttctgactgtcctgcaattaccaccacatgcctgatgatggctggccggccctagccgtgcagaaactactgtctataaggccccttcagatgtttagggcaattccctcgcatctattctattggcattggtcttacccacttccagcttctctctgacctcccaccctggcgctgagctaatcttgaaacatcgtgtacttaagacaacctcaagctcaaagacatctgctggctctgcactgcttatgggctcagtctcagctctgtggtccataatctttttggccattgtttccccaaacatagggtttggctttggccagtctgatctctctacaaccccttggctactcaactctccaggtcccatgtgtgccatgctgttgtgtgggccaccccatacatcctgcttgtccttcaaaggcaaggctcagcctctacccaggaagttcctcccatcagctccactgtacaacggcctccttttctgcctgcccacagcaccttgtctcctctatcctcatcctcctcctggtcctgacacccccactcccttttactcattcaatgaaacaatgtagatgaaggaactctgggaacaataaagcatcatagcaagtgaagatacccactttttgtgtgcacaactcacagaattgcaatctaagtagggaacaaattaaaaaaaacagaaaaaagcataatcaaaaatgtttagggctgagcatggtggcttatgcctgtaataccagcactttgggaggccaaggcaggaggattgcttgagtccaggagtttgagaccagcctgggcaatatagtgagaccccatctttacaaaaaaatacaaaacttagctgagcatagtcacacgtgtctgtagttctagctactcaggaggctgaggtggaaggattgctttagtctaggagtgcaaggttgcagtgagccatgattacgccactgcactccagcctggacaacagaatgagatcctgtttcaaaaaaaaaaaaaaagccgggtgccatggctcacgcctgtaatcccaacactttgggaggccgaggcaggcagatcacctgaggtcaggagtttgagaccagcctgaccaacacagagaaaccccgtctctactaaaaatacaaaattagccaggcatggtggcacatgcctgtaatcccagctactcaggagactgaggcaggagaatcgcttgaacctgggaggcggaggttgcagtgagctaagatcatgccattgcattccagcctgggcaacaagagcgaaactccatctcaagaaaaaaaaaaagttcacagtatttctataacagtaaaaaaactggaacaaaaaagtctaattacaggggaaggataattattaaataaatcatggaacatccattaaaaatgtttataaatcattttaacaatatggaaaaatgggatattaaattagtagaaagaggatacagaagcatatctaaaatacgaccctatatacatgtgtcggtatattacaatgatatttataaaaatgcagatacctaggacatatagcaatggttctcttttggtggtgggcttatggatgatttaatatttctttttatacctttctaatttttccactttttcagtgagcacatattagttttctcagttctctttttttttttttttttgagatgcagtctcactctgtcaccttggctggactgcagtgacacgatctcagctcactgtaacctctgcctcccaggcttaagtgatcctcccatttcagtctcccaagtagctgggacaggtgcgtgccaccacgcttggctaattttttgtatttttggtagagacagggttttgccatggtgcccaggctggtcttgaactcttgagctcatgagattcacctgcttcagcctcccagagtgctggcattacaggcatgagccactgcgcccgaccttggttctcatttttaacagataatgtttctaagtggttaaaaaaaaaaatacagaaggggtgccattgaaaagcatgagtccttccctccattcctataaggggatccccgttaacagtttcttgtatctccctctactgattttctctgtaggtattacttttattcatttttattattgttattatttttatgagatggagtctcactctattgcccaggctggagtgcaacggtgcgatcttggcttactgcaacttccgcctcttgggttcaagaaattctcctgcctcagcctcctgagcagctgggattacaggcgcctgccaccacacccggctaatttttctatttttagtagagaccgggtttcaccatgttggccaggctggtctcaaactcctgacctcaagtgatctgcctgccttggcctcccaaagtgctgcgattacaggcatgagccactgtgcccggccaagtattactttttaatcatgaaaacaactaaaaaagaatctcttggcatgggatgagaatttaggaagcattaggtccacacttgagattggggctttataaatatgtgatgagctggtttctccaaccgtgtgcgcgcacatgcacacacatgcaagcacaaacccatgtgtgggcaggaaacttcaccagaaagtctgtggctcttctgttctgctcactgagttctggcagctgggccgcaaaacagaaggctggagatgggcaagcttgtccttcctggttttggttttcatttcattccctcccttgttctctgctgaggactgagagttttatcagttgtgactcaagaaataggaaggtgctcagaagatgcggactgtttcctgctttgatttatcgaatggcaaatgcatgcgtggttacaggcccgtgctagtgctggatggaccacatgcccctgggcaagagtggccccccagagtgaaaaacagcagaagtggaccagggagaaaaaaaccagcccttcctccactgcttgcgcaaaggggtgggaatcgcagggttagtcctagtctgggaaacccaagggaggacagttttcctagctagcctctcctgcctttcttatatgtgatctttaaccttgcttaaaaattttttttcaggccaggtgcagtggctcatgactgtaatcccatcaccttgggaggccgaggtgggtggatcacttgaggtcaggagttcaagaccagcctggccaacatggggaaatctcgtctctactaaaaatacaaaaattagctgggtgtggtggtgggcacctgtaatcccagctactttggaggctaacgcaggagaatcacttgagcccaggaggtagaggttgtaatgagccgagattgcaccactgcaccccagcttgggcaacagagtgagactccatctcaaaaatttttttccaataccaaaataattgttcattgtaaaaatgtaaacaaaacaaaattgtatatagaaaaaaaatcccggcaccgtcccgtcctctctgcaacataaaaaacacttaagtttcatgtaaatccttctagttccaattactatacatatataaacatatagtttgggacttttttttttttttgtatttttagtagagacggggtttcaccgtgttagctaggatggtcttgatctcctgacctcgtgatccagccgcctcggcctcccaaagtgctgggattacaggcgtgagccaccgtgcctggcctagtttgggactatttttaaaagaaacatggattatacacatgtaatgtcatacaaattgtatctttcacttaagatactatgaatactattccatctcagcacatttagatttatttcttttcttttcttttttttttttttttttttgagacggagtctcgctctgtcgcccaggctggagcgcagcagcccattcttggctcactgcaacctccgtctcccgagttcaagtgatcctcctgcctcaaccttccgagttacaggcgtcagccaccacatccggctaatttttgtatttttagtagagacggggtttcaccatgttggtcaggctggtcttgaactcctgacctcaaacaatccacccgccttggcctcccaaagtactgggattacaggtgtgagccaccatggttgacctctaattcattctttttaaggcttcataagattggaaggtacagatgtatcatcattttcccacctggaaactttgtttccaatttttcacttatacgtaataatggaaaaaactctacccttattcacatttatgtgtacatgtagaaggaattctaggtggtaagctcttgggattggaatttctgggtgactcttttgttaatgggttatatcttttctcctgtttctatgtgtcagagaagtagatagcatcagataggtggtttccaaacattgtattatttatttgctgtgaagatgctatccttgctttcaacatgcctatagtctagatggggaaaaaatgggtagatggataaataaatcataaaggaataatcaaagtgctcttaggatcagaaagaccctcagaggtaatttcttccaacatattacttactaatcctgaggaatggccattcagctacatgacaggatggccttggagtcagaagatctgagtttgaatcttagtttctcaatactctggtgtgtgaccatgggcaggtcacataatctgagactcaggagtcttatctgtaatatagggatcctcaaacctacatgatagaattttacacggtgactcaatgcaaggaacaaagtttaaattacatagcacagtgcctggcatgcagtgggcactctggaaacatcagtggaacctccagtgagatggaagccgctacaagatgagcagtcagacctttgtatgactggaagtgtaagattttttttggttttatgtttttttattttttttattttttgagacggagtcttgctctgtcgcccaggctggagtgcagtgacgcaatctcggctcactgcaagctctgcctgccgggtttacaccattctccagcctcagcctcctgagtagcgggactacaggcacccgccaccacgctcagctaattttttgtatttttagtagagacaggatttcaccatgttagccaggatggtctcgatctcctgacctcgtgatccacctgcctcggcctcccaaagtgctgggattacaggcgtgagccacagcgcccggccgtttttttttttttttttgtgagacagagtcttgctgtcacccaggctggagtgcagtggtgtgatcttggctcactgcaacctccacctcccgaattcaagcgattcttatgcctcagccacccaagtggctgggattacaggcatgtaccaccacgcatggctaatttcatttatttatttttttgtagaaatgggattgtgccatcttggccaggctgatctcaaactcctggcctcaagtgatctgcccacctcagcctcccaaagtgctaggattacagatgtgagtcatggtctataagtgttaagttgcttcaaagttgctgctataaggcactgaagcctacctcccacagcttctagccagcagccctagcatcagacagaaagtctggaacagatgtggtcaaagcaggaggaggacaatcctgaaagcagagggacagagtggtcggcaagaacccatgaagatgttctttgaagagcattctgcacaccccatctggcttctgtgtccactggcagtgcctcagctctgcgtgatgaactgggacccacaattccttggcagctaaagctgaaattagttgtcctgtggtcatctttgagtgttacaacaatctgctatttgtatacacataactacatgctggttgttggtaatcatacaaatgaataataatgacagctattattatctgccatgtattaggtaatgcgtgcatttttttcttgaatcctcacaactctgtgagcaaggcactaatgttatccgtttacaaggaggaagaaactgggcctcagtaggccaagtaatttgcccaaggccacacagcagtgaagtggcagcggcaggatttgcacaagagacttttatgtcaaagcccatactcttaaccatgacactcttcctactcccaaatgatctaagctttaaaaattgggaccgagatgcagaagctgtcacaagtcaaaggttagtgagaaattcagggactggcctgggaggaagcaccttaattaggaagcatgaactacagccagcctatgttctggaaaaagcaactttaaaatgacaacagggaagaaagactccaagctggacttgtggtgggcctgtgttcctcagcccacccaggcctgacatagccaggcccattccaaggagaaattctatgacaaatgcaaatttgccattcactttacaaagcctggctgcaggcttcttgaacctatttaccattctttttataacaaagactcgagcatcatttgctatcttcataaatttcatcagtacttttgcccccaggccctgatacagggcattttataagctttaaaagagaagtattacaatggtattttcaattcaaccttcaaatcctttgcacaaggagagccaacagcaaatagaaaagacgccacagggggcatcatggatccacaaagacccaatatgcaggagaacatgtcgggcaaggtagtattgagataaaaacctgtcacacgtgtacttaattttatacaataagcaacaaggaatgtttaatgtatattgtataaaaaatttttcaggccgggagtggtggctcacacctgtaatcctagcacattgggaggcccaggcgggcggactgcctgaggttgtgagatcgagaccagcctggccaacatggcaaaacgctgcctccactagaaatacaaaaattagctgggtgtggtggtgggtgcctgtaatcccagctactcgggaggctgaggcacaagaatcgcttgaacccgggaggtggaggttgcagtgagccgagattgtgccactgcactccaacctaggcaacagagtgagactctgtctcaaaaaattaaaaaaaaaaattaattaattaattaattaaaaaaatttcaagtgtcatcgaaatcagcaacttagggtattttgtgtaactgaatattctgattaagtgggggctgccctgtatgccacttaacatgaccaatttccaaagattagatggccataattgcccttgacactaaaatcatgtgaaacacagccagtttctttgatgactcaaaacgtactttgtgatcttgccaagctttgagatcatcgttacaagcagcattttggttgtgaaaaacaactctccttatttaaccttttggggtggattctgagcaagaagttccctaggctacggtcaatctcgctgaaatacaaccacccaccgctcctttctgggtttagaaatctggttttcagaggtgggagtggcttcaagcagcgtctacctgtgttcagaaaagatgaagaaagacaggctcaggctccctgtataggagaattcaagttcattgtagtcactggtgactggttctgaaattgaggaactagtttgaggaacttcagaataaacaagaaacccaaagaactcagcttccacagaaggcttccaatgcatggaaggaggcacaggtccagctccgccctgtggcggggcaaccttgaccctggcctcatttcagatgctgccccacatgctctttgacaagctggaccaagtaaccagcttgaggacatgagtggcagaggggtccctttataatgaggggtcatattcttgtcctcccttgggaaggtaaaaaagggcttgggacatggggcatgatgaggaatattctcagaggatctcacacgattctttggtaaaagagggtaaatcatgaaacagcccacggctctctcgtcctccccgaggccagcagggcttagcgggaggagtttggattcaagtcttgtactttcactcaacagcaaatatttaatcagtggctaccatgtttcaggcaccgtgctggccagcaggaatatgaggatgaccaagagccttctctgttgaaacccttgaaaggccttcttggaatgctgaacccagttacctagaagcactgccttgatctacctgcctacaactctctagtggcaccaagcctatgggatgtgccagtgtggtcactgccctcccaattctcacttggaggggtgggaggtggtcagttatgtgtttattagctggctactcactgtctgattctactttgaactatattttcttttttgagaagaggacttgttctgtcacccaggctggaatgcagtggtacaaccatagcttactacagcctcgaactcctgagctcaagtgatcatcccacctcagcctctgaagtagctggactacaggtaagcaccaccatgcccagctaatcttttttttttttttttgacagagtcttgctctgtcgcccaggctggggtgcagtggtgcgatcatggctcattgcaacctctgcctcccaggttcaagtgattcttgtgcctcagcctcccgagtagctgggattacaagtgcccaccaacacacctggctaatttttgtatttttagtagagacgggtctcaccatgttggccaggctggtcttgacctcctggcctcaagtggtctgcctgtcttggcctcccgaagtgctgggattacaggtgtgagccactgcgcctggcaatgtccagctagtttaaaaaaattttttttttggaggtggatctcactatgttgtccaggctggtctccagttcttggcctaaaaggcaatcctcctgccttagcctcccaagtcattgggattacaggcatgagccactgtgcccaagcaacatttgagcaaatttctcctgactgtccctacgcttctgaaaatgcacttctttcccccagagtgctgaagttgcccaactgttaccaagctcccgctccaagctgacaagtggtacaagaccccagggtgagagaaataccaaggtgttcccacccaggcacctgcagaatccgagacgctctacgcctgacagtgctggctcaggctggaaaaggagggccactgggctgcgcatggtggcctcctcgctccctccagctcctatagtcatggctcctgaccagcaccggggttgacctgtgagatgtctgccttcgtgcccagcttacccctgtcttggtgaggtcctccagggcggtgcctcaattgtgtttggttttctagcacctagcagacatggcccatttgacacacttggcaaatgttcctgagtgaaaggacagacacacttctgaggaataaatgagtgccacaggctctgagagcctggctggacagggacacgtgtccacactgtccaatcacctggcaggctggaagggagggagtcacaacttggtggctgtattctaactgcaccccagcaagcaggtgtcctgaaagatggctgtggagcctctcctgccatcccctttcctaaatgctgacctagagacccaattacttctaattgcttgagaagataacccttctgaactggacaacacccatctgggctcggatttgcatatatttgcaagtatctaatacatgctagagggaggtggtgcaggactctgtccttcacattgatctatacaaagctattcctgcctctccaggcacagcatctgccagtggagactgttgggcaggactcaaggagtctggtgggtccaatcaactcccttggccaaaggagtccatcttttttttttttttttttttttttgagacggagtttcgctcttgtcgcccaggctggagtgcaatggtggatcttggctcactgcaacctccacctcccaggttcaagtgattctcctaccccagcctcccgagtagctgggattacaggcatgtgccaccatgcccagctaacttttttgtatttttagtagagatggggtttcaccatgttggccaggatggtctcaatctcttgaccttgtgatccgcccgcctcagcctcccaaagcactgggattacaggcacgagccaccgtgcccagcctccatttataatcttaactggcaaccacatcctcattggaggctggctaagcctccttttcctcccaaccctcctggctatccctagtatggaccagaaacacctaccttttaattctggcccagtaaaaggaaactttaatgtcagtagaaggtgggtggtagattttggctacaataattctttgcacttacaggggccaccatccagatatgacatcatgacatcatgcttcacccacaaggaagagcctctcactgagaggagccaggcagatcagctaggataacacccagagtatgcatgcacctcctgcacagaagaaagatgcagaagagcttcgtgcactgtgggtttggacccctgtaatcaatcattgaaagttactaaatacccactctaggtgagatactgcttggctaggtaggaaagtgccctaaaggtgtgggcaacctttgagacttcctggtaattgtattttcttatcaaccttgacctccttttgattacatgaacctcatggtataagacagcgtccaacaaatagctttctgtttactttttcttagacccagggcagcagctgctgtggctccacccttcccaggcctggcagagcttgcagaaaggctgagagtgatagggttgtggtaggggaataaaaggagaagctagtttaaaaaaaaaaatcctgcttcaggattagttccttcgttccctggcagcagagtacagtgaagagtctgggttttatagttcaggctctgccattaactagctgtgtggccttgggcaacccacttggctttcttgggccaccattttctcttctgcattttctcactgcaaaaaatgtgaatgatcatgtccaggctataatcctaacagctctttctggacagtgaggttaaggttatttagccatgccagcaggaggtgactactggttggtccagactgatggggtatgggtacaggggctgggttggtagtctgccagagacagggaacgagattatttgcaagagctgcagcttcattaaagtcaagccctccttgtagttggtcctggacattgcttatagatgtccctgaccataatcggtcaagttcaacaccaactgcactagtccagaacagtgtctgaagaaaatctctgcgttaatggacacctgatagtggctttagcagaaagagcgtcaggagaagctgtagtaaccagaacctgggagggagggatggctcaggagtaccccctgctgcttctttcttggtacaaatcctggtcctagaagtgtagacaactgagatggtggcaggcttgggattcctaaagctttctgaaatccagggtttaatctagcctttacaatcgctggagctctgcagagactccaactcaggtggctgaaaaggaggcaggtggaaaagcgttcctaaaaggtttttcacaccaaaatagggcttgtctctctgctctctgccaagggatttcccagctccccagggccaaagctcccctcctgcttctttgctgactgtcactggaagcaggccattttccaccctcagggtggctggacttaggagtcagtgacactgctgatctgggctctgtgccccgtccacgatcccccctccgctgtcagcccactggccccagaagcctcctgtttacctcctgccccctgcctccatagccctggggctgggatgaggctgatttgtggcagagggctcctcacgaaggtctgctcaggactttctctgcaactgtgctggggaataaatcgcctgtcacctacacccctgcatgggtgactcaccttccagagaaagtgctctgctcacctaagcaaagctgcttggaaaatgactaaggcacctatcaaatgcactctgtggggccaaccagttatggagcaaggtccaggcacactctgcctctcacctccagcctgaagtcaagtgcagagctgccacgccaggcctgctggtttcattttcatctgaaccgagctccacatgaggcttgacatccggtgatctattttttctaaaaactagcttcactttagaaatgactcttcggccatcaagtcagcttccccaagagaaaacaaaatgttatttaaagggaacagtagcctggtgagagcctatatttttgttttgtattaaggtgaaaaaagactttaaaatataacatgaaactttttttttcccttgtgagattaaaacaaacgtttttctttcaagagatggggtctcgctatgttgcccatagctacttgacctcctgggctcaagtgatcctcccgcctcagcctctcaagtagctgggactaaagaaacacacgtcaccattccaggcttcttgtgagatttaaaggggaatctgcaagtccttgactgcagatcgtgggcccccagacagagtctcagagagaagctgacaaagacatctttacgagggggaaagggtggtgagctggggatgccatgtggtagtgggaacctcatcccacagaaccaaatgttccctcctgttcccccaaagaacaagtccttgctgatctacatgccatacagtattttccctttcctcacctccaggattaatgcaggaacctacttgatcacgtgtgggacacaggaagcccctagacaggcctagctgtgtctccagctcagagttaggattgtcaactgggcagagcctggacctttgtagcctcatttggagtatggtgagggcagtatatagtgtaagacagggagaacccgagagctgaagcttttagactgaaggactgtccccctaaaggtcctactgagaaaatgactctggcctgtcaggcagtctgacccttcttgacatcatcttacagaaaacaggtttagtcacaatgcagtaattggcaactactactgctactattactactactactactactactattactaccaccaccaaacaccaccaacaagaacaacaacaacaacaacaacagttacagcctctatgttctgtgctgggcactgggctcagcactttacatatctcctctcattttctactcaaaacagccccatgaagtatttctgatcccattcacagatgaggcacctgatgattagagaagtgaagtgatttgcttgcgggcacacaggcaggccgtggcagacctcgacctgacccaggtctctctgacctgacagcctcagccaccacatgtgacacggagacaccaaggacttgttctgttgctctggacaaatcacgggctctctgcctttgtttctacatctggaaaatgggcacaagcacacctgtccaggcagcaggctattcatcttttggccttttattaattaaaaatcaatatcaattaataattgattggtacaataaataaataaagctgctaccctggtttcgttatgttcaaaattgacatgtttgggggaagaaaatccttatcgtttcatgagcaaggtagtagaaaaagcagtgacctagatatcaagaaaagggggtttagattctgagcaatcctgtctgtttctccttatgaggcttcacttttctgatctttgtccctgcccttcttcacatgagtatggtgtgaaaatacaaagactggccataaaattattcttgatgccacataatttcaagggatttctatcagggagctgagggattaagacatgtagaaaagcaagaagggaagaggctcctttaaactagaatacaaagagcacaccggccactgaagaaaaatgactttttctgcattgtcattcaggcagtcataagcccagaacaaaaaaatctcatacttcaatgtcctgctcagctcaacagaaatgctcccctacaatttgccctacgtctggccttccctttttgggctactactttcagcattttagccagcatcaccgagtaaatgcaaaaccttcacacatgcatcactttgaatgcccacccagctcttgcagatgctcagccccattctgttcccttactagggaatcctggtgtgtggagaccagaggggctgacatccttagagctccctaaatccactgacatggaattgtccccggcccaccaatttcacactggtgccatcaatagtgcccataatgctcagatgtttccagtttaactgaaatactaaaatggggcaaacaggaagcatcagacacaactgtggtagtgacttattaatcacgaaagcagaattttagttgcattttaaccttttgccaggaaaaaaaaaaaaacaaccttgagatgatggaagccattagtagaagtacgctgcctttatgcgtattgggctgacttagactttttacttaggactgactttgcttttaagatttctgaactttccccccagaaagaacatctgtcaaaccaaccaatatgaatctgtcagctcttcatcgaggcaggcaggcttgttaggaaagcccatgtgctgtccattgagacaggaaaaaaaataggaagttaaaagtgccttcacaggccaaagtgatacaacactgttcagagggtgccaacaacgaagaaaacaaccctggataaagctttcatctctttcacatctccgcagatctctcaccagaccctagccagggatgaactgttatcaatcaccaaaaaaaaaaaaaaaatcacaacagttgccgagggctggacaaccaatcagcgcaagccatcttctcagcagtaaatgatatacacatattccaggcagatcacaaaggagtcagtgttcaacaggagaaccaaaatgaggaaccaaaccttcatctgttgaggcgaaacagcccaaccagacatttttgtttaatagagggagactgatttggcagggtctctgtggtgccgctcccacaaactcttaacagacaataccaatgacaaaaaacccccttcagaactgcttcttataatcagaaaacactcagaagatggcctgaagcttggcagcgtcttgctgtctgatttcacaaagagctggtacacatacctgggtacttatctctaaaattagagtcagagacgattacttttattttgagatcttctgagaagttctccacacccttcaaaataaataaggatgtccgaaaggtgtctgaaaaattcagaggtctggcatcgctccaaagaaactgattgatatcacttaaaaaacaccaagagtaaatccaaacacaaccaaagtaaggcaagcactttttaagtgtcctctcacattaagagcataaaaaccacaccaaaaacttctccctcctttctgcatctcagttctataatgtggtcctgatctaggattctgggaaagacccatccttagtcccagctatgaggcatcaggcaagatatataccacccccactccctcatacacacctgcctcaggtgcctcgcccataaaacaagacactacaatctgtcttaccacacagccatctgaaggaaaacggagctcacaggtatgaagacactaagcaaaaaacacatcactaatgttaagatactgtctccttctaatctttcagaaagaccatgtttctagtcaaggggtttccaacatttttcttggaataaactccagactcctattttatatcatgacctcactctaatcatttaatttcatgtgcttttaaagtccttaattaagtcattggtgttcattgtctccagcgatcaaaagtagttttaccatttactttgctgatgtatgtaccttttcaccacttatcctctccctcattcatacctccagtccaccctttagggccgagagcaactttttaacctcgactaggaaggaaacactttttctgaagctacccagcactaaggaggctcccgggcaggtgggaaacgtacgtacaagtggcccctctctgcctggtgcccagtggctgcaagatgccagggccacgatgggtttccaagatgggaatgttatatttgaaccgacagataaagtcccgagttggagagcccagaagaattacagaggaggactggggtccgagggcggagggaggatgctgcgggcggccagcactgccccgctgcatgctgaggacaggcttagctcctgctccccgccttgaggtgtgacctgagaacttcccatgaaaggccgggagggtttcacgccagggcagatgccagggcgcactcctgcaggagacacgtccgccccgcggcaggcgagctccatcctgggggcactggggcgcagagcaggcgggcgggcctggcggcggcgcggggcactagtgaaggggaagcaggcggcccctgcgcgcgctcggagccagcgtgtggccagcaggagtgcgcggcctggaggcccggggcgagcgcggcaccggcagcgcgtgcgagggcgcgcccgcggaccgctgcgagtgggttggacggggtacgtcggactgcgctggcctggccgccgaccccactgctccggggcgaggggccaggccgcagcccagcccggggctgagaggcgatccatcccagccgctccctggtcgcctcgcaccgggccccagggtcccgccccgtcacctaccggccaagcgccgatctccccaaccaagcgagtgttgcgctccgctcgcccgcgatctcccgccgccggccgccgaccgctgagctccc

SEQ ID NO: 2566 - DNA, 20717 bp, Homo sapiens
  source 1..20717: mol_type = genomic DNA
tcaataagaacaagtttaaaaacaaagagcatggacaggcagtttacagaaatgccaacagccagtatgaaaagagactggctttttaaggtaatgaaatgtaatttgagcagtgacattacactgggtgggcaaagatgactgtcactctcgtggtttatgtccccttgagtcaatgggtaaggctggaattaaactggcaagtggagaaatgacagcagcctcacctggagtctgtttttttgggtggagcaacaactgccatgtccacagtaatgatgaatgcttctcgagccacgtcgctgccaaggtcttcacaggcatttctaaaaatgaagaatccttgactgcagacacgcaagttaaaaatcactaattatgttctcgatccagggaatatagttaataacttttgtgtagactccatactgacctgcttccccacaattcatggaaccccaggacactattcctcccacaaaccacctctctgtttcactatctagaaacaccagtgcccctccgctgtcacctctgcagctgtccttgcccccactttctaagccagcacaaagcatgttagcagttacacttccccttggatagggtggcttttcatatgcagcagtacatttttgatggtcaacaatcggtatgtcgacatacattagatttctagcaagaaaacccctttgggttaatccccatccagatgcagttccaatgtcatctgtcctcataaaggattcagcttcttttcttggcagacaaataggcgtgatgttgctattgattacaactttgttattcaatttaatcagtgctatgtcattgtcaaagccagcatcatgagtataaccttcatgtataaaaacagcttcagaccaggcttgtgtataatgaggtgatagtcttttcagggtgcccattcgaatgtccagggcggatgcatcatgtttttgctcatagacggcatgagcagctgttaggacccagttgtcatataaaagtgcacctgctgctgtggttccacctaatatcaggacttgccaaggaaaatcaccaggttttgccttttgccctccatatatacgccctcctgttgtgcgggctgatagtccacaaactggagaaagaagcagataggtagagagcctttgtaaaaatgtcaatcgtgtttttcttaaattatgaccgccttgaagtatatatttgatgtcaaccaaaaattatattacatgaattggtgggtgactacctatacaggcaagtgaggctattttaaaacatcacagttcaaacacctgataaaaccttttggtatttcttagctcctcagaaaatgagattagtgaaaactgacttttagaagttattttgttttgctaaaataatttggtctataagattgggaaaattggccgggtgcagtgtcacacctgtaatcccagcactttgggaggctgagatgggtggatcacctgaggtcaggagtttgagaccagcctggccaacatggtgagaccctgtctctactacatacacaaaaattagccgggcgtggtgatgggcacctgtaatcccagccacttgggaggctgaggcaggagagttgcttgaacctgggaggcggaggttgcagtaagacaagtcacaccactgcactctagcctggtaagagcaaaactccatctcaaaaaaaaaaggagattaggaaaattaacagggcaagcaggcattgtctgagcagatggactggatgatgtgcataggaattagaaggatataaccttttcattgtttctgttttcctacttgtaaaatgggtatttatgtaatcctaggaaagcaggaactaaagtcagtatcaggatttgcaaaattacttttacctttgaacatacaaatgttttagaaattagaatgttgcagttgtggctaggaccctgtggattccaaaattttatttttggtctagttgattcttccaaactaagttttattgtatctttattgcaaattaaatacgcccattaatgtagcatatatgtttgctgttgtggtagtgtacttgcattaatacctacagacgttgtgttagccaaatacaggtttaaaaaaactaatttgagccaaataacacaagggtaattaatatattactatctttctgggttttttttctttttttttttttttttttttttttgagacagagtctcgctctgtcacccaggttggagtgcagtggtacaatcttggctcactgcaagctctgcctcccaggttcatgccattctcctgcctcagcctcctgagtagctgggactacaggcacacgccaccacacctggctaattttttgtatttttaatagagatggggtttcaccgttttagccagactggtcttgatctcctgacctcacgatctgcccgcctcagcctcccaaagtgctgactttttttttctttttctctttttttttgagacagagtctcgctctgttgcccaggctggagtgcagtggcgcaatcttggctcactgcaagctccacctcccgggttcacgccattctcttgcctcagcctcccgagtagctgggactacaggcgcctgccaccacaccaggctaattttttgtatttttttttttttagtagagacggagtttcaccatgttggccaagatggtctcgatctcctgacctcgtgatctttccgccttggcctcccaaagtgctgggattacaggcgtgagccaccatgcctggccctgatttgtttttttaaatcattctacagagggggaggttgcagtgagccgagattgcgccactgcactccaacctggcaagagagcgagattccgtctcaaaaaataataataataattctactcaactattatctttggagccaattctggttaaaaaaaaaagtactattaaaaggcagattgcattgatgtttaaaaactagatgttgaaaacaattgcttggggaaattatttgctttgggttttaatagcattttaacatagaatagtaactcaacagaagaacttgtgtttataaatgtataagttggtcaagataatttttaaaatctttttttttttttttttttttttggatatggaatttcactactgttgcccaggctagagtataatggtgcgatctgggctcaccgcaacctccaccacctgggttcaagcaattctgcctcagccgctcgagtagctgggattacaggcatgtaccaccacacccggctaattttgtatttttattagagacggggtttctccatgctggtcaggctggcctcaggtgacccacctgcctcggcctcccaaagtgctgggattacaggcgtgagccacacctggcctaaaaatcatttaattttttatgcttgcctagttataaggtcaaagagaatcaaatgactgatgcagtcagcacctaacaacctctgtatatgggaagggggtaatgagaacatactatttggaaataataacagcctaagagccaagtgctgaagttacatttctgcctaccacagctaaagctctcctcactgtctcctacccagtcctcctttccatcaattaccagtctcttgtataaatgtatccattaccaggctcacagactgggagtgatttttctcctttggagctcgtccagaatccatcagcctcacacacatatttacctgcaaatcattggaaaagcaaaaatgtttaactgcatgtataagatggttgtcatttgcttgaatacccccttgaaaaatgttgattcttgagcatcagtgggacatagaggtgtctgaagaaccattttacatgatttcataaataggaggtctctgcattaccatgtttgcttgcaaagtggaaaccttttagatgtgtaacttgaatatgtatcaagatctcaagtgcttaatgataaggtgttgacttgttaaattaaaccatttggaatacattgtgtgtttgtagtagtcatttactagatctgttttcagatttttgcaaattgacattaaagtcactttagctataatatttcacttagcggatgggagaagtggcttttaatcttttgtctagccttagccaaaaatgttggttaaagtttattttcagaccatgggggctcaagttccaagtattgcccacccccaactttgaagaatttgcataccatcattcactttcattgtgtagaaggtctcttcacagctgtactgaatcacagctttgtaggtggtcactccaggacctgtgatgtactccactcggccactgggtagatcatcaggagggccacagtcaacaactaagaaagaagcatgggagggaggaatccattgatcatttcagtgctaactttccaaaggtctggagaagcacctttgggaggctgaggcgggcaaatcccttgagctcaggagtttgagaccagcctgggcaacatggcaagaccccctctctacgaaaggttaaaaagccgagcatggtggcacgtgcctgttgtcccaattacttgagaggctgaggtgggaggtaactaaatggctgaactgagggggagtcgtccatgtggaggaagaggtgtgctgcctttcctagagaaagggaatttgaaaccacccagagctccttagcaccctcatgtcaaatataagaaagatctgcggccgggcgcgatggctcatgcctgtaatcccggcactttgggaggccgaggcgggcagatcacaaggtcaggagatggagaccatcctggctaacacggtgaaaccccgtctctactaaaaatacaaaaaaaaaaaattagccaggcgtggtagcgggcgcctgtagtcccagctactcgggaggctgaggcaggagaatggcatgaacccgggaggcggagcttgcagagagccaagatggcaccacttcactccagcctgggtgacagagcaagactctgtcttaaaaaaaaaaaaaaaaaaggctgcagcggaacagcacatgacatggcacaggttcaatgtaaaaggttgcaatttagaaggcagtaagggtagaaaaggacacgatagtaagattggaggagctgggctcggtggttcaaacctgtaatcagcattttgggaggccaaagtgggagggtcacttgagaccaggagttcaggaccagtctgggcaatagcgaaaccctctctacaaaaggtaaattggctgggcttggtggcgtggtctcagctactcaggaggctgaagcaggaggatggcttgagcctgggaggatgaggccgcagtgagctatgatcacaccactgcactaccgcctgggtgatagagactttgtctccaaaacaaaaaattcagcttattcttctgatccttttaataaattgaagtttttagaaagacctggaagtctttctaaagctcactgggcacggctcacacgtgtaatcccagcactcaagagaggccagggcagcctgggcaacatagtgagaccccatctctaccaaaaatttaaaaggagctgggtatgtggcacgtgcctgtagtccaagctactgaggaggctgagacaggaggatcacttgagcccgggagtttgagggtgtgtcacatgaggtatggttgatcattatcccagtttggggtgtgtgtattaccacataaaattgccccccttttctacatacaatagtgtatacttgctcacacatgtgaattgtgtgtaattggagggacacacaccaaaacggtaacgattaggccgggcctggtggctcacacctgtaattgcagcactttgggaggccaaggtgggtggatcacttgagattaggagttggagacaagcctgggcaacatggtgaaaccctgcctctactaaaactaaaaaaattactgggtgtggtggcgggcgcctgtaatcccggctactggggaagctgaagcaggagaattgcttgaacccaggaggcagaggtttcagtgagtcgagattgtgccactgcactccagcctgggtgacagaatgagaccccgtcaaaaaaaaaaaaaaaagtggctggtcacggtggctcacgcctgtaatcccaacactttgggaggccaaggcaggtggatcacttgaagtcaggagttcaagaccagcctggccaacatggtgaaacctcgtctctactaaaaatagaaaaattagctgggcttggtgggaagtgcttgtaatcccagctatttgggaggctgaggcaggataattacttgaacccgggagaaggaggttgcagtgagccgagatggcgccactccactccagcctgggtgacagaacaagactccgtctcaaaaaataaataaatattaaaaagtaatgattatacttgcatatggtggtattacaggtattaagatgttcataattttctgtattttccatcttctaccatgaatattgttgctttcatacttagaaaaatattgtcggccgggcgcggtggctcatgcgtgtaatcccagcactttgggaagccaaggtgggtggatcccctgagggcgggagttcgagaccagcctgaccaacatggagaaaccccgtctctactaaaaatacaaaattagccgggcgtggtagcacatgcctgtaatcccagctactagggaggctgaggcaggagaatcgcttgaacctgggaggcagaggttgcggtgagccaagatcacgccattgtactccagcctgggcaacaagaacaaaactgcgtctccaaaaaaaaaaagaaaaagaaaaaaatattgtcaggctgggcgctgtggctcatgcctgtactactagcgctttgggaggccgaggcaggtgggttgcctgagctcaggagttcaagaccagcttgggcagcacggtgaaataccatctctactaaaatacaaaaacttagccaggtgtggcggtgtgtgcctgtagtctcagctactcaggaagctgaggcaggagaattgcttgaactcagcaggcagaggttgcagtgagccaagattgcaccaccgcactccagcctgggcaacagagtgagactccgtctccaaaaagaaaaaaaagaaaaaaatattgtcaaagaacacactttggaagcctgaggcgggcagatcacttgacgtcaggagtttgagaccagcctggccaacatggtgaaacctcgtctttaccaaaaaaatacaaaaattagccgtgcgtggtggcatgtgcctgtaatcctagctactcaggaggctgaggcatgagaatctcttgaacccgggaggcagaggttgcagtgagccgagattgtcaccgcactccagcctgggtgacagagtgagactccgacacacacacacacacacacacacacacacacacacacactctctctctctctctctctcacacactttgggaggcccaggtgggcagatcacctgaggtcaggagttcgagatcagcctggccaacatggtgaaaccccatctctactaaaaatacaaaaattagccgggtgtagtgacatgtgctggtagtgcctcccagctcctgggggtagctgacgtgggagaatcgcttgaacccaggagacagaggttgcagtgatctgagattgtaccactgtactccagcctgggcaacagaatgagacccttctcagaaaaaaaaaaaaaaaaaaaccttgtcaaagaacatatttttctaaagcacataccttccctagtaggttggttctgttttaacctctaagaatgcactgagagatgagtaaaaagaagcaaatttgaaattcaagggctgataaatggatcattaaaaaaaaaaaaccaaggatccgggcacagtggctcacgcctgtaatcttagcactttgggaggctgagaccggtggatcacttgaggtcaggagttcgagaccagcctgggcaacatggcaaaactctgtctctacaaataatacaaaaattagccaggcgtggtgtcaggtgcctgtggtcccagctactcaggaggctgaggcaggaggattgcttaagcctggaaagatagaaattgcagtgagccgagatcacaccgctgcactccagtctgggcaacagagcaagaccctgtctcagaaaaaaaaaaaaaagggaaagaaaaaagaaagtaaacagaaaaccagagaagcaatagaagcagcaacagtagcagcagagggagttccgggcggttatggggcctgtagtcaccacacgaccgtactgctgcacgcgggcattggccggtcccaagatccatctttctgacaaactgcagtaaaggatttcaggggcaagtgaccctaaagaagaattcagaatatattaatttccttgtttatatcataaaatcactccccaaagctgtgctctcacagcagttcctattctagtgttttacgaggtgctcctgaagggggtggcagcacacatgactagtatctgcgtgtgctggggttggggggatgcctggcacatggacgcactgccccaccgcctcggtgcacgtctatgccacctaggttacgtatttcatcactcaacaggtattggcattttatgaatcagatggaacctttgcagcaatttataattttttttttgcttttcaccctaatacaaaaacatatcagatctcagccaggtgcggtggctcatgcctgtaatcccgacactcctggagaccaaggcgggtggatcacttgaggtgaggagttcaagaccagcctggccagcatggtgaaaccctgtctctactaaaaaaatacaaaaaattagcctggcatggtggcgtgcacctgtaatcccagctcctcaggaggttgaggcaggagaattgcttgaacctgtgaggcgggggttgcagtgagccgatattgcaacactgcactccagcctaggtgatagagtgagaccctgtctcaaatcatcatcatcatcatcatcatcatcatatctcaacatttctgcatctgatgttccaccatttctttatataaagtgacagaggaccaggcgcagtggttcacacctgtaatcccagcacattgggaggccgaggtgggaggattgcttgagctcagaagttcaagaccagcctgggcaacatagtgagacccccacctctacaaaaaagacaaaagttagccgggcgtgttggcgcttgcctgtagtcccagctacttgggaggctggggtgagaggattgcttgagcctgagaggtcaaggctgtggtgagctgtgatcgtgccactgcactccagcctgggtgacaaagtgagaccctgtccaaaaaaaaaaaaaaaaaaaaaagccagaggactgtggtgacaagtttgagaaagcaggtgtgatcagacttgcaagtgtgtctgtgtatctgtctagctggtggccattagctggaggagggctactaagagttcttttgtgagcttcgtctgtgtgctgtccatcagctttcaccgccagcgtcattcacagggaaacatttttcgacttgctaagataatgtttttctaaaatcaaacattaaaataaaagaagatggctttggcagaaaccctgtgccgcaaaggatttcaggtcttcttgtgttaagtcagaaactaaagaagtcgccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaacaaaaaaaaaagaaactaaagaagtctgtggtccgaggagctgtggaaaagagcctgcacaagaagtttgcaaggtgggaaaagtgtctctctttttttttttttttttttgacccgccacaggactgtggattgcatacctagctatcgttccaatgttattactttttaccactgggattccatgacaattttgaagaacataaagaggacgtgttaatttcttacctgtgcccctaaagcaacacgctaagcattttttaaaattatactcctcccttaacagtgaccactatttataactttgcagaatatactctttcccggggctgtctacttttttgtgggcccaggagttgtttcatggaaaggtcatttgaccagggggagaactttaatttgatgcaagactgggcacatggaacaggatagcaaactcatctttctgtcattccagccacttcacaaagagctgctgtcgtgtgtgaccaacagaaaagttgcccgttttattttattttatatatttttttgagacagagtcttgctctgtcacccaggctggagtgcagtggtgtgatttcggctcaccgcaacctgcgcctcccaggctcaagtgattctcctgcctcagccacccgagtagctgggattacaggcgcccgccacctaataatttttgtatttttagtggagacggggctactacctcatctaatttttgtatttttagtggagacggggtttcaccacgttggccaggctggtcttgaactcctggcctcaagtgatctgcctgcctctgcctcccaaagtgctgggaatacaggtgtgagccaccgcgcctggccaagttgcccattttaatcaccagctttccaaactagctttaaaacaaagggctcgcttatgtaaatttaaagttaagtataaagaaagaaagaaaaaagggcgggattcagaatcacattttccatagccatcctttttgtcctctgaaaacttatttcttggctttttatcatttaaagatagacaaaagaaatcatgctgacacacgattttctcactttcctttcacatatctgcagatagaaatatgtttacatttcaaagcaatcgtcattgatcgtggtgtactttgttttaactcacttgcagaagctcatagccagtctcgcaaaagatggagaagctgtctttcaggatgtatttggcttgcacaggtgaaacgtggccattaggtggcgccatcggataagggcaaggctgcgctgcgcagaggaaaccaggcttgttggttttcatgtggtctacagcagccaagactgaatcgagccatctgaagttcttagtttataaagaatacttaacatgtaaagagagctcaccatacgtggggtagggttctttaaaaccaaaggcaagattaaactctcaggtgcttttgcaaattaaggtttcttgttttccctgggactgagcaaaaggtatgtgagaaagctgggttatgtgggaagatggtgcagtccccacaaatagaacatctgctccatgccaggaacttcagagccatggctcaaaaccaagagagagtgtaactccgaggaaaagagctcaggggaggctttgggacttgcatgggactggagctgtgtttaaatcctagctctccatttccccatggttatgtgtaacctctctgagtctcagtttcttcatctgcaagatggggggcggttgacgataatagttgccccagggctgttgtgaagatcaaatacaaagcacctaggctagttcttggcggagctgtaatcaaccctcacagcagccccataggacagctgttatggcatggggagaaaaaccggctgacagacttgaaactaaagatccaggctgatttggggagcctcaggcttcccctcatgagctgcattccactctggcccccaaaccctggcctccactcaccccaaggcttcagtgctccccagctgcccctaaaaacccactggtcagtttcggagtcctctcctccctccagcacctgctagcatccagtgatccctgccaagctgctggggcagctgggtgcacctgggtgcccctgacccagcctgtggcctggggaagctctcagtcccatgcaggtcccaaagtctccccttgaggaatcaatctccagggacagccttggtggacctgtggaggcccagggcttctagcacttgagtgtctgtcacgacgaagaggtggtggaagttctggcagggcctcagagggcagagccagggccagtgggggtggtcctgagaggcagagtgtgtagatcctggctgcaaactgctgaagctgtggctctggtgcaacactccatggtcagaactcctttttcccctgccccaactcatacccacacttcaacttccacagctccacaccctgaagagtgaagcctctgggcttttgcacatactcttctgccacctagaactcttctgccacctagaactctgtccaacacccacttatcctttaaattcaatctcagcatttcctattcaaggatagcttcctagctcctagcccctgtctggtgaggtcctcctttggactctcacattgcccagtgcttggctctaggctgtgcttgccacagggctctggttatgtttctgtgactgttcccttactggactgagcagaggctgtgagaactgtggcttccacgttacatatccctagtagacatccataggatggaatgatgggtggatggaaggatggtggatggatggatggatggatggatggatggatggatggatggatggatagattggtggatagaaggactggtaggcagaaggatgggtgtatggatagatggctggctggatagaaagataagtaaggtagaagaatgggtggatggacagatgaatggctggaaggatggatgaaagaatgaatggatgaatggatggatgggtgggatctgtaggtagaaggatgggtggatggatagatggatggctggaaggatggatggatgatggatggatggatggatggatatatgggtggatatataggtggatgggtggatggatgaatggatgcatggatggatggaagaataggattggtaggtagaaggatgggtgggtggatagatggatagctggaaggatggatggatggatagatagaaggatgtgtgggtagaaggtcgggtggatggttggatgaatagaagaatggatagatagaaggatgggtggatgcaaggatgggtgggtgggtaggtaggtggatagaaggatggatggatggatggatggatggatggatggatagatggatggatagatggataggatgggtgggtgggtgaatggctgtaagaatgggcggatgggtaaatggatgggtgggtggatgaatgagggataggattggtaggcagaagaatgggtgggtgggtagatggacagttggaaggatggatggatacatagaaggatgtgtaggtagaaggatgggtggatggttggatgaatagaggaatggatggctagaaggatgggtggatggaaggatgggtaggtgggtgggtagatgtacagaaggatggatggatggggctgggcgcggtggctcacgcctgtaatcccagcacttcgggaggccaaggcggatggatcacgaggtcaagagatcaagaccattctgtccaacatggtgaaactctgcctctactaaaaatataaaaattagctgggcatggtggcgcatgcctgtaatctcagctattctagaggctgaggcaggagacttgcttgttccaggaggcagaggttgcagtgagctgagattgtgccactgcactccagcctggcaacagagcaagtctttgtctaaaaaaaaaaaaaaaaaaacggatggatggatagggtgggtgggtgaatggctgaaagaatgggtagatggatgaatggatgggtgggtggatggatggataggattggtaggtagaataatgggtgaatggaaagagggatggctgaaaggatggatggatgggtatatggatggatggataggattggtaggtaaaataatgggtgggtggatagatggacagctggaaagatggatggatggatggatggatgtgtaggtagaagactgggtggatgggtagattaatagaagaatgggtgggtgggtggataaaggatggatggatggatagaaagatgggtaggtagaagaatgagtggacagatggatgactgggagaatgggtgggtggatggatggatggatggatgggtaggtaggtagaagaatgggtgcatggataggattggtaagtagaaggatgggtgggtagatagatagctggaaagatggatggatggatggatggatagatagaagaatgtgtaggcagaaggatgggtggatgggtagatgaatatgtggatgggtagatgaatataaggatgggtgggtggaaggatgggtgggtaggtggatggatagaaggatggatagatggatggatggatggatggatggatggaaggatgtgttggtagaaggaagggtagatgggtagatgaattggatggatggatggaagcatgtgttggtagaaggaagggtagatgggtagatgaataggatgggtggatagaaggatgagtggatggaaggatggatgggtgagtagatggatagaaggatggatggatggataaatggaaggatgggtaggtagaaggatgatggatggatagataggtgtctggaagaattggcagatggatggatggatggatggatggatgagtggatggatggatggatggatggatggatggattggtaggtagaaggatgggtgggtgcatagatggacagctggaaggatgggtggatgggtggatagatagaaggatgtgtagatagacaaatgggtggatggacagatgaatagaaggatgagtagacagaagaataagtgggtgggtgggtggatggatggtggatggatggatggatggatggatggatggatggatggaatgatgggtaggtagaaggatgagtgaatggatagatggatggctggaagtatgggtgagtggatggatgggtgaatggatggatggatggatgggtgaagaatgggtgggtgggtggatggatggaagaatgggtggatggatggatggatggatagaagtatgtgtaggtagaaggatgggtggatgggtagatgagtagaaggatgggttgatagaaggatgggtgggtggaaggatgggtggatgggtggttggatagaaggatggatggatggatggaaggatgggtaggtagaagtataagtggatggataggtggaagaatgggtggatggatgaatggatggatgggtgcatggatggataagtaggtagaacaatgggtggttggatagatggatggctggcaggatgagtggatgggtggatggataagattggtaggtagaaggatgggtgggtggctatatggatagctggaaggaatggatggatgcatggatacatggatggaaggatggatggatggatggacagacaggacgatgggtgtatggatggatggatagaaggatatgtagaaggatgggtggatagaaggatgagtgggtagaaggatgggtggatgggtggatgaatagaagaatgggtgggtagaaggataggtgaatgaatagatggatagctggaaggatgaatggactgatgatagaagaatggatagttagaaggatgagtgaatggatagatggattggatggatggatggatggatggatggatggatggatggatggatgaacggacgaaggatgggtggtagaaggatggctgaatagaaggatggatggataggatgggtaggtagaagaatgggtggatggttgtgtggacaaaaggatggatgggtgggtggattgatgaatggttggaaggatgaggggacagaaggatgagtggacagaaggatgggtgggtaaaaggatgagtggatgggtgaatgggtggttggaagaatgagtggtggaaggatggctgggtggctggctggagggagggacagcgggtgcttccccttagaagactgctgcctcagacctcagacaccactaaacctggtgtcccttcctagtcctggcccagaaggagccctacactctacagctccttgacactccaggagagagggcagctctgcgcttccagccaagatctgagacccacttgctcacctgtgctcgtgtagtggatcttccagcctgtgtggtctcctgattcatctgtgacaaaggtgatggtcaccgtgttgctttttgtttcaatcctgtggggcaatgtcttcccacagaatgggccatgttcttctctgtctgtttgaatctgagaaagaagctcatgaaagctggggagcagctgcctgggtctggcctgggccggagggaagtaacccacctcctcagcatttcagggacagccaatgaggccaacccaggccatggattggggtgcccctccccactctgcctcccacacttgtactcgaaggccccagccttggacctccatagagcacctgaagaggtgggggtcaccgagggtgacgggaacgtggtgggggccatgctgcaggaagtagggggtgcagctgggctgagggggaggatctgggacaagatgaggggcccaggagccagaccttgagaaagtcgtagggacacagggtttcagggtgtgtctccacatcgaaggactccacaaagtccagaatgacactgaacccctcctccaggctgatgctgtaagtgcaactggagagtttgggatacggccgtgggtattcagggctgctgagctccccagacctctgggtgaagacctggccggagcacagggctggaaggagggaaggcaggggagtgacttggcgtgccctctatcagccctcgcaccaacagcagggtggatgccttggggagcaggaaactgggacagggatgtggctgggacatctgcatccctgggttgggctgggccctgcaggtggccagcccctgaggcctacccagaaaccaaacgacccacccgatggctgaggggccgcttagagagggggtttctcttgctttgaggctttagctgaaacaggcagcactcgggatggagcgcacaggccctcactcacacccccagggagcgtggtggtgtcctgagccagagtcgcaaccccagggtaggggctagagcactgagttccaccaggctctgccggggcggggggcgggggtggatggacacacaggaaggaggaagaagggacactctccttggtccctgggaattcgggaaaagagaggagcatctcctcgagcctaagggccccttcggagctcccctaaattcccttacagccaccccagtgattcccaagtttattcatcaggggtctcctacccgaacccagccaagaccagccagccccctgggttcctggaggaaccatccggaagaagggtctctcatcaccccctttccccaggtctgacccctgccctgggggctgctcctggaagttcaaggcaacagtgatcatgactgagtctggtgctctccttcctcgctggaacagctgatgctgctgccacgggcggggtgttgggctgggctctatccctcaaggaaggcttggtccccatcccataccaccaccccacccccagctgcagtggggggcatttgagttgtgaggcctctaggaagtgaggagccccaacattgcctgccttcttccacgtggctgtgccctatggggcagtgggaatcacccctggatttgcgggggaccagattacccctcaatgaatatctcccagggtgtctcctctgtgggtcaggctcctccaggccagaccctgaatgggggtggttcaagattactctgggctcagcctctggggacctggactcgagcgaggccttgcccctctccgggcctcagtgccccatcttcaaaacggggggtgaggccaaggagcctgtggccccatggaggaggctcccacagacctggggttcatgaggctgtgaggagggtaggcagagaggagcgcaccccgccgcctcccgaccctcccaccccagagacacgtggcagcaggtggggtggggccaggtttattattgggtccatggtgggtgaatgggagttggggcacagccatctcagcccaacccggagctgaggccagcaggctggctctggcttctgacctgctgggcaggccggagctccaggggaggctagaggctctgctctggaagagagatcagagaggcaaggagagacaccgagagggagaaaccgagtcgggggaggcagggtcagcgccagcaggtggggctgcccacgccccagagcactggcccgtcccacagtgcagggaaccagggaaccaggtcccaaggaacgagggctagatacccccgactctcccgtggctacatgaggggttcccagagcccaggtggaaccaggtacacagtgggatgttagaattagtctcagtcgctagggcagggtggcactgatgagcctggctgctgagaggggaagcagggctgagaaggggagctggaggcagcagggcctagaagcacccagtgtccagggcccaggccctccgcacccctgggcagagcagcaatggccctgaggagccccgggtatcccaggagagggtgcgttggggcccaggcagcctccctcacctgagcaggtgcgcttgttacggtgcaggacgtagcctgcgcggcaggagcagtagaaaccgcccaggtggttgtggcagtggtggtcgcaggtgggcgcctctcccggggccacctggcactcgtcaatgtctgggggagaggcagggccaggcaggccgtcaggagggaaagaggcgggatccagcctggactcctcccaggagatccatgacctcagagtggacctcagaggaggcctcgtcctgtctagggtgcgggactggtgccgggccaatcaccttacaggcctagggtcgctgcaagctcccagcagcgctgggagaaagatgcaaacatcacctctgttaaaccagtgggagtttcagtgtccggcccgaggtcacccagctaatgaggggagtcaatcaaacccagggggcggggctacagcgctgaacccttgcagcagcttcctaaggagcagagaaattgagccacttgccagaggtcacacagttggtctctgcagggactgggatctgaaatcaaacatcctggcagcgctcccgctggcagggccccactttgtcagctgtaaatggggccctcggcccctgcgtcgtttttgttttttgttttttgagacggagtctagctctgtcgcccaggctggagtgtagtggtgcaatctctgttcactgcagcctccacctcgcaggttcaagcaattctcctgcctcagcctccctagtagctgggattccaggtgcgcaccaccacgcccagctaatttttgtagttttagtggagatagagtttcaccgtgttgccctggctggccttgaactcctgacctcaaatgatcagccagcctcggcctcccaaagtgctggaattacaggcgtgagctgctgcgcccggccagtccctgcgtcacttgaggcgatgctgtcctcagatccctggctcagagttggcactcagcccatgtgaatggaggtcacggctgttttggtctttgcattgtggatgatgtcaggccagaggcctctcccctgccctgggaaaggtggggaaactgaaggcagggctgcctggcctaagacagagttacccccacagccagctgcgcagactgagatgttgcaggacccctcttggctcaccctcggctgcatagaaggcctcgaaccccgtgaacggcttctcgttggagtagtcggagcggaaggtaatgtccaggctggagcccagcgagtagaaagtgtccttgccaggggcccgctccgtgtctgtgctctcctgcccgcacagcgtggccagcaccttggcccccgagctcagctgtggggtcaggtgtcacagggagtgaaggcaagacccaggcctgatctccctcctggccaagcctggcccctgctcccaggtgtccctgaaccctggctactccttggggaccccccgaccctgagaaaccccagccctcccgtcctgacggcaccttgacgaagtcgtactcgcagaggtgggagagctccaggtcgaagtgggtgaagtagaggcgcaggcggtagccggggggtgcagtcagggtccagcgccgctcctggtcattggcatactcccctggaaagccgggggatgccaggcgcccgaacacaggttcaggccacttcgggcccaagggggtggccaccgagccacacagaaggcccaggagggtcagcagcctatgggcagggcaggggcggtgagggcccaggcctgtgctcccaccccacaccctgcagggaggctgtgggcgcccacctacctcatggtgtgcccgtccagctggcctggcctggtct

SEQ ID NO: 2567 - DNA, 2442 bp, Homo sapiens
  source 1..2442: mol_type = genomic DNA
tggggtggggccaggtttattattgggtccatggtgggtgaatgggagttggggcacagccatctcagcccaacccggagctgaggccagcaggctggctctggcttctgacctgctgggcaggccggagctccaggggaggctagaggctctgctctggaagagagatcagagaggcaaggagagacaccgagagggagaaaccgagtcgggggaggcagggtcagcgccagcaggtggggctgcccacgccccagagcactggcccgtcccacagtgcagggaaccagggaaccaggtcccaaggaacgagggctagatacccccgactctcccgtggctacatgaggggttcccagagcccaggtggaaccaggtacacagtgggatgttagaattagtctcagtcgctagggcagggtggcactgatgagcctggctgctgagaggggaagcagggctgagaaggggagctggaggcagcagggcctagaagcacccagtgtccagggcccaggccctccgcacccctgggcagagcagcaatggccctgaggagccccgggtatcccaggagagggtgcgttggggcccaggcagcctccctcacctgagcaggtgcgcttgttacggtgcaggacgtagcctgcgcggcaggagcagtagaaaccgcccaggtggttgtggcagtggtggtcgcaggtgggcgcctctcccggggccacctggcactcgtcaatgtctgggggagaggcagggccaggcaggccgtcaggagggaaagaggcgggatccagcctggactcctcccaggagatccatgacctcagagtggacctcagaggaggcctcgtcctgtctagggtgcgggactggtgccgggccaatcaccttacaggcctagggtcgctgcaagctcccagcagcgctgggagaaagatgcaaacatcacctctgttaaaccagtgggagtttcagtgtccggcccgaggtcacccagctaatgaggggagtcaatcaaacccagggggcggggctacagcgctgaacccttgcagcagcttcctaaggagcagagaaattgagccacttgccagaggtcacacagttggtctctgcagggactgggatctgaaatcaaacatcctggcagcgctcccgctggcagggccccactttgtcagctgtaaatggggccctcggcccctgcgtcgtttttgttttttgttttttgagacggagtctagctctgtcgcccaggctggagtgtagtggtgcaatctctgttcactgcagcctccacctcgcaggttcaagcaattctcctgcctcagcctccctagtagctgggattccaggtgcgcaccaccacgcccagctaatttttgtagttttagtggagatagagtttcaccgtgttgccctggctggccttgaactcctgacctcaaatgatcagccagcctcggcctcccaaagtgctggaattacaggcgtgagctgctgcgcccggccagtccctgcgtcacttgaggcgatgctgtcctcagatccctggctcagagttggcactcagcccatgtgaatggaggtcacggctgttttggtctttgcattgtggatgatgtcaggccagaggcctctcccctgccctgggaaaggtggggaaactgaaggcagggctgcctggcctaagacagagttacccccacagccagctgcgcagactgagatgttgcaggacccctcttggctcaccctcggctgcatagaaggcctcgaaccccgtgaacggcttctcgttggagtagtcggagcggaaggtaatgtccaggctggagcccagcgagtagaaagtgtccttgccaggggcccgctccgtgtctgtgctctcctgcccgcacagcgtggccagcaccttggcccccgagctcagctgtggggtcaggtgtcacagggagtgaaggcaagacccaggcctgatctccctcctggccaagcctggcccctgctcccaggtgtccctgaaccctggctactccttggggaccccccgaccctgagaaaccccagccctcccgtcctgacggcaccttgacgaagtcgtactcgcagaggtgggagagctccaggtcgaagtgggtgaagtagaggcgcaggcggtagccggggggtgcagtcagggtccagcgccgctcctggtcattggcatactcccctggaaagccgggggatgccaggcgcccgaacacaggttcaggccacttcgggcccaagggggtggccaccgagccacacagaaggcccaggagggtcagcagcctatgggcagggcaggggcggtgagggcccaggcctgtgctcccaccccacaccctgcagggaggctgtgggcgcccacctacctcatggtgtgcccgtccagctggcctggcctggtct

SEQ ID NO: 2568 - DNA, 27188 bp, Homo sapiens
  source 1..27188: mol_type = genomic DNA
gtgagccacagcgtctggccccttttcaaatttttcttgtattctccaggatttagggtgactctagttcttagatctttctaaaaatacaatctcaaaattcatcaaaaactggaaactcattgtttctttcatattcaatttgctttgtcagaaattccttacttcttttgtcaattaagttgctagagaatagattgaattcaggaataaaataattctcaagtttttctgtcctgaggcactgaagaaagtatgtcacgcagttatcaaagcagaggcccaggtctttgcggtcccactgactgtcttgagggttctgggtacatacgtgaaagaaggcagttttcacatgataagaagagaatttatccagatgttttttgtctttaaacctttctttcagctgttctaaaaggtatttcattagttttaaacaatctttcctgttgaataaaaaaggaaaacacttatttttacttatttacattcaacaaaggattttaggcatctcatagcaaaaatataaacaataaagatatataataacataaatataggccgggcgtggtgacacaacgcctgtaatcccagcactttgggaggctgaggcagggggatcacctaagatcaagagtttgagtccagcctgactaatatggtgaaaccccgtctctactaaaaatacaaaattagctgggcgtggtggcgcacgcctgtaatcccagctactctgcaggctgaggcacgagaatcgcttgaagccaggaggcggaggttgcagtgagccaagatcgcgtcattgcactccagcctgggcaacaagaacgaaactctgtcacacacagaaaacaaaaacaaaaacaaaaaagccgggcgcggtggctcatgcctgtaatcccagcactttgggaggcctaggcaggcggatcacgaggtcaagagttcgagatcagcctggccagtatgctgaaaccccatctctactaaaaatacaaaaattagccaggtgtggtggcgtgcacctataatcccagctactcgggaggctgaggcaggagaatcacttgaacccaggaggcagaggttgcagtgagccaagatcatgccactgcactccagcctgggcaacaagtgagactccatctcaaaataaaataaaataaaataaaataaaataataaaataaaatgaaataaatgaaatgaaatgaaatgataaaataaaataaaataaaataaatacaacagtcacactaaaatctgattatgttttcaaatatatggtttgaagtttcaaaaacacattttttccctctctttcccattcttagcttaaatatattctatgaatttcttcaactgtataaagctaacagatatttatactattttttttttttttgagacagggtctcactctgtcacccaggctgggatgcagtgatacaatctcggctcactgcaacctctgaccctcccctcacccccctcaagcgatccaaaatcttgttttgttataaaattattttactttattgaactgcaaatttaatataaattttttcttttctaaaatccactgattgtatcacagaattatttacattattaagagtaccatagataatctgccatctcatctagttatttagtagttgacaaaatgtactatttatgaaactatttagccttatcaacaatatttctttttttttttctttttcctttttttttgagatggagtctcgctctgttgcccaggctggagtgcagtggtgtgatctcagctcaccgcaacctctgcctactgggttcaagcgattctcctgcctcaacctcctaagtagctgggattacaggtgcatgccacctcgcccggctaatttttgcatttttgtagagacggggtttcataacgttggccaggctggtctcgaactcctgacctcaggtgatctacctgcctcggcctcccaaagtgctgggattacaggcgtgagccactgtgcctggccaacaatatagttttcttaatgcttacttcaaagcctgcatatgagatcttaaagaacctctgtgcctgcatgttgggcatttttgttttgactttttaacttttgtgatctttatactggccaacttactttatttatttatttatttatttatttatttatttatttaagatggagtcttgctctgttgcccaggctggagtgcagtggcatgatctcagcttattgcaacctctgtctcccgggttcaggtgattctcttgcctcagcctcctgagtagcggggattacaggcacgtgccactgcgcccagctaatttttgtatttttagtagagacggggtttcgccacgtaggccaggctggtctcgaattcctgacctcaggtgatccacctgccctggcctcccaaagtgctgggattgcaggccttgagccaccatgcctggccaatactggccaactttagaaactcaaatgaacaattccttttcaatcttagttctttatggtgtgtatgccatcacaaaaaaaaatggtggggtgcagtgtctcatccccgtacttccaagactttgggaggccaaggcgggaagtttacttgaacccaggagttggtgaccagcctgcctgggcaacaaagggagaccaccatctctaccaataaaaaaaattttttttgagacagggtgtcactatgtcacccaggttgcagtgcagtggcacgatcatggctcactgcagccttgattttctgggctcgagccattctcctacctcagccttccaagtagctgggaccacaggcaccagtcaccatgcctggctaatttttaaattttttatggaggtggggtctcaccatgttgctaggctgggattacaggtgtgagccaacaggccctctacaaaatttttttttaaattagccgagcatggtggcatgcacctgtaatctcagctacttggggggctgaggtaggatgattgcttgagcccaggagatcgaggctgtggtgagccgtaattgtgccactgcactccagtctgggtgacagagtgaaagtctgtctcaaaaaaaaaaattactcacttagtgttgttttcagtttggccaatcaatccctagccgtcaacacaacccaactatcccaaagcaagcccagtatctaataagagcgaccttttggcctcctccaattatatggcattaatatccattacttttaaacaagcagaatactaagacccatcgaattgtcatggctagtgctcataccctctcactctgtcctactgatacatctatacaaaaacacattcatctgatccagggttcagaactactattccccggccttgccttctaacaacaccctttccttggccctttggatctagcttctctggtttcatactcacactctccccagctcaacccaatcctgccctgccccccagacccaacccagctcagctcttcaggtctgaggtgtggagtcaacaaataattaagcataccatagataatctgtcatttaacaaaataaggctgttacctgcaacatttctcttctttgttttcacagcacgttttagattttccatgattgttcaaaatttccttttcgatgtgagagaaggatagccgccatgtttcttcttaatttcaaaaagaaaaacaaaaaagcactttacccaaagcatccatatctaaacaatattcaagtggtttccctcatgaaaatatcctggggctgggcatgggggctcacgcctgtaatctcagtactttgggaggccgaggagggtgggtcacctgaggtcgggagttcgagaccagcctgaccaacatggagaaacccatctctaccaaaaatacaaaaaaaagttatcctggcatggtggcacatgcctgtaatcccagctactcgggaggctgaggaaggagaatcacttgaacctgggaggtggaggttgcagtgagccgagattgcaccattgcactccagcctgggcaacaagagcaaaactccatcaaaaaaaaaaaaagaaagaaagaaaaagaaaatattctgaaaaaatcttaggagtgaatcaaaagaagtgaacagataaataattatgtataaaaataagtacactgagacaaaaaatgggcctaaccgaaaaaaaaaggaagtcacagtttaatatagttagcaatagtaagatgtattaccttttatatattgctaaattccctttgttaaatattttgtttcaataataatttgaatcaatttattcactttttctgtaccatccttacaggttttatattaatacaaaatgaattggggaccatttcctttattcttatttatgagagtttgtgtaaatatagaatgatttcacctgggcgcggtggctcacgcctgtaatcccagcaccttgggaggccaaggtgggcggatcacaaggtcgggagatcaagaccatcctggctaacacagtgaaaccctgcctctaccaaaaatacaaaaaattagccgggcgtggtggcgggcgcctgtaatcccagctacttgggaggctgaggcaggagaatggcgcgaacccgggaggtggagcttgcagtgagcggagatcgcgccactgcactccagcctgggcaacagcacaagactctgtctcaaaaaaaaaaaatttctccccgagtcttaccatggctagctcttttatgctctgaccaccctgttacttcgtggttttatactagcaaagtataagtagtttataatctgaatgatttttcagaaaaatcaatcaatataatctgtcacattaacagaatagaggagaaatacatgattgtctcaatagatgaagaaaatgaagctcttaaaatcctatagtcgttcatcattaaaaaaacacctcttagcaatctaagtctagatggacacttgattccataaaaggtagattttagaaaactatagcaacaatcattatgtgaggtaaaaagttggagagagaaatcagaaagaaggcaaaacatctgctatctctatttctgttcaacatgcactgggtgtcatagcaagcacagtaagggaaggaaaaacagggttacacactggaaagggagaaacaaagccatcattattcataggtgatgtaattgcatatataggaaatacaaaagaatctacaatgctgggcatggtggttcacgcctgtaatcccagcacttcaggaggccgagacaggagaccagcctggccaacatggtgaaacaccatatctactaaaaatagaaagattagcttagccagtgtggtggcgtgtgcctacacataccacatgtatgtatgtatttgtatatagtcccagctacttgggaggctgaggcaggagaatcccttgaacccggaatgccgaggttgcagtgagtcgagatcacgccactgcactccagcctggacaacagagcgaggctccatctcaaaaaagaaagaaaatgaaaaaagaaaaaaaaaattatgtaaataaactcaccaaatcaattaaaagagttaccaagattgtggatacaaaaatcaaaggtattttgatatatggtaataaacaaaaaatgaaattttgagaaagatgttacttacaatagtataaaaactagcaattaggccaggtgcagtggctcatgcctgtaatcccagcaccgtgggaggccgaggtgagcagatcacctgagatatggggttcaagagcagcctggcaaacatggcgaaactccgtcgctactaaaaatacaaaaattagccaggcattgtggcacacagttgtaatcccagctactcaggaggctgaggcaggggaatcgcttgaattcaggaggcagaggttgcagtgagccaagatcatgccattgcactccagcctggatgacagagtgagactcagtctcaaaaaacaaaaacaaaaacaaaaaacaaacaaaaaaaaacacccaacagttaccttctagatctaactgctaatgaaatatggatgaggccaggcacagtggctcactcctgtaatcccagcactttgggaggctgaggcggtggatcacctgaggtcaggagttcgagaccagccggaccaacatggtgaaaccccatttctactaaaaatacaaacatttagccgggcatggtggcacaagcctgtaatcccagctactctggaggctaaggcaggagaatcacttaaacctgggaggcgcaggttgcagtgagccaagatcgggcgattgcactccagactgggcaacaagagcaaaactccctctcaaaaaaacaaaacaacaacaacaacaaaaagaaatatggatgaaagcagaacatgctaaacgacacttctagaatgcactctacaaactctctttgggaaactctacaggaaaaataacctgtttcttcaatgagtaaattgaagtaaattgagtaaattttattcaaggaataaaaaagttatgaaagaggaagttatgagttaaaagagatttaacagacatattggtcagtcacaatgtatgaaccttatttgaatcctgatccaaacagactgatccaaacatacaaaaaaagtatgacacttacaagacaagcggaaattttaatactgaataggtgtttgatattagggaattattacttttttctttcattttttgagacaagatctccctctatcacccaggctggagtgcgtgaacacagctcactgaaacctcgacttcccagcctcaagcaatcttctcatgttagccgttccaatagcgggaccagaagcatacatcaccatggctggctaatttttggatttttttgtagagacggggtctctccaccttgcccaggctgatctcaaactcctggggtccagcaatcctcccacctcccaaagtgctggaattacagctgtgagccactgtgcccagctaatataagaaaattattatttgtttatacatttatttttatttatttttattttttgagattgagtctcgctctgttgcccaggctggagtgcagtgacaccatctcagctcactgcaacctctgccttccaggttcaagtgattctcctgcctcagcctcctgagtagctgggattacaggcatgcgccaccatgcccggctaattttgtatttttagtagagatggggtttcaccatgttggccaggctggtctcgcactcctgacctcaggtgacccacccgccttggcctcccaaagtgcttggattacaggtgtgagccaccgctcccagtcattgattatttttttaagacaaggtttcactttgtcacccaggctggagcgcagtgacatgatctcggctcacagaagcctcaacctcctagactcaagtgattctcccacctcagccccccaaatagctgggacaacaggtgcatattaccacacccagctaatttattttgtattttttgaagagacagggttttgtcacgtggcccaggcttgaactcctgggctcaagtgatccacccacctcagcctcccaaaatgctggtattacaagcatgagccaacactcctggcccagtctcctttggtactggtttaaaattttcataataaaaagttttggccaggcgcggtggctcacgcctgtcatcccagtactttgggaggccgaggtgagcagatcacctgaggtcaggagtttgagagcagcctggacaacatggtgaaaccctatctctactaaaaatacaaaaactagccagacacggtggtgggcacctgtaatcccagctactcaggaggctgaggcaggagaatcgcttgaacccaggaggtggagggtgcagtgagccgagatcgcaccactgcactccagcctgggtgacagagcgagactccatctcaaaataaataaataaataaatagttttaaaatagatcaattacctatgaataaattaacaaaagatatacaaaacctctgcagagaaaatgctaatgaatgaagctgggaagtattagaggagatgtaaataagtggattgggagactcaatattgttaacatatcaactctctcccatgttttttttttttaatacagacagtgtcttgttatgttgcccaggctggagtgcagtggcaagatcatagctcactgtaacctcgaactcctgagcttaagtgattctcttgcgtaactaagactacaagctacaagtgcacaccaccacgcctggctaatttttaaaaagtttttatagagatgaagactcacaactctctataaaaacttttatagagagttttttttttttaatttttttttgagacggagtctctctctgtcaccaggctggagtgcaatggcgtgatcttggctcactgcaacctctgcctcctgggttcaagcgattctcctgcctcagcctcccgagtagctaggactacaggcacgtgccaccatgcccagctaatttttgtatttttagtagaaatggggtcttaccatgttggccaggatggtctcgatctcttgacctcgtaatccactcaccttggccttccaaagtgctgggattacaggcgtgagccaccacgcctggctagagtttttacacagtgttgtccaagatggtcttgaacccctcacctaaagcaactctccttcctcagccttctgaagtgctggaattacaggcataagtcatcattcctggccccaaatttatctatagattcaacattatctcaatcaaaattccaaaaagtattttgtggaatctgaaaagctgatttcaaaatttatatgagaatgtaaagggtcaagactctctcagacacccttggagaaaaacgaagtggtagaacttgccctaaaagatattgagactaattataaagctacattatgtacaacaacatggtacaaagatagacaaagattttaatgggacagaataaagagttcagggatagctacacaatacggttggccctctgtatctgagggtttcacatctgagaattcaaccaatcgtgaattgaaacccacagatatggagggccaactgtattatatcattttatgtaagggatttgagcatctgtggacttcggtgtctgcagggtaccctggagccaatcctgagggtcaactgtacatgactgtaaagaaaggtggcacgtaccgttgataaaatttgataaggatggcactttgcctctgtgaccttcctcccccaaaccaataactctgatctaatcataagaaacataataaagaaatctcaagtaaaggacattctacaaaatacctaactagtactcctcaaaactgttaaaaccaaaaaactgtcacagtcaagagtagcttaaggagacatgacaactaaatgcaatatggtatcctaaatgggatcttggaacagtaaaaggacattaagaaaaactaaggaaatctggataaagtatataatttttttttttaatggagtctcgctgtgtctcctagactggagtgcagtggcatgatcttggctcactgcaactccacccaccaagttcaagtgattctcctgtctcggcctcctgagtagctgggactaagtcacatgccaccacgcctggctaatttttgtatttttttagtagagacggggttttgccatgttggccagggtggtttcgaactcttgatttcaggtgatctgcccacctcggcctcccaaagtgctgggattacaggcaagacccactgtgcccagcagatatagcccttagctaacaataatatatcaatattggtttattaattattaaatgtattgtattaatgtgagatattaataataggaaaatgggggtgctgcagtggcacgtgtctgtagtcccagttacttgataaggtgaggtgggaggatcattgagctcagttcaagaccagcatgggcaacatagtgaaactctgccccactacctcccccagaaaaaaccccaggggaatgggtatggggttatacgggaactctctgtactatcttcacaatttttctgtaaatacaaaactatgctaaaacaaaaagtttatttttaaataaactacactgagatatcatttcttactttttgagatatcattttctcactggcaagaatttcaattggcaaaaagtttaacaagtcagtgaggttgagagtgaaacaggtactctgatacattgctgtggaaaagcaaattggaatgatgcctatggagatctgggaaatgcctagcaatattacataacgatttactctttgaccagctgtaaaaatagactttaaaaaggaatgggtgttttctctatatagaggtatggagtgagatcgaaaatatcttgttaaattaaaagaaaaaaagtgttatatctgagagcagggcgtctataaaattaaaaaataaaccaaattaataaaattaaaaagaaaaacatatgtcctggccatgatggctcatgcctataatcccagcactttaggaggccaaagtgggaggactgctttaggccaggagtttgagaccagcctgggcaacatagcaagaccctgtgtctactttaaaaaaaaaaaaaaaaaaagtgtaccttttatttaaaaagggggtagcatacaaatatattttgtatgtatataaattactatattatctaatatttatgttcaatctacctttttcaaagtaataccagtattattaccaataatacacttataaaaaacagcttataatttttttgcagttttttgtccttaagataaaaggacagtcaaaataccaagttttaaacccacttgaaaacatgtccactgattacagtgtcgtgcacctgtaatctcagctacttgggaggtgggagactgagacgggaggatcacttgaacccaggagttcagctccaagaagaacaaccctaactcctgggctcaatgatcctcctgcctcagcctcccgaaggctgaggaaactaggactataagcacatgccactgcacccccatttccctattattaacatcccatattcataaaatacattggtacaataaaccaatattgatacattattgttaactaaagtctatactttatccagatttccttagtttttacctgacttctttatcttaaaaatatatattaaatataagtatttatatgaatatatttacataagtatttacatgtaatatattatgtataatttatatgtaatatgtcatataatataaaacattgtatataatttatattatatactatatacacatttatatgccatcccctttttaaaataaaagggacacctttttctttgtttttgagacagggtctcactctgttacccaggctagagtgcagtggcaccatcttggctcactgcagcctcaacctccagggctcaagtgatcccctgacatcagcctcttgaatagttgggactacaggcttgcaccaccacacctggctaatttttgtatttttagtagagacaggctttcaccatgttgcccacgctggtctcgaactcctgagctcaaatgatccacccacttcagcctcccaaagtactggattataggtttgagccattacatgaatgagagagagagagagagaatatatttacttacacttttaaaacacggaaggccaggcacggtggctcacgcctgtaatcccagtactttgggaggccaaggtgggtggaccacctgaggttgggagttcaagagcagcctggccagcgtggtgaaacctcatctctactaaaaacacaaaaattagccaggcgtggtggcacacacctgtaatcccatctactcctggaggctgaggcaggagaatcacttgaacctgggaggcgaaggctgcagtgagccaagattgccccactgcgctccagcctgggcaacagagcgagactctgtctcaaaaataaataaataaataaaataaaaaataaaacatggaagggtaaactaaaaacaattaaaaaggtttctaatcagggaaggagagaagagtgtggagaggacatgaacagaagatgtttctctaactgtacctttttccatagctttgactttggaaccacgtatatgctttataaatttatgaaacgaattaaatcaaaatttaaaaaccagtatctaaaaacagataacataatgaaacaagttaatttacctatgttgagttaaactgtccagagactttttttttggcaggcggggtatagaggacttcttgctatgttacccaggatggagtgcagtggcatgatcatagctcactacagccctgaacccctgggctcaagcaatcctcccgcctcaacttcctgagtagctgagactataggcatgggccactgcgcctggctgaacatttttttgagtgggttaaaaacctcatattttgactgtccttttatcttaagaacaaaaaaactgcaagtaaatcataaactgttctttaaataaattatatccttggtaataaaactagtattattttgcaacaggtaaatttttaaaatttaaaatttttaatcaaaaatcaataaaaacaaggccaggcacagtggctcatgcctgtaatctttgggagatggagatgggtggatcacctgaagttgggagttcgagatcagcctggccaatatggtgaaacccagtctctactaaaaatacaaaaaattagctgggcatggtggcacgcacctgtagtcccagctactcgagatgctgaagtgggagaatcttttgaacccaggaggtggaggttgcagtgagccaagattgcaccactgcactccagcctgggcgacacagcgagactctgtctcaaaaaataaacaaataaaaataaataaaaacaaaaacataatatttttaaaaatatagcttgtgagaccagggaatttctagtagaatgtttagagaaagaaaagatatagcaggtgttataagtgtctccaatctagtacaagtattttcactgttaagtccctctgttcacatacactcacacacatacacagaagcagagttttgtctaattatacataatctggaatgatggcagatgcagaacagccaagggtaacagaaagcagaggtgaagctaagcatccagcaccagccttcactttctttcattttaatggaagaatgaaaagaactccctaaccatggctagatgcagtggctcacgcctgtaatcccagcactttgggaggctgaggcgggtggatcacgaggtcaagagatggagaccatcctggccaacataatgaaaccctgtctctactaaaaatacaaaaattagcctcgcgtggtggcatgcgcctgtagtcccagctactcatgaggctgaggcaggagaatcgcttgagccaggaggcagaggttgcagtgagccaagttcacaccactgcactccagcctgggcaacaaagcaagaatccgtctcaaaaaaaaaaaaaaaaaagaactgcctaaccacataggccacagggccaccaaaggactcttcttcatctctaaggtgatttaccttccagtgttcctcaggacagtatggggtcagcaagagatggtatggggtcctgttgcaatttttgtatcacttacagtgagggtttcctggggcagctattctaaaaattgttcagtttgcagaacaacctctttgcagaaagctataattcattttgtaaaaacatgaataatgatatatgtaagtacccttcatagactatttttcttacagaaaatgattcctctatgtatgcaatatatgaagttatgatgtgtgtccacaaaaacacaaaccatcaaactaagcatgattgactatttctgggcttttttcagcaatactcatttataacttggttcatttgttttatggtctccttcaatttccctggaatccaatagtagtaggtgccaaaagtcctatataaatctatgggagaaaatgaaaataatcagctactttctttttttttttagactaaatcacaaggaaaaaagctacttcccaggagtttgagaccagcctggccaacatggtgaaaccccgtctctactaaaaatacaaaaaattagccaggcatggtagcgggcacctgtagtcccagctactcgggaggatggggcaggagaatcgctttaacccgggaggcagaggttgcagcaagctgagattgtgccactgcacttcagcctgggcaacaagagcaaaactctgtctcaggaaaaaaaaaaaaagaaagaaagaaaaaaaaaagttacttccttctaccttcaaaaatatcaccattataaagttttagctgtagaccaactcagtctgtttcttggaagttgaattttacccaagagcacagcctgaaaacccgtcctgatctgtgaggctgagacacgctgcataggagcagtggaatgggaagatgaaggaaagagagaaccagggctgagaatgagagtctagactctaatgataatattaatatgtaataacgtataactggcatgaacagaattggccacagaactgcatgcacattttatctttccagaatttttcaagtacttttggttaacacagtgtacggatgagcaaatgggtttagaaagcatcataactagctcgaattcacacaactagtagaaggagcctcaggattcagaaccagggcagtctgactccaaggccaatactgcttttctttaccgaaaaaaataaaataaaattcaaatatggattgctagacattttaaagctgagtatttgatattaatactacaactttgcccttttcaattctgtctgtcaccagactcccatcttataacctattttgcctgatggctcttgaaatgacaacagcattggttggctgttgatcttttactgcctgaacatataacattaacaactcttttacttctttaagttaactttaatatttaaaataccttggaaaccatttccttcctttgcatgcttgggtacaaggtaaaatggctttagtcgtagttgcttcctaacttttgctgaaagccagttttgaatgcgcaggccttcttgggtgctagcaggccagctactttttgattccaaagccagggttatatccacagatattttttcactaataagaagtgttacagcagggctccctcctcttttcctcttcatgatgacatctgtatctggttgaacatataaaagaaaagaaagtatttattaatccaattttctctggaaatacaggggaaataatgtaactataattgaagatctctggtgtgctaagtatgaagtaaacattagtggtaaaacagaaactggctctaaaaggcaaagtattttactaaaccaatattggctgggcatgatggctcatgcctgtaatcgcagcactttgggaggccgagacaggtggatcacttgaggtcaggagttcgagaccagcctggccaacatggtggaaccccatctctactaaaaatacaaaaattagccgggcatggtggcgaatgcctgtaatcccagctactcgggaggctgaggcatgagaatcacttgaacccaggaggcggaggttgcagtgagccgagatcacatgactgcactccagcctgggcgacagattaagactctgtctcaaaaaagaaaaaaaaacaaaaaacaaaaaacacaataattactgatatctcccattgggaggcattgtcaagatggtgtggggcatatatgatgaaggggtctctgtagactttgaggtttaagagtgctgtgattaaattttcttcttttcttttcttttcttttttctttttctttttctttttttttttttttgagacagagtttcactcttattgtcttgttgcccaggctggagtgcagtggcacgatctcggctcactgcaacttctgcctcccgggttcaattgatcctcctgcctcagcttcctgagtagctgggattacaggcatgtgccactgtgcctggttaaattttcattacaaattatagatggcagaatggagggaagcctagaggagaggccagatgggcaagagggaagagacaggcagcaaaaagaccacagcaacagcctggcacagaggctgggtgccacggcagcacagaggtagtgagcatcaagacacggggaagaagtgagagcaactaaagaagtccaaatcaacataagtggtcatgagttgaggctacgatgtgaggaggaaagtaggagccttgggatgccatcccaggatcttggccttcctaggcctaatggctgatgttggttccattcctcaaaatagaataagcaggaagaagaaagattgggccaagctgaacttcatgagatacaatgagctctagatacctgtgggacactcaagtggagatggctgctgggtgggtggctatggtcagaaatttagatggctttgggagttgggggtttataagcagtaaagactactactgtcagataagacttccacagtgacgaagtagagcacaaaggagaaaatgctagaaaaatctgcaaacctggccacctgttacccaaacctggccacctctcctgttaccactgaggaagtaagtgtccatctaccttacttttttttgagacaaagtcttgctctgtagcccaggctggatgcagtgcagtggtgtgatatcagctcactgcaaactccacctcccagcttcaagtgattctcctgcctcaacctcctgagtcgctgggattacaggcatgcaccaccacacctggctaatttttgtatttttagtagagacagggtttcaccatgttggccaggctggtcttgaactcttgagctcaaatgatctgcctaccttggcctcccaaagtgctagggttacaagtgtgagccactgtgcctggccctccatctacctttcaaaggccacctctgcccatagtctctggatcccttccttctcaacttctcaagtaccatgctcttcaagtatttcctctcctacatcagccatctctccctccctgctagattattctgaaattcatacaaagggttatagggtatacctctcctttcaccccacatcttcctcctctccatactcacccatctttctgcttccttccagcccaaacttttttttttttttgagacagggtcccgttctgtcacccaggctggagtgcagtagcgtgaacatggctcactgcagcctcaacctcctaggttcaagcaatcctcttgcctcagcatcgtatgtagctgggaccacaggcacatgccaccactcctggctaattaaaaaaatgtttttttcttttttctttctttttttttttttttttttctgagacagtcttgctctgtcgctcaggctggagtgcagtggcgcaatctcagctcactgcaacctctgtctcccaggctcaagcaattcttttgcctcaacttcctgagtagctatgattataggtgtctgccaccacgcctggctaatttttgtatttttagtacagacggggtttcatcatcttggccaggctggtcttgaactcctgaccttgtgatccgcccaccttggcctcccaaagtgctgggattacaggcatgagccaccatacctggcctaaaatttttttttgtagagatggactctcactttgttgcccaggctggtcttgaactcctgggctcaagcaatccttctgccttggcctcccaaagtgctgagacaccacagttagcccagacagaactttctagagtggcctacacatgttatctccactgcaaccctgccttttcactctgtgtccatcaccccactgacatttctcttgtcaaccccacaagaccaaagaacaaatccattggatttctggatgtcagtagcattccaaacactgaccgctccttctacaaaacactcatagtctccttttgttcattctcttcttcccaaactcttttttttttttttttttttctgagacagggtctcactctgtcgcccaggctggagttcagtggcgcggtctcagctcactgcaacctccgccttctgggttcaagaaattctctgcctcagcctcccaagtagctgggattacaggcacccgccaccacgcccggctagttttttgtatttttagtcaagacggggtttcaccatcttggccaggctggtcttgaactcctgacctcgtgatccacccgcctcggcctcccaaagtgttgggattacaggcgtgagccacggcgcctggctcttcccaaactctaatggaattctcttcttaccactctacttaacattgcaacttcccccccacctccatctcccacattcctgatccctctcactttgctatacttcttcacaacagcacttactactttccagtatacaagataatcattttttccatttgttattaattgtacgtctgtgcttgcaagataaagctcttaatctaatagcgtaataacatacaacacaaattgcagtgagtgctctgaagggaataaactgggaaaagtgatagcaattagggtggaatggggtggtggagccaagccctgaggcagaaaaaaagagcttggaaagatctaggaacaaaaagagactctttcggaaaagatgaagttatatgaaatgaagctgaagaggcagccagggaccagattctgtactgacttgtagaccctgaaaaggactttagatttcattttatttttgagacggagtcttgctctgtcgcccaggctggagtgcagtggcacgatctcggctcactgcaacctccacctctcgggttcaagcgattctcctgcctcagcctcccgagtagctgggattacaggcatccaccaccacgcctggctaatttttgtatttttagtatagatggggtttcaccatcttagccaggctggtcttgaactcctgacctcgtgatatacctacctcagcttcccaaagtgctgggattacaggtgtgagccactgcgcctggccagattttaatttaatttaatttaattttattttattttgagatggagtttcgctcttgtcactcaggctggagtgcaatgccccgatctcggcttactgcaacctctgcctcccaggttgaagcaattctcctgcctcagcctcccaagtagctgggattacagacatgtgccaccacacccggctaatttttgtatttttagtagagatggggtttctccatgttggccaggctggtctcaaactcctgagctcaggtgatccacgcacctcagcctcccaaagtgctgggattacaggtgtgagccactgcgcctggcaccagattttattatctgatcattgagaagccaggttttcatcagagagtaatgactggctttgtattttaaaacatttactctggcttctaaggacagatattataagaaggcaaatagggagattagaaaggaaaatgatgtaatagttcaggtaaaagatggtggcagcttaggtggggtgggagtagggtgctgggattgaagcagcagacaggtccaagctgtagcagcacttgcatctggattaagcgtagggggtaacagagaggattaaattaagatggttcccaggtttctggatggtgcgtctgggtggattgattgtgccattttctgagatgggaaggactgaggcaaaacatagtttggtatatgaattaagttatgtttattcgctttggatatgtttggttatagattcctgtggtacatcaacatcaaagtggatatgttaaggacgtagctggatataggtttggagtgcaaaggatatatttgggctgcaagtaaacatttgggagtcatcatcatataggtggcattgggaatggatgaaatacctaggcagagagtgtagattcatttatccatcaatttaataaatattcattgattatttcatataatttaatcatttaatttaatcaatattcattgattatctaatgtgtaggtgttctagttatttaggattcattagagaacaaatagataaagacctctacccttctgtactttataatcttgtaatcatattataagtaattgccaatgtacactcctctactgatgtttcttgacctctctactgcactttttcttactgcagagaggtcaagaaacatgagaatgggagtgtacattggcaattactaggtataattaaacctttaagaatcaaaaggcaaaagtcttacctttaatgtcgttaatttcttccttaatgattttcctaaactttgacagcatcttagaagctgataatatttcaccttctaaaaactgactcagaggattttctttcggatttcttttaaatttcacaaagtaatatgcacgagtgttggaatattcttctagttgaattctggggacttccagtttaaacatgacatcaaattcattaggtgcagaaatctaagaaacagtaaaaatagtactgaaatatttgcttatgaatattttccaagtgactggaactttttaaaaaatttccacttaaaactttactttaaaaagcaagattcataatgtctatatataccctctgggagtgggactagtggagctggcaggaggtggaagagtattaccagtttcattttgtaggttctacactcaattaattttttttaccatgacctagtattatttttataactaaaaatgattttaggccaagtgcagtggctcacacctataattaaattttgtggggccaggtgcagtggctcatgcctgtaatcccagcactttgggaggccaaggcgggcgattcacctgaggtcaggtgttcgagaccagcctggtccaacatggtgaaaccccgtctctactaaaaatacaaaaattagccgggcatagtggcatgcgcctgtaatcccagctactcaggaggctgaagcaggagaattgcttgaacctagaaggcagatgttgcagtgagccaaaatagtgtcactgtactccagcctgggcaacagagcaagactccatctcaaaaaaaaaaaaaaaaaaaatttgtgtatgatatgtggtagggaatcaaggttcatgtttttcctacatagatatccaattgacccagcattatttattgaaaaaaaaaaatcgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccgccggggcgacagagcgagactccgtctcaaaaaaaaaaaaaaaaaaaaaaaaaaaaaaatcgtcctttcagccaggcgcggtggctcacgcttgtaatcccagtactttgggaggacgaggcaggcgaatcacaaggtcaagagatcaaggccatcctggccaacatggtggaacttcgtctctattaaaaatatgaaaattagctaggtgtggtggcatgcacctgtagttccagctactcaggaggctgaggcaggagacttgcttgaacccgggaggcggaggttgcagtgagccgagatggtaccactgcactccagcctgggcgacagtgcgagactccgtctcaaaaaataaatgaatacatattttaatcagtttgtcaatttaatttaaaaaactgatcatatttcaactgattgcattaaatctagaacaatttgaggaaaaatgaacacgatatagttgtcaattacttcctcttcaaatttacccagttatgtttttaagttttgaatatctttagtgatatttattcctaaatatttgatttttaaattgtttttcaagttttcagttttttgtttttttttgagacagagtttcacgcttgtcactgaggctggagtgcaatggagcaagcttggctcactgcaacctcagcttcctgggctcaagcaattctcctgcctcagcctcccaagtagctgggaatacaggcgcgcaccaacacgcccagctaatttttgtagttttagtagagacagggttttgccatgttgaccaggctggtctcaaactcctgacctcaagtgatctgcctgcctctactcccaaagtgctgggattataggcgtgagccaccatgcctggccaaagttttcaatttttattttttagagatggggtctctaggctggagtacagtggctactcacagatagatcatagtgtactgcagcctcaaactcctgacttgatgtgattctcccacctcggcctcccaaatagctgggactatcagaatgcaccaatggacctaggtttgatatttttgatgatattctaaatggtattttcattttgtttttaatcttgttagtatattgaaatatttttatttttgtttattgactttgcaaccagcaattttgctaatttactaattatttccaacagtttatatgtgaagccaatcaagtcatctacacataacgatttcatcactctttttcccatcttatgcctttattttccttgtcttgctgcatcagctgtatgtattcctttacgttctttttgttgttgttcaacattatttatgtaattcattttcactgttcatgttgctgtagtttgttccttttctttaccagttaatataccattacttaaaaccactggccgggcacagtggctcacgcctgtaatcccagtactttgggaggctgagacgggtggatcacctgaggtcaggagtttgagaccagccttaccaacatggagaaaccccatctctactaaaaacacaaaaaattagccaggcatggtggtgcattcctgtaatcccagctactcgggaggctgaggcaggagaatcgcttgaacctgggaggcagaggttgcagtgagctgaggccacccacgccattgtactccagcccaggcaacaagagtgaaactctgtctcaaaacaaaacaaaacaaaaaacaaacaaacaaaaaaaactacaattaattgatttctatgtaaccttttcactgagtccaaactatataaatagtaaagtacattaacacttagaatgaaaagaacatatggactgacaattctacagggaatttctacaagaaacttcccatgtattttcgagatttttttttacctagaatttgtagtcccaggtagctgggactacctgtgtgtgccaccacatccagttaatttttaacttatttttggtagagctggggtctcactatgttgtccaggctggactcaaactcccgcctcagcctcccatggtgctaggatcacaggcatgagtccactgtacctggcccacatatatctcataatcagtaatagaaaaagttttaggctgggtgtagtggctcacgcctgtaatcccagcactttgaaaggctgatgcaggtggatcacttgaggtcaggagttcgagaccagcctggccaacatgctgaaaccttatctctactaaaaatacaaaattagccaggtgaggtgacgcccgcctgtaatcccagttactctggaggctgaggcaggagactcacttgaacccgggaggcggaggttacagtgagccaagatcacatcactgcactccaccctgggtgacagagcaagactccatccccaaaaaaaaagaaaaaagaaaaagaaaaaaagaaaaagttttagataaaacaaatttcactggatttcttttcattggcataatttttaaaaacaaagtggttctgggctgggcatggtggctcccacctgtaatcccagcactttgggaggccaaggcgggaagatcatgaggtcaggagatagagaccagcctggctaacacggtgaaaccccgtctctactaaaaatacaaaaattagctgggcatggtggcgggcgcctgtagtcccagctacttgggaggctgaggcaggagaatggtgtgaacccagtaggcagggcttgcagtgagccgagatcgcgccactgcactccagcctgggtgacagagtgagactctgtctcaaacacacacacacacacacacacacacacacacaaagtggttctgaatggagactgtcttctgaatgtcttgttctctaattctaactagtaactttctttttcctttggacccgccatatacagtaattgaactgaattgatacttacataataagaatcatgctcaatcagagacatatctgatgctgaaaagtaaattagttaattaaaaagaatcatgctcaagacacagtctgggctgggtgccgtggctcaagcctgtaatcccagcacttagggaggccgaggcaggtggatcatctgaggtcagagttcgagaccagcctggccaacatggtgaaaccccgtctctactaaaaatacataaattagccgggagtgggggcaggcacctgtaatccctgctatttggaaggctgaagcaggagaatcgcttgaacctggaagccggaggttgcagcgaaacctagatggcaccactgcactacagcctgggcaacaagagtgaaactccatcaaaaaaagaagaaagaagaaagaaaagaaagaaagaacaaaataaagagagagagagagagaggaagagagggagggaggaaaagagagagacagagagatagagagaagagaagagaagagaaaaaagaagagaaaagaagccgggtgtggtggctcacgcctgtaatcccagcactttgggaggctgaggctggcagatcacctgaggtcgggagttctagaccagcctgaccaacatggagaaagcccgtctctactaaaaatacaaaattagccagggtggaggctcatgcttgtaatcccatctactcaggaggctgagacaggagaatcgcttgaacctgggaggtggaggttgaggtgagctgagatcgcgccattgcactccagcctgggtaacaagagcgaaactccgtctcaaaaaaaaaaaaaagaaagaaagaaagaaaaagaaaaagaaacaaatctcttgctgggcaagaaacacgctccagtcaggaacctgcttctaaactttcaatttacacaggaatgattaatgactcaatcacccacaagcaaatggagctgtgtaatacacacgtcgaagcaattatacggaatgtgtatctagaaagcgttttagtatctgtaggagatattcttatttgtttgtttaacattatactgtaagcttcccatgatttctgtgtaagaaactggggacagacggccgggcgcggtagctcacgcctgtaatcccagcactttgagaggccgagacgagcgaatcaagaggtcaggagatcgagaccatcctggctaacacggtgaaacaccgtctctactaaaaatacaaaaaaaattagccgggcatggtggcgggcgcctgtagtcccagctactcgggaagctgaggcaggagaatggcgtgaacccgggaggcggagcttgcagtgagccgagatagcgccactgcactccagcctgggggacgcagcgagactccgcctcaaaaaaaaaaaaaaagaaaagaaaagaaaaaagaaaaaaaagaaattggggtcagacgggatagcaggagagggggcagggaggaagagggggagagaaactgaagatctttttttctatggagtaagaggtcttcctcataggaaaaagtctacgtggaatttttaacagaccacttcaaattatccaagtcaatatctgactcgggacctcaggtccacaccatcaaacactgccctgttacggaaactcgatacatgtcggcttgcatgaatgaacccatacatttgaattcccccgggagcagtgtcttgaaattagccagcaatcagtaccggttggttgtctgatcgttggatgtgtagatgaataaacgaacggtttgtcgttttacttagactaggctaccgaaaaacatgcaaaagtctaagttacttccgaagggaagtgaggggcgcgacccggggaaggtagggactgcggattgcggaaggccgagcagcggggctcggcgggagggcgccaagcagctcaccttcacgtgctcatagtagctcccggtgttcagcagcccgacgcctctgaacgcggagtcgcacttcagtctgagcagcaggtggtccacaacccctttcaccatccccgccgccgtggagatatcatcgcggctgagcttcaacttctccaaaaccgcccggagcttcgaggccccaggcgccgcatccctccgtacgagaatgggggccgagaccggcaggccggggctgggcacgtcccagggcccgggcggaggtcttggcttcgtggagcagcgcgcgcccctctggcggcaagaaccagccctggaaagagccggctcccgagccgcaggaggctccagcccctctgccccaggggcgctggtggcgtcagacggctgcgtgtcctgggcgcgctgaggggcctttttggcgcgggccccagttgcgcggacgggcggcctctcctgggtgtccggggcgctctttttctgccgggatcccgacttcctggcggggccgaactttcccgccttaggcagggcggcctcgggggcagccggagactcggtgggatccatcggggcgcccctggcattccgtgcggaagccttgggggcagtggctccggcctcggaagctctctgcatggcctttccgtgccaaggctgcatggctggcgctttctgttccccgaaagaagaatccgtttcaggaaaaggccgcaagaggaagagccagcagcagctgttggaaaccaagcactactggcgggcacacaagagtctgcgacccgaaggggaaccccaggct

SEQ ID NO: 2569 - DNA, 6321 bp, Homo sapiens
  source 1..6321: mol_type = genomic DNA
tgtgactaaatggagtttattccatcaaagcaaggttgatttaatttttaaaaatcgatatgtgttatgtataatatcacattatctcattaaaaagcatgtatctagcggcataactgtgtgtattaagacctaaaatatagtatcctgatactttactacacactttaaaggtgttaacttatttcatcatccccacaattttcatgaaataagaatgattattttctctcagctgcaaatacatggctgaaacacaaagtaactggctctagatcatgtagcaattaagtgacagagctgtgaatccagtttagataggcctgactggagcacttcattatattgtctttcaggagtctatacctgatctggtggtctctgtattggggttgctaaccagtgcaataaggtaagaaaaaaggtaaagcaattgggaagaagcaagtattgccatattttcagcttacatgactatgcatatacaaaatccagaggaatctacaaattactagatttaagaaataaacttattgagtttactaaacatcgtaagactacacacaaaacttaactgtatttctgtgtacaacaatagaaaagaaaaaatatttaaaatatattattaaaatcactaaaaccaccaaaacaagatatacaaggtttttaaactaaaaatgtcaaaacatagcaattaagttaaagaaattctagttacatgaagcgatacatgatgaacattgattagagattcagtagtaagttgccagttctgcataagttgattgatagactcaatgtggtcccagtagaaacctcatcaggattttgtagaaattgagaagctgtttctaatatttatatggaaatcttgactttaagaagaacaaagctggactatagttacaactataaatgtacaataattaagatagtgtactgtttgacacaagcatcaacaaatagactagaatagacagcccagaaacagacacacacacatacagttacctaacttacaaaaatgcaccaccctagttcagtggaggaaaaatggtctttcctacatagtgctgtctcaagtggatatctattctaccaggaatagatagaatgtttattaataaaactattagaaaaaaatggaaaaatatcttcatgatttcaaaatcatgaaaaatctcttcatggtttcaaaatcatgaaaaatatcttatgattttgggatgggcaaaaatttcttaaacatgacacaaaaagcactaattttgaaagaaaatatgaataaataagactttctcaaaattaggaaattttgttcatcaaaattcaacattaggagcaagtcaaaaactagcaaaatatttgtaatacacattaaaaaggacatattcagaatgtaaaaataacttaaaaatcagtaagaaaaatattggctaactaatttaaacaaaatacaaaaatgtgaacgggtacttcacaaaagaagatacccaagtgcccaataagcatataaaaaagtgttcaaccttattacatgttggggaaatacagattaaaaccatggggaaatatcactttacatccacaggaataatgaaaatcaagagaactgaaaacattgactttttacaagcacatagagcatctaggactgccacacattgccggtaggagcataaattcatacaatcacttaggaaaactggtaatatctactaaagctgaatacatgctttcctcatcctctaccagttccactcctggataggtagtgaaattagtgcaccatgtccaccaaaagacaagtccaggaatgttcgtgggttctcttcctcatggccaaaaattggaagccacttaagtgcctattaacaatagaatggatgaactgaggaatattaatataagggaaccctacatggcaatgaaaaggatgaaacttttgtacacatgacatgaatgaatctcacagacttaattctgagtaaacaagacatacaacattacacacaatatgattccaactatacaatgtttataaacagacgaaattactgtgcagtcatggaggtcagaatagtattttcctaggagttagtactaggaggagttataacggggcttctagggagtcaaaaatgtcccatatcttaatctagaaagtgagtatataggtatgtatgtgtgtgagaatttgtgaagctgtttgcttgagatttgttatttatgttctttacatggtttaatatctcattagaaagaaaacagagttcatagagaaagttacaaaatagattttcttaatacctgaaacttggtaaaaagctgtggtattaaactgtggtgatgtcattaggggagccctctacccaaacagaaaggaaggctcaacagagcacaggtgtttgttgtaaatggaaaaataaatccgtcttattttcatactgcagcaagttaacactatcgaaagcattacagattaattaaactagataattaatgtaggatgcaaaagatagggcctcatagtatatattaaaaatattatataattagcatgactactactgctgctgctaactactactactactattattgctttgttggtgctgttagtgatcatttttagtgattgcccacaaaaggaacaatactggatatgaggaaattgatataatttatcttttcaagcatactgtgggcctgtgggttgcagtaaaaagacaaggagggcctgagtgatatgacccttcagatagggaactcacagacggccagatgggaggtggagcaggggacgtcattccactggccatttttcagtagcaatacacaatcttcatcagaaccagcattgttgggttcaccctcgttccagtttgtgtaggtcagtctatttcctgtcagatccacaaactgcccttctgtcttctcatcagtgatgcccaggaaggcttcctccttgatgagattctgaatggctccattctctgcagcattcctgggggtggccacagaggcctggaacttgacacacaaggccttcactttttcaaaggtcattatttcaccattggtcaggaagaacttgttcccaacttgtttgcccagagagaaggtgagccctaaaatgtgaaaaagtgggtgaaactgactcatccttaagcccaactcaaggtatttctcaagaaaaagtcttctagagtacagttgccggataaaatatagtatgtccagttaaatttgaatttcagacaaacaatgaatattttagtatatctcccatataatttttcagacacacttatactaaaaatgtttttcagctgaaatccaatttaactggtgctttgtctttttatttgttaaatatggcaacccaaatgtgaacagacagactggtacaaaggcctctctgtgctttcagatcagaattctaaaagacatataatttggacttctgaattctaaattgttaacttgagaccaaacaaaaaatgtctgaaaatatttgccccaggcaggttagaccccacggccaggtctcaataccagtgcaacaaagggatataagtcccattttcagtgagcaatatcagacggtaaaggattagggtctctcgagtcagactgacttccatctataaaccacccctgccatttattagctctgtgcatttgaacaagtaatttaacttccctttgcctccatttctaccaaaatgttgtgagaatttcatgaggtaagaatatgagaaatgcctagcagggtacagaaaattatatgcattcaacaaatatttgttgcattctatttttcccaaacttcaagctgcctggagagtaagagaaaaagcttacactttttgatacgtgccatttctgtttgcagagcttttctttctgaggcagccaggctactatcaccatctagaaaattagaacaaagtaaagaagcattgttgagaaggagcctcagaactgtgcatatacaagggagtggagtatctttttcaaactgaaaaaaaaagcttattttacattgatgtttacactttgaaggaaaataaaaaatactgaaaagcccaaagaatgaaaaatcgctatttccatccaaccccaaatgtccctctttgtctgtttactgtatcccaaagtacgcatacatatcacatgcacacatatactccctgattacctagcaatccatatgccaggttcttcacagatttttttttcaaataaattgttctatcaaaactaaaaagaaatctcttgaggcgttactctattatgacctggtgaagagtgacgaaaaagattgcagagtttttgtctttggagaggttttgcttttgatgtcttttgttttgtttttgttttttccaggtttgttctgttagtcaggaaaccaagatttttgtgagttgcccattatccaagtggggagggcatgagcaaatcacttgttgtagtagatggcaaaaatggcctcaatagggtacagctcctcgcattaagacatgagtctattaccccactccttgaatctgggctggccttgtgacttgttttgaccaatacagtctgacagaaatgataatgtgctctgagtcttcaagaagcctaaagcctatcttatttctactcttgggaatcctgtaatcactgctatgtgaacaagccctgttggatgatgagagatgtggttcaattaccctcatcactccagctaacattcagacaacagccagacacatgagtgagactattggccatcagttgaccacagacatgtgggtaagcccagcttaaaccagcagagaaatcacatggccgacccacagacttgtgatttaaattgacggctatgtttttaagctattaagctttggcttggtttcttatgaagtaaaatatgacataccatggttacatgcttttgtaaaaataggtataataagcccacacttagatggcctgttttctccctctaggaccagggcctcacattagactgtttcagctgatggagaatccaggctcagctcttacagggagtgcctgatgagggagttgtcttgaaaagtttgtaagtctgtactcaggcacttataggaattccctaaggctctaagaatgaagagagggctgagggcactgggtcagaaagcaaatttgggtatcttcctttgaaggaacaggagaaggggcacctcttaccagatactcaaggtctcagaaccctgggtgaagtcagctcagaccttgctggggtccttacccggactttttccagggtctcctttttggccctttggtcctggtgacccagaaggccctggatttcctggaggccccaactttccaggggggccctgtaagcctctgagcccttggcctgttggaagacaaaggaaatgtgacttaatatctatgttcttgctctctctcttcaagagtttgatgcccaatcccttctcaggagaaaggagaccttgacccaggactgacctttctgagcactgctctcaataactgtatggtgggcacctgagagcaataacttaagaaataaagttgccacgtggaggttgctgcagggagggtgcaaagtgaaaattaactgcatttgtttttaccagtagttgttgttctcctgtccagcccactgctgctggatctccctgtaaacagattcccccagtaaaacctatgtttgtttgctgactccatctcttctttggcctcttgaacctggtgccatccctactgaagtgaataggggtctgacatgacaatgacccagagaagaaaaattcatcctgtgtcccacgggatggcctgacctgtgggccactttcctgggctggcaagacaactattagtcacaaactgctgtgtggaattctgagatgccagagaatgagagctgaatctctgttttgagttacagtatagttgagaaaaatatactcaaataggacatcagtctcctcatatccccaggcagtttcctctggaaggtaaagaattgcagagacagaacagcccaacacgtacctggttcccccttttctcccttggtgccatcacgcccatctttgcctgggaagccgttgatgcctggagagctacaggcaatcactgcagggcaggtcttttgggcatcctcacaggtcacagtttctgagtaagacgctgccaccatactcaggagaaggagagggagtgatggaaacagggacatggtcctcaccttggtgtgagaaaactcagggaaggttaatctcagttaatgaacacatatttacc

SEQ ID NO: 2570 - DNA, 17957 bp, Homo sapiens
  source 1..17957: mol_type = genomic DNA
gcggggcgcggcggcaggaactttcccggggacccctgcgggaaggcctggccagtaagcgcgcctctttggcccgaatcaacatggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtaaccgcgcgccggcggggagggcgtggcgcggagccgacgggaacgtccgcgctgcggagcagggcagggaagccgggaggcgggcccggcccgagcttgtccttgtcgcgcaggtactccgagcactatgtcgtccccggcgtcgaccccgagccgccgcggcagccggcgtggaagggccacccccgcccagacgcgtgagtcccccgagccgggcccactacagcccccggcgccgccccgtctgccctctcgccgcagctggcagcgctgggtgggtgcgcgggacccgggcgctcagcctcgggctgggcgctgccgcttggtgcgcacagacacccacagcaggctgtggcctgggtgctgcttaattcgattgccatttgcctctgtttggtttggttcagtggtgagtcataatgccccaaggaaaagacaaatccaggaaggccggccctgaaagttaatggctgtcttttctgttttgtgtgacacaagctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcaggtgcgtgtctgaagatcttggttttgctgtgcttgatacacagctgatgctttatctgctcaggtttactggctttataacagttggcataacgcctaaagcatcccctctgcacgtgactgagcatgttcttaaccagaggagctgaacggagtgcagaaaatagtagttttagggcttagtgagcagaggaagcagcttctctggtgcttttttttaatagaacatttaagagtgctcagaatctcagccaccgcaggttgcaataaatattcagtttgctgttgcgattagatggtatagatcaacagacaacatgctgtaatttcaggtttgatatgccaccagaatttcctaattttgtttttatagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggtgagtatgcagtctcctgaaaccatcttatggcgggtatcatgtgggtaactctgttttcatgattctgtcatgtttttctgtgtaggcagcagcagaagatatagtggcaagtgagcagtctctaggccaaaaacttgtgatctggggaacagatgtaaatgtggcagcatgcaaagaaaactttcaggtgagctacatgtattaaaattcttactttgggctctgaaaatgttgggagaccgtgtttataatctatatctaagtagccataatgactagaagggccacctgtggtggctcacacctataatcccagtactttgggaggccaaggtgggaggatcacttgaggccaggagtttgatagcagcctgaccaatatagtgagactccatctccaaattaaattttagaaaagaaaaaggaagaaaaatattatttatttctgtctcctgatagtgacatactcataactttgtgtgtttttagtagttgcctgttcccaaatgctatatgcctaatacagttttctctccacttaaagagatttcttcagcgttttattgaccctctggctaaagaagaagaaaatgttggcatagatattactgaacctctatacatgcaacgacttggggaggtaatcaaatactctttaaattcaagttacgtgttttaaaatagttaaattagcaaaatataacttgttcatttttattttctagattaatgttattggtgagccatttttaaatgtgaactgtgaacacatcaaatcatttgacaaaaatttgtacagacaactcatctcttacccacaggtaagaatttagctttgaccttgatgaattttagtaacagtctagaaagaatgtttccagataacagaaattcttcagtaatgaagatagtatgcgcaaacactttaagaaactgagtatcatctcctttggcccggtgtggtggctcacacctataatcccagcactttaggacgccgaggcaaatggatcacttgaggtcggaagtttgagaccagcctgggcaacaaagtgaaaccccatctgtactaaaaaatacaaaaattagccagacatggtggtgcatgcctgtagtcccagctactcgggagtctgaagcgatagaatcacttgaaccccggaggcagaggtgcagtgagccgagatggcaccactgctctccagcctgggcaacagtgagattccatctcaaacaaacaaaaaaaaactatgtatcatctcctttaagatgaacatttttttttcacattttaatgttcctgaaagtgggacttgtattactatcaatgacaggttatggtttacttggcagtgtttttcatgtagaaaaatgatgaatcttaaaactgatagcttcttgggtttcatgaagtaagttatcttaaatggaaatactttaaatgaattacatacttcctgctgctttgaaagaatatattgtactgtagacttttacttctaagcctcaggtcagtttctattaatgaagtatcagctctgttgactctgggtgtagtctttggaggcaagcagacttggtttttgaatcttggttttgctgattactggctgcataaccttggtcaagttccttagccaaccaaaagctgtttcctcatctgtaaaatgggaaccatatgttaagaaatttgaataaatatgatttaacttactttggtatcgccaggcacggtggctcatgcctgtgatcccagcactttgggaggccgaggcaggcagatcacctgaggttgggagttcaagaccagcctgaccaacgtggagaaaccccgtctctattaaaaatacaaaattagtcaggcgtggtggcaaatgcctgtaatcccagctactcgggaggctgaggcaggagaattacttgaatcccagaggcagaggttgcagtgagccaagatcatgctgttgcactccagcctgggcaacaagagtgaaactctgcctcaaaaattaaaaataaataaataaaaaacttactttggtatcacttcattatagaaggaaaataaagtgtgaggtcaaaatctttttcccttctaatagaaagcaaagaatatgccagtatacatcaagaaggcactttcgtataaattatgaaatttaacccaattgaaaatatgcagaaatagatagttcagcatacctaaatttgaaaacagcacgtgcatgattctgtagggtaatactttggggacatgacatgttgtctttttatactttgctaatctgacatgcctttattatatttaacactgagatatgaatacaaatacatcttcatatttgtttttacaggaagttattccaacttttgacatggctgtcaatgaaatcttctttgaccgttaccctgactcaatcttagaacatcagattcaagtaagaccattcaacgcattgaagactaagaatatgagaaacctgaatccagaaggtaatgtatttttcataggattacttttgttgaaggaaaatgccttacatgaaaatagccttgttttcattgagaaattatgaaagaagtaattggcggtggtagtcaaggtgacggattataaattgacaataatatagattcagttatcctatatacttatgaaccccctatactttttaaatttaattgaagtttctgatataagagatgtgactattggccgggcacagtggctcacgcctataatcccagcacttcaggaggccgaggcaggcggatcacctgaggtcaggagtttgagaccagcctggccaacatggcaaaactcctttactaaaaatagaaaaattaccagggcatggtggcacacgcctgtagtcccggctactctcgggaggctgaggcaggagaaacgcttgaacccgggaggcggaggttgcactgagcagaggctgtgccattgcactccagcctgggtgacagaatgagaccctgtctcaaaaaaaaaaaaaaattagattttaaagatttgaggatcacttgaggccaggagtttgagaccagcttgagtgacataagagactccatctctttttaagaagaaattagcaaggcacagtggctcacacatgtaatcctagcactctgggaggctgaggtgacgggcttacttgagcctggcaggttgaggcttcagtgagcagtgattgcaccactgtactccagtctgggcaacaggttaagaccccatctcaacaacaacaaaattgtagaggtctcatgaatcagtggcaggatagggtgatcttcacggctagcagtggctaaatacaggccagaacagggtagcttgtctgaaaccagcaggggaaattagttgcgggcagtgggaccttcaaagggaaaaagttgtctgtcaggaaaggttcaaataatagaggaaacgagcaagagtgaaagatcagagcatctaaggggttctcctgtgtggataataatgactttaaagtatagaggactttttctctaccaggtgctcttactaggcttgaagtacattggcacgttcagtccttggctctgggataggtgctgataccaccccattctataggggacacaaaatgtacacagaaaggctagggtcaggactcagtccaggctgtctggcttttttcctgacacagcagggtgtcatacaggaggccaggtgagtgaggcaggaggcagggagcagggtaggcagacaagaagggaacgagggatgcctgctggacaggggccctgaggaagaagggccagaggttcgctgggcttgagagtctcctgaagacatagcctgcagatgactggacacagaaaggtcgccctaggcagagtcttgggcacctagctcctgtctgtgatcccagctattcctggacctccacacctcaggtcaggtgtgctgacctctcttctcccctcacagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatggtgcgcagccaccctggccccccaggctatgctttgcctgtctgtatcctcaaaaggccaactataacttgtccctcggaccctgagcctcacttcccgaatggcatccatccctctctggtcttgtgggtttcgttagtggcctatgggctaaatatgcagagcacgcaaagcccctgcttcagggcactgtccctgtgctgttgccagtggcactgtctgttgttagagacactgtattttcatggcctaaaatgcttcaaacgtttgagatgagaatacttggttaaatgtcattctgctttttccattggtaaaggattgaggaatttttctgaaattttttcacaaattttactgtctaagaagtttggtcttttttctctatattcatgaaattttaagatgaagttattaaaatgacagaaaaaagtgaggggaaggtagaaaattgcttatttaccgtgattgtgactgtaaagatgtgggaggacaggatttgagtttttctgtgactgcgtgtgcatggtttctttaatgttgcatgggatggagagctggagacagaaaggcaggcaccctgctccgcaggagcacatggcctcctattctcagaatcatgcaggcccccaaagtggcttagagaaaagcccagcatccttaggcctctcagagggtacctggtttggaaaggccttcctcgaccctgctttatgaaaagcatctcagcttcccccaccgcagctccctacattccttcccctgttttgttgctgtctgttgcagcaacttctttagaagaagtaatttctaaggaaataatgagaaacatggacaatcatttatgtggggatatgcactgcagccttatatggcaaaagcagtacaaagacatgcagattttgtccccctgccctctctttgtggcccacatgttctctgtttgctgaccttcagatcaagcttcaggagtctccggaagacatgcctgcagggcagacaccacacacagttatcctgtttgctcacaatgatctcgttgacaaggtccagcctggggacagagtgaatgttacaggtaagagtgtaggtttgcaccagcacttgagcatgtctggcttgctttcaatgctgtgctttagtgagtcattggacttggtcacaggtccagttctacctccagttgtcactgcttgtctttgagactgtggggtatatccctgctttatctgccacctttttaactgagtaccatggcccagcagtatgaaattgttcagttcttcccaaacttgaatgttggagctcatggttcgtgtggtcactcgcctcttgatacctcagtatcctggagctgtgtgtgtctcaagtcagtactgttggcatcatgagagagcagcctcagacaggcttgtatgggtaaagttttgagttatgccatcagctcagagaagtattactcaccaatgctggagttttaagtaatttttacttaatttcccaaatgtatagccaagggttaacatttgtttgttacagagaaaaatgagtcagtgacttgtttccatgtgtagaagctgaggttcagggatgcatagacagcagtagctcagatgccacggtaaatcagaacccaggacccaggtctccttctcttgctgccacaagagtgctctttgcacagcaccatatgagtgtggcagtcctccttttgatgctgtagagtcacaatggattttggttgggggcaagggagtgttgatggcagcacggttcttcattgatgggcaaggtggcgacggtcgcggagtgcctgaatctgctcctgagcggagggcctggggcacaccacgcatcggctcttgtcttcagtgaggcagtgctcaccctgtttcttccccagtgtgaagtcccgcagttatcactggcaatcttccgtcgtaaaagtacttgaagtcatggagaatttgaaagaatgcgtagtttttagtgagtgacgtgcgcatttccagtcctgctaccctgaaacctttgataaagtatttagtccaatatttttgtttcctcacctacaaagtggagttaatgtgatgatacatgtgtgagagtgtttggggccaaggggctgtggaaagtgctgtgtagatgtgaaataagtatcaatgctgctctgtgagataaatcattccgggccactttaaacataatcttccatccctagcctatattggagtgaagaatagtgtgtattctaagaatgtgtgtaaactggtttgttgtgttaaacaagaattacactgacccactgaataaacaaggacagtgctctgtgccattgcgttgagatagctgtaacggggaaaggccaggctttctccaaaagctgcaggaatcagcctggagttaaagccttctggtttgaaatccagaaaagacgaacatcagatcagacctctgtatgtgaggagcctggcttccagaagaatgcatgatttgcatgcttttgtcgggggtggtgggtaggttggggggacctagtctagttttaatgactggaggattttagcattttgttgcagtcaagtaagtgctaggcagattctgtacactcaacttagggaagtaaaaatactgcttattaaaaacaaccacgaacccagcattgagctagaagcacagcagctccatttcaccctcagggtgactgtgcccgtgggcatgctcacgtagctacagttgccctggagcactgctgactagtgggcccaggtgaacacgtcctcgggtctatcatttgcagaaacctgggttctttctcttttgttttgttttgttttgttttgtttcattttgttttgttttgtttttgagacggagttttgctctcgtcacccaggctggagtccaatggcaccatcttggctcaccgcaacctccgcctcccaggttcaagccattctcctgcctcagcctcccgagtagctgggattacaggcatgtgccaccacgcccggctaatttttgtatttttagtagagacagggttctccttgttgattagggtggtctcgaactcccaacctcaggtgatccgcctgcctcagcctcccaaagtgctaggattacagacatgagccaccttggttctttcgagcttgtccgtttcctgctgctatttccctgcttgctcatagcaagcgggagctttgcaatgtgggcctgagtcctgggcttgggagggtcatttaagagacggtggagctcaccctttccagggccagcccgacgtggtgcctcgctctgaagtgcacctgttgcctacgctggttgctgagccactcggaggaagatatgggaaggtaaaagtgcatctcctggttgtgccctcaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaaggtaacagtggattttaaactaggggttgggatttacaattctttgggatcaaatagtataaacatccactccgccactcgagccatccgccataaaggacagagttgtggcctgttagagcaagtgctggcaacctgacttgccattggttgagaagaatcatagcattgtctatcctcatctctggtctaaacttaggtttctaaacagaagaggccacacagtgtcagaatagggacttgcatggccaccattctggtgtaatgataggtgctgatgaactggtcagtgataacttaaagcatatcaagcactttcacgagcctttttataccttcctgtgatttcttaattgtagttctttataagagagaaaagtacctctaaagtttaaactacatctcagttaactgtgcagaaaatgaatgtttagacatgtctctgattatttagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggtgagtcgccttctccaccgtgaacatggacgtgtttaaaatatgtggacccttgaaagacagggtctgtggaactgtgctgtgctaccttggttctaacttggggagattgataagtgctttccacatcatatttcagctaaatctcaacatgtcttctacagggtgtcacgttttgtctttattgctgtactagccttgaatttgtcctaaagctcttgcaaggtgcctgcttcctgagaaagatgtggttatagcacacattcatctaaactcagtccttggcatgaatctgaggacagggcttatccaggtgaactgctgaagtcagtaaaggcaacatggctcaggcaatagaaactcagtggagggaatatgggtttagtaggtggccgggcgaagacggtgcttgttaattgccagcgtcagggagaggcttctaactgcactctttgctctgataggctgggatcatctgtcagctcaatgcgcgcacctctgtcctggcagcagcaaatcccattgagtctcagtggaatcctaaaaaaacaaccattgaaaacatccagctgcctcatactttattatcaaggtattaaaacagatttttattttgttcatttgtagaatattcagggtgagattgaaaaggagctactaagatttcagcaactgctaatggaaactcttcactcttatcaagatgtttcaaatttggttggtcaagagttttcacgacaaggatgatgtgtgttctcatttgttttttaagcagttgggatgtttacctcccacgccgtttacacatggctgtcactcactactcttagtcctaaagccactgctgagagtcaacagagaacaattccgtacagtagatgaggctctgaaaagttagatttattaaagtgcaatcacataatcttcactcttggccccactacaaatattggacatttttcataaatggattttaggttttaattacttgcttttttttctttttttttgacagaagttttttttcccaaaaaaacagttgaatgtgttttcattcaaatctttccattgtcagccaggtacagtgactcacacctgtaattccagcactttgggaggctgaggtgggtggatcgcctgagctcaggagtttgaggccaccctgggcaacttgatgaaaccccatctctactaaaatacaaaaaattagcccggcgtggcggcgcatgcctgtaatcccagctactcgggaggctgaggaggcacaagaattgcttgagcctgggggagtggagattgcagtgagctgagatcataccacttcactctagcttgggctacagagtgagactctgtctcaaaaaaaaaaaaaaaaaaaaaactttccatcgtcaaaattatagtaacgtttccctaagggaagacttcctttgactcagctgattggtccccagccgttccctgggccgacctaaggactagggacagcacagggtgagtggggtgagtggatggacacgaaggccctttccacaccaggcaaagatgcttctccctgatggcgctcacagggtgcacattgactgcacatctgtggtgctcaagcagtctttagtacgtcgtttgtaggtgtattggtgtctcaactaggaaaacagtttttttgttgttgttttgggtttttttgtttgtttttttgagacagagtctccctctgtcggccaggctggagtgcagtgacgcgaacttggctcaccgcaaccttcgccttccaggttcaagcgattctcctgcttcagcctcccaagtagctgggattacaggcaggcaccaccactcctggctaattgttgcatttttagtagagacaaggtttcaccgtgttggccaggctggtctcaaactaccaacctcaggtgatccacctgcctcggcctcacaaggtgctggaaaaacagtatttttactttgttttcttaggtttgatttgatcttcctcttgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggtaaccctgctgaaaaaaggcttactgtgcctgtagcccacagcattaatgtaactgaccaatcatctcctttaaaatattaattattttgttacgaataacatactgttctcttccttgttttgagacagagcctggctctcttgcccaggctggagtgcagtggcttgatctcggcttactgcagcctgtggcctgtgcttctgggttcaagcgattctcctgcttcagcctccctattagctgggattacaggtgcccacaaccactccggctaatttttgtatttttagtagagacagagtttcaccgtgttggccaggctggtcttgaaatcctgacctcaagtgatgcgccagcctctgcctcccaaagtgttaggattgcaggcgcaagccaccatgctgggcctaagaataataaacttttcttttttttttttttgtgagacggagtctcgctgtgtcccccaggctggactgcagtggcgcgatctcggctcactgcaagctccacctcccggattcacgccattctcctgcctcagcctcctgagtagctgggattacaggcacccaccaccacgcctggctaattttttgtatttttagtagagacggggtttcactgtgttaggatggtctcgatctcctgacctcgtgatccgcctgcctcggcctcccaaagtgctgggattacaggcgtgagccaccgcgcctagcaatatactattttttataactgtttattacttcctcccatattgcaaaattgatctttccaaatgttgcaaaagggggaaatagttcatttatgtaggtagtacacacactttatatgtttaagtacttacaagcatagtgaatttaagatcaaagacctggtttcaaatagaggcaacactacacagtaatttggaaactgaaaaagtcatccagtttctgtaagcttccttttgcttgtaaaaaacagaatgagctgtcttttaggttcacttttcagcatcctggtacatgagctgaagtgcatgatggcacatttaggttattcaagcattgtgatattaagaaggttcctggtgctttgatgagctttgcatcctaactgagctcctaaaaattctaagatgaaagttacagacattatgtaatttttttgtgtgtcatagtcttgggggttgttaatgaagaaataagactgtgtcatctgtatgtgaaattgatacaacttacctttgcagcattctcccagcaatccttatgagccccattgtgccccatgtgagcacttttcccagacaggcctgattctccctatgagtgctcacagccttctcctctccccacatgccacattccttccctctgccacgccatgcccgtctctgttcttcagagctacgttagatgccaccctctccaagaattcttcccaagcatctcccagttggaatatgttcacccaccactgcacgctgcacgttgatgtcttcacctgcgatttctgtggtctgtctgtgtagtctctaccacttgatgagctccggggcccaggaccatatctgagttccgtttacttaatggaagcctaagtgttcaaaattcacccacaaaactaaagttgtcaccaaggaggtttgcttttgcttttgtttttctacctacaataggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacgggttcgttattttcagtgaacagaaaagcttttgaaaattatttcaatatgcatgtagtttatatgtcagatttaagctaacagttaaatcatttgaaacagaagttcttaaccttttttggattaggacccctttgagaatctgatgaaagttgccctttaatcttatcttgataaaaatattgattaacacacacagttttgtgtatagtttttttttgttttttttttttatactttaagttttagggtacatgtgcacaacgtgcagtttagttacatatgtacgcatgtgccatgttggtgtgctgtacccagtaactcgtcatttaacattacgtgtatctccaaatgctatccctcccccctccccccaccccacaacaggccctggtgtgtgatgttccccttcctgtgtccgtgtgttctcattgttcaattccagttttgtgtatagttttaaggagattctgtctccttgactgtctgggaagttttgttaacccattttagagaagttgtttgtttcttagcagcagctgcttgctgcacagatgtgtagactgttaaggaaagcagcagctagtggcttacagaaatttccaaataattaaaaactcattcccttcaaatgtactcagcccctgtcgccttatctttctaggtgatactactaaaggaatatttttgagaatttgaagcatttcatttcataatagcaaaaatgttttcattgatttctttttaaatcagggatgagtgccacctctcgtaaacggaaagaagaattagctgaagcattgaaaaagcttattttatctaagggcaaaacaccagctctaaaataccagcaactttttgaagatattcggggacaatctgacatagtaagtgtttatatgtattttttgtttgatagagctttctctttttccttaatattgcttttgggtttttttcctttatttattaaataataaatatagagaagaatgaagaaaaggaagatgaaccataagccatcatcaagaaataatcacaattaaaatttttggctgggtgcagtagctcacgcctgtaatctcatttgggacgctgaggtgggcagatcacttgcagccaggagtttgaaaccagcctgaccaatatggtgaaaccctgtctctattaaaaatacaaaaattagctggatgtggtgataagcacctgaaatcctagctactcaggaggcttaggcaggagaattgcttgaacctgggaggcggaggttgcagtaagctgagatcccaccattgctctccagcctgggcaccagagcggaactccatctcaaaaaaaaaaaaaaagaaaaaattgttatgcccctttcatagttgttataagtttgctttaggtatgaaatatttgggtgtccttttgtaaataagtaaggtagttgtttagtgaaaagaactatgcagtctttcagtgctggtccactttccatcgctgtgttgtgactgagagggcagagttgatagttacaacgtggactatacagatgccaagtctaccacatggaccatctggctactccactcctgatttagagcataaggcatgtgtacagccaccaaaaagagaaagattctgggtggtactttaacattataattattgtgtttctaacaggtaaaggagggacttgacgtgtacaatatttattttctttctcttccccacaggcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaa

SEQ ID NO: 2571 - DNA, 17957 bp, Homo sapiens; identical to SEQ ID NO: 2570
  source 1..17957: mol_type = genomic DNA

SEQ ID NO: 2572 - DNA, 24380 bp, Homo sapiens
  source 1..24380: mol_type = genomic DNA
accgcctcttgtttttcccgcgaaactcggcggctgagcgtggaggttcttgtctcccctggtttgtgaagtgcggaaaaccagaggtgaggctagtgggagtgggactgggactgggagccagcaggcatctggatttccgggtgtagttggagtgggacaggagtttctcgggaactggggttggagtccgggagcgcggccgggggtccccctgctccggactcagggcagggacccaggcgtcggaggggaggaggtgccaggcgctgcccccagcctgttctggccgtttgttcccaccccaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacaggtgcggctcctgcggggccgggggctcgagttccagtgtggccgctcacacgcctctaccagcctgctagagtcctggacagtcagggcacagatgggcccagacgggggaaagagccggtcctgggtcacagggctcatcccggcagcctcacgccttggtataaggctttgtgtattttgttttactttattttattttattttattattaacgtatttgtttattattttgagacggagtctcgctctgtcgccaggctggagtgcagtggcacgatctcggctcactgcaacctccgcttcccgggttcaagcgattcttgtgcctcagcctcccgagtaggtgggactacccccgccatcaccacgcccggataattttttgtaattttagtagagatggggtttcgccatgttcgccaggctgctctcgaactcctgacctcaagtgatccacccgcctcagtctcccaaagtgctgggattacaggcgtgagccaccgtgcccggcctgctttgtgtattttatctgtacctggagttaacttctgggtgagtcacctgttgagtgggccaccagcaaccagctagcgccacttggaccgtttagttctttatccagatcttgttcctgttcatctgcttcctatcatccttccatgtcatgtctgagaccttacaaactcaagttccctgtaggtgtaaaaggtgaagatggcagttaggattcacttcacttcgctcattcatttatttataccagtcttgcaccttcattgattgagcacctgctgcctgccagatactgttctgggtgctgggctgcagcactgaagctggacctggctcctgcttctaggtgattgtacgacctgtgacatcatgagaattctcataggcccggcctctatccctgaaatgttaaaatgcagagaacatgaggttgcaggttcagcactggcccattattagctgagtgacttccaggtgtcagtgtctctgggcctcaccaggccagaaatgggtaaagccattcctgctttcacttactcatgcagcagctgatattgcccacctgtgtgccaggcactgcgctacaaagatgaaaagacgtgcttcttgtcctagagaagctcctaagtcagaggagtgagtcgtgaagaccaacagataacttccacggtggtcatttcctccacagaggaaggtgaaaggacttagggaagttttccggggggctgaagtttgaggggacctttgagctaaggtcagagttgcaggtgtagaaagctttctgtctaggtaggagcaattgcttgtgtagaggtgtggggtgtcctcacagcaagtggctttcagtagcagtctggccattttactggctcctggacataagggagacggggctcaggcctgtgatactgcgaggctggggaacagcctgtgcgttggtcagtggtccccaaatatgttcttgccacagcagtcacatgggatgctctgctaagcatctgggctggacgcagtggctcatgcttgtaattccgacgctttgggaggctgatgccaatggatcatttgaccccaggagttcaagacctggctgggcaacatagtgaaacccaggctctatttaaaaaaaaacagtctgactagaggttgataaggcagatgtgttttctgctgccttggtgcctccagtttttttgttgttttgttttttgtttttttttttttgagatggagtctcgctctgtcacccaggtttgagtacagtggcgtgatcttggctcactgcaactgctgcctgccgggttcaagtgattctcctgcctcagtcccccaagtagctaggattacaggcatccgccaccacacccggctaggtttttttttttgtatttttagtagagatggggtttctccatgttggtgaggctggtacctttttggtttttttttttgagacagagtctcagtctgtcgcccaggctggagtgccctggcgagatctctggtcactgcagcctccacctctggggttcaggcattctcatgcctcagtagctgggactacaggcgtatgctaccatgcccggctaatcttcgtatttttagtagagactgggtgttgccatgtggcccaggctggtgttgaactcctggcctcaagtaatccaccctcctcagcttcctaaagtgttgggattacaggcatgagccacctcactgggccccaagtttgagctgtgtgcattgttcttttccaagagaagttaaaggctctgcggagtccttcagtgacagaactggtttgttgttttgtgcacgctggcctgggtgttgaaacatcctttgactgtcttgtggaccccttccatggagctttctttagggcatgcctgtgccagcagtgagtagcctctgcagggttaaataatggaatgatctggaattagatgtgtgtttgggaagaggaatggtgaggtcatggtggctgtggtgtgggcagattcaggggtgcaggcacacctcagccagtgttggtttcctcttctttgcacccttcctgccccaccctgctatgtgcccactccagggatgaactcaagcggcattacaacctgggggagtactggattgaggtggagatggaggatctggccagctttgatgaggacctggccgactacttgtacaagcagccagccgagcacctgcagctggtgagtgggaccccatccctgagcttcccagggctgctctgccccagttactaatagcctgtgcccttccctttctccagctggaggaagctgccaaggaggtagctgatgaggtgacccggccccggccttctggggaggaggtgctccaggacatccaggtcatgctcaagtcggacgccagcccttccagcattcgtagcctgaaggtgggtcggagggcagtggctgctgcatggtgcagagggctttggatgcagccagacctgagtgctagctgtgtggccttgagtgaggcacttgacctttctgaacctgtctcctcctggagacaaaaggatcgtttgttgttttttgctttttgttatgaaaaattacacacccaaaagcagagagtagtataatgaatcccataaagcttcacccagatttaataattaacattttgtgttgtttcctattttgtcctttttcttttttgctaaagaattttaaagtaaattcatgcacagtggctcatgcctctaatcttagcactttgggaggccgagggaggaagattgcttgataccgggagtttgagaccctggctctccaaaaaacaaaacaaaaaaaaaacaaaaaaaacaaagctaggtatgctggcatatgcctatagtccaggctacttggaaggctgaagtgggaggatcaaggggcctaggaatttgaggttacagtgagctctgattgtgcctctcagcactttagcctgggtgacagagcaagaccctgtctctaaaaataaaaaataaattacagacatgacactttatcccgaaaaaaaaaagttttcttacatagtctcattagcacctcaactgaaacatcaaagatctcttagtatcattgaatatacagtctagattcagattgaccaaattacctcacatgactcttacagctcgtgtgtctcagccaggaccaggcattgtactggattgttgtttaaatctcttttaatccaggacagcttcctttactctgggtgtaagttctttcacagatacattattgatttgctaaagaagcaggagccattatcctgtagaatgtgctgccttttagatttatctgaaggcctccttggggtggttacaacataccccttcccccccgtgatttttggaagctggaagttagatgcaaaggcctgactgtgtttcgatttcacataccgggcaagaacgcttatgggtggtattggatccctcattgcatccctccatccactatgctgagactgaccaggtgctaggttgaggtggtgatggtcactttattgtaatgatgcaggcatggagtcttgaattccgcctccccagcctcgcttctgcttcccacagcctcttcctgctttctttgagagccccagcaaaacttctgctcatgtctggttctctcgttcagccggaggagggcattgagaaacggagacaaggtggagagagattgtcccagtcctgtacactagtggctcaggagctttgtgaagggcaagggctggccataggaaggagtggatcggctgagaatttatgttttactttttattatggataattcaaacattagaatataaagagaatcgtataacgaatcctcttgtactcatcacccagcttaataattagcaactagaggccaatttttttttttttttttttttgagatggagtttttgctcttgttgcccaggctggagtgcagtggcacgatctcagctcactgcaacttccgcctcatgggttcaagtgattctcctgcctcagccccccaagtggttggaattacaggcacacaccaccacgcccggctaatttttagtagagatggggtttcaccatgttggccaggctggtctcgaactcctgacctcaggtgatccatagatgccaaatcttgtttcatctgtggccctggagttcttttgaaacaagtcccatacatcatataatttgatctggaactatttctccatgtatctctaaaagatgaatctctttttttttgagacggagtttgactctgtcgcccaggatggagtgcagtggcatgatctcagctcactgtaacccctgcttccccggttcaagcaattctccggcctcagcctcccgagtagctgggattacaggcatatgccatcacacctggctaatttttgtatttttagtagagacggggattcaccatgttggccaggctggtctcgaactcccgatctcaagtgatccgtccgcctcggccttccaaagtgtcggtattacaggcgtgatccactgcacccagcctttgaagagtcatttttaaaggcatagctacaataacatcacacttaaaaattaacattacggccgggcgcggtggctcatgcctgtaatcccagcattttgggaggccgaggccagtgaattgcctgaggtcaagagttcgagaccagcctggccaacatagtgaaaccccgtctctactaaaaatacaaaaagttagctggacatggtggcagttacctgtaatcccagctacttgggaggctgaggcaggagaatcgcttgaacccgggaggcggaggttgcagtaagccgagatcctgccattgcactccagccttggcgacacagcaagactctgtctcaaaaaaaaaaaaagaaaaaagaaaaaatattactgccttattgtccggtgtgggaatagtcattaagatggggaaactgaggctcaaagagaagtgacccagacagaagaccacacagcaggttttgacagaacttgaactagaatgtgggcccctgcctcccaggtttgttctgtgttgtactctacaggtccaaggatgtcgccatcagagctggggtcaggtctctctcctggcacctgccactttgtagtgaaatgtgcttagtgtatctcttgccctgccacctccccccccaattgtgctgcgaggtctttaaaagcaggagctgtgcctgaggctcctctgaaccccagggtccagatagcctggcactgggtggatgctctggaagcattttttgagcggaacagaagagctgtggccctccctgcagctctgtgcccacctcctccaggctcctgcccaggatatttactggcatatctcagatgcgtcctggctccccttaaccaacaagcttcccgatggctctattacagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacgtgagtctgtggcccagagggactgtgggaggtgacctgagtgaagatcagaaaggatgagaacaagtagcaagcactgcctgcagctgcttctagagatccactgggatgggctgggcaggggtgtgcccttaggattggcacagatctgatgccctgtggctctgagacaccatgaacagggtccctctacattggtgacttctgtctcaccaggatacccagacagcgttgtagggaacccagggttgggagggaaaagcagtccagggtaatgagtctacttggaatcttctgaagcaaactatggtttgctcactaggccagatctagcctgctgaccctatggcccaggaacacgttcgttcatttaagtattgcccacagctggtttcgcactacaaaggcagggtatgtggcctcttggctggcagaacctggaatgcacatcctccggccctttctagaaaatgtttgctgcccccagtctgaaggaaccccaccctcttcactggctgctctttcttggctccttcgctggtgcctcctcagcttcccatccacctgtggcacagctgcctcattccatgctgttgacatctctcacttggagaggcacgctacctcctccctgatcccccgcgtccaccctccaccccctcagtctgttttccacccagcagccaggtgtcccttgacactcaggtggtccagtcatttacttcttagtcaagtcctgcacagcccaccacgatctgctcctggcttccccaggcctcgctgcccctcctctctccaggcccggcctcactgcctccttcctgtttctggaatacactgactacccccagtctcactgcctttgaccttgctgtttcctctactgggagtgctgttcctcaagctaccatagtctgtgtcctcacttcttcaggcttctcttcacatgtccccttaccaggggcatcttgcccaacccttcatcttcagtttggtgtgcacgtacctcgtctctcccacacctgcctacttttttacttttcttcacagcatgtagctgtcactctttaatatgattgtttgcttgtatgtcttttcagcctcccttgataggaacttaggctccacaagagcagggacctttttgttcagtgctgtgccccctgcacctggaatagtgtcagacacatagtaggttttgctatgatgtttacttctttatgttgctataatatctattgaataatgacataattacctagggatacgtagaggcttagaccctcagaatggtctagaactgcctagaatcccactggaaaagatcttgggatttgagtggggctttagtaagagaattgatgaactagctcttcacccatgaggacaccatgatcctgcaagaagaccgagtgtgacctgtctgcctcctctcagcaagttaatggaaggacccagcctcaagcagttcccttgactcttaatccagtgctaggtccgtcagtgttgccttcctttcttacctccaggcagcgttgcctgcctggcttatctccagcttattctggagacccccataaattgccgctggcaacgtctccttgctggctcctgggatgaatgagccctgcctttggattctccaggtagctttggtgactcttttcccttaccttgtacagagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtgaggcagacgggctgggaggtgggcatctacgacggtggatgtcccagctgtggccctaacccgagtgttgggagtgggtcatctggagcagggtgagtagggtggagaaggtggccagttgcagagcacctgctctgtgcctaatgcttccataagttcctctcatctcgtctttccataatctgcaggggcatgtcagccccattttgcagatgaggaaatgtaacttggagagattaaatgacttcctgtgtggaggagagccgggctttcagcctatgtgcattgctttccaaagtctgtgttcttcttaggataagaggcccaggatgcacagctagataaccaatagctggcaaagcctcttcccagcctgacaccccacctcctaccccaggctttctttttttttttgagacggagtctggctctgtagcccaggctggagtgcagtggcgcgatctcggctcactgcaagctccacctcctgggttaatgccattctccggcctcagcctcccgagtagctgggactacaggcgccctccaccatgcccagctaattttttgtattttttagtagagatgaggtttcaccttgttagccaggatggtctcgatctcctgacctcatgatccgcccgccttggcctcccagagtgcgtggattacaggcgtgagctactgcgcccagcgtaccccaggctttctgttaagatcctgctgaacagccacggtggctcatgcctgtaatcccagcacttggagcggctgagacaggaggattgcttgaggccaggagttcaagaccagcctgggcaacatactgagaccctgtatctaaaaaaaaaaaatttattagctgggtgttggggcagacacctataatcccagctacttgggaggctgaggtgggagaatcacttgaccccagaaggttgaggttgcagtgagctgtgattacaccactccactctagcctgggtgacagagcgagaccctgtctcaaaaaggaaaacaaaaaagattctactgagggggagagggtactgagcttgggcccctcatagtaacctgggtggaaggttttgagatctttgattagggttctaacctgggcttgcatatcctgaaattgcatgcagatgttctgaggagagcggatctgtagcttctgttaacttcattagtggcaacagagtatgtaggggtcaggctcttgctccctgggcaagttatgtgactttgtcaagcttcagtttcctcatcagtaaaatggggataaggacagtccttaatctctcagagggctgcttgaaaatgcatgtggtgtttagcacaattccttcatgcagattacgtaatcaggatgtatgattttccaagcagttcatgaatcctgaaaacttacgaagtgggtatgggaagaggggagttggaggctcatggagtgacggtgatggtcttttctggagctgtgatgcctgatggtataaagcacttctatgtctgctgcctcacctgactccacaacatgagaggcaggccacttcgtcatccccctaggctcagaggtgcaatgacttcgttgaggtcacacagcgactaagtgtccctccacaccaccctgtctctgactgggggacttggagacttccctgtttcaacatctcattttgaaaacaggaaatgaaaacccagaggcaaaatgagctcacagagccatgaagaggcaaaaagggcgagtggcccctcaaggaggctggggggcgtgaagaggaagtcttgccctgagaggctaaagggcaccacacagtgagctgacagcagacacgtggagatggggcttttggagggctctgtgggctggcactaagcctcctaaaccagcgtacaaatgagttagcgagttcagcgagagtcaggccaccacctgcctttctgtttggctgtcactgtgggcaacaccatcctccaagcagctgagcatgggctgagtgacgtggggagagaggccgttctctgggctccgtggggctggagccagctcagcatgtggtgcctgtggcaaaaatgctgcagtggaccctgcgtgtcctgggcatgggtggaatcagagacttgctgtccaagtcagaatctcagcttttctcctttctcctctaccctcctctcaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggtgagttggctttggggtcctggcttagccctgctaaaaggctgtgcttgcatacttctggtaacaggcagctcgttacttcatgaggtagcccaggatgtccttgtgttgctcatatcattagaacgttcatttttatattaagtgatccctggaacttccacacattggtcctagctgtggctcctgggctgagggtgtttgcctaagtgcaggattaaggcagaaggactgaggtcaaatcactggggaattactgaaagccaagtcttcacttctgtgacaggaaatacaagagaagtgaaacgcagggttccaggcaggcagccgcctagtgtctagttggagaaataagaaaactgtgagaccgctggggacatgtgggtaaagtggtggctgttgtgggtcacgcagttccaaggaggtgctaaaggaggtctgagaaggaggaggtcggggctgggccttggggaaggttttctgggaggaggttaatctgagctgggctttgaagagtggtggatgtggaagaacttccaggcgggaggggatggcaggagcaggtgaaaaccccggcctgggcaaggtactgagtggctggagggccgagtgggagtctaggggatgaggggccaggtggtgtaagaggccttgagtgccgagatggggagctcctgcttacacctgagggcagcaggggccactgagggttttcaggtttgtttcagccctctggctgcagtgaattgattcagaggggtggcttccccagggctcagtccatggcccaccccacatttacacaaactacctagattattacaactttaaaaccactgacaggtaagtagctctcacatttccatttctagcctgggcttctccccacgttccagactttaataaccaactgctgatttgacatgttcacttacatatctgaaaggcatctcgaactttacatggctgaagctaagctcccctttccccaccctcagactggctcctctcagtcttcccatcttcaccctttcagttgctcagacaaaaacccccaagtcacccttggtgctcttttctctcatcccccacatctaatcactcaggaactctggccagctccacctttaaaacgtgtccaggatctgaccacttctcatcctccccacctgctctgagcccttgtcagccctccctggatcaccgttgatcctccccagtgttcgtctccaccttgccctaccttctctgttctgcagcagccagtgagcgatgctgtcatgaccaagacactatatcactcctcggctgaaaggggagaccttccagtggtttccaaggtcctatgccatctggccctctgtttgctcagaacccttctccccacttcccctcaccctttggaccctggaacacaccaggcccattcctgagggcttgagagctgggatctctgtttactcagataggttgtgctgtcctggccctaagggccctaagggctctgccttctgggaggtccctgagctggtgccaggatgggcagtgggctggaagagctcccttgtactcactcatgcgcctgctttgcctaccaaggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggtaggggcttgagttcccttgggtttggggaggcggctgatgatggggctcacagtaggataattactggataatcaggactgggcactcttttttgtatttcctgggcccctcagtctgccaggcacctttgccagcccccaagcttgccatcagctggctagtggctgatctgcgcacctgtctcagcgatgccctgaccctggcaagggggagactgggggcctggcaagtgcagtgggagagcactgagcttagggtcgtgtaggtaccaggacttaaatctcagcactgagcttggggtcagtagcagggatattattagcagctgccatttactgtgttcttcctatgcacagccattctttgttttttttttttgagacagtctcactctgttgcccaggctggagtgcagtggtgtgatctcggctcactgcaagctccgcctcttgggttcacaccattctcctgcctcagcctcccgagtagctgggactacaggcgcctgccaccatgcccagctaattttttttgtatttttagtagagacagggtttcaccgtgttagccaggatggtctcgatctcctgacctcgtgatccgcccgcctcggcctcccaaagtgctgggattacaggcgtgagccaccgcacccggccgcacaggcattcttctaagtgctttatgtgtctgaagcccagtcattcctcacagtaacctgttaacgcagctgttgtgcccattttatagatgagggaattgaggcatagagagttaaagggacttgctccccagcacatgcaggggagccaggagcctgctgtcatggtgcttgttctgccgcaccgtgcacagcccacaggcagctctctgtccttttctttcaagctgggaggaacgttgctcagatgctgggtgtacccgagcacagccataagagccatttcctttaaccctcctcttctgggaggcaagctctgtcctcattgctaggcaagacctaccatggtttgggaactacagagctgggtaggaacatgggtctcaggccacagccactaccttcttaccaactctgaggcccatgatagttgggggagtcaactgccagcccaccaatctggtgactggatgtcacatgcgatgccctcatggattctcaccttgtccatctacccttcgtcccccaggctccctgatggacttactcgccgaggagacatcaacctgctgatgctaggggaccctgggacagccaagtcccagcttctgaagtttgtggagaagtgttctcccattggggtgagtggcctgggatacctttgccaccttggcttgcagggaggaaggctgcagggcagggcctctgggtcctcaggacacctgtggtgggctggctcacccggaatctcttcctcctttctcttggctgcggtcaggatggccgaggagatgggaggaagaagggagccaacaggtgtatgtaggtttggggcagggggcgagtacactgtactgagagtcaggatggggtttgggtctcaccctggccagaaattggctgtgggctttgagtaagtcacccaatctccctgagcgtcagtttatccatttgctaaataatgatattgttatcattaatagctaaaatctggctgggcatggtggttcatccctgtaataccagcgctttgggaggccgaggtgggcggattgcttgagctcaggagtttgagaccagcctggacaacatggtgaaaccctgtctttaccaaaaatacaaaataactagccaggcgtgatatgcacctgtggtcccagctgcttgggaggctgaggtgggaggatcacttaagcccagaacggggaggttgcagtgagccaagattgtgccactgcactccagcctgggtgacagagtgagaccatgtttcaaataataataataaataataataataataataatagctaaaatgaagggccagacactgcttgaagtactttgcatatatttacttagtcttcacctcaactgtgtggcaggtactattacccctgtgttaggggtgagaaaactcaggtacagaatgggtaagtgtcttggcccaggtctcactgctggtaagcattagagcaggatgtgattgaacccaagtgtctgatgagctgggtcctctgctgcgttgttgaatgggtctgcggggatcagagccagagaaggtctgacatgatccgagtggcggggttgtatagggcgagatggtggtctttggatagataggaagtgtgccaaatttgccacactggcactgtccagtagaaatagtgaactgcacatgcgacccatgtatgtcttctcagattgtctaacagccacattaaaaagtagctgggtgcggttgtgtgcatacctgtagtcccagctacttgggaggctgaggtgggaggatcacttgagcccaggagtttgagaccagcttgggcaacatagcaagaccccgtttcaatttaaaaggaagaaggggaaagaaaaaaggaaaaacaggtgaagttacttctgtttaactcgctatatctaaaatctcatttcaacatgttgtttgatatgtagattattgagatactttacattcttaggagctctgagtctttgaaatcgtgcgtattttgcacgattaaggacatctcagttaggactttcccaatttcaggggctctatggcagtatgtggcgtgtaggtctatatagagacgacaagggactcacgatgggggcaggctttccctgggagtcaggagtcctcatcctagccctgaggctaactcctcttctctgggcctcagtttgctcatctgtgagttgggcctcacaagactgtgtcacagggctgtggtgaggcttaggtgagccatggatgtgatgccctcagcggggagaacatctgggcacaccgaggcccagggcagcatccccttccagagggagacgcactgagttggagccttgagtcctattctgtaccctgcagccagctttgatgtgtgaccttgggcaaatcacaacctcagtgggtctttttgtcttatgggggtcaaagcatggagttgttattgggccctgacaccaccccactgccccaggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaaggtgagtctgatgaggtgggtagtagccaaaaggtgggtggcaccagggtatgtgacttcctgtgctcagccagcagaaatcacctctgacttgggagacatgttttcaatccctgggccggtcactctagtaactgtgggaagctgcttaacctcttcaagcctcagttcccatatctgaagagtggggagaagaaaggcaagcccacacagttgttcccatgattagaggtgacctggttgctgccattggccttgcgtggagctggtattcaggagtgagggctgctgttagttttcctgtttctactgctccctgctccctcacttcagtaggtctgatgatatttctctcttccccacttagatgcgagaagatgaccgtgtggcaatccacgaagccatggagcagcagaccatctctatcgccaaggtgagtggccctccatggagagcccagcctgcagcagcccagcgtggcccaaccgtcctcaggctgccctgattgggaccaagttctctttgcccaggcctagaatctgtgtgtgtgtgtgtgtgtgtgtgtgtgtgtgtgtgtgtgtgtgtgtgtgtgtgtgtgtgtaaacgtgtatataagaaggcatctttgccatctcctcccccttttcgtcgtctgtcgcctgttaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtggtacgtccaggggcagggctggtggccatgggacctgcctccaggcaggcttgtgattgtgtgggaaggagaatggagaacaagggccttggctggcaaagtcctgactgtcaggctgtgaaattggggagcacgtgagagggcggttgttgtggactgcagaggattgaagcagggtctggagtcctgtggcctgctctgcctctgccgtgagtgataagctgtgtgatttgggctaaatcagtttctccctgggcctcagtcccttatatatgaaacagaggagttgacattgggttatgagtaatagaacctcagttctggttagtaaatttttcaaagaaaaaaacatagtggtttatagaattggtaagtccggcggcttaaggcccaggtagatctggattctcaaacaactgtctctgcctttctgttctgcttcccttggtggaatctttgtacttgggcagctgttcctcttgtggtggcaaagacaaaataagattttgtcctgttagcttgtagcttaacagcccccaggaaagaggaggccccgtcttttccagtacttctatcaaaagtcccaggatagactcctattggcttgggtagatcctatgtccatgcccaagttggggtggacaagatacatgccccaagtcggggtggacaagctgaacccacccctttatggaccagggcagaggagcaaggagcattaagttctctctaaaggagaatccagatgctcccatcagaacgagggcctggtgctgagcaaacaggctgagcacgcctgagatctcagcaccctttccggctccttgatgccagggccccatcagctctttctggctgttccacctcagtgctgggactcaggcttgggacggcctgtgggatgacccattatcccctctgctctccagatgctggccaagcatgtcatcactctgcacgtgagcgcactgacacagacacaggctgtggagggcgagattgacctggccaagctgaagaagtttattgcctactgccgagtgtgagtcctggacgcaggcccacgggggtgaggttgcccagcttccctgggtgggagagaacccagtcccctggtcctgctcctcctcatgaagaacagcccagatgttgctgttctgaggttctcagctctactgaatctgctctgctcccttctaaccttgcgtagctcactggctcttggcttcagttttcccacctccacaccaaggaggtgggatttagatggtcttgaagacctcctcgagtctgacatgcagggaggcagtgaagtgtagacatggtagacatgggctctgggtcatacctgccttcactctatgactttgggcaagttggttggcctctctgagccttgatttccccaggcctatcgatgtttgctaggatttttgtaaggattgcacaagatgatgagtaagtgcttggcatagccctgccctgggtaaatactcagtgagtcgcagctgcaatttgattgttctcacagattttcaataataataattatatacatagtactggctggttgcagtggctcacgctgtaatcccagcactttgggaggcggaggcaggtggatcacttgaggtcaggagtgcgagaccagcctggccaacgtggcgaaaccccatgtctactaaaaatacaaaaattagccgggtgtggtggtgcacacctatagtcccagctactcaggaggctgaggcaggagaattgcttgaacccaggaggcagagattgcagtgagctgagatcgtgccattgcacttcagcctgggcaacagagtgagactctgtctcaaaaaaaaaaaatatatatatatgtgtacacacacacacacacacacacactcactcttacacactactttctttgtgccaggcattctgaattactattcagtattttctatatgaataaattataaccctcccccaaaacctaccaggtaaggtgtgctattattcccttccctttatggatggggaagctgaggcaaaggaagttaagtaacttgcccaaggtcacatgccagaggtagtggagccaggatgtgaacccagctgcttgcctccagaggctgtgctcttaaccacagtgcttcgattcttgtcgtacagcgctttggtgatcttttgaaggagctaaaacccaggggttgagggctctttgaatgcactaccagtggggggctggtgggtccctgattcagcacctctgccagggtgagtgggtagtccctgggtcttcatccaagtctgagctctgtgtggcccagtcttgagaggcttgggcccacagctgtgagtcagggagccctggattctaatcttccctctgcactaagtccccaggtagccttggggagttccctccctccctctgggtctcagtctccacatccttaggatggttgagctaaggctttccctacatcagtgactgtcagttggcctgggggctagaggggaggggatgggatagggtagatgctgatcagacttccccacacctaccgtcccaggagagtctgaggtgctcccagcccctggactgcagtcaccgccaagcctcctgtgggtgtcatcagcttgtcgtgtcttcagatgtgttgggtggaggagtttgagactgctgcaaagcccaccacccagtgggcctccatgccgctgtgattgtgccattgttcattacatgtatgggggaccttgtggcaagacaccacacagcgtctaacagtggggaagaggcggttttcaccctgcagacgtgcctggcttttcttcacctgttttttaagagaggcacccatatttctccccagtgttgatgtttgtggcagctgcccacagccagatttcacttaaatcttttccgattgttgtcccccagcccatatgagtgggcagctgtggtgtggtgggaaagtgcatgtctgtaagctggcagggggctgggggaaagggtaggtgccctaagagtccctcctggcctcacaccagcctctccccactgtcctgcaggaagtgtggcccccggctgtcagcagaggctgcagagaaactgaagaaccgctacatcatcatgcggagcggggcccgtcagcacgagagggacagtgaccgccgctccagcatccccatcactgtgcggtgagcaggcgggcagggctgggccatggcagatggggcttgctttacacagcagggtgtgcttggcaaccaggggcagtggtccaggcttttcacttggcacaggcccatagtagctctgggcaggaagagtccctttggagcataaactatggcctccttgatctcaatgatgatccatgtttcttgatttaaggccgggcaaacctagacccctcttgtctgaatttggcctggcttctcccattgtaggaagcccgaagggagggaaggacccaggcctgggagtcaagagtcttgggtcccagcctctagcccactgtgtgactgtagggaaattacattccttctctggccctcagtgcttttagctcctaactctgttcattcttgtgactttgtagacaatacagtgggtaagagttgggatttacctggtttgaatcctgtctccagcactgactggttggaaatggatttggctataagtaatggtaaatccagataaagtagcttaaagaaataggaagttcatttctcttttctgtagcactgtctggaggaagatggtatggggactggtgtgaggactcctcaagctcccccttactcttagtccgagatggccgctagaacttcagccatcacctccaggcagcaggacaggaaggaaagagagcttcccttttaaaggacacttcatgaagtcccacacaatgcttggacttacaacttactgccatagattggtcacacaaatacaacctggtacaaaagatgtctgggatgtgttttagtggatcgctgtgtgccagactaaaaactggggttccaagctaggtgcagtggcctacattgtgatcctagcactttgggaggctgaggcaggaggattacttgaggccaggagtttgagaccagcctgggcaacatagcaagactcccatttctacaaaaaataaaaaattagccaggcattgtggtgcatgcctgtagacccagctcctcaggtggctgaggtggaaggatcactggagcccaggagttcgaggctgcagtgagctatgatcatgccactacattccagcctggtccacagagcgagactttgtctcaaaaaaaaaaaaaaaaaaaaaaaattgcagttctatgactaagatcaaaagggagatggattatggggacacctagcagtctccaccacagtcttaccactttgggcaagcacctccctggtaacgggctggctggggaggaagggaatagcggaccgaggctaccctgagcacgctgttgcccccacaggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggtgagcagatgcaggggccatggtctcaattgatctgggttccctggctcggagctctgtgggcagggctctggcctgctgggggcctgcagtgtgtgtcttgcttctctgagtttgctgagcttctctgagtttctttttgccataagacccctctcctcctttctccccaccgctgtttcctccaagatgggaagaagcagcttctctccagacccttgaacacaatcctcttgacccaggtcattgatgataacccttctcactggctaggaacaacagttgatgctctgcttcctagagcttgtcagcattttcagtgcttccagagttatttcttgcattttgccttacagctgccccctggaagccaggtgagcagtcagtcctgcccatgttagaaatgagacagctgacactcgaaggggcctttccctggtgcccaagatcacagtcgcttggctggaatgcaagtctcctggcccctaggccagcgttttccacaccataagccatactgtctggtttcggtcagcctttcaacagactgtcccaggcaccgatcatgagccaggctacctacgctggggaaaatctgttccttcacccagcagatacttcattagtgttactgtttgccaggcactgttctaggtgctgggagtataagagcaatcaatcacagggtcccggccctcctgggttctcattctcgttctagttggggagagatagacagtagagaaacaaatgcaggtagtgtaggtagtgaaaaaggcagtgagggagatgatggcagggccaggtgtgttggaaaaggaggacgtgctctttcccatggagtgagtgggcatggcctctgcaaggaggtgatgccaagcagggagctgcatgaaggggacagtgtggctccttgggggaagagctgctcaggtggaggcagcgctaagtgtcagtttccccaggagggagcaggtttggtgcatttgaatggggaggcacttgggtgaggaatggggtgggtggggcctgttcctcctgtcccccttggtgaagactcagcctctaccctggagacacttgctgtcacatgagacattgcaggtggaggcctctgggatgctgcaggcacagagggcaggggtgatatggagtggtgataatttgagttgggtcttatgggctatgtaggagtttgcctcacagactcccctctcaatgacttcttgaccatgagcccaccatctccttagctgaaacaccaaggcctctgtggcagtaattggaagtcacgagcctcctggttgccgagggctcctcagggcacctcgtagatgtgtccagggcaggctggcttccctcctgggtcactgatgggccccttccaactctctctctaatctatctgctccagcaacaaaaggagtcctgctgtggcctccaagggcccgcaggacttggtccctagtgacactctggccatgtctctgctgcgctgggccccgggctgctttttgaatgagacaggtgtgttcctgcctctgtgactttgtgcttggcctggagtgtccccacatgtgccatatcctgtctcctcaatcaggcctgcaccaccctggcacactcggtgcccttttctgacttactcttcggggcctggctcaggctgttcttccttgggctagaggctgtctctgtccaagaactcccattgtcccagctccccggctgcctcacttctccatgcccacaggggtggagggcttcaccagccaggaggaccaggagatgctgagccgcatcgagaagcagctcaagcgccgctttgccattggctcccaggtgtctgagcacagcatcatcaaggacttcaccaagcaggtgagcctgccttggagtgggggtgtgagccggcacggggtgcaggtcttctgctggttcccacccactcagcactggcatcttactcagcagacaggccctgaacgggggtaggatggacaactgtccctttctcagaccttttctagccatcattccttccctagggacatcttcatcaggagcagggatgggggtattttttctgtcccacgaaggggaggggagagcagaggtggttggattctggtgaaaccccatacaagttccccgcagcccttcccgtctgtgcctttccccgttggcgggcgtttcatggagtgggaaggggcagagccatgagagtgagctttctggctcactgaggagggtactgttggccccatagagagaagatgggatttcccagatgctctggaaaacctgtcacctttaaaatctcaggattaatcctagtttctggtctccgctccttgtacatcatctcattttgattcagggcagtttaatgggtggtatcgtgtctattctataggtgcgcagactgaggcttagagaaaggtttagagcttcggttctagagtcagatgggacttaagtcccagctctacctcttaattgctgtgaccttgagcaagtggcttagcctccgtgtgcctcagtgtctggtacacagtgggcactcaggaagtgtgggccctttaggtcaaaggagcctgagtacaaagttccccgtgagcctggggatgtctgggctctgtcggagtcccctcgggcagcacgtgccgttagccagccatgtgctcccacagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggta

SEQ ID NO: 2573 - DNA, 17875 bp, Homo sapiens
  source 1..17875: mol_type = genomic DNA
taaggcacagagtgaatatttatttatcacagaggtcaagccgaagctctaattttataaatcctggaaaagctggccagaaaagtacagagacttgcccaaagtcaaagctaaagatgcttccagaggccaggagagaagaaaatgttttagtagcactccataactggaccctcaaatctactcactccaagcatcccttcaagttcctgaccccaaagtaagaatctcagtaagaaaaaaatagagatggtttccaaataggaggtaggacaccatgagtggcatcgagcaataactgcaacagtctggctaaagatagctgccacttatgacatctgagcatgaaactagctaattttaaaatggccatttaatacatgcatgtaagaaatcttgtatcccctaaatctatacaaataaaaaactataaatacaaataaaataaaatggccattaaaaaaacaaacaaacaaacaaaaaacaacctgtggcttccaaatcccttatcttttcatttattcataaagatttctggtcccacccatgttccaggacaagttgtatcaatataccccaatcctttctaacgccctgagttctttcttccacatatcttctaattcgtggtctgggagggaaaagggtagtggagttctcaggtggatgacatctccaaaggggagaggacaaaggcctctggcttggcttcctgcttcagcactccagtcagcaggaactcaggcgagaggaggggcagcccaacccgtagtggaatggagcaatgagggaagtcctgagggcatgtgatcacaactctctgaggctggggaagacagagcaaaggcaaaatcaggtgaaaaagaatcctagaaatgggttcaggacccactaaccagtcttaccatcactaaaataatacctcctaatatgaagccaagtgaagcacaccgcatactgtctatgaaatactcttgctaggccgggcgcagtggctcatgcctgtaattacacagcactttgggaggctgaggcgggtggatcacgaggtcaggagatcaagaccacggtgaaaccctgtctctactaaaaatacaaaaaaaaaaaaaaaaaaaaattagccgggcgcgctgacgggtgcctgtcgtcccagctactcgggaggctggggcaggagaatggcgtgaaaacccaggaggcggagcttgcagtgagccgagatcgcgccactgcactccagcctgggctacagagcaagactccatctcaaaagaaaaaaaaaaagaaaaaaaaaaaagaaatactcttgctagaggccaggcacagtggctcacgcctataatcccagcactttgggaggccgaggtgggtggatcacgaggtcaagagatcgagaccatcctggccaacatggtgaaaccccgtctttagtaaaaataaaaaaattagctgggcgtggtggtgtgcgcctgtagtcccagctactcgggaggttgaggcaggagaacagcttgaacccgggagatggaggttgcagtgagccaagactgctccactgtactccagcctggcgacagagtgagactctctcaaaaaaaaaaaatacttttgctagaaagatgaacctgaatttattcaagcttttacaattatctgcaatttccaggaaatatggagtacagaggaacaagataaattatatgacaaggaggcaaacccaaaattccagactgaggaacattctaaaggacaagtgacccagcttctgcaggaaatagatggcataaaaaaagctgggtgggttaagggatgctctagagtaaagataattaagaagataataggtgtggcagtatgtggaccttatttgaatcctgatttgaacaactgtatagagacatttttcagacaatgggagaaattttattaatggagtgtgagcaaatgaccaataaactactgttaattttgcttaggatcaataatggcattgtgattatgaaataaaatgtacgtatttcttagagatatatatttaagtatgtaggaagaaataatataatattggcagtttgctttaaaatatttcagcaaagaaagagaaaggaaaaaaagaaagaataaagaaaaataaaaagaaatgaaatacttcagcaaagaaaatcaaaggaaaaagccgggcgcggtggctcacgcctgtaatcccagcactttgagaggccgaggcgggcagatcatgacctcaggagatcaagaccatcctggctaacacagtgaaaccccatctctactaaaaatacaaaagaattagccgggcgtggtggcgggcacctgtagtcccagctactcgggaggctgaggcaggagaatggtgtgaacccaggaggcggagattgtagtgagccgagattgtgccactgcactccagcctgagagtgagactccatctcaaaaaaaaaaaaaaaaaaaaaaaaagaaaatcaaaggaaaaaagggatagatggagcaaatgtagcataatctaaattaagctgctgctgaatctcggtgattgttatatgggggtatcagcagatctgtcccctcattcctatccctttctataccataggtcttttcccccaccctctcactactttatattcctttctgaacctccatttttttccctccaatctttgccattccagccacctctttaactgccactgccacctcacccagacccagaacatcctaagcataccttataggaccgaggcatgctgggtaggtatgtgcctccacagcagctaataatctctcccatctgaggtggtggtggctggactccaggggtcacatagatctcatagccctaagagaaagaaatgatggagatggtattgtagattgggaagcactggagggagggctgaagcacaggttaaaagatagcctctcacctctagcagccttcgctcccgagccctgctcagtgcgtcttgaaggctaaagccaaagttcttctcttgctcagggtcggtcaccacatattcatccgggggtaagaagaaaccagccttgcgggactaaggacggcagcagtcagcatcaaagctcagcccagcccctcaatcagctctgctgcctagcatttagagagagctcacaaaatgtcttttaaatcaatgcaggcttctggctcaccaatgcccctgtcttcctgtaacgcctcttcccttccaccactttctagggcactatatgagcagtcttgccactatatcggtctgtcatcatcccttggcctctcacctgatgcagccagtccagggacagaatggggattccccgccccagggcacacaggaacttgactgtccggcggatgcgatcagtgaccaggtgggaagcctctgccgctgaaccagccagacttccccccagtgccagcacagcccgctctccccgagcatccaccactcctgtgaagagcacctgtggaagggttgacctgaggtggttacggcaacccatgccatcagcacccatctctacaatcctctaggtctccttgcatcctcccctcatctctgtctcccacaaagtcccatgcctttgtctcttactttgggggctgttgattcttggttaagtttggtccgtcggaggctgcggcttggtattctgttgggctcctcctctgcctggtctctctttctcttgcctggttttggagtcacgacatcctgagattgagaaaaatcttggtgggagtttcagagccctgaagtcatttttcccagctttgtggtcccaaccctctcctcacctcttccttccctggcttctctgcagtatcttcttcctcttccttgataatcactgtcttctgggagacttcccctctttggggctgtttttgatgtggtggtgaatccatggtagctaaagacctcttgcggctttgagaggccttaggctggagctccggggtgaacctagatctacctgctggttccaccttttggatctgggaggcatgaattggtgtctcaagaagctggggagaggcaggctcaggaatggctgtaagggattcagctgctctcactgctccccatctttggttccttgaggcctgggatttaggttccaagggtgcagagcaaggcttatggtcaatgggagctgcgagggagccagggttcccagcggctctctgcctcttgatgcaactgggttgagtaataggctcaggggaaataggctggtctgtggtgacaggagattggaattcaggggtggtaggaaccggcatagctcttactgtggaagacctcagtgttttgctctgaccaccctgagctatggcctcaggggtgacggactggtctgtgggggtaaaaggctcaagatcagaggctgctggttcaactggtttgggagtcttgacagaggacctatttgtctttctcctagtggccctagatgtgagcttgggggtgacaggctggtctgtggaggtggtaggatggggctcaggggctgtggggacaactggctcaggggtcttgacagaggacctatttgtcctgcacctagtggcccgagatgtgggctcaggggtgacaagctggtttctggaggtggaaggctgaagctcaggggctatagggacaattgattcaggggtcttgacagaggacctatttgtcctgcccctagtggcccgagatgtgggctcaggggtgacaggttggtctgtggaggtggaaggctggagctcaggggctgcgggcacaactgtttcaggggtcttgacagaggaccgattttttcttcccctagtggtccgagatgtgggctcagaggtgacaggctggtctgtggaggcggaagcctgtagctcaggggctgtggggacaactgtttcaggagtcttgacagaggatctatctgttcttcccctagtagcctgagacgtaggctcaggggtaacaggctggtctgtggaggtggaaggctggagctcaggggctgtggggacaactgtttcaggggtcttcacagaggacctatttgtcctgcccctggtggcctgagatgtgggctcaggagtgacaggttggtctgtggaagtggaaggctcgagcttaggggctgtggggacaagtgtttcaggggtcttgccagaggatctattttttcttcccctagtagcccgagatgtgggctcaggggtgacaggctgctctgtggaggtggaaggtgggagctcaggggctatagggacagttgattcagggttcttcacagaggacatatttgtcctgctcctagtggtccgagatgtgggcttaggggtgacaggttggtctgtggaggtggaaatctggagctcaggggctgtggggacaactgtttcaggggtcttgacagaggacatatttgtcctgctcctagtggtccgagatgtgggcttgggggtgacaggtcggtctgtggaggtggaaggccggagctcaggggctgtgggcacaactggttcaggggtcttgacagaggatctattttttcttcccctagtagcctgatatgtgggctcagaagtgacaggctggtctgtggaggtggaaggctggagctcaggggctgtggggacaactggttcaggggtcttgacagaggatctattttttcttcccctagtagcctgagaggtgggttcagaggtgacaggtcggtcggtggaggtggaaggctggagctcaagggctgtgggcacaactgtttcaggggtcttgacagaggatctactttttcttcccctagtaacctgagatgtgggctcagaggtgacaggctggtctgtggaggtggaaggctggagctcaggggctgtggggacaactggttcaggggtcttgacagaggacctatttgtcctgctcctagtggcctgagatgtgggcttgggagtgactggctgggctgtggaggtggaagggtggggctcaggggcagcagaggtagctggaaagggtgtcattctggaggacttccgagttctaattttaggctttgggtggaaaggctccagctctgaggacaagggagcctctggagcttcctgactcccatcttgcctggtcttacgaacggttggcttgatagaaggtaaaaggggagaaagaaggggcggaggtgcaagatgtttctggctctgagagttaaggggcttttggggtggggctggggcttcaggtactgtaggaggcagacaagcatctggagattcctgatcgccctagggagaaacagaagcaagtgagggggaggaggtggagaaaagagatagaacttggatactgttcttgatacttgtttatggttagataggcttaccagatttccaccgggcgtggtggctcacggctataatcccagcactttgggaggccgaggcgggcggatcacgaggtcaggagttcaagaccagcctggccaacatagtgaaaccccgtctctactaaaaatacaaaaaaaaaggccaggcatggtggctgatgcctgtaatcccagcactttgggaggccgaggcgggtggatcacaaggtcaggaaaccgagaccatcctggctaacacggtgaaaccccgtctctactaaaaaatacaaaaaattagccgggcgtggtggcgggcgcctgtagtcccagctacttggaaggctgaggcaggagaatggcgtgaactcgggaggcggagcttgcagtgagccgagatggtgccactgcactccagcctgggggacagagcaagactctgtctaaaaaaaaaaaaaaaaaaaaaaaaaattagctaggtgtgttggcaggcgcctagtagtcccagctacctgggaggctgagggaggagagtcgcttgaacccgggaggcagaggttgcagtgagccaagatcgcgccactgcactccagcctgggtgacagagtgagactgtctcaaaaaaaacaaaaaaatacacaaaaattagccgggtgacatgcgcctgtagtcccagctacttgggaggctgcggcaggaaaattgtttgaacccaagagacggaggttacagtaagctgagatcacgccactgcacactccagcctgggtgacagagacagactctgtctcaaaaaagaacaaaaacaaaaaatatgctcactggattttcctttctgtctatgatctctcctccattagactgggatctacctgggaagctacctttttcccacagacctgtctccataatgctactatagtgttctccacacgtggatgatggtaaggaaaaggatggctggggcaaagaaagaagaaacacgaagggtctttcttttgagtcaggtaggagatacaacttaggaaacagatatggaaaacaacgggtgccgaggataaaggaatagaagccaatcaaggcgtgacaaaaatggaagaaaactgaataatgagaaaggaatagattaaagtgaggctaggtgaaagagcattggagaagatatagagatgacttgtggaataggaggtagaaaaagtagctctcaccctggaaaccttctcagcagctctgatcctggaagccttctcagcaggtggcatcttgcaattcaggaggcctagacagaaagtaaacacaaaggtggctgagttccaagcagctggttgcccaggggttgattatcacgaggcctgtgtatcaccttgggttcccctctgccttcacttacctttctgatgcctcctggggctcactggggatccccttccacctgactggctcccagaaggtacgggggctgaggtaggtcccggaaggtcccccgcccccaccccaggctctggtgttgggctggaggcctgccctttctggtcctggctccctccctctggctcccctctctgtgtatctctctccaggatcactttgggcaccttctcttctaactcggctggatcgcactctctgtttgctactggtctctctacttctctctcaaatgctttgcttggaagggtctgcttctgtacttgtttctcttgtatttcctcagatgtctcaatttctaccttcaaactctccctatctctttcaggacttgcactttccccatttttgtcagattcttgtctctgggtgtctctagctaacaactgtttttgttctctgtcctgtttccccttggttaattcttcctctcctgtcacatctgtctgtctttctggtagcagtttctcagtttctctctccaatggccctctctcagggcccaccctctctgctgtttcttttggtatacccatgactttatccacagtctgcctccctctgccttgaatccccattggctctgtgtgaactgggctctctggatgttggtctcctggtattgccctaggtggagacaggcaaggtccataggcctcaaggtgcgtgtcaaaaggctgggtctcagagtcctcagactctctcagacagaatggctgtgtagccaggacctcccatggttcatctagggtacctggaaggggaggaaggaagagagagagagggagagggagagaaaagagggagaggaagagggaaagggaagtacaggttgacataataaatatgatgagaaaggatttagataaactcatgaataataaatctgaacaggttattaaaggtaagctgggaataagggtggtagttataacatttaacgtttgtctcaaaaaggtcatagccttaggcgggcatggtggctcagacatgtaatcccaggactttgggaggccaagacatgaggattgcttgaggccaggagtttgagactagcctggacaacatggcaaaaccccatctctacaaaaaatacaaaaaaattaggtgtggggacggggacctgtagtcctgtagtctcagctacccgggaggctgaggtaggagaactacttgaaccccaaaggtcaagactgtagtgagctgtgatcataccactgcacttcagcctgagtgacagagactctgtctcaaaaaaaaaaaaaaaaaaaaacccaagagaaaaagaaaaacatcatagcctaatatgagttccctgaatagtctctcatcataccactgcattccagcctgagtgacagagaccctgtctcaaaaaaagaaagaaagaaagaaagaaagaaaaacatcatagcctaataagagagttccctgaatagtctctctctctcaagacagtttcactctgtcacccaggctggagtgcagtggcatgatgttggctcactgcaactcccaactgctgggctcaggagatcctcccacctcagcctcccaagtagctgggactacggcatgtgccaaagtgcccggctaattttttgtatttgttgtagagatggggtttggtcttgaactcttagactcaagtgatccacccacattggtctcccaaagtgctgggattacaggtgtgagccaccatgcttggctggaatttccttctttttaaaggctgaatagtattccactgtgtatatataccacattttcttttttcttcattgacacataataattgtacatatttatggggtacctgtgctattttgactcatgcatacaatgtacaatgataaaaccaagataattgggatatccactatctcaaacatttatcatttctttgtcttggaaacatatcaaatctcttctagctattttgaaatacacaataaattattaactatagtaacactactgtggaactgaacactagaacttattcattcaatctgactggatttttgtattcattaaccaacctctttatgcattctgtccctctacccttcctagcctttggtaaccaccattctactctctacttccatgagatccatgtttttagctcccacatgagtgagcatacaatatttgcctttctgtgctgacttatttcacttaacataatgtcctcagggttcatccatgttgctgcagatgacaggatttcattctcttctgttgctgaatactgttccactgtgtatatatacacattttcttttttttttagattgagtcttgctctgtcacccagtttggagtgcagtggcatgacctcagctcactgcaacctctgcgtcttaggcagcaatcctcccatcttagcctcccgagtagctaagactacaggtgcatgccaccatgcccagctaaattttgtattttgagccactgcacccagcctatatacacattttctttttttttattattagagatgaagtctcactctgttgcccatgttggagtgcagtggtgtgaccttggctcactgcaacctctgcctccggggttcaaatgagtctcctgcttcagtctcccgagtagctgggactacaggcacctgccaccatgcccagctaatttttgtatttttagtagagacagggtttcaccatgttggccaggctggtctcaaactcctgacctcatgtgatccacccacttcggcttcccaaagtgctgggattacaggcatgaggcactgtgcccggcctacattttcttttctttcgtttttttgagacagagtttcactcttgttgcccaggccagagtgcgatggcacaatctcagctcactgcaacctctgcctcctgggttcaagggattctcctgactcagtctcctgagtagctgggattacaggcatgcaccaccacacccggctaattttgtatttttagtagagacggggtttctccatgttggtcaggctggtctcaagctcccgatctcaggtgatctgcctgccttggcctcccaaagtgttgggattagaggtgtgagccactgtgcccgaccccggcctacattttctttatccattcatctgttgatggacatttagtttgatttcatatctgcctattgtgaacagtgctgcaatagtgtgtgtgtgttttttttaagagacattgggggtgggggttgagggatgggctattgcccagactgggctcaactgatcttcccatcctggcctcccatgtaactgggactacaggtgctcactactatgctgggctaattttttcatttttgtggagaccaggtctctctctgttgcccaggccagtccctaaatattttcaacctgcagctggttgaattcacggacgcaaactcgcatacacagagggctcactgtaatcagagtatgaaagaaacatgtaggaaggcaaatcaagaaagaacgcaggccgggcgcagtggcttacgcctgcaattccagcattttgggaggccgaggcaggcggatcacttgaggtcgggagtttgtgaccagcctggccaacatggtgaaaccctgtctctactaaacatacaaaaaattagccaggcatggtcatggacagctgtaatcccagctacctgggaagctgaaggaagagaaaccgcctgggaggcggaggttacagtgagccgagactgcaccactgtaatccagcctgagtgacagaggaaaaaaaagagaatgcagaattggggacacagaggagggaagagtttcttatacctgttgtctggaagctgcaatgggaagggccaagctcttggggtggagtcaacatgaaggcctgggtaggttcatcctccatgctctggactgctgtacaggaaaagatggcctaagttcatctcctccatactactgtagggttccattcctggtctcctaccctacccatactagcctttacccttcaaggaccaccagtctaatctcccagctcccactggtacaggattcaaataacacagaagtcctcaccttccaggccctgattctccagaaagcactgggtagcttgtaggtccagatcttcagaatctggtcggggaggaatataagacagtttaaaacaaaaatcatacctgacactaaactccttaaataatctctacctttctctccccaaccccagctgttagaaccctggttgatttcagaggtctaggaaggaaggccagcacttaccaccatagttgtcttcagagtccttggtcccacccacatgttgttctctctcccttcctgtggggacctgggctccctctctctgtggctgggtggattcccctagagtgtctgtgtccaccaccagatctgtgaggttctctcttgagatagggaggtcctgctccacttgtgccacaggtggcccaccctgggcccccacctcatgagctctctcctgcttaagaacagctgcagcccactctgccccagcatccccttctgctggaagctggctctttcttacatctgcaactactgaggctgttagggaggtgccctcctctgcatctgtttcacagtccccatgcagaggccaggcttcctctagagataccacaagcagctttgctggtcccccaactgctttcacatctgtttgatttgtcccctccacagacacctgatgcttctttatatgtataatggctgaccctggcgggacttccttctccacttgtgtgttgatgtccactgtggtggaggcttggcttctctccaggtggatcccaggtgagctcttatctgcttccacactgtcatcactgtccccaaaaggaggttggtccttttctgaatgtgctctaacaagggctctaatctttgtgtgatccttgaggacagcttctctattttccactgggagctcttcctcctccacgtctgtgtcactgtctctctcagtggtggtttggcttcgctgcagaaggaccacacgttggggcatgtcctcttctgcatctctgttccatatagcaggctggctctctttcagatgtgccaaagtcagcgctgctgagacttcttcctcgtcatctgtatcgctgttgataaccatggaagcttggcttttctccagagggacagcctgtggggccttgccttcttccacatctgtatcactaccagcctggctctcctgcagatgggccaggcctggtgctccaggaccccttgtacctactccatggaagatcttcctcttcttcataggaatgacaactggggttgctgggatcctctcttcttccgcatcagtgtcgctgtcgatgaagccaaaaggctgagccctttccaaatggacctcagctggccttccaggaggcctgctgtcatcatccacatctgtgtcactgtcctctccaggaggttggctcctctccagaatcaccccagctggaaccaccccattccctgcacccctcttgacttttgtatcattgtccctctccttcactaaaggctgatccttttcaagctggatttcagttacaacttcagcttcagactgctttgcctctacagtggcacctcttctggcagctgaggaggcctcctctgtggctggttgctgaccttcttccacatctgtgtcactgttcaaattgaaggcaaaaggcggcccaaggccgcccaggaccggggaatgcccctcttcatcactgtgaagggaagaaaagagagtctatagaatttatttccctggaagggataccccaactcaactgtgagctccttgaggggagacacaaggtagcatatttcttcttctgtttccaatttgttttccacttggcacatcagatgtgctccataaaaattcagctgagtgaatgaatatgtatggttccccagccccaactctcatgataatcatctcttttagagattgatcctccagcccctggttcttcctcattttgaagactcaggtgtctgactctttggcactcacctctctggaactatcacagaggaagatgtggtccttgatttttttaccatacgcctttcagaaagaaaatctgtcaagaacagaaaggaatgagttgacaattgtacactcattattcctgtctcctcattctccctgccaatatacaaacttacctacttcctcctccgagtcctcagccaacagaagcctctggggttgagtttctccctgtactctgggtgtctcttctactgtcagagggccccgggagacaaagggcagagagacatccaggcgatggtactggcagagcaagtcagcaaagagaatcaattcctggtccctcagacggtgactcaccccagggctcaaaaccttaggaggtctcaggatttgagtaccattaaggctcccacagtctcggaggataggtgccttgtcccaggctaagatttcaatctctgcatgttgtttggagatagatggaaagggcagggccacagagcagtcaggcattcggcctaccacattcttcccgaggtgtagtgggaaatctaagaattagagaggtagataagctccaagatcagagtcctggcctgtcattaggaaaaagtgcctattaggtactctactactcactcaaggcctccatatgcattagaaaaataaaaggccctaggacatctaggcactgaaagagtatatgcgataccccatccatccacaatggatgtttttttactgttataaaatacacataacacaaaatgtatcaccttaataattttaagtgtatagttcagtggcattaagtgcattcacactgttgtgcaatcatcactaccatccatctccagagcacacaattggattttatttgattttttttttttttttgagacagggtctcattctgtcacccaggctagaatgcagtgtcatgatcatagatcagtgcaatcttgaactcttgggttcaagtgatcatctggctcagcctcccaagtaggtgggactgcagatgtgaaatgaaccaccacacctggctaatttttaaatttttcgtagagacagggttttgctatgctacccaggctggtctctaactcctagtctcaagtgatccttctgccttggcctctcaaagcacgggaattacaggtgtgagtcactgcacccagcttcatttcaatctcttaattttcttttatcaaagtaaaatcacttccagtgagtccagggtagtagtctgcaactatcaactcaatcggccccatctcttccattcatgaaaaaaaaaaattcacatctcattgaaacatacataagcttcttgcaaccctccaaataccttaccacaaaaataaaagatctatatcaatacttgaacatccaataccctctgacctttttctggtccatgggcaccactaaagatatgtagccgccctactggctccacgttacacctcaaggattcactggattgctctgtctcctcctcttcttcaacatcccagtcaatagcctgggtgtcctccatgatctgggaaggatacacattatcaattatcctcattattggttcacacaaacagcatcagagttatcagactgaaaactagggggtaaactggatcattatgaacgttgatgcttctctttccaccaatctttctgttgttaaccttctgaagcacttaaaacatttttttcttttttgtgatggagtctcgttctgctccccaggctggcatgcagtggtaagatcttgggcccacggcaacctctgcctcccgggtttcaagcaattctctcacctcagcctcccaagtagctgagattacaggcacctgccaccatgcctggctaatttttgtatttttagaagagatggggttttgccatattggccagggtggactcgaactcttgaccttgggtgatccgcccaccttggcctcccaaagtgctgggattacaggcgtgagccactgcgccccgttgtttttctttcttttttagcccatgctttttatacttttaccagaccacctcagtttgatcagatgcaactgcaaaaaatgataataaaagatgacatatatagaagcttcctatgtgtcaagcactgttctaattactttatatcgactctgactcatttaatcttcacaagaaccttgtaaagtagtattactatcttccatttcttcagataaagaaactgcaacatagctgggttaagattttcagatctccttgaaacatacataagcatatataaggttaagacttgccccaaatcactcagatgtctctcctctaaaatcttgatggtttttcgtgcacacagaataaaatctaaactccttagcgagaccctccatgatctgaacttcacatcttgtaacgcctacccctcgcccgcaaaagcctatggttcagccagacattttccccagtcttcgaacacactgttcttgtcttcccacatcttcatgccttagcccaattccttggctttttcccacctagttttctggtccaacttctaccatcctttaagattcagttcaaatgtcactttctttcttttttttttttttgagatggaatctcgctctgtcgtccaggctggactgcagtggtgctatcttggctcactgcaacctctgcctccaggcttcaagcgattctcctgcctcagcctcccgagcagctgggattacaggcgcccggcatcacgcctggctaatttttgtatttttagtagagacggggtttcaccacggtctcgagctcctgacctcaggtgatccgcccaccttggccacccaaagtgttgggattacagcagtgagcaaccgcgcccggcctcaaatgtcactttctcagcaaaccctttcctggcgtgttccctgccttctcgtgttcctggtgtatcctgcctgttccacagtggtcaatggatttgtgcttactctaagatctctcgctatattgtaaccattactttccatttctgccttcacactcacccacctccaggactggattaggggaaccgtgtctttcccctagggtccatcatattcattcaatggttatggtatacctgtttgaagtatttggtatacatctgtgaaccaaacatgaaatcgaccctgccctcgggaaggctcatcaccgagcctactgatgaaggaacaaatgagatggaaagaaaatagcataaatggaattcacctgaaaatatgccactctagagggaaactgttgacaggtagggaaagtaggatgccccatggataaagtgtcaactccgtctttatgacaggccaactcagcgggtgcccaccacgcttggctccaattcaaagagccaccatctttggtccccacctcagtgggttcccttgtggcccgacgtctccctgtgtcttcatacctaaactcggagcggggcgccaggtaaggatgagtattacagtccgagaagcgaacttccaagtcacctccgcccagtcgcacccaaggtacgcccctcccgccttctgggggaaccaagatggctcccggggagccgtgggccaggcccctagaactcacctactttaagtccccgcgcgcgccaccagtaacggtcgcgacccaggtggagcgactgcgtgtgccgaaaaagagcttatttgctgattggcttctgccgctgtctttcacaaccgcagccagtcgagcggaggcacacccaaagccccgcccccttagagttcaaataggtggtgtctcccaggctgctgagatcagttaatgagacggtaattgaaggccgccgtgcgccaacagaataatgcacgtcgattgggcagctccaagggacaacccactaccgcttgcccgcccaccacccacttcccgcgcagttccaaaccgcgaccagagagtctggcgccagctgccggcaacggatagaggggctgtgtcatagacgtccgacgtgtctggtaaggccagagcgcctttcctcggtcctcctagacatggtg

SEQ ID NO: 2574 - DNA, 185865 bp, Homo sapiens
  source 1..185865: mol_type = genomic DNA
tcactaagaaagccagtaactttactgaattgtctgcaaaatacaaattataccttatttccagcaggagaaacttttgaaaatttcccacttttattcactacagacagctgaattaagtcccttgagatacacagatgtggtttaacttagttataacatcttgtcatctagtggcgacaaagtccagcttatgccgctgtgagcctctatttgaatatttgttgcaaatgcttgtatgccctcatttacaagcgattttaattactctcatttaatggaaacaagtccccaggaaaagaaaaagaagaaaaatgatacagcaaaccatctgaagcaatccaagtcctatgcctacagtgacccaggtctactttgctcgaagagaacactggtactgcattcaaaccacaacagaatccgtcacttaactgacctctctgaattaaactgaggtatgaatcaatttgaggtatgaacagggaaggcaaaatgcaataccagattatgaaaataaccaaaatggaaaaatttgatgtagaagatatgtggcttggattgctccacatctttggttaaaacatattaagaaaagcctttaattacatctgtagtctgaagcattctaacagacaccagtattccagcaatcttcaaaagatctgtagtggcaggaaattaacgccataaaagtgacgacatcacggcagatggcacaaatgagaacagatgaagtatgccatgcttaggcaacagcctttattgagggttcaagtggcttcttcttctttaaaaaaaatgttttttaaagaaagaactacaaagcgtttactctctggagaaacaaacaacaaaataaagagggcaaaaaatgctatctctaagttaaaagatgggtatgtaagaaaaacaaatccataaaagtgtgtgagggcagacattcttttaaaaagtgtcttggaattttgttttttcattctcactttagttaacttttaaatgatctggggatgacaggtatttttatattcatcattacaaaatgctaaattccacctttgggaaaaaataagccattttactaaaaaacacaatttttaaaaaggttgaaataaacagcctccacgcagcaatgcatacaatatacaggttgtgcagcttgcgtatattgcatcactgttaccagtattcaagcttcatattaccaaaaatcttttaaaataggattagatataacaatactcgcagccgtgtaaaatgccacttatggatcttttacttgcaatgaagaatgttgcctaaaatgttactctaggacgggttatgtaaaataatactccctcagggctctgccctaaagtctggaatacaaaggatttactgtgattaaaaaccatactagctttgcaaatacaataaatggtaaattacagataaggtataagggtaaagatagaccaagattgtttacagaaagtgactcatcaaaatcaaaattgtgcttcttctcattaaatcatcttttaaaaattctcagattatcccttccctatcttgccaccactttataagaattcagtagtgggaacaagagatgactggcatccattttcaagtgattctgttctcttcatgttcttataaaactattgtcagaactgctataaatagccaaggcttctgctggtactttagcttactttatcttcagcattaaaaattcactttttctttgttgctgaggcaaattgcaggttaaaaaactaatatggctatttcttcatattttcatgtaatgaccctttcccacccactggtatctactgatattgatatactaaagtattttgaaatgacaaagaacatttgtgaaatgtttgcatattttatacacatcaagttagaaggatgggttgtaaggatgggatcaagtctatggtgaggaaaatgattttcttattttattcccctgtgcgtgtgtgtgtatgagtgtgtatattttcagggatgtttttgtttttcctctgcataaatgttattctttcatgttccatggataccttgagtagtgggatatatatgaaatggttgatagattttttttttttaatatataaaacattagtacaaggcaggctagcatcctttatggatacaaccaaaggtgcattgtggtctaattgtggatttcagatcaagttaagaaaaatatagcctagttaataaggtctcttggcttctgccacccagcggcagccttttacaatgagaaacacatagcaactatgcaagtaaaagagaaaaaatggataagaaatgtcctacacatgatatagcagtgttgatattactgcctatatcttctttgctgtgtatgtcaatgcatatgattggagatgaatcgacagatcttcacattccaagagaaggaaaatctttcctagactgaaatatcttttaaacaatatatattgactttcttatggcactcacttattaaagggtctgaaaattaatcccttatagacgaatattagacaagagtcattttttttaaattaaaaaaagggacatagagaggttctttatgggatttcttgaaatggctattaaatctctttattgaagaaaaaatagatgacatacatgctttatgcagaagtgacatttgggggtcctgacacaccgggattgttcaacagtcctatattgctgacaagattgtcaagggtcagttaaaataattaaaaacggatgacaaagcaactatccctttacctgcttccttcttgtctagcacccagtctttcacatttttcttctgtgggaatttataacttattcaccaagtaaattccatatcacttgtttctagggccatatttgcaggacatgtgccccaacatagcttttctattctgggcatatttctaaaaagcgtatcaaattctaggctgaaaaccaaccagatgatttagaatatgggcaagttaggatatgcacttactgaattccaagatgcatggtgaaatggtgagatcagaaaggggccctgcatttgataaaaatgcaaaaaacaaaataaaaatagcatgaaagaaactagtatatacaatggatgtcagttgacccaatagattgctaatgtattaaaaacaatttagggtgttgcaatgtgatatgttctaaccccacaggttatccttttgacagctgaccttaaacttataaaatgtaagcagagtaaaagaaaacagaaagaaaatagttactcaaatgtgcaactgcacaaatatacccccctcccgctattaagataacaaaacttctgctattaccataatattatatatattagaaagctatacacaagcatgttaatttcacagatttttttaaaagattcttaatattttatataattagaaatacacatttcaaaaacaaaacttctacaaagagaaaacagttatcttggttagcaaagcatggagttcttcatggcttagggtagtgctttctatacaaaaagtcctttttggttttttacaggactgtttaaaatattagcgaagctatcaaggggaaaaaaacacattttggcttaagtaaactacaaaaagccacaaatgctttgcaaactctgtcttaccttttatatgaaaataagcaaaatgtaatgtacatatttttatatttttatttaataagagatgcagacccagatttatttatttatttaattaaatatgttagccctccaactccacatttttttttaataggtatggtcctcttttaatggtctctgatcctttttaatgagtgccatacgccaatgatatgcctgcaggtttgtgagcattcttgggatgtcaggtgacctggtgtgttcctaacatttaccaatggccacccattaccgggtctgtccaagcatctatacatttttctatatgttgcataacagctgctctctctttcagtaaagatctgccgcttttggcaaatgtttccttttgtctatttacatgtaaataacgttgaacctgcaacatgacactatctattgtaacatacattttgcaaaggagcacaacagtgaaaagaagttagccttaaaatctattttgtacaagtgttctgttgtacaactcaagtgctaagcttatctcagcatttctgtttatctttatactgtatcactgaggcaatttaaaagtacttttacaaaacagagtacctgactttttttttttccacacacggcacatataatgcatatcgaccccccttccccattaaggtatagcacacacacacactgcaagaaaaaaaaaaaaactagtaagtaataatctgatcatgttgcccatccttcagaaagtcgcatgcgcttgactgagggactttccctttcgtccggcgaaggtctggtgagtccaatgggggagtggaattcgttccggtgatcctctcggtcgctcccgtcgtacgaactgctacagctgctcaagctgtcaacaggagatctccccgcctcgtggcgcgtgtgttgtgggtatctcgaaggggtggtggtacggtctctaggaggagaaacaggttctgacttgatgttgaggctttgagtagaaggcagggagagatttgaactctgagataaatgagtgctagtgcaagctctgtaggaggaaaggaaacccagttacagatgaaggaggcctggaggccccaggaactcacaattaaatcaaacatcagcttaaagactcgcatagacaccagagcatgcccagagtgaagaaaacgtgcttggaagcacataagggcatcgccttctcagggcgatttaggatgcctttgttgatttgcccggtagtaattacagcatttaactggtccaggcctcatgaattatatctctagtctccgagaggctccctaaacatataggttaccatttcagaaaggtttaagacacaatggaaaaagcattttctgtgttcatggactctatccctagactagttctaaaaattaaatttctaagcatttagatacagtgtttagctctggaattagacttccttgatttactaatgcttgtgtttgaatattatttttaaaagcttattatcaatataaatatttgcctccaattaataagcacatacagatggaatcacatagtcttcagagaaagtgaagggagttaaattttaaatgactagaactcaaatgctgcacaataactgtatctggtaaaaagctttggaggtggaaaaaatggaaagggggagggaaattgaaaattatctgcagaaagtttaaacgttggttttcaaacacttaagactttctactccattaaaactgataatttgactttcttcatccttttgcagttacatgagatgaaaatactttgtgttccacaatgacctcaattttattaatgttagtcactccctgatgcgtgcggttcttaggctaccactcctcttatttatcattggcattagttgatgaatctggtgttgcctaaggaaagcttgttgccaagaaggatgtagtgtgattttactgtgtttataatccttaatcctcatatattcccagagagaataatttttcctttttccaaaatctgggaaaatttagaaacttggaattctagaggaaaaaagtattaagcccttaagtgtagattagcaatcacaatgactttgatcaggataaaccatagtggcattgctcgcatcaattttaagatgcttttactcttcttacactaattacactgacttccagagctagagtcaggattacttgactatattgtcaaaagagcatggtactctcttttactgaggaagaatccaagtgaagaattatccatacagacacacccattttaaacaaaggaaagcaagcctacttactaatgtatgtaattatgctgctttccagtggagagaattagttggcactaacaatgtcattatgaccactgagagaaaaagtatatatttcagaaaaaaagtgaagtaacttggggctggctttttgggagatgcaatacaaactcaagatgtatagtgatataaaattagtcagaaacgagtttatctttgagtgatgttttgtacaaaagcaccacctactggcaaagaattactttccttctcctattaataaatagatgagctaatgtagagaataatataaaggagaattatttgtttccttaataagcgtctctttctctagcttttatgatcttatataatcaaagcagtgttagcatttatatcaagaaactacactgactgtatataattttcaaacacctgtttatatttggagctatttatttgtagcttattaatttatagtctatcagtttactaattttccaaaagttttaattaaataagccttgttaaaatggggagagggaacacctgtatttcaaaaggattcataatggtagactattttatcttggttcaaagttacttagtgattcattctgatgtttgaggaaatcgtcttttgatttctggaataaagaattttcctggctctaagaaagaccatttcactaaaatttaattaaatgcttctgctatgaatcacacaactatttaataatgaatatgaattaggagtctgaaaataaaaagtgatatgtcaataaatacttttgcttgctctttgacatacagattatgtcttcacagggagggtgacatagaaaattagaagaaaaaattggtgagttggacagtctaagcagttaatctagacaaggtaagggaaaaataatataaccaaaattctgtttctttaatacagtttttggaagctgcattattcacctctttgcatcatcttcctatgttaactggcctgtataggtttagctgtgtatcttccccatgaaagatgtaacaattattggttatcccttcctacaaacagactagcttaaatttatcttttggtggaatttcatttgacactgaaaacatacatgaagcattttgagtagttctggggactaaatccacagtagtaaaatgcaagtgatatcttagattcagcttcattatactgtgacataggatataaaatagaatggctagtctctgttaacaaagaagtattttcttgaaaagaaaaaagtagcattaaaataacttaactgcatatatgctaggttcagatataagcatgttggtctacttgagaacaaaatatagacacgaataattatagaccctgataattgtgaaatactgcatatgtgtgggtgggtgataaagaggtgggtggggagatagaagccagatatgcaagttacccatatcaagtcctctatgcaaattttcatctattacagatgcttttgaattgggaaaactcctaccctttcccataattgttcagaaatcaaacatgactggatagttttattcaaaatttttactgcctccgcctggaaattagactatcaaactatatttaacctaaccttttataagtcatctctactcagagttatctctctcagtatgtactgaacacccacatcaacaaagttgacgtatggaaatgcttccagaaaacaggctgccctttttataggtggtggtttagaaaaacactaaaacttagtgttacactaaatcaaatattagtattcaaaggactttcattaactcttgatggcaagttcctctgtcagccatctctctccctatagcaaataaatttgtgttgcttacttagcttggttagataaaatcagatactaggttttaaaagtatagctttgaagacttaaagctccaaaggacaaaatgaactttttttccatggacaaaatatgaagaactctgtttatggttttgcaattttgagaaagaattgtggtaaccatcttgggctgctgggaatatctactttggtggagctgaaatatattccactctgctatgaacattgtctctagccaaaagaatgtgagcccgcaacacaaatctctgcgacaactttggcctggaaaatgtatcaattctttttaaattgatttacactgtaaagaattaaggatgctcatgtgaattactttacataagtattgcagcttgggattttttaaaaaaacagtttaacatttaatcgtgtgaatatgaggtagtccatgtgaaggaacctcctttcaaaaagctactctgtgtgtgattgtgagagggagaaaagagtgtgtgtgaagcagagagagagaagggccaacagtggaaggactggaagggtcattccattgatttgaggggtaagggaagtgattaagtgcaattaaaactcacagagaaaactaagagtcaaattaagcacaacgaaattaagtgttgaaaggaaccgggagctgaacaaaatgcttaacctttggctgttgtaattcagttcctttctgtctaaggctgtccctcctttctcattttctgaaacctctattagaggcagcagagaattagattcttccttgtaatagaaaagagttttaaaattgtagtacagctaaaatatgtaaataaatatgtgtttatatgtaaaaatataaattatcaggtactattgaaaacaaaaaaaagccacattcagagaaaataatatggcttttgacattgataacttttagggaaatctagccctataatggatgaattttgtgaaaaaaatgggaaataagcagttatgtttatttttgacaagaatcatgttcagtggattccctgctaagccatagcagttgatactttgtacaaaatatgtatacatgtacatattttttagttgcctggatggaattatgtgcttggtgataattacctgaagaagttcccacagttaatgtctacttgaatagttaacattccagagaaaatttaagtgtcctaaaaagataaaactctgcgctgatcaatatgtaatgtatcttcaaagttaactatctttcaagaaagctgaccaacagtatcacgtgaatttatcttactatttaaatgaaaggttagattttcaatgacagtgattagcgggtaggatgaacataagcaaacagtgtacgggtgaatatttcataatcagatcactaatatatgctaaatcactatcatgtgaaagctagtgggtggggggagagagggcaccagcaaacataagagacacaaagttgtggtataaatcagtgacttttatactaatcagtgttttattctcactgtctccttagacatatggatatataactagttaactaatacagctaagtgattaacgataacaaatggctaagcagaaaagtaaaagtgggctaggcagacagaatatttttaaaatataaaagcttgttatctttaaatattttatatcctcctggtattttcttttgaagattaattgcaattttggacttattaaatttacagtcaggctttcagttaacgttttaagcttttttaaaaaaatgatttgttttatatgaaatagtgtgaattgtgaattcagagctttttaaaggtttgaacgtttccatagataaatgacaagagtcatttctatgataaagacatatctgaaaactaccacaagggggcagaaagatacatcctctgactacataaaacaaaaattatttttatatccaaatttaggtaattagtattatatgtactagttagtattatatacatatatttcttaaaatatctataagtatacaactatactatgagtacattataaatacatgaagcctgtgtatcaattgactagttgttcctatgtgtattaggttaacattagcataaaccatatggtttatgtgaaaaaagaaaaattctcaaatatctaagcttatactataaatgccttcttatgtcccaaatgaactgtgtgaaaactaaataaaaattatatcactgatagaagtggaaacaaatgtagcctaaaacaataaggaaagaatttacctcattattacagagctcgctgtcctcttaaaaaacaggtatataagatttaagctacttgaaaagtattgatctgaaaattacacttggatttcaataaagtagagttttatacccgttaatgggatattgaagcacatatttagagactgtcatttgtttttcaaaatacattctaaaattatattataaaaaataatattgcttaccccaactgactgagggcagatggtggcatgttatgtaggtgttgctgttgccagccagttactgaaccaaggtgaagagcgctggcggtgttaaacccagacagagatgacaggtctgcactactcagagagtactctagattaaagaataaaacaacaagggaaaatattaaatttagaaattatcaaatggtaaatagaataaacattttcaatttccaaaatattctattaggattatcgttattatagatatttttaattttgaggggaggggagataaagcatcagcgataattctaatttaaaaggaatatactataaaccaaaaataagtattccacgaatgctctgaagtagcatagtccgcaattctagtttattagaactacaatctagtataaaggtatgtacatatttgatgatgtagaaatgttaaacaatcctgagaaagtgagctttttattacatcaaagaaacagctcaattttcttgaaagtgtgtttctattttgaactcaggttgcataaataaaactttcagtcagttaagaaagaaaaatgtggatattcactttgtcttagtgaagaatgggtaatgctgcagtgctgtggacggcgcaggccctaaataaagcttcctaatagagtaaaagataactttttcatcttgattttcaataaaaagtatttagtgtactaattgcacatgacaaagctactcaccggtaccatatgttgttgaaatggctgatggatatcctcccattccttgtcctggtaaagtaggagttgctacggaaaccactggggtagccaatgactgagccgactgggagttatttatcctttgattcttttaaaataaataaaaagacattactgatgaatttttttaaaagttaaaaatattagatttcagtattagttttccacataaagagataacttggtacaaatctcatgaaattaatcatttaacatgtgtctctatgaactctgccaaccctatcatttacaatccttcaagagaccagctgttgccatagtaacccattacatcagtatctcctaggcaactgaactagtaacaagtaccatagctttattatgggtaaaaacagactatgttgaaaactgatgaaatatgtatactgtacttccattgtttcagttttcattcaaatgcaaattaaaaaaaaattaaaatcaaccatggtagtttttatgttcagttctacatacagcagagagcaaatgagtaggggctcatgttatattttgaccagcaggtggtgctgtgaccactttgttcagattcttctaaacttccctcaaactagatggcaaagcagctaatgcgaatatttaactcattacagtaaagagataaaagatccaccacataaacttaaaatcatgagactttaattcccagaagaagaaatattttagttttatgtaatgaaagaatatttttgtttgaattttactataaattgtcctaaaatattgaaaacagaaaaaatattgaaacaaaaaaaaaaacctgacattcttttcacctgtgagtgatgccagaaattaatggtatttaaacataatcaatgttgacatactgtggtaacttccaatatcttccaattttatcaaagctaccacctctacctaaaagtagctttgcacatgccatttgagggaagcgctctcaccacttaccaaaagcaggtcgacatcctcagactgagagcatgcggaaggagttttattaattagtgtccgtaaatatttataattgggcaaaatcttttcaacaaaaggaaaagcatcttccgatagacacaacagtttaaacagttttaaaacccagactccaaagataactccttacaaagacattctttgtttcccttaatgagctgtttgtctcaaatgtgaagacaatctacccggttttcagcccaggtcagtgtctcaatgttcattatttcatcacttcattttgaaggaaaaaaaaagactgtgctttgaaacctcacttgctggaggaaggggagctacacacctggctgccagagagggacctaactgacccatcacagattccctgggacagcatcagttttaagggacctggaataaatctgttgatagagatggcctgccatgcacggcccacactgcttggctgtagccctgtaggaggttatatttattagacccagtttttttctgaagggaatgttgcatattatgtgatgtttttggttgatattcaaaattaatctgcactgtgccataataaactaatcagctcacaggactgttttaccctgaagcttgccacagagcagagaaagaaaaaagaaataaatgtgtttgcagaatgatctaaatttgtctaccgaatcttggttttaaacgttcttgctcttaagcaaagctaatttgtagaacactgatgtaagtctctttgttgttgaatttggtcccataacattatcttcatcttaggcatgcagacccagaagaaagaaaaatgacagggtctggggatataacctctatttaaaatttcttatttatttatcttccttagaggtgctacaattcttttttgatgtaaaatataacctttgttcctaaaatgcctaggattttaatttgcttttgagagatagctattttcatgaagtaaatgtatggaaagatgaattgaggcagtgtgtaggcatgcgatgtattagatataatcattgcaatacatctaagaaaggatttgctaattaacaggagaaagttcatttagaaattgtggaaagtactttctcattgtcagcgtgttgaggacataaatattgtaaaaatactatgttataaagtacctcattacctattattactctgcttatgggacgtagagattgaccgatggtagtgtctgatttttttccaactataaattgaaagccttaaaagaaaatgtttttcttatcctagaacatcagcctagtgaagttcaccagatatatatatatattttttttacacggaaaagggaaatgcaaaccagttaccagaaataatagctaaatacaagcaaggctctgtcaatggcactgttatgttaattttctgggagaatgttaagtaattcatcaagttagacaaatataaaaacagcaaaacatatacaaaacattatcaatatttatttaaaatgtagttttgtattaccactgatggcatcgtattcttgctgcctggtggaataagaactcggagatctggtttacggttattcattcctaaattcattgggggaggagattttgcttgcatattcttgttcaagttaccaggtgagaccagcagacctggtgagtttcggggattgccatacccgttccctgttaacaaaaaacaataaagcatttaggaagaaatctaggtcaaatacgtttccgaagaatacacaacatgagaataaaaacaaaagcttaatggtaagacgtacattgcaaaaccataggatgactgatttgacctccatgggacaagtaacccaattaagtattcaatagtcctctgaaggaagattaaaaactttttatgagaagagagccaatatacatcaacttgctcagaagtcagcatatactttttttcctatcaaaaatattcaggaagaaagtcagacagtagttcagggtctaagaaaagcacagaactggtcttgcactttaattgactagcttggcggaggcctggctggcgtgactcactctttcagttcactggtttgggttttattttgtgtgtctgtgtgtccttaaatgaagaaagggcataccagcaagactgtaatttctaggacaggcaggaggaggggaagccgcttacacattttgctgttcagttccgcttttctctgagtgaattctctctatggtttttcttccatctgctttgccctccttactaagttcagtgtacaacccttgctttcctcctcacacagaacttcagaaagcaagactccttccctggagctgaaatgaagtgatgatgcctccgctaaagtgctgattcaccaaggcacaggaatagccattgaactggaagactgaaagggttttcttaggtctctgatgttcagtatcctactaacagaaaagtgggtatcccaaggtctgcgtttttcatatttcaaaatatgaccaagagagctagggaggagttgattacaaatgccagcagagctggcatgacagtggactcagaaagacatctgctgatttcctccactgcctctgaagggagaataagagaactcagctacctgattcaacaatccttgctagaaactagacagttgttttctgaagctttctaaaggagacagttaaacctcattgttattgccatcattacaaaacacaagtatctattacccctgcatgagtgagattgtgtgctacccagtgaggatgcaaagacaaggccccaggcttgaaaagctctgaaatctctttgtggtaatccaatacatactcatggaaaacataaagaccaatacaaggcagcgtagggtgaggtgcctgcagagtaatccagattaagtgttattgagttcccgggagagaagaggtgatccaataaaagattcacagaagaggcaggaattgatgagggccttaaagaaaggccataggaagatatgttaggcttgtgactgggcagtaggaaagggctgaggtaggagtttaaagagcatggtaaggggcactgagaggaacctgtttagaaggggacccgtgaaaagagaggggtgtcagaggctctggagggatgcaggggttgggctgtggagatctcaaattccaggctaaaagtccttgggtttatatggtggaaatgaaagtttcagagtagaggtatgacacagacctctaagtggtcagaaagatctactggcattggtatactcaggaattagtaaggcctgctagtgtggaccagtctggagactactttgatggcctgagatagaggccatgaggaactgggaaggcagagcaaaggtatatttcaggagatatttatgggaacatctttagaagcaaaatatatttgaggcacactgtataaagcagatttgttcttcatatcccattcatttacctgtctcattttatgcatgaataaacaggctgaatatataacaaataactacaagattaagtctgtcaattggattatgaataaaattatcccagttcctggggcaaaaaaacaaaaataaagcaaactggacacccccaaaacgtgtgttaagtgacaggactcacttaagaaatgttggttgaatctgaatatcaattcccttctataagaaaacttctggaatattagccaaattctctaaagctagataaatatgacaaacccccaaattttctttacagtaaattcgaacagtattccatggcaaaagctgttacataaaacaatgcatttacttcctctcactagaagaaaaaaacaaacaaaagagagtatgttcacttaaaaaaaaaaagcttgacaaaatggagtgcttagaggagttttatatttaatatgtcatcctgaatcattattgtgaatatgttatgaacttagtttgaattaatagattctacgggataaaaagagaataagaacatcaaggtcaattctgctctatactttgctgtcagctgaaggtcagatggacacactgaagacatatgtcacttatctattaagcctgtgtgagatctggtttatataaacaatcaaatggaaaattagctgggtaatttcaaaagaagggggagaaaaaagtctgttaagcagtgcaatgaagcttgaatagatcagaagaaactaaaaccccagctcggtagatgccgatactggtttgcatggaggagttattttgctaaaaggaagtaaaaccgcttcgtgaaatgtgttgtcctgtgatatgacaagcactgggccagtgtgcgaaaatggaaatgcttcacggaggccttgagaaaagtttgtttttttttttttttttttttttttttttttttagcattttctacagtaaactctctgagaaattccaacaaagcctatgtctttttgcccacattttaaacagtgattcagggcagcagtaggggaaaaaaaagtaaatatacattgtagcttttcattcagtaaatacctcaaaactaaaaaaattgattttaaaagccttctatttttctcttggaatatttcctgttatttggaaattacgccattttagaagattagtcacatattttaaggtgtttacatactgaaatgtaaaatattttgaaccatgatgacacttcttaaattcatatttttagagcatcaagttatttttaagaacaaataaattctgctttttgctagtgaatttctgctgtttttagcatattgtgccagctagcattttggagccgtataataaccatttctgtttccagccaccaaattgttattctttggacataatatagattcaggaatgcaagactgtggatcctaaaccagtgatatagaaacctatgatttgaaaatcaatgatgaatacatgcgtgtggtttactgctaagaagagcctgcatttaaaccggctgggaaaccgcagcctcctcctcactcagaatgctgcggcctgtgttgagcctgttgtcccaccttaagataaattcaccaaagagaatggtcgcatttaaattcaggggtccgggaggtgggaaacaccacctctcaacaaccttctaatatatggattcaaccttttttcatgctatgttttaaaattaccctctgcctggacaattatcaatttagacgtgactgtatgcagatgtcacattcctctgaccacttaaaggcacaaaaattataaagcaggagtgaatggatttcctgattatagattataagaaaatgaagtacagaccaactttagagtcagtttgttttatagtttcatttgattaaaaatattgttttacataaaaataacaaatttaagcatatatgagttaacttacataaaggattagagaatctacctcttctggttacaagtttgtatatactcatattagtgtcaatacatagaacttgaatgtggtgttaggagaaaaacatttttctccccagttaacttgcaaacacttgctgcattttttttattgactcctattttaagaagtcgtaaattcaaagaacatattcctggcttaagatattatgaggaaggcattttgccttgtctcacagagctcacttgaacatgtagctctctttgagctcaaagttctgaaactttcttttatttggatgtttaggcattttgagttttcttcacttgtttctttttcttttctaggactttgaattatgaatacaagcatataagactaataagcataaacagaattagtcactatggaccatggctaattctgccattggcataaccattttttaatctaccaaactgtcatcttctattatcccctctcctccttccatctccatatccaatgagataccaaatcttattcatttttcttcagaaatgcctgtctctacttccactgccaccatcttagctttggcttccatcaccatttgaataaatatttcagcaactcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaaatatttcagcaactctccatctgggcctctggtctctacttgaggggttcttcaccaggccttaagaggagtttcaggccttcagaggagttccttaaagctgtatgcaaacttttgtgcatttgtgtgatgctaaccaacccactcaaggaagtctttctgaactgctacttccatcatgttcctttttcatacatgagtgcttaacacagttgagtcagtgccctgcctggctctcagaactgtctacagttgacacactctatctatgaaacctaatttccaatggtcacagcctgccttatggtcctcggaatatatgcaaatctttgctctagcagttcaataactggcagtattggctctcctgtttaattcaaatttatcttttaaggatcaactaaagttccaactctttcatgatgcctttcagacaacttcagcccacactgaattcactcccctctgctgcaattagtggcagcgataatacacagagtactagttctttatatgtttcaggtgcttcacaaatagatatatagaatatgctagaaaaattaagaattattcaggaaaggcactaaaaggtaagttattgagggacaatgaggtgagaactgaaaatgtaatgagtaacttgttaaattgaaacatcaagggtctcttctctttatgctacttgagaaaattttatattttagataatgattgcaaattgatgaccaagtacactattgagacaaactgcttatctaccatatatatgaaagccaggaaatcatgtaagtgcccacctactaaatttgtttatagagagttaattaaagcgtcttttctacctgttgcacctgttaatcatttcacagcacattaccttagctaactgcaagtggtagaattaaacaagtcagacattttccctaatgaaaatgaaaagttgaagtctctgatattttcttccacactgacgagtatttgttgccacaggttgtcgttatatcaaggtaaatctcaatactaatttactcatacagaacttttcaccaaaagataagctgcatggtatcctagggaaaagaatggtggcagggtggctattaagagtgaacaggaatttatcagatggttcagagagaggctttgcggagagaaggaatgcaggacagagagatctcagagtttagaaggaggggcattcctctgaagatgaaacaatggatcttgaagagcagaaagttttccgaagttgaaaaagaaggcttggctaacatgaacctctaagattatgttaactttacactgtaggctttatactaagcttttaccaaattttatactctagaaaatgagtgcctaagatagcttcttagttgttagctttattaaatttgtgttaggaaaggaacaatgatggcagtggaaaggagagacaaaagggggttggactgctgttagagaagctagttagaacgccttgctctagaatacatgagaaatgatgtctgaatgaggcagcgcagagagaaaggtttacaggcatccaggagttggggacaaaaaaaagataaggcagagtaatctaggttctactcaaaatgtttctgttaagagttctctcaaccctacagagccttagttttctcaatagaagtatttccctagtgtgagagaagcatgaaagtaatctgaatgagaggctctcaggtactcatctgaggcagtcattgacaatcttaccatccaacaatattagcaatcgctaacacagtgtatagtattatttaccaacaacacaacattaagcatacacattaactgctcagaagagtaccaggcacttgtaactgctatgtaagtgctagatattgtacatggatataaagcacttttaatcttcacaagaacaaccctgtgggatactaatagtatccctatgaaaaatgagaaatgagaaaaccgaagaaaagagaggtccaggaatttgctcaatgtcaaacagctatcaactggtgaagctatgatttgaacccaagcagtatgtccagagtccatgccctgaagtacaacactacactgctccttcagaaccagtcatgctctgagatagtgaaagcctttctatgtcgagtctcatttgcaaattatggggatacaaatgaagagaggacacaactagggacaggacagtcaaggttgtcctaagccagaggtgatgtgcaagtttgagggacatgttgtaaggtcaacttgggcatagtaaatagtagttctggttcagaagacactgaattctcataaagaggcacagaatggtgatgttcaaaccatatttctggtctctttctggataaataaatatttacaagtaggaaatactgagtttagctacactgaacaccagagtagctgtttaacttttagtgtgctattttgagtggatgattaaatatgcttttaaaagtagattttgtaatattttagtcaataatcttctcccctgtaatatacttaaatggtaatgatgcttacttacttactgtcaatttaagagaccagcttctatcagaaacacccaatgttacagtgaaatgtccagtattttttagtatctgcgattagttgttacccgggaaataacttctaatatataaatgtataaaaataattttgtttagtaatttgttaatagtatctgattttgagggatttgaagcaaattgacacaggaaaacattaagctgaacacacagctggacctctgaagtatcaatttgctgcttttacttcaacaaaatgttttactcactttaaaaaaaaaataaagcaattttgaaaacagttacagcatactgggttgttagacaggaaatgtcacatacataataatgctcactatcatcaattaattttatattttagtttttaaagttttaagattaaaagttagtttccaatatcaggatattgttttgtgcctcaaatgaacatacatctttttatagaaaattactttaaattgtgtatcataaacttgctcatacaatcccctactctactggaagtgacagttgaaaaaaaaattagtggaaaaatatgatcttctagactgcagtcctagcctgaatgcctgaaaccttgttacatatgctaggaactgtgagttattcagctgttgtgtatcaaaatcagttttgtttttatttttatttttttgagaaaaaaagatattttacattgaatagctctaagagaaaaggcaaccacaaaacattcaggggtcagaaatctgggtatgatgaaaatttcaatatgcttaatgtagaaagggggcaaatcagatttctgattcttatcttgctaaagactcctaattagggattcttacacacaaaataaaggctccactttttctgggggtttcttagggaaattatataataatgcataatgttaaactatgaagaaacttctctgaaacctcagtgcattttgtggtatattcttagagaaataccccaagactataccaaagccaagaactattcttggccataccagttcaggggcatcagacgttctaaaaagagagctgtctcttctctttgaccatgtcacctgatgctggaccagagcttcaggaatttcatatctagcctatttgtccttgacgtttcttgggctgtgttttgttcagcgattttgcgtgtgtgtgtgtgtgtgtgtgtgtgtgtgtgtgtgtgaaattaacagtctgtcaatgagacaatgagcttttaacgtacagcacatactgtgtaagctctggattgtgagggagaggtaaagaaattttacttattactaagttgtttttccaaagattgagagtccatcaagtaggtttgtgttggcgaacattttctcatttgtcctaactgtcatgcggatttaggcatcaccatcccagcttttgacagatgaggaaactgaggcttaagaagcttccgttacttgactgagatcaccctgtcagcaaggaagaggctttgatttgaatccaaaatgcaggttgctaccactacattacaaaagccagatgtctgagatttagcatgcatccttgtatttgcaaataaggaagaaattgacaatctgatgtctccagtacaaaaaaaaaaaaaacccaaatatcattctcctttgggtactgatttactgaagggatagtttttaattgcaccataaaaatgctattgaaccacactatctttaaaaaattccatttaactatgaatgatagatttatgactcatttaattgttcacttcttgagattttggggctgtctctttgctaaaaatgagggggtgtcttcattattgacacaatcgctcattctttcagtcatttttataaacaaaaatattgagacagtataaattagagagagcatgacagaagagaaagaataattacttgtggttttaacatttacacaactgctgcgaacacatcagaagttcataacgttcaaagtgaaatgtgttgcactgtactgtactgctctcacattctgcttcagatttattaatacatccgctttacttccacccttgaggataggagccccgtgctggacatctctgtgaagcctactggtgtgctcccttcaccacacatttcataaatactactggaactgcattaagctaaacattataaccagaaaggctagaaaatcaagaatgtagatgattataaccatagctcacatttattaacaagcacttactctggggcagaaactgtgctagaccccttgcatcagttatctcatttaatttttacaacaatccggaaaaagaggagtttaacagacttttcaagggcaatagtgccatccctaaaataatttgtatatcacatactttccttggttgttttatttttttgaatatctgcctctggaatcttttcccaaactactccttgggcaaaaattttggtccatggttttacggttttcactgagttgcttaatattagagccaactaaagattcagttttcttgattgttatgtaaattaatgttataatgtttgaatatgtaaactggccatagatttagttttctcttactactatattataatgttctatattagtatagcagggctttttcctccttatactttaaatacaacataatcggttctttataataactggaggtggtgggtggactctaaggtcaagaaattgtaaaaagaaggcataatgtctagtaaaatagataaacttaaatttgagttcagttaaaacaattgaaatggagcaataataaataaacacagtgaacacttagcaccttttggacgtatcagttggttataaatttaaactgtttatccaaggttcttggtataatacttaagtttaacatagctaatgatctttcaaatatgatactgtatcatgactaaatattctttggattgaaattcaactgaaacatactatgtaagtgtaactgcaaaatttaagtgattggcaaaggtttgtctaaaaacagcagattatactcttggctgacagccttgaagcaccgagtgagaaagtccctggtaagtaaaaaactgatttccaaaagagggggtttttaaccaaatccccccttcagcatctgctctctactgatgcacaatgtcacatcactgatgattatgaaaaaagctttcctttctgtgttatctccaaataaaatcttatcatgatgccaaagatagggaagaggaacctaataggtgtataaagagaaaagactgctttgagaaaaaaagacaaattctgaataaaactagtatttcagggggaaatattaacggcttgaatttaatattaaaaacaaccaaggttttcttatccttcacactattaggttaaatcaatgggatatgagtaaagaaaccaatcttcacagtactttactgtagatatagaaggatagagaataaaaaggatacaatttgtgaagtcagaaatcaggataaacaaagggctctaaaatctgctaaaacactctctaggaagttataacctaaaattttctttttttcctctggaaatcaaactccttaagaatgaagtcaaaccaaaggggtcgaaggcatattttacaacatcctgacttaacctgtaacatttttcatttgtcttgtctttgacctgcctttcccacttcaacatgagcccctagagaatggtatcaaggtaatggtttatctataatttgcttggttttgtatatggaaagtgaacactgattttcttggcagtagctgcataccacatgctgtagctatctaatttgaggactaggtttttttttttctttaatcttgataaacttggtttgggttaaaaatatcattgttacttaatttcataaataataataataaagcaatgccgttagttatttacttatgttttgggtgaactcccaaggtaaaactgccaatgaattcagaatttttaattcagaacaattcaaactaatggaacaatactttcaaaacagaacccaactattaacctagatttttttcatttgctgcttaataatattttaaaaataatataaaaattatatctttatactaacaattagttttcttatttgagggtaattaagtatctttctccctttcttgaatattgcaatcttaagttatgttttcctgggcaacaaaaaatgcaaacttgttaaagccaactttttaaactaaatttttaaccacttcactgatattttaagtcactaagtaagaattgcagagaagtctttctggccaataagaaagtcagccaagaaatttttgataagtattcttgaaaacaaatacttgcaaaacaatggtgctggtacagaaaaattaagcattgtctgacctttcctctttccacttagttctattttgtaatatgctaagttttttctttttcaatgctagatgaattacaaaaacataagcaaaattttatgattatattatcataaaacattgcgtgtaaatggattgtaaaaatatttgtttcttatctccaatctgagtaagtactaagttcaaaggtgctgagtcatgacctaaggtcttgctagatggagtctttccagagtctggaaaccagatctcttattcactgctcaatatttatccacggcagtacactgccaccatcaactctccatgtatttagctgacataaattaagcattccagaagtgacaatgcttgataaccaaatgcataaaatagtcaacaattaacattcaaaataagaaaacagatgttagtttcttttttataaaattatatctaatttacaataaatgccaattaaaattattaaccaatatacataaatctcctttgccttactgtcaaatagctatgtagattgtaaaattatcttaaatgttcaaaggaattcctaaaggtttttcatttcttttttctctttttttgatctcaactatgaatcaataactccttgagcatactggtcctttctactcaataaaaggcaatcgtattatcaaagtgaaaacaaaggatactaacgggatagtgaataatccaacacaaggcattgctctgctaatggttatttccattaaatctaatgactacaaacaaccgaacttgatcttaccatcatcaataaccactcagattagcatgttaaaagctttaatgtggtcaggcatggtggctcacgcctgtaatcccagcactttgggaggccgaggtgggcggattgcctgagctcaggagtttgtgaccagcctggacaacgggtgaaaccccatctctactaaaatacagaatattagctgggcatggcagcgtgcacctgtagtcccagctactcaggaggctgaggcaggagagttgcttgaacccaggaggcggaggttgcagtgacctgagatcacaccactgcactccagcctgggtgacagaacaagactccgtctcaaaaaaaaaagttttatagagttatgacaaaatgttattttaaaagcagtgacttttcatttaggttgttaagaggaaagaattaagtagtggatgaataaccatcaactgaaaccttagaaaagtcactgttactaactaatgtattataatgacttgctgtatatttctcttataccaagagtacaactccatcctgctacttctttattaccctttgtcttcatctttgaaagtatttcaagttaagtgatgataagaagttgtattaagaggtgatttgtgatggtctgagataccaacccacatttcatttactactatatgtcagctcttcaggttttccgttaagaatattagaggagttaatgaaactttgctttattggcccagggtactcagccatttaatcaaatggttaattaaacattcgttgtatactgtttcagaagaatacattatttttgtgagttacagatcaagggtatatctttttttattgaaaattacataatttatttgaaatgttccttctggtttacatcaacactattaaaacttcatggctagaagatctatttttcccttactcagctaacaaacatttaccaagtatctgctgtgtgctaacgcttaggtgttaaactgggcatacaaactgaatgagaaagagtttgcctccacagagctgagcgtcctagagagatgtgcccagatgttgcaatcataatgcaatgagaaatgtaatgttggtacaggctactatgtaagcacaggaaagaggtgcataacttgtctgttagagtcaggaaaggcttttctcaaatggctgaactgaattctgtgggatgacaaagagtgctcaatagcatgaagcagaagaaggaaaggcatgctaggattgcataggtaagagtaagcggccgtgacattgccaagtggcggcacagtgtagcaattaagagcacacactgaggccgggtgcagaggctcacgcctgtaatcctagcactttgggaagccaaggagagaggattgcttgaatccaggagttcaagaccagcctgaaaaccatagcaagaccccatctctataaggaaaaaaattaaaaaattagccaggcatggtggtgcatgcctgtggtcccagctactcagtaggctgagggaggtggactgcttgagaccaggagattgaggctgcagtgagcctagatcgtgccactgcactccaacctgggtgacagagcaagacactgtctcaaaacacacacatacaaacacacagtatgggacctgactacctgggctcttccttgtgcaattacttaatttccctgtgcctcagtttcctaatctgtagaaagggcataatgtgaacacttaatttaaacgactattatgagaatgatgctttttgtagagtgcacagtaagagcagtttagatgtctactgttagtagagctggagggccgggttcttgatagcagtggcagaagggaagaaggttaaggctggagagtaggaatgggcctagggataagatattcactgttaattttcaaagagaagccatggctggatttttggcatgtgaatgatgacctacagttagcttaaggttttaagaaagaacaagcagtcctggggagactgaagcaggatgcaatataaagcagggagatgaattaggatgttctagaaacttactggatgatggtatgatgagaaaaggatggctcaggcactggatgggaaagatgctacactttatgataaaactgagctgaaaaaaagcatgcttacctttttggtcttttagtatttataggcacaaaataaatgttcaatttacttccttgcctcatgagactctccctccctctcactttttttttttttttaacaaagtgagatgacttgatttagaaaaaaactgcagctgctaaaaagtaacgtaattgcagtctcgccacttggcctcaagagtttcaaactttatctgaaaccttgaatttcaatgacaatatgcaaaatttggaagctatattttggcctttttgctttggttttcttctctgaaaatgtagcaacattctggctggccttgttttcctctggtgttatgtgattctctgacatcagcacggatatattcagcctgacatatgatactggttggcatgagaaagaaggggaagatggctgagtttatgagtaggacatgacagctaagcttgagactaagtggcatctgcaacaggtgttccttgggaccagagttagaaagggcttcttcctctatttttaaaatatgggtaacactttcacagctatatagaaactgtgaaaactacatgctcgtagctataatatgcaatcaagatataatatttattatcaccagggtggagtaattcagtatctttcttttggttttcttctatttctgaattagaagattctcatacctatggtagaggtcctgaggtaagaggatgaatttgctaagtgcataagattttgttagttcaatgttactatatcctacgtgtgtcaaacttttatgcctacaggattgagagtcttctctatccctagaggatcattaaacttagccaactgtctgggaattgacaatgacagaataattgaacaaccaaacactttttattttcaatataggattccaaagcattctagctattaagcagtaacaagccacttccatcaaagctgagtaggccatgttttcctccacattttttttttttttactactttttttttttttttttttttttttttttttttgagacggagtctcgctctgtcgcccaggctggagtgcagtggcgggatctcggctcactgcaagctctgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcccttttttactacttttaatgactttcagaaccactactagctgtttccataatggcaagcaaatcggtgcagtgagatattgggtaaaacatcataacatctaaaccatttttcttatattatatcttggtctttgtgaccacccaattctcagtcctcaccattctttctaatcatagtgtttggtagagacttggatccaagaaacattggtctggatttgatctggttctctcattttgaggctacaaaccacaaagtattttttgagggaaaaaatttcatttccatgtccagcaaaatactacgtgagtttacacactaatttggctcgacctaattttcaaaagatatataaaataggaagctagtgttattcatcttgtttgctaatcactgtgtaggtctaatactttttcttcattattcagtgaattagtgaagagccagcatcagaacagagaaactctaccctcaaatagatatatttataaaaatgtatttgtaaaccaattttctttatcttctttcttataattagcaggctattctacttgaccctggcaaaatattttaattaggctatccatgtctatttcaataaacttgattttttttgacatttcaaacataaccttgtgtcattcatgcctgcctcctactattttaaatgtatagcatgttccagctgcagaaattaccatggttacttgttatgccaatagtgaactgcagttggcatttgaaagtattgtgctatcttgcctctgcattgaaaatgacatcgatatctcaataatctcaatattacaaattaacacggaaacctggagaaatgtgactgagacaattattggtcacagtgtaagaagttcttagctgaaatatattttagggtcttttggggatgcattatattcatgttgtctaagagctcattttaatgccaatgtgattttattttattaacagtattgttgaataattaaaatcttaacccctccttttctttatgtactcttctttagaaatgcatagaagttcaatacttctttggctggaaaatgattcatatttaatgtgaaatgattaacagagaacacaaaaagtatggtttgctaaaggtactcttgtgtccaaggatggtatccaggattaagttgattggatcagagcccttaattctctgctgaccagttgaagctttattaaggaaggttctagttaataaatagttttcttctaagttactatttaaccactcctgcttcagaaaagtgctttaaaaattcttggtgtcatttttccatgcctctcacagatctcttaactttatttgttcaaaagactttgtcctgcaaatcacctagtagaagaactcagaacaatgatacatactgcagtatggagtctgggcttacctgcactggtgcctgcaccagacgtgaggtctccacccatcagaccacctatggattaaagaggaagatcaaaacgagaaaggctaaaggcccacagaacaaaacactttaccttcagcaacctcagtattttgtcctcttgcaatagtcataaacttgtaaagtacaacccaagtcagatggctgacatttgttttattgtgccatgctgtgctcaaacgttaaaaatacattcaatcactgacattttgcagaatcttttttctaagaaagttacatttaaaaaaatccagtctttggtctctgcatttttattatttctaagtctaggttttccctaagcagatgttttatagaaagtgaaagaaagagtaaggtctactatatgctcagatgacctcacatttgatgtttagttctttgtaaatatgttttatgccattaattttgtgcaatgttaattgtccagaaatttgatcgtttcatgaatctacccacatttactactaaaatcttattgactgacacaatataacaaatttttcaccggccacagattaagaaacatatgcttattcattgctaactttagacagtatgttaaaatttggcaatgtttatttatgagagtcaagatgtttcaataaggtattgaacataaaaattacttttagttttgggcctggcgcggtggctcatgcctgtaatcccagcactttgggaggcccaggtgggcggatcacgaggtcaggagatagagaccatcctggctaacacggtgaaaccctgtctctactaaaaatacaaaaaattagccgggcgtggtggcgggtgcctgtggtcccagctactcgggaggctgaggcaggagaatggcgtgaacctgggaggcagagcttgcagtgagccgagatggtgccactgcactccagcctgggcaacacagcgagactccgtctcaaaaaaaaaaaaattacttttagttttgaaaaaaacaacattcagccaaaagaataatagtgagaatatcatctagattttctaattgcctctaagtgatactctgtaattattagttggttcaggttttggaattaaaagaaaatgtttgtttatatatatacatatatatacacgatttttttttttttttgagacagagcttgctctgttgcccaggctggagtatagtggcagtaatatggctcactgcagcctcaacctcccaggctcaagtggtcctcccaccccagcctctcgagtagccgggaccacatacacaagccactgtacctagttaatttaaaaaaaaaatgtttgtagagatggggtttctctatgttgcccaggctggtcttgaattcctgggctcaagcaatcctcccacctcagcctcctaaagtgttgagattacaggcgtgacccactgcatctggccttcgttacagtttaagcaaatgtttattatttccaatcagataatattttggaaataccgtatcaaattcaaaaaaatgagcatgagtttatcaaataggaaagtgaactgcattctagtatgatctgaaaggaatacatgtggttactgaaaattcatacgaaaattttcaaatatattcaaaagtcaagagaatggctcaatgaagtcctttgtatacatttcccagactcaagattaaaattttttatttggatgaatttaactgtattttctatataaagcttctgtaacaaaaatagtaatacatgtttggttttaattgtaaggcagatatataagtattctacaggaaaattcctccatgaataaactattttcatacagctatgtgtatgtaggatacattaaaaatttcctatagagtacttttaaaaatatgaaatgcaaatatataatggtttgctgtatgtgacttagaaatacaattatttttgatgctgcttctggaaacataaaggaataattttgttatattcaatacgcattgacttggttcctactgttagtttagcaaatcaagagaacattcttcccttaaatgttctttaaatccagtatcaaaatagacatatattaaatacaattcatcataatgtattttgattgttctaagtactaagaatggatgaactttttctgagaaataatttatttttctcttggacactgtgaattgaacaacagcaagtaaaagtgcagagacaaatttgtggcaggtgtacatgtgtttaattaacttcatttctgattcagctttgtttttatttcacatgtcttacaaatgatgctatcttatcatatttcctttctgcctaagtcctttgtgggataagttactgtataaataaaaaaaaattgacccaaataataaataactaaatgggataaatactatcacagaacacaggggaaggtttcacagaagtggtagcttggccaggaggaagagggaaaatggcattttaggcagggaggacgagcagaagtaaaagtgtggagaaaggatatctgacatcctgtttgagagtatgtggttaaaatatagccacaggaggagataggtgacagaatgaaaaagataaacggcagattatgaaagatttcgaaaaacatactaaagaatttaggctctatcatgcaggagacctagctcgggggtggatggtaagccatgaaggagagtaagtggaaaaccagaaaacatctcgtagataaagcagtgttggctttgccgaaaatggttccttccaactatttgttagcattacatccttatgaggacatacctgtgttacctgcacttggaggtcgatgtgttacaccaggagacatactattcctctgcagagaagggtgagccagtggcaataggttggggtttcccagtgagctgacagggttgctgtacaccaaactgttgtggctggacactgggatggagactggcatctcgaagttgggaggtggaacagcctgcaggaacagaaaacaaaacaaaggtaaaagaaaagaattaataacagaagctcttcaagacagacagcccttatttttccaagaaaaattctacattccaaactactttgtgtctagaagaccattaagaagagctctcaagacgttcagatcataaattgatttcttaaatgtgcttagaactccttctttgcaaccattaaaaaatgtttcacttttgtttaaaacaaagccccatttcattagactccattgtctttggattccattctattaagtagtaattgttcatttgtgatatctgaatctggtgccagaaatgactgcaagatcaaaggtgcctgattgtgatgacttcacagagaaaaaggattaaaatgcaaaccgaagcctttgatttaattgcttattgaagcatatttatgtagaagtttaatgatagaaaatcatctccaagcatgtgcatagcacatataccttaattatcattttttaaagtctatgttttaaaagtaactctaaagataataggcattttaacatacaagattcaacagagcatgtatcattcaataattcacattttgaagtggcaattcagaaaacactatgcttcatattttggtgtgtaccgccactgacaaatggcaagacctgtatctcaattgtgaaagttggcaaatatttagtgaactgaagctgtgtggatgtctaattagattaatccaggtttcaatgattgatttttgagtaattattttgtcaatttaagcaaaatcatgtttatgtttctgctgtactaactagatgaacataggaacataattgtagctacttttttttaagcattacgagtaaaaatactctttgaatataatgccagagaactcatatggtatcaaaacatatggcattcttaatataaaatggacatatatatggaataggatttatagaaggcattaaggcattcccttgggggttctcaataagttattgtgcaaatttaaatgcatatgtgcttgaggctcagttggttgttttttttggtcccattttgtttttactattgtttgcccttagtgctgacatccactttctgttactgtttggttggctggcctgcatcatacatctttctgtgtaatatttctctgtttatcttggtgatgatcacaatacttttctttgtttatgtttatgctcccttattattaatttcccatttttcttttcttccatgttctggacatgtcaatcttgacaacagcaaatgctttacattcaaaactcttttctttcacacatctttgatttttcatttgtattttatttcatatttacttttattattatattattatttttagacacagtctcactctgttgcttaggctggagtgcagtggtgccatctctgctcactgcaacctctgcctatctggttcaagtgattctgctgcctctgcctcccaagcagtggttggcatgtgccaccacgcccagctatttttttgtatttttagtagagatggggttttgccatgttgcccaggctggtcttgaactcctgagcgcaggtgatccgcccacctcggcctcccaaagtactgggattataggtgtgagctaccacatctggcccaatctgtcattgttttagagggaaataaaaatgttcaagtgatataagtaatatggtcagtctttattaggatttatctacagtaaacaggggaaataatttttggatagacatcatgacataatggaatataaatgtttgataagacatcaaataatgaatttagccttacatgtccagcccccttttaacaacaaaaaatcagcatatgctgtaaagtcgaagtctatagcatgaataaaatattgtatttcttcattaaaaggccaaataaggattgctctagcatacccaagaaaacaaagtaaagtgattctactaggtatattctccacttgctccatccagacccaccctctagccccttcactgtactgtgtgcccaggagctgaccctccagactgcatcaaccaggctctcctgccctctggcttcccactggtcagtgggggaggcaccagcaacagcacagagagcaggaggggagcaaagtcagggtatttttttatagtggcatcatccttgctgggccacaggctggctgaggctgcgtttctctagcgaagaccccatctctttttgagttgttctctcctatacacatagatcttgctgtgatctggtacttttcccctccacttactctttcagatctagagataggaacagcttctaggttgcaagccctaatgtacttcattattctctcaggttttccttaactctacccatctgtaaacagtccttttaacaaactgtcttcaattaccctttagagtttgccatctgtttcctgctgcaaccttgggccataatagtaactctctagatctagaacactggtactctacaggggtgggactgtctccttagggagcattttggaaatctgttggactatctttgggtatcaaaatgactggagggtgtgactattacactggctcaagcagtgccatctcttgcctagataactgcagtcacgtcctaacagatttacctgctccggtccttgccatcctttatattttcaaaccagaaattagattgaccctttaaaagcttaagtcatgccaacactcctctgctcaaaaccctgtgagggctctcatcttagaataaaaactcaagatgagaatttttttcttccaagggtccacaggccctattaagctctagcttttgccaacctccgttatctcatcgcctaacaccttctgcctccctgcctcatttccatgacgaactgcatcacctccttcaagtctctgctcaaaatctggccttctcttggaagcccacgctgaccaccctatttaatcctgcaatttgtcctgccccttgcccatatcctgatctctttctcctgctcttctttctccttggttataaaatcatttatgatgttggttaaatagtgcccttttgctgtgaggcaatgcagagcctactctacttcttattatacgaacttaatatttttcttcaaaggagaatttttaggaagacactctactgacacaaaagtaaagcttctatttactgtatattacttattgagcaggcactgtgctgtatagttgacatacatgatatgatttaaccttttaaacatcccttgaccatagatataattctttccttttcaaattggtaagttaagtaagtgacccaaagtcatctaactagtgactgagtctgttgcttttgctaccaaacactatgcaacacagtataagtttttggatagaaataaaatactgtagtcagaaatcattctgttaagtgaataagggctagatattagcagtttattatctttggaccatgtaaataataaactaaatgggttctcatgaaatgtgggtgagtatctacactggagtgtctcaggttttaggaaaaaataaatcttaaagactccccttttccatatttgcttagagtttgtatttaaagccatctctgggctacaaatgttttaatttgaattcactgttactacttataaatgtttaactgttaataggtatctaaggatctgctataaaactatatcttccctgaatatgctatagaatgttggttgtgtctcattagagagcaaagcccatatcccctcacccttgggtgattatatgcacatccaaaataaagaggattattaataattatgtaatgagttcagaaccatccaaacaagcaggtcagtgaaagtcattctactccttccttcctctgactattatccccaagaattaattcttcagcttctagaattctggatcagaaacaactggatgataatgattattataaaactactttgtgattggctaagcagtcaaatataattatggtatcagagtatagttgaaaatttcaaaattcataaaatataccaagatcatttgtattctattaatcttttgctttacctgtatcaagaactacctataataattttttaaaatttaattttattttagatacatgtgcatgtttgttacatggatatattgcatactggtggggactggatttctagtgtacccattacccaaatagtgaacattgtacctaagagctaatttttcaaacttcaccccgccctgctaccttccccccttttggagtccccagtgtctattatttccatctttatgtccatgtgtacccattgtttagctcccacttctaagtgagaacatacggtattagattttctgtttctgagttaaaggaactatctataataattttgaaagcaaattataagcttaaaaatgagcacactgagaagatattttagagaatcagaataaacactagcctttctatcaggaatctcagttacagtccaggttatgtaataaattgccatctaaccaggcaggtcatttaatctcccttgaccttgattttcttatctaaggcatgaaatggttgtatctatgaagagatgaagctgctctaaacattttagggaatgcaaatgctataatcacatataaatatttctaagaaattggcattattctttttctccttgacttttcaaaattaggaaacttgaaagcatctacatttaaacaattttttttttttgtctaaaaaatgaaagccaaaaagtagttaaaaacaccaaacttgcaaagacttcagggccaggctccaacttttacaaacactcaagataggaagaaagagagaatttggggtgattaaatgaaatgctgtcagcagaactggctatgtaatttgcagggcccagtgcaaaatgaaaatgtgggggccctttttaaaaaagtattaagaacttcaagacaatgacagcagagtatttaaccaagtgcagccctatgagaacagggccaagtcgagggcccatgaagccggtcccagctttgaaggacacagacatgacagctaaaaaacttttagtttctatccctgaacaaagtgatcacggttactgtagtgagtcataatcagaaaagtatctgaactctcatccaaaacccactattttcccaaacttaccacaaggaaaagtccaataaaaaaatcaaataaaatagttaaagtaaaatatttttagttaatgggccctcttttatttaatgtgagtgattgaactgaatcttccccccaccctttttttgccactaatgacacctttaaattttgattaaccattaccagctgctgggctgtagtagaggaaaaaaaaaatcatacaactctgatgacttgtgagtaccaatgctggttatctaaattccctcaaggctgcctgacaagtctatcatggacttgttcattccctctccaactcctattcctcatgatgtctaacttctcggtcctttttcaatcacctgcttcccccttccctaattaactacagaagctaaactaaatacattaaaaaacaaaatagccaggcatggaggctcacacctgtgataccagcactttgggaggccgagacgggcggatcacttgaggtcaggagttccagaacagcctggccaacatggtgaaactccatctctactaaaaatacaaaaactagccagacctggtggcaggcacctgtagtcccagctacttgggaggctaaggcaggagaatcacttgaacatgggaggcggaggttgaggggagccaggatcacgccgttgcactccatcctgaggcacggggtgagaccccgtctcaaaaaataaaaaataaaaataaaataaaatagaggtcattatatggtcacctactcagcgtaattctacccagctaccaccttagctacacctggctccatctgtaacaccttcttgtttaggtcccatcctccttcccttccttgagaggctttgccattctatctccattgtacctgtatgttcaatcttttccttcctccaagcacttctcctctgcatgtaaataatctcaagcgctttcattttaactcctcccttgatcctacatacaacattatttctctctcttcacagcccattattttgaagaaaatacatactgtttctttccacttcctcccttcccttttactctcaaccaacttgcacccgcctctcattcattcagcccctttcctaacttctgctggttcctcagacggaggtgttttctcttgctgtgaagcccagcatgaaccatggcgaacccagcatgaggaaatgctgctcgacacagttccaaatcacccatgaattattttatgtaattgaggaatatgggcataaattacaatatactaacaggtgactgcaatattaaattttctgttttaaaagggaaactcttcaaactgggtcttcgaaatagaaaaacagtcttgtaatgtttttaaagaggtggagacactctctacatacaaagggcagagtgtccttgccctgctgtaaatgttttagcagctgtggaaactttcaacaaaattgacttccagcaactcagagcgatgtgcaaaaactgggcttttcatcgtgaagactgaagcacttactaaagagatggagactctgtggcatagctcggagctgggtggctccttctcacagctctgcccgtaaactctaatgtggtttttcagcccctaccacacaccactgcaccccttaagaaatcacgtatcttgatcttgaactctttacgtaacaggctgaaatcctgtgagggaatacaggtgtgtattacatgtctctctccctaaagtatgagaaacaagatccaatgtgcattcttccagaactttaggggttaaaactccacctatatgatcgcttccattgagtgatcagcagtactgcatacatctgtctttattccaactgtgcaggggattcttactatctgacacacctaaggtactccgccttaacatcctacacttacaaaccttaatgcacagctgctccacaccaatgtattatatagcaagataaactcagatcataagaactaaaaattggcccaaatggcgtggcgcagtggctcacgcctgtaatcccagcaccttgggaggcccaggcgggtggatcacctaaggtcaggagtttgagaccagcctgaccaacatggagaaattccatctctactaaaaatacaaaattagccgggagtggtggcacatgcttgtaatcctagctattcgggaggctgaggcaggagaattgcttgaacccgggaagcagaggttgcggtgagtggagatcgtgccattgcactccagcctgggcaacaagagtgaaactccgtctcaaaaataaaaatagataaataaaaataaaaattggcccaaatgagccgcttctttttttcttctaggcaaaataaaataccaatggatattttattatttaataattctggacataacaagtatgcatggctacatataatactaaatactccatttcataaagtgcccactatgaatgtgtgcatataatagttttatgaaacccttaagaatttatagcacttagctttccttcatgatacagtgtattaataattctgattcaacaaaagttctactgctgacatttcatttaacaaaagaagcagataggtatttataaggatagaaattttaatatgcacacattttgtaaataagttttaaagtgttcaatttaattcaattcaggtttgagtgtgcagctactatggtaaagtattaatttatcttgtgagtgcagttgtgaatttggcctcgaactttgtccccacatatctgcacttgtaatcaccaaaacatattttcacttcagtctctctcatttctcaggtttaggctgttttgctaacttacaaaaaatgaacttttttcaaaaggaactgattgcctactgaggagcttgtatacaattaaggttcagacactaacattagttatttagaaggtatgtgagccttgggtttcacccctttcagccacaaaattaacattatttgattgatgacagaatctaataaaaagtatgtactttcctcctatatatgtggacaacaaaataatacatgcagttatttctcttaaatatctggcaaggcatatgattgactgttagaatttttttcatttggttaaaacaaaaattagccaaatgttaaagcatggaaaatgttggtggcaaagcggataatattctgataaagctttaaaatcaccccagcacacaaacatgttgaaatcttaccattaggtttcatgcagtctgttccctgcagcgagcattagctttaacccttcagtgctgttgttgaatttcatgtatagggagaggggctgaagttttattcagaaatcagcttttatttaggtgatgattgtcagtttacatgaaagaattgctgacccacttgagtatctgctcttagcaaacaatgtataatctatgtattttatagcaattctcaaacttgcttggaaggaggttccagtgttttactcatgtattgtgatttgcatggactgtgtgtttaaaagattgtgtaaatttacggtgtgtctcataaatctttctcttcctgctgtgaactgttctacctcagaatgaacttttcgatggcaactctgttagattacataatctcagcatcctttagggtttgctttctaaatgagctgcccgtgggatgagatggctatttatctgtttgactttccgaagagtcttagagaaagccatcactgagagggttaaggtatgttactgcagcagttatcagcagaccagccatctacctttggtacttacaggaattttatgactcttgatcatattatcaaattcttcattaatttttttgtatttttcttcagtgcgtggggtgagtgcataagaggagtcgggatcggggctttcacagcctttgttttctttcttgttcaatgcctgccaggttcagagaaatatcaagagtaaaaaaaatgaagggtgttctgagtacttacacacaatctttgcctgctgatcattagatcaatatcttcgttaattttcctgtacttgtcctcagactcagggctgtgacctacggaatcgtccgcatcggggtctgggctgtcacagccattaaggcccttctttctcaacgtctgaaatacataatttggaaagttcaaacctagacaaaggctgtaagagacattcaggggcattaaagaagttcaagctgtccagtatttcaggttattacatatgctttattctattagggaagagaaaccacagatgaaagctgagtcatttcaatcgagtgctcatcagcagtttaaaaaaataaaagcgaaagattcctcttgcaactaaattcagtcaatgaacagagggtataaggactcaagtttcatgatacagaattcttacgtgcttcaaatatctagtgagagacaattacagcagaatacaattaaggtggcaaattgcaacactctcttcccacagaaaaatcagaaatcaggacattacacaatgatttccgaacctgtgatgatgacaaaagcagaaatgttggaaacagatccaagtgtgaatttaaactaatggttggcattagtggtgtcctgtccccacagcctccacttctgatgtacttgacagctaaagggtgtaagagaacacagctaatatccccaccaagcatcggtgaagaatgctcagacgctgtgcttatatggagaactacttttgtttgttagggttctatatatgtgaaaatcttatcaaaatttataatactgagaaggtctcttcctaaacacaggtggaaagaaaagtgaaaacagctgagctgagtaaggaagacgaagaacactgaaaacaggtaaccaagtcaataactaccaaactagcaagggttcctcctagtttttcagctgagtaggaatcaccctgagactgacacatgaaagtaaaaagtcagtgcctcatcttgaacctcctgtctcctggatgtgggtctggtctagtctcagctgtcacagaagaataaatactaatgtaacattgtaacagaaaaagtataagttaggagtcttgagttttacttggttttttaaatttgagacaggattttgctctgtcgcccaggctggagtatagtggagtgatcttggctcactacaacctctgccttctgggttcaagtgattctcctgcctcagcctcctgagtggctgggtacatcaccatgcccagctaatttctgtatatttagtagggaatgggtttctccatgttggccaggttggtctcaaattccttgcctcatgtgatctgcctgcctcagcctcccaaagtgctgggattacaggctgagccaccacaacctggcctgctttattattattatttttttttactaacggttgtcaacttaattgtatacaattcgatttacagagataatgttatgtttttagagatcataaaacttctgattaatcatagtttgtcatgttaattattaatagactagcaacatttctgaattttcctggtaccaccaagatccgttataaagagatgcatacctaagtgtctctcattaatggaaagttcagcagagctcatctttattaaagacagaattcacatacaaataaagcaaaagctgtgacatcaagctaaggaattcaaagctgagataacaccccatctttaattcatgcaattggggaaaataaataaaacaacatgagttaaaaaggggggtgtcagtcttaaaaatctaaactccttggctcttatcaatgtgtaacaaatgtaacattatttaaaattagtttctgaggcactgaatattttcacttaaaataaaaaatcaagaaagctatgatttctaatatatctgggatacacagtggctctgtaaatatttattaatgttatagtggtataatataacaaataaacatatggttacagcttattatgtggtaaaatgtttgaatattaaaatgaatattttgacacagcatgataaaatatacatttacaatcttggggaatttataattggtggggccacctgtccccttatcttggatctacaggcatcatttttcactcataacaagtacttttagagactttctacagtaatactataaagaacatcacaatacattagaataataattttatttactaacttaacttcctgtgcttcatactcttttcttattatctcaaccacaaaaacattcttctggctgataactattgtattatgatgtgtttctgctttgatctctgcatatctttgagcttttaagaatactttctgattgtttttgcattatattccacatatttttcattagaattcatttgtatagagaaaaatatgtcagatcaagaaaatattatttgatatttttcaaaagttatctataagacatgttaaaaatattctttctttcttttttttttttttgagtcagagtcttgctctgttgcccaggctggaatgcagtgtggcgtggtcatagcttactgcagcctccacattgtaggcccagacaatccttccaactcagcctcctgggcagttggtactacaggtgtgtgccaccacacctggttaaaaattatttttgtagaatcagggtctcattatgttgtccaggctgctcttgaactcctagactcaagggatgctcctgcctcagcttcccaaaatgctgggattacaggcatgagccatggcaccctgccaataattttcttatataaacctttaatttaaagccttccataatgttaatttatagtcttatccaggcagtagatttttcagtgtgcacccaaatcttttaaccaataaatcttattgtaaaaattatagttgttttgatatgcagatttctgacaacagaatgcaagggtgaggagaggcctatcaactgtcattacaatccatctggcacatacatgtgtgctaaatattctcacaaagctttcagggggtagatattgtgtttggtttataaaaattcaaacatcaattacactttgttgaaagatctccacaaatattaacccattatctctcacaagtcttccatgaagagattaggtaaacctatgccaggtctcaaacccatatggccaagcatgatggtccaaggtcagtcaacgagtatttgcctcctgcctggagacagtgtggggcctgactttcccctgcccgttttcccacccgtgtgaagtgatgagtgcagactagatctctctcactcatatgtaactatagttaggacactggacgctgaaataaatgaagtagaaattgtccaggcgtggtggctctcgcctgtaatcccagcactttgggaggccgaggcaggccgatcacgaggtcaggagtttgagccaagcctggccagcatggtgaaacctgtctctaccaaaaatacaaaaaataagccaggcatggtggcgcacgcctgtaattgcagctacttgggaggctgacacaggaaaatcacttgaacccgggagccagagattgcagtgagccgagatcacaccactgcacttcagcctgggcaacagagtgagactccatctcaaaaaaaaaaaaaaaaaaaaaaagaagtagaaattttaaaaaattaggctgagggaaaatttcaagtatgaaaatagagctaaaatattgattttcttagatgtcaaattttagtcaagagttggaatgcatattggtcaataaaacacatcagtttatgaatgaaaaaaaccaattaggtcagtggctcactttgtacctgaagaattatataaactattaaacaaacaaggcaggtggcatggagtcacaaaggaaatggcagtgatgagaaggaaaaatgtggctcattttctcccaatacattcttcttgtatctgactgcattatcttgctatgaatatcacccgaatctaagtaatgattcaagttaaattgtgttatttaaaaaagagcattttgagatatacaaacacaaagctgaagagcaaattaatattgagttccaaattcccataatcacataaccagaaagaacattgaaaaaaatgttcaaaaatattatcctcagctgagtgcttgtataacacatttctgccaagaacaaatgattatggtggaattataaagctctgaaaatggaagtgatggcacaaacttgaatatcatagtgtgaatgtggaactataagagcagttttatctttattatattaaaaatctacagctgtttaatgataacaaaagaatttctgttagattcagccaagtctgtctttatcacagtaatgaatagtcgatatgaacgaaagggctgactaaatggataaataagcattattccttcgggcccttttctagcaaaatcaaaatctctgctgttggcctttgaaagcttctctgatcttttacaagtgtcactggtcaggtaatgtaggtacttcaattgtcattcttttacaggggctggaagtcctaaatgtatatactgtctctcagctgactgactacgttttgaaaagatttattcatgtatgtcaagataaggcaagagatctcctaaaaccaccagcttctctccttacgtatctgaagaaactctttcctcagagaactcaagtaaatcttgagcaagcctgtatactgaagtcagctttccacgtcagagtgacactgttgaggtagatccatcaactacagaggcttctgggatattttcacaagacagcgattgtcatactgtgagctgagaacagccgtttcctagaggagtaattagattgacagaaggtgacatattccaagcaataaatgggagaaagagtccagacaggtaatccaaaaaccacgtggaatctttcctcccagacatgtggacatatggaccctgcattattccatttgctcatcggaaaaacttgaaatacgtacaaactgatgatgataggtgacaggtgcttcaaaaattctaatgaaatagaatttcattaggggaacagattctatttcgttactgaaaggaatataaatgaaaaagaatgctacatggagctctcatttcttgttttaggcattacgttatcaactagaaaatccttttcttatgcagtgattaaaactgatttttcccttcttaaatactattttgttatttaaaaaattttttccttttattctttcaaaaattatctcgttagtaaaaagaaataagtaaattattgacctttttcgattatatgaagctgtatttttatattaatgctatttaagtaaaattcagctttttttcagagaaccaccatcacagactaaaagctttcaaccactcaatttctttacatgtctgcagtctcagtcctcaagaatgtatattttcatcatcatccttttcctgtgcctgcccattctacatgcagagaaacctggagaaacccccaaattactcctattaacctttgttaaaaatccaagtaatcacactttgttgcataggtagtgtgatctttacttcagagggttgatgtgtcaagaacacatgcaggaattattactattagttgcatcaatgtcatgttcacacaaaaaccaagaaaaaaaagcatcaacttagaaaaggtagtttcctttcctctgatcctgaatcatttttttgcttgtcgttcacagctttatgaagataagtatctactcttaacaagctgaataatctttagaaagtagtaaattcatgtaggaataggaagtgcagttgaaatgaatactgcctataaattgagtttctaagaatatttcctgaaagtgtttccatattggtgtgctggtactcacgctgctgctgtttcctgaccctttagtatctacagagaggtgctttgaggactgtgcccagtgccttacttcatttaaaatttattcggcaaacaattattgaaaacctaccatgtgccagatactgttttgtacgcttatgtgttaggaaagcagccaaatttaaaactaaaaagctctgacctgacttataacattgtatggtttttgccttaggctgagggaagattagatgccaagaaatttctccacaggttttaataaaactgtaagcattgtctatactatctctccctgtagtaccatagtcccttttctttgttcttattctagaaatgaagacacattaatatattaaatctagtataatcagcaggtagactttaattaggcaagcaaatcatatccaatacagagtacaaaaagttagattttaacaaaaattattcacttgtggtaaaaattttaataaaaagttgaaaatataaaactgtacaatactgtatttctctaggttatttattaatgctcattctagccagatatcaacttctactggggaaggggtggatggggttggatattgtcattgtttttatttttatatgcttcctcaaaagataatcttaatattggagctgaaatttttttgactgaatcattttcatcttcaaataatggaaataaaagacacactaattaaagatttgaaagccttttcatgtattgaacacaaggaaacatccaccaactctgtcttaagggccacaaattatttgacataaacattcaaatggtgctaattattgatactctagtctggatgagaccgccaagcatcatccggcccttcctcatgcccacagtgggtgaggaataatggtgcaaacgctgcatgcctttccttctgcatcccttctcaagctgggctctccttcaggaatgagcccaccaatatctgttcctccttcaaagagcagctgacacattgtctcctctctttagactttctgatcgctcaggctgaatcagtttctccttcattcaggcactcattttattctacacattttcccactatagtcttaatcatacattattgatcctttatgtgctttttcccctctgctagattgagaggtccttaacaaagcactttgctttattcactttggagtttcaccagagagcagtctgacctactgtagttgctcaataaatgctagatgaatgaatggaacacacatttccacttcaatgttaatgtatgtggaggtttcttgacttgaccaaggctgtctggctggctggaggcaaaggctgtagtagggtccagaccccttgatacatatttactaactgctactatatgtcaggtgctgccagtggtcctctggatgctaagatgatttttctggacatttgataaagatgatttgtttatgtatgtgtttttcttcctgctactatgagctactagaggttaggaatagtttatttgtcatctcgtatcaccagaacttagcacaaggcctggcaagtggtcggaacttactagatatttgcagcattcatgacaaactgaaatgaatagatgaacagaacagaaaagaatgttcaaatgttagagggaggaagattagtctcagtgcagtattttgcaactgcaatctcttttttttccatttattactaccatttcacactacgttaaaactcaatgtttttattccctcttaataactcccaaatttactactttttgaaatgtacagtttttaagttagaaagcagtgcaatgtaggtgtgatttgtactatgtatgaaacattataactcacaaattttacattattgaacgcttaaaatttaggggtactagtctaaatagacaccctcagaaaaactgagcagtcagtgaaatcttttaatgccagaaagtcataagcatataatctcagtgatcaaaagtgtagctgaaagagggcacagaattttcagcatggaaagagaaaaaagggagtgatattttaggcagaaggtaaaggttagcaaaggaaaaacaaaacctttgtaggaaagagcacagggaaatttgtgaatgtgagtcagatactataaatctgaattaagcatgctttcaaattcttgggcaaagttcatcattttcccccattcttggatgctagtctactgctccactattctcctgggcttttacattggtcttattctgggccaacatttgcctgagggaattcatggaaaatcagggtgattctggggccaatcagatgattcaggcttcctcaggacagatcaaggatttggtgtttgtaaggattcttccgccaaacctctattggaacccggacagggcatgcatcatgagttggcctagaatgggactgagatggggaagtctggcacacgttagctgtaaaacactccctgagatcctcaatccagcagagatgtgaagtgaaatactaaagagagaacatttaatatataataattgaaatgcatgataggatatgcagttaatcctatatatctatatctatagctatagttgttgttgttgttagacagagtcttgctctgtcacccaggctggagtgcagcggcatgatctcagctcactgcaacctctgcctcctgggttcaagtgatcttcccacttcagtctcccaagtagctggaattacaggtgtgtgccatcaagtctggctaatttttgtagtttttggtagagatggggtctcacaatgttgtccaggctggtcttgaactcttgacctcatgtaatccacccacctaagcctcctaaagtgctaggattatgggcatgggccactgtgtccagcctatcctaataatctttataatgcaagttaagaaaagaaaggctggaatgcaaagaatcaagttgtaggttgttttgaagaatgggcaatgttagtgatttcttaaatgaggaaggaaaagacaagacagaactataaattaaacaaaggttgagagaggaaaggagtaaattaatataagatcagagaacaggttttttgaaagtataaaatgtataataattgtaacttcacatactaaacattttagactatggcattttacttgcaaatgggttggttacagggacaaaaaggctgtatcttgaggcactgatgctttacaaataacatgttggagcatctttcataaaccattaatgacttattttaacaaaagatgtagatgttatcctgggtcatcaaaataagtcaaatcattatttttatttcctagttgtaaatgcctttttattcaatttgagtctatgcgtgattagtcatttgaaatgcgagtagcttatatcctacatctttgcattcaccagtcacttctgagctatcttttgagtcaccacatttcctcatttctacaggatttcccacgatctcttctactatatcatttcttttcccatttattttctggattccagcctaccccttcatccatttctctcccatctttcccttcctagcaaatgtcacaatgtacttgttcaagctgaaaactcagaaatcacccttgattccgtaatttcttgactcacctatcgttattctttctatttggtcttctgtgttttgtctgtttgtttttggactcccaccttccagtcaatcttccttcatacttctggcagggtctaattaaaatgcacatctaattggatggctgttctccttgaaaaccctccacctgcctctaggctcatttcctcttttctccagcctactgtgtgtattagcttgttctcacactgctaataaagacataccaagactgagtaatttataaagaaaaataggtttaatggcttcacagtttcacatggctggggaggcctcagaatcatggcagaaggcagaggagaagcaaaggcatgtcctacatggcggcaggcaagagagcttgtgcgggggaacccccatttataaaaccatcacatctcataagacttattcactatcatgagaccagcatgggaatgatccatccccaagatttaattacttcccactgggtccctcccatgacatgtggggactgtaacaattcaaggtgagatttgggtcaggatacagccaaactatatcgctgggttttggccaagggggaaatttcatgtcatttggcaagtcagctcaatcctttagaaacactgctttgatatacgccattccatccttcctagaatatccttatttactcctcctctcagttacacaaaccttaattgtcctaggacaccctattacctaatgccctcacttacttggtgaagctttttcctaacgcttgtagaaggcactcaggaactcccttttctgtacctgtacagtccttgacctcttttttatatgtggtatgttatactgtaatttattttttaacatgtctgcttcaccaccaggtagtgagttctgtgaaaaatgggcatctctggtccctaacacagggcttgggtaatatgtgtggactcaaccaagattctcagttatggttcactggataaatgaataagcaaacaaacttgacagtcatactttctaacagtgacagacactaattcaaatgagttgggtggtcttgtagagtgacagtactatttatttgttttaataagattattacctcaaaatgtaaggagtacaagttctggtaggttaaagcaatatctggaatgacttcaagattgcggcacaggacatccctgtgggagctgagggaatggaggaggtgacacagactattgtaactggttcacaaatggtgggatttctctgtgtttagacctgctcagagtctggggcatgatgggcttccaagccatctgtggctgctgctgctctgttactgccaggaagacacaaacatgttgagaacaaaacttactgcaatagacacctttgtgcattctcttctctatttctacgtctcccctccgaaacaaggcattacccttgatgtactttacagaatatctgtcagttgggatctccagtttattaccagcttatcagaaaagcagagtatacacagaactttccataaggcattgcaaaataaagtcttgaggttggcaactgattgacttatgtcatgactattttaatcatacctgagaacttaagatatcaaattcctcatttctgagacagtcaggaactcccaagataaagattgagctgtttcctttaattccttgtctcccaacctaaagtggtggaatttacgttcagttgacagccaggcttaagagaggtaaagacatctaatgggcttgaccctggcccacttttctcctgggctggcccttgtcctgatggggaacattctctatgttgtggttgtcatgtcttaagtcacaggaccaacatcaccaataacagttttcaatttgggacagcaccaaaaatactgcaagttatttctattcttcaatttcttaaatagcaggcagagagatttttcaaggaccaattctggattgtgaacacagatttcatttatggtatcctcaacttcttcccacataatacgtgacattcaaatctttttaaaattgatttctccctcttcctaataaaccagcctgctcttcaaggagtggctataagtcattcactcttgaaaattttcactttggttttggttattctatagtgatctgacagcaatgagcagggagggtctcttatagtctatctccccagttaatatgccctgtgaagaacaaacacacttagatgctaattgagggttttgcctgagcttgtgatatgccatcccagagactgccattgacaactgttaacacatactgctcaatacccatattgttctgattagagaaaagtgaagtatcaggagtgcagagcgtcactgggattgtgggaacacaatacgtaagtcacagccgcctgtggctgcctggggagagaagagtttcagtgtgttagaacgaagttctatgagagcagaatctttgtctttttcacctctgtatccacagcatcttgaatgttcccagcacatggatgacactcaataaatgttgttattgtcgatgaaagaataatggaattcaaggctgtagcaacagaagttcttatttaaaatggaattacaatgaaatctaaaaacacatagagggcacttattaggtttgtatacatactgtacatatacactgattctacccttagcaacatctgcccctcaaccccaccatcccccatcctcgtacataaacttaaattataaaaggaaaaaatcacgtggaagagagagttaatagaattaatgtctcttttattcttccttagaactatataatgaacagttatttcatattgttgctatctgttttctgcttttatatcattttctagattataagattcttgcagacaggaagtctcctgacgactttccatccttggcaactagtaggatatctgacagtagaatgttgctacaaattggttaacttttctggataggtgtcctacaggggactaatggtaaggacagcctgatgatatacaatggagaggctcaggcagactaagcaaaagctagtggctaggaatccaaatgttcccccttgaaaaccaaacctctctcgcgttttagtcaggtttgccaggtctgtaaaaggtgagcagtcttggtctctagtcttacttgtatattacttctccctttccatgtaaaatctctcctgggacttggctaatgcaatattagtgttttcactgtattggttcatatactggcaaaccttctgcttaacagaggcagtgaaaggtataatgggtagatggttgctggtcaggggacagttgctgatccagggccagttaagccagcagacagacatcctggggtttcatcagacttagcataaggacaggaaaccaggatgtactctctagtgaacaagaggcagaaaggccgactggaagtcagagatctggggaaaaggctccttgcaggttcaacagttgacctggaggtagaagttgttagagtttcaggatgttgtcaaatggtcagagaacaaacctctatctaccaacaactacatcatgcattaagaaagtctcacagactaaatctccaaaactcacagcagtaaacttaaaatgcaaataattgtttcttttctgcaaataagtttctacctcttttttttttttttctcgctctgtcgcccaggctggagtgcagtggggcgatctcggctcactgcaagctccgccttccaggttcaggccattctcccgcctcagcttcccgagtagctgggactacaggcgcccgccaccacgccaggttaattttttgtatttttagtagagacggggtttcaccgtgttagccagcatggtctcgatctcctgacctcgtgatctgcccgcctcggcctcccaaagtaagtttctaccttttatctctcctgtcacattatagattacttgtagagatggagagaattgaatccatttatcctctgtagctgttatctcattaccactcacctaatatgtgaatttataataagtggtggattttacgttcagttgacttgggtaggtgtctgatgaaagaaagtttgataggactgtttgataagagcttcaggtgcttaaaaataaatgtgcttcaaaattctgaggcagtttctcaaggcttctgctgcaaacacactgacatcattccagtggctttctttatttaaactcgtctttcctgcagtcctgtcgtagttctgcatgctgcaatgccactgtgtgcctgcctctgttccacacaaggctgcgctccttgagggcaggtctgtgccttgtgtcggggtatccttagtacctggcagagtactgggccctgggaatttcataatttaatgtaaatttcaagtttgctaattagagggcctttatttgcttacctaacaatataattatttccagctagtaccagaaaaataatcagagtatttctaggaccgacatcaaaagtgccagtagcatttcagagttagggtcctctgctcaactttccactgggacttgcctgctagtttcctggctcatttgttattgggggttgctgtgcctggactcacattgcagttcctgctgttttatggtattaatgtgaaggatcctttttcactagtgtaggcaattatgaattgagtgtaattgctcggagaggacacgagtcatgaataaatacaatctgaaaattcctaacatacattgcattatggcaaatagatccttctttctaggttaaatacttacaaataaaatataattcataagaaatattttgcaaagtgtactattactgatactgcatgctaatcaaggcctatatagactaagttactttattatcaggttaatttttttcaaaatttatgtttccaaattaaattaataattaaaatcaaattcatctcaatttattttccttattctctgaatgctatccatatatgaatcgacagtccagaatcatggaccaattattacttcacaaaatctcatttcccatgactgcatatattatgcagatgataatattcttaggtgtgcattgtcaccttggatttcacatgatgctataaaagctagagtgacactgagaactgaaaaatggaagggtatagagagtatttttgtgtgtgtgatttatatacattttatttttttatctcattttgttccattgactaggccctcagtatgacttaaagcagagatgggagcatatttatctcatttataactttaaaaggaatgagccaaatgtttcaccattatacacttactatgaaccctttttgttgatatatttcataaacttaaggaaatttctattcctagtccattaagaatttttattaatagaaactgaatttcatcaaatgcctcttctacttttattttgatgatgctttggtgttcataaaattgttaagataaatttcattaatcaatttgttaactgttatgatgaacttttccccataattaaaaaaattattagtaatattattttaaattgacaaacaatacttgtatatatttatatggtataatgtgccattttgttatgtgtatacaatgtggcatgattaaatctaactaattaacatatctatcacctctcttattttttatggtgagacatttgaaatttattctcttagttattttgaaatataaatacattattattgaccatagccaccctgctgtgcagtagctctcaaaacctattccctctgtctatctgtaccctttgatcaacaactcctcattcccgccctcatcaacctcttccagcctctggtaacctcaaccccttccggcctccagtaaccgtcattctacttagaaaatgtttaaaaataagaataccaagaatgagagacagaggttataaatagatagaaaaatactggaagggggagaggaaagaaagggagggagggagagagggaaggaatgaaaatgagtgaaaaagagagaatttgaagatcgtgtgaaagacagggaggggaaaatcaagtgaacacttcaagtgatcccttgctatgtgaactcatctctcatcatatgggctcagcactttatgatctaacataaagctttatgacaggccatcagcaattttgttcatcctgatatccacacctggcagtggctcggcacctgttgtctaactcaacaaggccaagtgcatgctgccagccccacggcgcactctgtcctgtggccccagacagccttctctgaacagactctgtagacctggcctcctggctgcctgattttgtagtcatgatggcttcaataacttcaggcattatccatggaaatgtactgcaaacttgactttttaaattaggtatttcaatttccataacttatgaaatctcagttattttgttagttcagtgatgagcttaagggtatcatttgcaaaatcatttcttccagattcttcattaggtaattataaaaacaacatttcctcttctatggcatgaagaggaaattaaaccagtcttccatcactatcaaaatattaattttcttaatattttaattgaatccattcctcagcaataacacctaccatttaccaagcatgtacatgtgccagggactgagcccgtggctttgcatgggtctttttttaatcctcacaagctactcttccacaatgactgccaatctacagatgaaaaaaagaggcacacagtggcccaagaacttgctgaagtttacaaagttagtgagtggtggaaccaagtctatgaacccatgaatgagctccagaattttctctcttagctatcaaattattctgcgtctgcaaggttgtttaacaataaggattgcctaaaccatgcctgtgtatctgtgtatcctttgaacacttactctcagctgaaattggtgaaatgactgacaaatcttattttttcataaagggatgtgtttgtaacggaattcattttctgataaaaaatattatctaaaatgtttttcctactattttgctataatatcaactgaatagatgggaaggcccttcaccaatatgtaggtactatctagaatagatgggaaggcccttcaccaatatgtaggtactatctatctagttaaaatgaagtgtaggttgttgaagccccaaggaaaagaaagggtgctaaatttttcttttctttttttttttttttttttttttgagatggagtctccctttgtcacccaggctggagtgctgtggcacaatcttggctcactgcaagctccgcctcccaggttcacgccattctcccacctcagcctcctgagtagctgggactacagatgcccgccaccacgcccggctaattttgtttttgtatttttagtagagacggggtttcaccgtgttagccaggatggtctcgatctcttgaccttgtgatccacccgcctcagcctctcaaagtgctgggattacaagcgtgagccaccacgcccggctgctaaatgtttcaactcctaacattcctaagcctaggaaggaagtccttcccaataatatacagactgtacctatctgcataaaatgaagcacaggtttattacaatgattagagtaatactagcaagaacctcaagtctctgtgactaacaaaaaggtccactttattattttggcacctatattcttcagatgcagaagccaaccacttgcctcttctcttcaatttgcttgagcagatgggggatgcaaaggctggtaactacaagactacattttctcttgggttgagggaatagattggggaaaagagaaaaatgtatgcttttatggagaaactattgtttctccctgggcaaagcgagggatcatcgagaaatcttgtatgctgtataaaaattattttcaaaatcatgggtatataatctcttccctttcctgtttgttgaaaaacatgcacataacaccaagttactttataggccagatgagaggaaaaataaagtaaatgacttaaacttcccaattttttcaacagttacaaggaagacacagtaagatgtgatcttctaaagtgaaaatttcccaaagtaccaaggaaaaggagaaactgcagaagagcttcaagaaccacaaacacttgggttttgcatcttgccagaaaatctgcactgttggtagaagcctggggtagggctggcaggacctgactcagcggagaaaatgccacccacagtcactgactctgcttccgcagtagcggagctcccctgttttctctggaggtttcccacagccgggccaatacccatgtctctcagatgggaaactggacttttggaaaattgaaactaaataaagttgtataacttttaaaagaagtttacaattatgatgctttgcttttcacatgcgcttaaagtccattttctgttgaataaataatattaaccacatattaaccacctaatagttttaaaatgtctcaaacagccatcaccatcattctgaacagaatcacacttctttttaaaagatcactgttaaaagatgaggggaaacagtaccattaaaaggaagcaaaacatagttcaaagtctgcttccatgaggtaatgtacactatcgactaattgtcaaaggaatccagtctataccgagatgaatgaagcatgaggttaaggcaggtggctgggagaagttagaaactctccctccccgattgcattacattattgtcgaagccaagcagatagatagaaatcaatgaaagttttgttgatctgacacaggaacttgtgcacagtgaaatggaagctatgtattttgtgctggaaactgccagtctcacattaactgcatgtatatgtgaatatatgtaggtttgtgtaggtttgtgtgtgtgtgtgtgtgtgtgtgtgtacagcatgaagcagaacatctgaaagaatcttcagaattatttctcgttagatgtacttttgggtagattttatctttttcccccagaaagtaatatttcaatatagaaatttaggcctcagcaaagtgaggttttttttttttttatgttacaatgcttgcaaacttaatggtggtttctaatggaaaacaaatttcttcccctaatcataatataagaatttgcaggccaggcacagtgtctcatgtctcacgcctataatcccagcactttgggaggccaaggcgggtgggtcacttgaggtcaggagtttgagaccagcctggccaagatggtgaaaccccctctctactaaaaatacaaaaaaattagctgggcatggtggcaggagcctgtaatcccagctacttgggaggctgaggcaggagaatcgtttgaacttaagaggtggaggttgcagtgagctgacattgcatcattgcactctagcctggatgatagagtgagaatccatctcgaaaaaaaaaagaaaaagaaaaaagaaaaaacgaaaaactacagttttctttaatataaataaaatctcttgtatttgtacaaacgcaattgtggaaaacactgaaatattttcctatttatttttatgctggtcagcaagtggtttgatttcggtagccagactccaggtgcagagttcagaactataaatttgttgtacctcctatcagttaaagttgactgagatggccatccctccccaaatcacagttcgtcttgaaaatcttcagagtgtgaaaaaggtatggctcagaacaaacaccagtggttaaaaatgatatccttttcccagtagcgatatacattgtgggtatgtgattagaatatttaaaatacctgttcacctggtattaagccacatgtgtaatacattagagtgttcctggctcatttccaagagtatgtatcctcactgccatgaaaatactgcgggagccagggcaaagatacttaagtttcaccctagaagcaatgcacaacatatatatttcactgttaacaatatcatcacactaagcattgttgactgactaatacttcaatgaaatcaattatttatttttgtgtcagaagagaaactggcagcatagggacacttgtgttatccttgctaattacttccattgtcttgaaatctcaatcaacctacccccttctctttctccctacatctctctcgttctttcactttctctctcattgtctaactcctcttcttggatacaaagtagttcaaaggggacaccaggaaataaattatatcctaatgctatctaccagagttcactaagagaacttgggcaagcccctctatttggcagagttccactttttttttcttttaactctattttgactggacttaatagaattacttttgactcctagtttttttcctttttctaccctttccctagtttaaaaatctgtgtagtgaggaccttatttctgaagaatttcatcacgttattacacaagaaatatacatacattatatgataatttataaaatgtgacattttatttaaatgtaagcaccaaatacactgaagatttcagtgtccaaagtatgcgtgtgtatatacaagtgaaagtttaaaatttttgcctaaatttacatatgcaaaaaggaacagcaggaaaataaataccagttgtatgagcatcatgtgctaatggctatatatgtacataagttaattcttacaggaagaccaaaagtgagttttattatcccttttttactgcttcagaagctgaagcttggtggaaattcagaatgttgcccaagatcacagagtttatgaaagtggcagaaaccaggtttgtctgacgctaaaatgtgtgtctgtccctcctccagcaccacactgtcttttttatgaaagggcagggcttttattatatggatgtgaaagtgtaaggggagagttttcatatttggcagtattgtattcagaatcctgacctgtttaggtgatcattaaaagtgcacatgtcctggctgggtgtggtggctcacacctgtaatctcagcactttgggaagccgaggcaagcggaccacttgaggtcaggagttcaagacccagcctggccaacatggtgaaaccccgtatctactaaaaatacaaaaattagccaggtgtggtggcacatgcctgtagtcccagctactcgggagactgaggcaggagaattgcttgagcccaggaggtggaggttgcagtgagccgagatcgtgccattgtactccagcctgggcaacagagtgagactctgtcaaaaacaaaacaaaacaaaacaaaaaactgcacatgttctgaggaaggaggatcttttgatcccaggagtttgagaagagcccaggcaacctagcgagactctgtctaaaaattaaaaagtgcactacttcattaggaacttctaaatttataagattttgatttatgtttcaatttactgtaaagaagcttatatagtttaaaataaacctcctaggccaggcacagtggctcactcctgtaatccaagcacttgagaggctgaggtgggaggatcacttgagcccaggaattcgaacagcctgggcaacatggcaaaatcctgtctctacaaaaaatacaaaaattcgttgggtgtggtggtatgtgcctgtggtcccagccacttgggaggctgaggcaggagaatcacttgagcccaggagttggaggttgcagtaagccaaggctgtgccactgcattgaagcctgggcaatgggcatgaaatcatctcaaaaaaaaaaaaaataaaaacaagcaaaacgaaaacaacaaacgcaacaaaaaacctcctgaggcctctataatttgcttttttaatacactgtatgtgataaatagtcctcagtcacagaaatgcatgtgcaccttattagtgcaaactaaaattatatgaatatttctgaagcaacttgtcctatgaaataaaaatataagtttggtgaaagctttcaggctttttagcacacacacatatacatacttacaaaacgtaaaatattttggcacttccacttttcacaactgtttctgtcttttccagcggaacctctctcaagaattgtcattatgctaatttactgctcgagaccacggagtgtctttctgatgccaattgtatcacatttaattccacatcaaatatttagagtgcttgatttccctgtctcttcttcccattttcattgccatctttcttatatctttttatttatgtgaatattctcttcatatcaagctaatacttttcatgcccttgtttcttttttcttgtgactctttgcatacttggttttttgaaagtttgcccacgtttttcatcaattgatatccatctttctgaatttgacttgtttgagcctaaaaaggactaccaatcatggctgcctgtcctgaccttttaaacttctttctaccacttattgcttgatgacatggtatcaggagcggcactgccatcatggtcgtcgttatcattattgtaaaccttaccaagtgtcagaccctgttctaagcattttataaatgtttatccatttaattctcataacagctaagcagaagatagtattattaacctctatttacagacgatgggattaagaaacagagagttggccgggtgcagtggttcacgcctgtaatcccagcactttgggaggccgaggctggcggatcacctgaagtcgagagttcaagaccagcctgaccaacatggagaaaccctgtctctactaaaaatacaaaaaaaatttagctgggcgtggtggcacatgcctgtaatcctagctactcgggaggctgaggaagaattgcttgaacccgggaggtggaggttgcggtgagctgagatcacgccattgcactccagcctgggcaacaagagtgaaactccatctcaaaaaaaataaaataaaataaaaaataaaacagacagtctaagtaatttgcccaaggacatatagaactcaggcagtctatctccagaactgatgctcctcaacactgtgctatgttgcctccctctaaataccccatagttctcattacgttgttttgtccagttgattcccacatgtattttctaccttaattggactgtaagttttgtgaggtcacagacaatgtcttccaaacttgtatttctcctggcatcaatataaagttctgtatatcctaagaatttaataattattgcttgaataaaacaaaatctacatataaaagtggaagcaaatttttaagatatacatactggaaggccactttcagaaatgaaggtaaaaatataacaaaaatcttgaatgctttaatgaataatttgcaatataagtctaactgcattgaaaatcgataatgaaattgctgtattaatttctttgcacttctatttaatatttcttaactgtcattataagcatttgatgcatagaataagcatactttcttttgtttaagccaagctgcttgcattattttggctttctattacagataatactgtagacatttcaaatccacaatgatttggaggtagtcaaatcaatatcagctacataatacataaaggatggatgcaaattttatagcaaagaaattaataatttatatctgtttactgtaacaaaattttttgtcagctttttctgaagtttaacaatgcttgagccaatattgataaattatgtataacatataactgtttaagataaaatgctactaaaataactatattatttcatgtttataaatgttacagaatctattatatgtagtaattcacgtagtactctttctgtatgatagcctagcatagttaccatagctcatatcactattacatctaaaaatattttttatttcagcagttaaaaagaaccaatattttccatattacagactttgctgaagagtcagaaatgaataatataatatcaaaggtaataatttcccaaactgaatttatcctgcatggtacaaatgactcaacaatgaaaattttgtttaaaaagtattcatgtaaaaggctttgtccctggaatacagctctaagtggctcactatctaggttgaaaatggtttcgcagggttgtatgtcctatttttccatgcctgcagtaaagatacaatatgggaattcagcttggtaattactaatacaccacacagacacaattacaccctgtatgctgcataaaggaatcacttgtggtctgcatccattacaaagagcagtagggggccaacatgcaagacgacaaaatgctttacaagacggaaggagaccagaagagtcgatgtacacagatacaaggaccttgattcttctagcaatgatttaagcctctttccatcaattatcgtcttttgtctcaagagtcttatcaccagcagcattacaggaactgaacataacaatgctcagactcgtataaccctatgaactgtgctgacatttccacaccctgttgctatgtttgacctggtttacagattacttaagcaaaacaaaatagaaaaaaaaagcattcccattgcaaaactggcatacacacacacacacacacacacacacacacacacacacacgtatttttttatgacttactcagaattccatttgttgaaactaaaagccatcctactccagaaatgctatttttcaaagtagtttctacatcattttaaagattaaaagtaaaaatctgcttgagtgaaaataataattttaagaaagagactaaatgttggcatgttaaggggatacagactgaacaagagaatttcatgtctcagggagctaaactaaaatgagtcagctgctctcttaaggtacaatgagtcacaggaataattttcttgctgtgaaactccttaaagttttgagtttaattgcaagcagtaagtggtttttattataacagagtttcctctgttaattattacacgacgtacattattttacaatactttcatttaagattctcttttaaaatacatcttacaaatatgaatttttaagaccttaggaaagttagttatttatggcagtttgtcaggttccctgaaacaaagccttgtctttcagaaaatgtttacaacctatgaggaaaaaaaaaaaagtatcctggggctaaaatgtttattggcacctagaagtctgaagagagagtcgggcctgtggttttttgagggcactttatcatcgcccgcattctcaaaggtttctctgaatgaatagaactggattactcagccttctattccacgcctattcctctccattttccttggcacgactgagagccaggctatttttagttaagcagttttctatttttagacaactaccagttagaagacatttgttagggaaaaattaaaaaaaaagcacacacacacaaagggaggagggaaagaagcttcctccacatattgtgaagcagccttcaacctgtaactccaggcatttcagctgctttcaatcttggaaaaataaagaaaaattcagagttcagggttttaaaaataaacctaccctctggcaaacagaccaaaatacaacaagctgttactatgtgaaacagtgactacaaaaacaaagaacattctccaatgattaaactgcgagaaaagttgaagaactgattaggttgtaagaatgttgcacaggcatgtaacaattttccagcctctcagccagatgtatcatgttttagaatttagagaggggaaaaaaaaatctcatctgtaaagttaaactaacgatgtgggatgcaactttaaggttgaaccttttattaagcttaaaggcaatgaaattcactgcatttttctaacatttgtgttctatggaatttctctagaaattataaccatctgtttatagaaaaaccatacattaaaaaatccagtgctaacagaaaacaaaaaataaaggctgctacatatacatactacatatatgtgtgtatatatatacatatatgcatttaatgtccatatatcactacatttattagtctcacttttagtttaaatgggaaaaatggttctcagattggcttagcatatcaaattattctacttattcaaggccatgccttcatctgaaatctacagtaagatttttcaggtgctcacagttgtaactgctttccttctcctctgttagcccactgtactttgtctatatcttattatggttcagataattgggtatcataatcacagatgcatcaccagtaactggcagaatgcttagcaaatgatcttcatgtccatcaatatctactgaatgagagaacaaatactgtgtatattctgtccaccatggactgctactggccctggagggccgtgaacaccatactttgcacatacacttaataaatacttgtggaaaagaaaaaaaaaatcaattcgttgacctttgttagatcttcttaatttatgtaaaatgctacagttatttatataatcattcaatatttacttataaataatacacttattagcataaactatgcagtcgtaaattaagaatttttgtctttcttttggttagcattttttcttctctgaactttttctcttgactttgaaaataaaactaattttttaaaacttaagggttgacaatgggctctgacagctgttataacctgcaatcctcatgacagccccgtaaggagctcagggtagacagcattaactcatgaggaacctaaagcccagcaaggttacataactcgccctccgttagagaatgagagtgtgtgatgttgctgtaactggaactgaatttttaatctccatctttccttcaaatttgtggagcttttaaagtcctatatcctagaagtaaaatttgaaagatgaactctcataacaatgcttcaacaatattctttagaaaaatcactttgtagctttatttttcccccacatgaaattaattcagaacaactacagttaaggaaaaccaatcatggagtctggatgaagataaaattccgcacatactaattaagaaaaatcagaagaaaccgtgtgcacgcatgatcttttctttcctgttggaaaagttcacaagggacctagcttatttctacgttcttactactcatttttcctgtgccttttccattttctcttcttcctcagggcaattccagcttcagtgatccctccattttctcgtctttctccacaaaatcacatagactttaacaaatattctgttccttggagtaaatgccaactgagtgattcaactttcctggttggatttctctgccctggctcaggtcctgactgacgcacagtgggcatgtcataaatgcctgctgcaggaatggaaggtgaagtagccaggtgcaacctctccagtttacatatcctttattgggctgtatctattaaccatcatgccagtttgtttgtttgtttatttatttatttatttatttatttatttagagactgtgtctcgctctgtcacccaggctggagtgctggagtgcagtggcacaatctcagtttactgcaacctccgcctcccgggctcaagcaattctcctgcttcatcctcccgagtagctgggattacaagcgtgtgccatcacgcctggctaattttttttttttttgtatttttagtagagatgaggtttcaccatgtaggccaggctggtcttgaactcctgacttcaaatgatccgcctgcctcggcctcccaaagtgctgggattacaggcatgagccacctcggccagcccatgccagttatttgaatgaaagagaacactagatgcaccagtttcgtcatttactgtccaacagagggtttctttcataatggacaattatatttgggagccactagtcacatcttgcttgaaatgtggatagtgagactgaaaagctgaacttttaattttatgtaatttaaattatatttatatttgtatagccacatgtggctaggctaccttacagattaatgcagatctatgtcttttcatctgaagtctggttatattatccaaagaaaatttacatgacacaaatgagtttataattgtcatagtataggtgctaaatataccatttatttacaaatgtgtacagtaactttcaaaggggttgggtttctggaactaaccacagagtcaatcaataaacttatgtcctattgaaataactgagagtgaagttggctttagattagtagtagctcatgcatagggtaactttggtctatttttctatgaaatggtttcctccttgacatcatagtgatggaacttgtttatgattaaatagtaatatgcacacttttatttttgaaaaataaagtaattcagaaattataaaataagttactattattaaaataagttactattattaattcatatatctacttttttgtaatactttttttttttttgagatagagtcttgctctgtcactcaggctggggtacagtggcatgatcacagctcactggagcctcaacctctcatgctcaggtgattctctgacctcagtctcctgcgtagctaggagtacaggtatgcaccaccacatccagctaatttatttttatttttgtagagttggagtctctgtatgttgcccaggctggtcttgaactcctaggctcaagtaatcctcctgtctcagcctcccaaagtgctgggattacaggtgtgagccaccatgcctgctataactatttttttttttaatgtgaggaaaaaacccaaacacccattgtgtagttttactgtttacaacgtttcttaccctagaacagtagctctaaatagttattcagtttatttactaaaacataaagataagagatttaattgatatgaagaggttttcagaatctaattaaccttccagctagtcattaactctatgacctttagaaataattgacagagaattttttttcttattcataacttcttccaggtggttaaatttcagagtagtgcagaatacactaaacaccattgagacatgactggataatatgccaaatagctataaaatggggtatatttccaataatataatctatttacttaatctgttgtacacatatgcagcatttacctaattacagtccttttaatgactgactttgattaagtcttttcccagaatgtcctattgattattttgaccaagaaaataatgaaaaagttatgggtactactatctctctgcacccaaggcacatgcccctaaccaatcacatcacacttcctgaatgtctggacttggactcagcatcttccttaactgtgtgctccaggcagccagtacaaagtgatgggcacacactaaggagtgaaatgtgccagagtcccacctcactgggtagtgatgtgccttttatgaatgtatcacacttccagaaaaacctaagacacttcctttcaagaattagtttcacagaatttcagttgtaagaacctgttttatagcatgattctaaccctccataaaattacaaagaggaaatagtctacagacacactttcaaattccatgaagaaggaaatacatgtttggaaaaggaaatctagatcctttctactccagcagcatcagcatcacctggtcagaaataaagggatcctgggccctgccctatacccactgagttagaatcagcattttagcaagatactctggtgattcacactgggccacaggcatttcatttgacccaatactggccaaagcactaacaggtttcttctctcttctccagtaatcaaaatactgtaccttggtctggaagtcctttcctttccaccagcaccacaagcaatacttttacttggtttcctgtgccttgtaatttaattatttatttatttttgatgcaaaacaacatttactcactctagctgacttgaaagattctcacttttattattagaacacatcggatctcaccaaagaaaaaattgtatatttaaaaattttatttatgctaatgatcatcagtaagttgatatatattgaatgtccacaatatgctaggcattgagctggcagctggaggtacagagatgaacaaagcttcgtcatgcccttcagggaaaggagagggatttgtaattagacaaaacaaaaacaaaccccccaaaaccaacagtggggtgaagaaattaaaataaacactccttaatgaaaagagccatcatcttagaattctgcttctaggcaagcctcagaatcattcttagaactttacttttgaatatttcatgactatatattcagtaacttttcctgaggaagtaagaatattctacactttgattcttattcggcaccttttagagccaatgttagttttacttagatgatatcaatggctagaatgtaacatttggttcaaatatgctgcttaccaccaagttccatatgccatgaaatttgtaaatatcattaaaaattgacaattatcatccaggctatatatttttctcttttcatttccaggtatggtgggagtcaggtgaagagagatcacatgagatctttgttttgctctagttcaggaaggttcatgtaaaataataatgatgacaaaatggtaatgattaatattgataaagaaattatattactgataaaagtctatattttgaaccctgtcttttctgcttctactattattaagtaattatctgctcactgtgttcatactaatgcttgcaaactattagagctgtgtaataacagagactagaggaagctcagttttattgcctcacattactatttgttcaacaatgattattttcttaataaatgagatgtgaagcagctcttcgtgtttataaaacatgtaaattaagcaagaagattatttttaaaaaagaaatggctcttcaaatttgatctatacaaatcattgtggtatagttatgagaaatatgaatacatttaaaaaattttagactcatttcttctttaagactttggggaacaagtaaaaatattatttacaggtactaataaaagtcttttaaagatatataaacaaaattatattaaaattcaggaaaataaaaaactttttaaataacaaaatctttttccccttttccctcagaagccacaacatagaaggtttaaatctttatggaaaatactaatactttgttaatttttcaataccatgtattgaaaagcaattatatgcttggcttaacagaggggagggtagacttacttagtcactagcagtaagatctatatcaattatgttttatagtaaatctaagaaggatttgtaatgtatctcaagaatactatttctctaaatttttttataatgaaaaatacttttctggagaaattaatttactaattatataggtaaatactggtccaatgttgcttcaagtaaattaaaaatagtaataagacagaactatcatctttccattcacaagcttcaagttaaaaaaaaatacagtatacttcacccagctcacacagttaatgttccctgtcagcctggacaacttgcaagtgctttctgaccagatcataagtttactgattgactctgtggttataggttaggggtaaagtgtgcttttagttttatggtgagtgtttagttccagatcagagtctctcgaagtgaacatttatgctctgaattccaaaatcacaaggtacacagttactcacttccgaagtgactcctcaaattttatattgaagaattaattttggtattaatttgaaaacacaatttgtttaaatatctccctcttcatatttcagtctagaccagtgctgtctcatagagctttctgtgatgatcaatgcattctgttgtatatcttccctgtttaattcagtagccactagccacacatgactactgaatgcttgaaacatgactaatgcaactgaggaactgaattggacattttatttaattttaattcatttaaatgtaaatagtctcatgagcctattggctactatattggagagtatggacctagattacttgagtgtttttaaattgtgctttgataaactctatcaaaatttaatgaattgtttcattggaactgtaaaaacattttttcatactttaaatgtgcaacgttatgccacatgataatcacttgattatatgtctgtctttcctgtttgtttattctataaatatattctgaggaggtaactttctctagacctcatgttaagcactgggaatatgatggtgagcaaaacgtgtacagtcccttgccctttgggagtttagaatctagtgtgggacaggcaattggataacaacttcaacagtgctctgatgggaaagatagaacacatgatgactgtaatacaggggaagcacctaacctaagttatgggggcttcaaggatgactttccaaagtgtaattgggacctgacttgagtgaaggataagtaacagccaagtagagatccagtaaggaattttaagacaaaacagagcttggagaggttgaggaatgtacgtatgtacgatgtggcttgagtataggatgggggttgtaagggcaggttaatggcagggaaattgcaaaaagtgaggctgaagagtaagagaaatacatggatcagatcatgcatggccttgtgagccaacttaaggactgagagtccttgagggaccttggttatatctgtatctccaggcatttcatagcatataacacagagcaggaattcaacaaatttttgttcaatcaatgactgaaagaaggaaaatctgcaaatgattaggtaagtgaatctgtttttttctcttaagaaaagtatccttgtataatatgtatctatatagcacataaaaataattttgtacatatatatttatttactttaagttctgggatacgtgtgcagaacatgcagacttgttacataagtatacacgtgccatggtggtttgctgcgcccataaaaccgtcatctacattaggtatttctcctaatgctatccctcccctagccccccaccccacgacaggccctgctgtgtgatattcccctccctgagtccatgtgttctcattgttcaactcccacttatgagtgagcacatgtggtgtttggttttctgttcctgtgttagtttgctgagaatgatggtttccagcttcacccaggtccctgcaaaggacatgaactcatccttttttatggctgcatagtattccatggcgtatatgtgccacattttctttatccagtctatcattgatggacatttgggttggttccaagtctttgctattgtgaatagtgccgcaataaacatacatgtgcatgtgtctttatagcatcatgatttatactcctttgggtatatacccagaaatggtatggctgggtcaaatggtatttctggttctagatccctgaggaatcgccacactgtcttccacaatggttgaactagtttacagtcccaccaacagtgtaaaagtgttcctatttctccacaccctttccagcatctgttgtttcctgactttttaatgatcaccattctaactggtgtgagatgttatctcattgtgcttttgatttgcatttctctaatgaccagtgatgattagctttttttcatatgcttgttggttgcatgaacgtcttcttttgagaggtgtctgttcatatcctttgcccactttttgatggggttgtttttttcctgtaaatctgtttaagctccttatagattctggatattagccctttgtcagagggatagattgcacaaattttcttccattctttgggttgcctgttcactctgatgatcgtttcttctgctgtgcagaagctctttagtttaattaggtcccatttgtcaattttggcttttgttgccattgcttttggtgttttagtcatgaagtctttgcccatgcctatggcctgaatggtattgcctaggttttcttccagggtttttatggttttaggccttacgtttaagtctttaatccatctacagttatttttttgtataaggtgtaaggaaggggtccagtttcagctttttacatatggctagccagttttcccaacaccatttattaaatagagaatcgtttctccattacttgtttttgtcaggtttgtcaaagataagatagttgtagatgtgtggcattatttctgaggcctctgttctgttccattggtctgtataactgttttggtaccagtattatgctgttttggttgctttagccttgtggtatagtttgaagtcaggtagcgtgatgccttcagctttggtctttttgcttagcattgtcttggctatacgggctcttttttggttccatatgaaatttaaagtagtttttttctaattctatgaagaaagtcaatggtagcttgatggggatagcactgaatctataaattactttgggcagtatggccattttcacgatatagattcttcctatccgtgagcatggagtgtttttccgtttgtttgtgtcctctcttatttctttgggcagtggtgtgcagttctccttgaagaggtccttcccatctcttgtaagttgtaatcctaggtattttattatctttgtagcaattatgaatgggagttcactcatgatttctctgtttatctgttattggtgtataggaatgcttgtgatttttgcacattcattttgtatcctgagactttgctgaatttgcttatcagcttaaggagattttggggtgagacaatggggttttctaaatatgcaatcatgtcacctgcaaacagaggcaagttgacttcttcttttcctatttaaataccctttatttctttctcttgcctgattgccctggccagaacttccaatactatgttgaataggagtggtgagagagggcctccctgtcttgtgcagttttcaaagggaatgcttccagcttttgcccactcagtatgatattggctgtgggtttgtcataaatagctcttattattttgagatacattccatcaatacctagtttattgcgagtttttagcaggaaggagtgttgaattttatcgacgcccttttctgcatctattgagataatggtgtggtttttgtcattgtttctgtttatgtgatggattacattttttgattggtgcatgttgatccagccttgcatcccagggatgaagctgacttgatcatggtggataagcttttgatgtgctgctggattcggtttgccagtattttattgaggatttttgcatcgatgttcatcagggatattggtctgaaattttctttttttgttgtgtctctgcctggttttggcaacaggatgatgctggcctcataaaatgggttagggaggagtccctctttttttattatttggaatagtttcagaaggaatggtaccagctcctctttgtacctctggtagaattcagctatgaatccatctggtcctggacttcttttggttggtagcctattaattactgcctcaatttcagcacttgttattggtctattcagtatttgacttcttcctggttttgtcttgggagggtgtgtgtgtccaggaatttattcatttcttttagattttctagtttatttgcatagaggtgtttatagtattctttaatggtagtttgtatttctgtgtgatcagtggtaatatcttctttatcattttttactgcatctgattcttctctctcttcttttttattaagtctggctagcagtctattttgttaatcttttcaaaaaatcagctcctagattcactgattttttgaagggtttttcgtgtctctatctccttcagttcggctcttagttatttcttgtcttctgccagcttttgtttgttcttgcttctctagttcttttaattgtgatgttagggtgtcaattttagatctttctcactttgtcctgtaggcattcagtgctataaattcacctcctctaaacactgctttagttgtgtctctgagattctggtacactatgtctttgttctcattggtttcaaagaacttacttatttctgccttaatttcattatttacccagtagtcattcaggagcaggttcttgaggttccctgtagttgtgtggttttgagtgagttttttaatcctgagttctaatttgattgcattgtggtctgagagactgtttgttatgatttgcattcttttgcatttgctgaagagtgttttacttccaattatgtcagttttaggataagtgtgatatggtgctgagaagaatgctgaagtccaacgttgatctggggtagagagttctgtagatgtctattaagtcagcttggtccagagctgagttcaagccctgaatatccttgttaattttctgtctcgctgttctgtctaatattgacagtggggtgttaaagtctccgactattattgtgtgggaatctaagtctctttttaggtctttaaggacttgctttatgaatctgggtgctcctgtattgggtgcctatatatttaagatagttagctcttcttgttgcattgatccctttaccattatgtaatgcccttcttgagtctttttttatctttgttggtttaaagtctgttttatcacagactaggattgcaacccttgcctttttttttttttttttttttttttttgctttccatttgcttggtaaatattcatccatccctttattttgagcctatgtgtgtctttgtacgcgacatgggtctcctgaatacagcacacagatgggtcttgactctatccaatttgccagtctgtgtcttttaattggggcatttagcccatttacatttaaggttaatattgttatgtgtgaagttgatcctgtcattatcatgccagctggttattttgcccgttagttgatgcagtttcttcatagtgtcaatggtctttacaatttgatatgtttttgcagtggctgttaccagtttttcctttccatatttagtgcttcctttaggagcccttgtaaggcaggcctagtggtgacaaaatctctcagtattcgcttgtctgtaaaggattttatttctccttcacttatgaagcttagtttggctggatatgaaattctgggttgaaaattcttttctttaagaatgttgaatattggcccccattctcttctggcttgtagggtttctgtagagagatctgctgttagactgatgggcttccctttgtgggtagctcgacctttctctctggctgcccttaatattttttccttcattccaaccttggtgaatctgattgtgtcttggggttgctctttttgaggagtatcttgtggtgttctctgtatttactgaatttgaatgttggcctgtcttgctaggttggggaagttctcctggataatatcctgaagtgttttccaacttggttccattctccccatcacttttaggtacaccaatcaaatgtaggttttgtctttccacatagccccatatttcttggaggctttgttcattccttttcattcttttttctctaatcttgtcttcatgctttatttcattaaatttgattttcaatctcttatatcctttcttccgcttgatcgatttgggtattgatactcgtgtatgcttaacaaagttcttgtgctgtgtttttcagttctatcaggtcatttatgttcttctctaaactggttattctagttagcaattcccttaaccttttttcaagtttcttagcttccttgcattgagttagaacatgctcctttagctcggaggagtttgttattacccaccttctgaagcctatttctgtcaatttgtcaaactcattctccatccagttatgttcccttgctggagaggagttgtgatcctttggaggagaagaggcattctggtttttggaattttcagcctttttgcactggtttttcctcatcttcatggatttatctacctttggtctttgatgctggtgacctttggatggggttttggtgcagacatcctttttgttgatgttgatgctattcctttctgtttgttagttttccttttaacagtcaggcacctctgctgcaggtctgctggagtttgctggaggtctacttcagaccatttgcctgggttaacaccagcagaggctggagaacagcaaagattgctgcctgttccttcctctggaagcttcgtcccagagtggcacccaccagttgccagccggagctctctcgtatgaggtgtctgtcgacccctgctgggaagtgtctcctagtcaggaggcacggggggtcagggacccacttgaggaagcagtctgtccctcagcagagctcaagtactgtgctgggagatccgctgctctctttagagccagcaggccagaacatttaagtctgctgaagctgcgcccacagctgccccttcccctaggtgctctgtcccagggagatgggagttttatctataagcccctgactggggctgcttcctttctttcagagatgctctgcccagagaggaggaatctagagaggcagtctggctacagtggctttacatctatatttttataagtataaaattagaagctaattagatataatgaatggtcaagtaaagtagacatattttcacatttacatccatttccaaattttgtgatactgagtttgtaaagaagtccaatttcgctatttgctgcatttgcttttcaacaaaaattgtatttagtattttcactaaactatgtaagagcacttagctcgttgataactttcatcaccattgtgaagctatacaagttataaactattttaaggcttttcccatcccaatttaggccttaattattactgtgcagaaaacattttgctgcagcaactgttcttagatgtctctaaatcaaaacagaagtcaggattcaggtgacagcaaataaaatttccaaaataataaaatatcaggtaaatataatctctcatctctcatcttctctccatctccctatgtccctttccttctctctctctctctctctctcacacacacacacacacacacacacacacacacacacacacacagagagagagacacacatgttcttcctctaaaaagaaaaaccaataatcctctactgagacagttgtgaatcaaaggtttcttctgcaggagttacatccatctctgaatttcctagagagcagcaaagggccttgtgttttattccccttccacacttaatcactggactgtgggcccagactgaatgagtagctcattagaatcactgagttcactgaggggatgagagattccttcctggctgggtgctaagtgatactcccataaggattttgtggttacaaaacgtgctggatatggaggtaacctgtctgggagtcctgtcactccaaggatcacttggaatgctctggaaaaacacatgacctggctgaatgagttctgttgaattgtttagcctacaccttcatttcagcagcttatactgcattaatgaggttattgttcctttgccgtccaattgttcccaagctgattttttgcatatatgttttacatccttaacaagaatgcctgtctcctgctgtttcagagtctcttccacagtgctgagcatgagtggagcttgctaaatcattgctaaatgaagcaatgggctgtaagcatgtcctgtgggatctgcatcttcagatcatcctgaagtactcaacaaccacatcttcttccaggaacagagcccaacataaactggtagggtttgctgtcttagacagctaagagaacgaggagtggagctagtgaacaagcagtgaagggggcagttccttaatgccatccgaactgaatttcaacagtctgacaagctagcgttttgggtaaatatcccagtatacttgtcacagagttaagtaaaatggacttccttcaaaggaagtgcttttaatacaataactgtttttgtttttttaaccaatggattaaaaatttaacacatttactaaatctggcatatttatatattgtatctaaacagatattcaagctgcattataatataatcataaaaaaactgatctcagtctgtctgttaagcctttgtgagtctttgtgccattgttggagtagtgctaattatcaagcaaagacatgataattacgcagagcttttttgctaaaagaaggaatctttttcaacacccacgcactgcacaatttcctatgaccctgtagcactactctggtatggcccagaaatttgtatttctgtgtaaaggctggaaattatattatttctatctctcccgataccttttcttcttgtgagtaaactgtttttagagggttaaggaagaggggtaatggtccaaatgggaaatataaaactaatgacccttcatgaaacatattatgctcctcattaaacttattcagttaaatgtattccattaaattaaaataaataggatttaaaattttacccaggagcagtaaacaatcttaacttttgactttatggtagatccattctaagaacgaattcaaatccctgatgtatcataggtctttgcctccagcacaatttatgtactagtgctgcagaggttttcaaatttagtgtgtctaagaattacttgggaacttttttttttttttttgagacggagtctcaccctgtcgcctgcgccagagtgcagtggcgcgatctcggcttgctgcaagctctccctcccgtgttcaggccattctcctgcctctcgagtaactgggactacaggccccctccaccacgctcggctaattttttggatttttagtagagacggggtttcaccatgttagccccgatgatcttgatctcctgacctcatgatgcgcctgccttggcctcccaaagtactgggattacaggtgtgagtcaccgtgcctggcctacttggggaactttttataaatgcaacttccaatccagattccctcttcaccaagtgtctcaagtatcctaatttcagtgatgcagcactttgaaaaatattccatgtgaagatgatgtaaattttatcaagcttagcggtcccatcttacttctttttccatgatctctgttattactaaaatgtggaaaagccaaatatgtgaagaatgcataattcagggagttgaacaggacggacccacaatgtgttagacttacatgttatgttcatccaaataattgagccatccaatctctagatttggcccaaaagcctcgaagtgtctttttgagagattcagagatttaatctattgatgttaacaagaaaatggaactggttctttactcctgttttacaagtattgcttttttaaaaattataatcttgcaaaagcactttcaaatccaatgccttcatttttgagatgagaaaacgtcagcccagagaggtacccaactcaccacactgcacaaaagtgcaagacaaggattcaaatgaaaaacaatgactcttaacccagtgctgtttttgtggcatttaaagaagtctgactttcaaatatccacctatcaaaaaatatgaagttttcatacaatatatgaagtgggtttttttgttgttgttgttgttaaacagacagggtcttgctctgtcactcaggctggagtgcagaggcacaatctaggctcactgaggccttgacctctcaggctcaagccatcttcccccttcagccccccaggtagctgggaccacacatgtgtgccaccatgcctggctaatttttgtattttttttgcagagacggagttttgccatgttacccaggctgctctcaaactcctgagctcaggcaatctgcccacctaggcctcccaaagtgttggcattataggtgtgagccaccacacctggccaatatatgaagttttaagttgccttcaagtcatataatatattcctaagaaaaaccctcagaagatgaatgttctaggttttaaactcctttaagaaagcaaattttagaagtcaacatattttccaattggctcattatggatctacagcatttcacatgacattaaggactagcagttccagtgtaatgataaattccaactcaaattcttttgttaccctgacttttgttataatggttttagtaatgagatggagtttttagtaaatagttgttttgttttctgaatttattttacataagtattagtgcacacacacaagcagtgttcaccttcatatttttgtactttcatatttatatgcaaataaaaaactatctgaaatgcataggtaaattttatcagtgatcctaaatttcaagatcaaggcaagcacacaattcaaattatcaatgaaaaactaaaataatgcatagtattttaagcacatatcaccctaggtctatttatcattcacttttgtttctctgaaattatttccttggcctcgttaaggcaaaaataaaatataataatcagctcaatacttttgaaaaactttcaaataaaaacaaagaaatgagaattagtcttagacaattgtaacaggtaaaagggagatggatgtgggaggcatattcatttgatcaggattagcactacatttttttacaatgtggaaccagtctaagcaatggcaagaatgacgtgtactctggcaaactggctcttgagtacatacttttgaaacacttattaattttcttttcattctgagaaagcaggcacaatctagggaagccagagtagacaaatagattaagaaaataggcagatgggaaccatccttattatacctcttcctttgttttgtagtcttaatcattgctcatgaagggtactacaaagtatttaaataggatcgatgctgaaaaggtttaaaatgttccagccaatgtaactaacctgcacaatgtgcacatgtaccctaaaacttaatgtataataaaaataaaataaaataaaataaaatgggaaaaaaaatgttccagccaaaactgtatggtatgttacttatgctaacacatctaaaacatttttgactttcagcatcatgcttatttattttgggcacaataaaacaattttttaaatctgacattgattaaacactgagctaacatttagaaattcattttcatctgatttctgattccatgtatattaacagttttcattgatatatataatgatataatttttaggaaaaaacatttctaggagaataattgcctttactcttccagcaagaaagcattcagaataatgagttacaaagaagagacataaatcgaaaaactgaaagtgtaaggttggggtgagttcatttttaaatacgttttttctttgatgatgccgggaaactattatatacctaaaataaatgatcagaagtgtctaaaatatggatgagctattccctggcaagagttcccaaccatggtgtcctgatacacagctgtggacaatgaccacttgccaaagatgaagcaaatagtttgacactggtacttgatttctagcaaagaccagatcttacatggtctctatcatcacatcactctaacttttgaaggggagagaaaaggtggagtaagagttgcgatagataataatcctgggtctatctatgggactatgaacatcttaagaaaaagaacatgatgtgtgtatgtgtgtgtggcagggggaggtccaaactcccctgcttgcggaggcttggggctcaccacgcatgctctctcacctccacgatgtctgagtttgtccggctctcatgcggctcgttgtactccgtgtacttgagaagcactttgtccatgtcggtgctggcatactggaacagcttgttggtgctgttgaagatgatcagcgcaatctcacagtcacacagcacgctcagctcataagccttcttcatcaacccaaatttcctctttgtaaatgtcacctagaaaaaagaaagcagccaagattttttaaaaaatattcatgcatgtgtggtttttttcttttcttttttcttttccttcacaaaacaatggtgtgtagttgtcagagccctgggcactaacacattcagaaagaaagcaaataaatctaatattaatttctgcttatcatttgaaaatgtgtgatttctagcttgctgctgaatgtgagactctaaatgcaagatttaatgtagggtattttaatgaaggtgaccagggaactggtcatgtttctttgagcaagttaagatttaaaaaaaaattaatttcagcatggttagcatatttcccaattaataattagtttggagcttgtttttgactatttgaagagtggacatgacattaggaacttagcattttagatctgtgttcaaacaagtcttaaaattgtctagtctcatgtcatttaattgaaaacacttgaagggatatgactgtgatctcagacgatgttgtattctgttttctagaaacccaacagggcactgggaagtccgttagccatcatatgcttagggttttggtttcattcttctgtgtatctttcttcttctctcaggtcagaaactgtattgttaatgccaccattttcttcttttaatctaatctattaccaagacccataattcctttcctcaaaatatttctcaggttcacactatttcccaggcaactctatcactgatgtccttatcacttcaattttggacagcctagcagcttcctgtcctcgatgatctccctgcctggaatcattccttcctcaatttaactcaaactgcaaagcctcactcttcctactgtctttttcctgatgagctgcctacaacagctccctctccctggctttgaaaacttcctacctgccaatcctaccaaatgcaaaaatacatttcactcttcccaatttcaactctcttttaattgaacttcagcttgttgctccagtctggctactgaaaaggcgtgaacattctttttttttttttttttttttttttttggagacggagtctcttataaacctttatatggtccagtgtttcccatctacagaatgaatacctgtttcccaacaggtattcattctgtagagtactgttcctataaaatactccttaagaaaaaagttcagtggcctaatatgtttggaaaaagaggcacattggtatatgaaaggctatgaaaccttttaaactttgtttaacttgcttttcgaacctattgctgacatatcgtttgtttctttgcatatttatttattttgaggagcacttactatcactcttcagaactaggtttttgaggcacatattctgggaaaagctaatttacttaattaagctactgttttcagaatgaatcatttaaacttttttcataccttcaaatccaacccaccttgcagagaggccagctcattttatcacagatttgtgtgtaattcctaattgcatattcctacccttcatctttctctttgtctccagacacccaatgcatgtcctccagttccacacctgtctaaacatcctggattctcaaaccttccaaagttcaacctcattatcttcagtctagaatctgcagccccttttggaatccccatctcaccataaactcagtcatccaaactagaaacctcagagagaactctgaatcctggcctgccaccttctcccactccccaccctcccccacaactaaatagatttatgttgacaaggactgtggactagcagacagaaagcctgacctcccagtctcctcattcctccacattttgttaattattgttttacttatcaccttttatttttccttcatgttacaatcacattttatattttcaaatatacaaaatatacacaaaaatataccaaatatatacaaaaatatgcaaaatatattttgtatataaaatatgcaaaataaaaaatacaaaactgtttatattttcctgtgtgatctgtttaacctctcttccactacagcgcatgctccacaagggtatatgccgtttttattttgctcactactttatccccagtgcttagaccagtagacatgtgtgggcacatggtaaaaatccatggtataaaaattgataggggaagctactatgtgaaatcttcagaaagatacaattgatgtatgtatatatgtgataaattttcccatgaaatttttttaacaactcatatgcaaaatgttttaacaatacatatattccttacttaataataattacactattttatcatatgacattgaaggtagtatggtagaaagcaaagaacatagggtttgtatttagagaactctgaatttgaatgccgaatttgctagtcatgcgaaattcacttaacaacttctcttttgtttgtttgttttttgagacagggtctccccgtctcctaggctggagtgtagcggtactagaatagctaactgcagcctccactttccagggtcaaaccatcctcccgcctcaacctccggagtagctggtactacaggcgtgcaccaacatgttctggctttatctttgtttgtatttatttttactagaaacgaggtttccctatgttacccaggctgttctcaaacttctgagctcaagcgatcctcccgcttaagcctttcaaagtgctaggattacaggcataagccaccgtgcctcgcctcactttaaataaagttctttgagtttgatttttcacatttgtaaaacagagatttatacctactcttaaggctgttgtgaggattgtatccaataatgtgtgtatagtattgagtataatgcttagagtaggtgctcaataaatattagttcccccaaatttcttagttgacttaaccaaaaaagaagaactagcaaaatatacttgtcttggtgacttgaagagtctaccagttatggctatttgaagatgttattatgactgatagaaagataaagctgtagtgaccatcgtttggaaaataaggcatttagatatttactagcccatatcaactagtcaatatttactcagttacgttatttacatttcaacttggataattcttctttcttgtaattgtcagtgtttttcaccttctatttcatctttattgattgtctttctaaagtacttctgaaaaaatatagctagtgttttattttcatatctgattatcatactactttagaaacttttattctgttttatgcagatgagtcataattgatattaaggatgggctgaaaaccatctttttggaatgaataaagaaacataatcattaattacacagagctgcactaaatgtcttttaatatttcttttagatccaattttgatatgaaaatgtacctgcatattggcattttacttagtgaaataggctacagaatacgttcaatacagaaggcactgacctagactactttcatatatctaaaaccacttttaatcagacttcatgaccacaagctatatgtggaatgtctcaatacagtatggtttctgttgtactcagacctcagaattttgcacgttacaacactcataatcaaagtacatttcagtacagaaatatcattaatgtcactatttgtgtttacttttagtgctcctcaatttttgtgtaaccaaataggctgctggataatgaatacttatttaataatacccatcaaagaagtcagtgcatatagcttcttctgcaatttaaaactgcaaactgaaatgatgactgtattaaagcacgtaagaaaatatcttcaaaatctactcttaattgctctaaatttaattctgcattatgttcatattcttcatagcattctcaaaatgtattttataatgctttttctcattgttcatagttagataaaattatttttaagcattaggctttctaaagagatctggaatataactcttcatttaaaatatgccactcaataacaaagatttcaattctgcgcttttatacttaaataatgccttgtgatggttacatttttcttaacttgataatagtttgtaatggggacaagtccatatttctttttaaataacatgtttggaaccttaggtgaggcagaaagaggtttttacagtagttaggcaaagagtctctcttttccagtatttacataagtcaacatgttatcaaattaaagagacttaatgtgtgatatagcatagaaagcagaactactctgtatgttttttattttatgtttttcctttatatttttgaatctttaaatagccccaaatgtgatgatggtatgttaagttttatagtggccctgacttttaaatcctagagtaaggacagataccatacatcttatgttgataatggctctagaacctattaggtgcgaaggaaaaacagaaattagaagttgaaattgagaaaagaaacattcattaaatatagcaccatacaaatcagttactaaaaatttaagaaagtctattcacaaaaaatataaaaataatttggccaagttttatggagcattttccgcatgtcaaacattatgctaagcaatatttattgaatattctctatgtcaggcatttgtgctaggtactgtggcttccattacataaaataatatctcccttgttcatatcagttccttgtggctggacaaaaaaaagtcatttaattccataacgtttaaaaggaattttctttatttggaacaaaatgcatgacttggccaacagagttatattttcagtcatatctaataatctgaattcgtatttttatttagagttgggtgaattcagtttttttttcagactaactttttctctggactgagctagaaaaataatagtagatgtaaattcagtcaagatgagtacgaaatgaaatctaccttactggttatttctaatcttgacttggtgaaagctgattgtggtattactcccatctctccttttccacctggccactggatgcacccatcacgctgtaagggttagtttaaatgccaacttctttctttgatgctttccttgtcacattcagataaaactcattcctttctcattgtagtcctccagcactttttacaaatctttattatgagacttactccagtattacaaagttggttgtatatgagttttcccttctgccagatttgaattccccaaagaccatccctcaggcctctcacagactctgaccagtggccactcaatgaacctttgctgaacgaatggattatggaatggaaatactccattttgaagtctgaatgtttcggtataattttatgttagagtagatgcttttttacttgccttttaaataatttaatctctcaaaaatagagattttggacacatatacctttattttactacaatgtttagcttattagtgacacaaatcttaagataaagtaattacactatcttggaatttataataaagaaggtaaatgatgtctggagaaaaatatatatgtaaatatgctgtagacttcaagaaaaatatacttcaaaaaattcagagaaaagtttttttcttttttatcccttgcctggataaaaaagatgaaagataaaaaagtctgaagataaaaatttaattttacaatcacaggatacagaaagaatggggaggatccatgggttcaggatgactgagtttgttcagcaaaaatgtactgaactttctgatgagttcagattttcaaagaataagcatttggaaaagtgatgaaatcctcatgcacaatttgagactggatggtagtaatttagctgatttaaatatggctgatgaactataattaatgaggccgacttaattgatcaatgttaagtttatcaaaaagtctctagtaaagtgccatagaattcagtacttttcccatcccaggagacatttttgtcattggtttagatgggtatataggaaggcaggcttatcagatctgcatgcaacgtaaatctgggtgcttgagcaaacccagtaggtgataagagtctatatccatagcgccttctacagcctttagaaagctgggtcacaatcaagatgaatcaaatgaaggtaattttaaagtccacattcatatttttaaaaaacaattacaaaagttcaggttggggataattaaggaattttgggaaaggatctaaagttttagcgttctatagtggtaattaattatcctactgatctttttgtttgtcagaaccatctttggtagcatattcagttctgagggtgacattttaagaaagcactgacaaaattagagcatctacaggatggtaaacagactgatgtagggtctgagaacaatctggcatgaggaaccattgaaagaatctggaatgtataactcagaaaaaaatagaattaaaagtgaaatgctaaacattttctaaggtctgaagcatatgtccatgcgaagaggcaaaattagtaagcattgttgaaaattagaaagagattcaaaacaagggaaaatctagtgatgagaacttcccaccaagcaggaagcagctcatttctgaatatgttcacatagagctgcatatcaaggaaggtgtagaaggggctcctgaattaagcaggaagttggactagagacctttaaaatatttattctaatttttagatgttcttaatctatgcctaagtatcatagggctttgagttaagagcaaatggcaatatggttcaccaagcatgcaccctacagaatctcctatgttttagttactcaatcccacccatacattatcgcctctaatttccatatttcaagaaataaaataactttttttgtagctagacgagacacaaaagactgtaaagaatttgagtagacaacattaaatgatgtactgaaaatgcacagaaaaataattatccagattgataaaacagcaaattcacattattaaagacattttaaagaaacaggatacatgcatcatgactggggcagtacaatgtagaaagaaaaacataaaaattgaaaaccaagtcccagctctgccttttatgagctgtgtgcccttgcgtaaaattgcttaacttaccggaaccccagtttcctcacctggaaagtggagataataacaggcatcatatagagttttgtgagaggtcaagtaagggatataataccagtgtaaataacttgttaactgtgaaacactttacaaagcaagtagtatcttctctgatgcaccaggcttagtcgctccttgaaacatactgtaaaagactggtctcctaggacctgtcagcttgtgttaccattatttacttaggtctagattagagtgtctctctcagctatatcctagtttttctcgagtacctgggccatcttttgctcattcttgtaacctgacaaccaataataatacttggctaaataaataaatgttgatagaatgaatagatatatggacagaggaattatagtgttttttgtaatccaaaatgaatagctgaaaataaatttctatggatgctcagactatgttaacaagaagtttgctactgagagagggaaatttcacatacttgttttattttatttttttgtcattttaacttacagtagaaacttacatttggtaaaattaatcaggagaaaaaactggacttggtcaaattttgtgtgtgggttggttggtgcaagtgaagcatatcagatttcttatattattttttagataacagtgttgcttatttgataattttttctaagaagttcaacgattttataattaattatctccctacattcgacagtatctctttgaacttattctttagcacagtttatcatccctatttttcagatgaataccgtaaacaaagacatgaatagccttatccaaggtccccagacttgttcctggatggactagaaaaccaaccctcttcacacaaagtgcatctttctttctgttagttagtgttccttccctcttttagataactatggattttaggggctgaagttcagctcaatatggacccagtcaactgtttattgagcagtatgcaggcactgtcatttgtaatgttacattaagaaccatcagaaattctgataagtgcaagcacagtaatgcataacattttaattaacgtaaggactgctttctaggttaaagtcaaaaaataatactaagaacactaaattgagagccagttggtttctaggttctgacagtaaatcaaagctacttttgtatagactctgcagccaactctgccctcagacgctccggccattcccactacagccactgagaaccacatgcatgcactagtgggcacaaactagttctatatttatggatgtttattttaatttcagaaaatgggaagaattttggttggtagtaaatacaggtctgcttacagctagaataaaaaaaggtggccctctgatttacacaggcaatgtaaataacaagttctaaaaacagagaaggagtcctgtatcatttcctacagggtagggaaattagtttgactactgtgaaatggaaagggcatttcataatctttctccactccacacgcctgccccctccctcaccctcccaggcccagccccattcataaagtcacctcagaagaactttcctgccattttaactgtggtaactgttcttgcaccttgcaggaaagagttctgaaagaaaaggacctttagaaacagcagctactcacatctataataataattgaggcccaactgcaaattgcctcagacatatcactaagggaagcaacaaaaatctgatctatgggtcccaaatacttctttccaccaaacacaatatttttagcctaatcttaattgaaccttacagtgctcaatgaatggataattttttatttttttattttcaccattctttaactcataaatagtagtttctttgttttaggatgtgtttgggattcgtatacccagctaattctattttcaaaggtttgaggtttgatcattttttttccctccaaataagagtcatgataaatataaccctcattatgtgaaaatatttcaggtcggctactccacctcatccccccacctagataatctctcagtttcctcccagttgaggaaacagaatgactaatgagtgacagatggacagttcacagatacaatacactctgtaatccaggagccacaggtcttcctatgtgtttaaagggttagggctggagtcaagagtctgcaacgacaatctttaattgggaaaaagggaaatgccctcctaaatgctctttctccacctcccttgttcctgacagtaagtaatggcacaaatgttctaaagtattcttcttcagttttattttgtttaattcagtctgtcattagaaaggctcgcgagctttaggcccgatgattactctcggtgggaggaagcagtgcctctgcagacttgtgttctagacaagcgttcctttatacaatgacggggcctgccatcgtaaatgaaaggctctttaaagagcagcgagggactcttttaagcagactgctaccacgtgcttgtaaccctccagcataacttgcgaggatgagacagcagtgtgttctgccgcaaaggggactattgtcctcgttagcctcaagcaaattgagcctccgtttcgctgaaatacagtagtatttccaaaggattttcaagcagtagttcctaaaattctgaacatgataaaaggattaaaataaggggcttagagtgtggaatttagaactctaccaacccctcaccctaagtcaacatcccaaatcccaaaataaaactccaaatcttatgcattggagggaaaataataaatcacagttagatctaaattaaataatcgaatgcacattaatgaaacgagtgtttattaacaaactcataaaagtttgagttttaaaatttgtgacagctgaattctgatgcatttgtctgcatgaggaaaaggaagaaggatgaccgaaaattgttaacttgatcaggatataagagattttactgtggcccattttaaggcctaggaatgttttgccttttgaaaagagaagactaacacagcaggcttcacattttttatatgggctgctcaagtctgcctggtttgttaaagggctaattttcattctaaatccaatctgtagatgcagtcataaaataaatacctttgtttctctgtatctcatctacataagagatataatttgaatctgagaagaatcaaataaaccagattaatattttgggggcaaaaacatgtttactagttcaacaaagccaaatgtacctaagggaaaggtcaaaggatacttcattccctgctgagcaaatgctcaggaagcacatttgtctacattttcctgtcataacaggaagagtgtaacttcttcctttccacaatagcctaggttttacctcctaactccaatattttctcccccagggccttccaaatcaatccttgcaagacagaaggctgtctcccttatagtttccaaacagttacatttgttgaaatgttatttaaatgttagtgatttctttagttaaactgttccaatttaaaattaaaagtcaaatttccaaacatttagactggttctctaattcttattaatggtccaacatatttcaaaagaaacacaaatacacattacatattatcaatttttaatttttttccttaatgatgtcatttacttaattttttaaaatttttgccaaagccattatcctcagaaaaaataagtttccaaactaccttcaacaagaatacattgggatgcaaactttaaaaataccctaataatttttgaagtagtttcattttgaactaaatgttaaagaagtgcagactgcagaggacatggcttttgaaacaattagcatcatgtcttttaatctacagtttggaagaaacttctcggtgtatgtagtctatttataatgttaatatttttagtgttggtttctcagtaatacaatgtcacacagtttgtgcatttgcaaagctaaaggtgacttgtagcagacagagtggtgtgtgcatgcattcccagaggtgaaaggggccattcagtatcaactttcttcacaaaatgagatacaataaataaaagcatcagattctttttaaattacagttttaagtagaaattatatgagatatacaaattagaactggaaacaataaaaacccttgaggccctcaagttcaaagaagagtgacagaattctagaagtgacaattattcttttccttatgaaaatgttggcctctctcagatttcctaccaaaggaaagtgaatgaatgagattgacgggagttggagcaatatctttctggcagtaaaggagtagatctagctgacataaatataaaatatcatgcaccgaacaggataaatagtaatatgtgtggcacactgttgctgtgatcctactacatggtggggagattatttgtgaattcttttcaaattgctaagggataaaatggaaatgaatggcctgaggccacagctgttaaacatacatctgagcattctgcctactgctttttttttttttttttttttttttaatttggaaactcttacaagtattatttaggtcattttcccttctggttttctttttcaactcttcaatcaccagcaattccaaatctttgaataaaaacttttcccttggtaattttaagattaataaaagaatgatttaacttatatgcatgaggagcttttaagaaggcatccccaatatgtggcaatagaccctataattcaattctgatgggtatgatgtcctaaaatattactatgacacacccttattttatttatatgaaataagtttagtataatttttaatacaagtgttggggaggcaggcatctgttaagaaatgatactaagaaaaaacaatcatcatcatcattattatgaggtatttgcaggcttattttggattaaaagataggaaaatcaataatttttcactgattgagctttttttcactaggtctgaaagagattccagatacttcttgattaacaagtataattcttctacagtatttaaagaaaaactcacaagtctggaaattctgtttgtggaggtggccaaaaaaagtgcatttagcagtggagactgcatcttccatctattctccaacttatggtttggaattcaccgaaaaattatttttttgaagcaattaatttgtatttctcaattatccagttactcacatttaaagagtgaatgtatctctctttcaacaaattttctattaggttattaagatgtaactcccaaatttagaactgtaattaacttgatgaaaaccaggaaaaagtaaggagtaaaattttttctttttaaagagtcacttgagggaatctatacatctctttttatttttcagtttagtgtcgaatagaccagatttagtttgaaaacacatcagtatgtagaaactgtcagaagctgcatctacactgaacacatttttccagcttttttcctagttcatcttatataatttataattcatatgaagagactgagatggggacataagaagagggaaagttagaaaatgtaacagctatgaactctgaattcttttagtcataaggggattctcctgttctattaacagaatgttgcaaattgtctttagtttgtgctccagttattgcactgataattacatgaagttttgtttgctggcaaaaactattagtgtgccagatctgatgaaagaaaagaaaacttaaggcatttaaatatatttctttcttaacttactattttaagccctaactgtgttatctgacaaatatttaaatgtctttttataacaagttgcacaaataaatttgggcttacctctcctatcctttcaaagtaggaaagctgaaattttcaaatacaaacatacaagtaaataggtttaggctaagcatgcctaatttttatatatctttcttcctaatataacagatttctaaatatattgtttgtagaaagagtcatataaggacaatattcatttaaaaactgttaaaggacccaaaattacagctaaataagacaaatgcattcaagtgttctatcccaccaaaggatgactacagttaatatatcttacagtttgaaatagctagaaggaggatattggaggtttccaagacaaagaaatgataaatgtttgagatgatggatatgctaactaccctgatttgatcactatacattatacatattaaaacatcactgtgcaccctatgaatacgtacaattatttgttaatttaaaaaattttaaacacaaaagaaatgaaacaagcacccccaaaaccatctgttcataaaaaccagtttgttgttgaactttttaaacctttgcatatatatgttactgtaaaatacaataaaagtgtcacagaaaaaaatctgtttcaggagcatgattaaaaattggtaccatgtgaaagagggtaagactgcctaactgatggaggtatttcaagggtaaaaaaaaaatgccgacggagagactgaaactgtagtgttagcataagctagaagctggtagtgataaaaatggtgaggagtagttaaaaataatttggtcagtaacatatatttgaaaacaggtcccacaagcataacatttaggaaacgacttctccccatccttgtcataaatcctctgcaaacgtcctgtgtgatctttccttcttgtccacaaactatcctctctgcatcagctcactcctgctctggtatcattctctagccccttgttggcttctgaaggctcctttgtgctcctgctctacctgttccacttttccatccatctcctcaatacccttttaaaataaaaccctcatgaaatgaaggtttaggtaacattctttattgtgctacacagtacaagagttgttttgatagaaatcacattaactataatagctaatggttcaaagagcctgagtcttaataggaatagctaataggtaaatttattgagcacttattatttggtgggtgctttacatttattgcttcatttaattgtcttaaagacctaatgagaaaggtactaactttttttcatcctcactctagtgatgagggtactgctgaagctcagagggtctaagtaacttgctagagggtcacatagctagtaagtggcagaactgggacaagaacgaagtttgtgtgtctctaaaaactatgcctcttagccatttgattatactggatgcagtataattgggaaaagtaatgacacaaaaccatgctcttagttattatattacactagatgcatcatgacataattttaaaaagcataatttgtttcgtgttgaatatgagagatccgggctcagatcttggtcacttcccagttttaactgtacaatcttgagccagttatttagaacttaacaggaccttcaaagctttgcgatatctgggtcctgtctaacatccaatcttttctctcatttctctacagtcatacaccaggcttaagtcccactgatcttccttcagctcctcagtcaagctctttcctctcttaaggaactttgcaaatactgcttctggaatgctgtcacctgcctaactctgaatcatcttttagctcatcttttagcacttcctcaggcctttctccaaccctgatgtaaataaagtacctcctattattctttcatagcacatataagtgaaatttttgttatatatttttatatttcatgtctgtttaactcaatcaggggtccataaactgtagcctacaagtgaaatccaaacgccctgtttttgtcagtaaagctttattggagcacagccacacaggttcatttacatactgcatacggctttcagactactagggcagagctgagtagttgagacaaaaactatatggctcacaaggctaaaaatatttgctatgtggtcctttacaggaaagctcgctgaacccctaaagcagaggataagctggatgagattcttgttcaccactgaatacttggtgttaggtacactgcagtctagtaatatttgttgatttcacagataaatgaattattcagccataaaatgggacttattaataaaaattatttgtaattatatatatatatatagttcttggcacataattggtaactacttttattaggttgtctgaaaatttctgtaagataaattaacaattcataatgttatttttacatacttgcttaagaaatccatgttgtctaagcttgaaactaagaaagaaatagtttttgtaaacttggaaatgccaaaaaatttttttaaataaaaaagctgtcaatttttattctcacctaaactattttacgtattgatgtttctgaatttgagctgtcaatttttattctcacctaaactatttcatgtattgatgtttctgaatttgagctgttccctacttccattatgaaagacagctaaagtaaaggtaaaattcaatttaaacagccattctatttcacaacagttttatttcttaatgatatacaacttataacatcagtgctgtaatatttcatttcacacttgaagtcagtatttctttttctggaaaaaacataacttattctgtgtatagctaaataaacaagtgcaatggcagagcagtctttgacaacttttaagaaaagatgacagtgagccattgcatgaggttctactggacagtctacagtggggcagcttcaaagagggcaaagcatttttctttgcaacatgtgaatacacagttgaaagaaagcccaggttacgggtgcctctacacagtatgatatgctgtttcggatttgctggttttgtttattagaagtgacctacataatttaggctctttcccaaatgactcttacaactgctctcatagtaggtgagaggtgcacaagacaagcatttatatgtaagatgtttgaaattgtcaacagcctctaaaataatcactgaaatatatattaaaacatggtggatttcaagtttactaattctgtttaaaagtattgaacttacaggcctactgtatctaaagactggagaaaagaataaatataccctaaattctaaagaataaaatcaagaaatctgtcttcagaatttaaaaaaatgataagtcaaactaagctgaatttaaataagttttcttcttctaaagttattatgacttctaacctggatgagggtaacagccactgtagctgcaactatatataaaaaaagaaaagatattcaattattagctcaaaagtgcgacattaagattctttgtttgtttgttttttgtttttttgagacagggtctcactctgttgcccaggttgaagtgtagtagtaacatgatcacggctcactgcagttttgacatctcgggtcctagtggtccccaagtggttgggaacacaggtgcatgccactaccacacccagttaatttttttttaactttttaaaataagagattgcatctccttatgttgcccaggctggtcttgaactcctgggctccagtgatctgcatctcaaagtgttgggattacaagcatgaactaccactcccggctttaaaattattgtatccctagaaatcctgtcatttgttacaacatgagtgaaactaactggaggacattatgttaagtgaaataagccaggcacagaaggacacattttgcatgttctcactcgtgtgggagctaaactttttttttttaaaaattgaactcactgagatagagagtagactgatggttactataggctgggaagggtagctgggcatggagtggggaggggataaagtggggatgtttaatggatacaaaaataggtaaaatgaataagatctagaatttggtagtacatagggtgactacagttaacaagaatttatcatatatttgaaagtaattaaaagagtagaattggaatgttcctaatacaaagaaatgataaatgcttgaggtaggtatacctcaattaccctgattttgatcactgcacattgtatacctgtatcaaaacatcacatgtattccatattatatacaactattatgtacccataattaaaaatagaaattaaaaaatcttgtatccctgttttttctaataaagcataataaaagctcatgaattcaacctgcaaaaattttcttctaactttgcaagcaaaagaagatataatgaatatcataaacctaaaaattatctggtattggtaataaagtgcaaatgctaattcatatgtttttgactatactcaaaataggttctggtccaaataacaaggtccaaacagtgttacatgacattcaatatttcagtcttaatttcaatttcaagctataggccaattaaaaaatagcggttttctattgacacaatgattgctctttggcttgatccacagcaagaaacgatgtgcatgaaaacactaaaggaatccaccataaatcttagtattattcaccctctagctaaacatgcagccaaaaatagttcaagttgtgtgtacctgaaaatatataataatttagaggagtataaacttgaaaacctaaaagtttctctactttttaatggcgtactgactttgatgcaagaaataattaattcctattcattatagtttacacatgaaacaacattacatttaaaaaaatgaatcaatcagttctagtcctatttgtatgtccaagaagacaaaacaggacaatagaggacatgagtgtctacatttgtggggaaattacagtctggtggttgtccccagggctactgtgtagccttcttcagtgtaaccgaaaagtaggcaaaacactcttctcttccacagtccagaaacgtcttctctgcaggttccatgatccatatgagatggttgggacccagcagtactataatttctcccaggaccattatttgatatttaacgttatacaaactacccagctgtccttacatagcctaactaaatccactctcccctagtgtgaagaaaaatagagtcaaattgcaggcattcatgatatacaagtctttaatgccaaactgagcatttgaatgtgtaaagtcttcacaacagattaattgtatcacacagacattatcattggcattctagaaaaaaattataacaccatctgcctctatgtttatcaaattcagatttaaaatggtatgaattaaccgatagtccttgcctatatgttttaagttattaatatcttgtgtgggtgttttctttgttgttgttgtcagcacaatgttaaaatgtttggatgtgtttcaaaatctcatttactatgaataaaatgaaagccattttcatacaggatatttatcctatattataaacctttaagtgaatgaccacaaaaggtctagttcccatgaatataagaatatctttgtttgatgatgcgtgcaatgtagcaatgttatgctgattaactcttaattatcaagctattcatgtcacacaactacacttcccatttcaaatttgtgttgaagtaaaaagtgaataatgacaaatgtgtaaactatgtttctgacagataaagtgatttttttctcctttatatataagagactatcagcactttaactggtcacatttaattaacccaaacttctcttaatagatatttacagattcaagatattttctgtacccttaacatatgtggagaaaatataattaataaataatgatacaaaaaaagtttactccactcacctgtctgttacgttcatccataatcctcgtaatctgaatcttttttctccccatagtccccgtttttcttctctctctcgtccctgaaattatgtattttttccttccttttctttctctttcctgtttcctccaaacaaatctccttcttcagcacttgcacagctcagttcccaaattcctgcattcgttcctgctgaacaaaaaagaaaaattaaataccactctaacagcaagtcagtttcataagaactatcatattctaattttatcaaggaaataaactatatggagctaaagcaataaaatgaataaaaataacttttttgttaaaaatatatggtatatcacagacaggagcagatcaagtagttttattttttaacaattaaaatgatctcataagtaatttaacaagtcatttaaatgatgcaaactatgcttttttaaagactaacacttgaaatgtatttttttttgtaaaaagtttcctaatctttttaatgaaattaggtgacaatttcacccgttatgaaaaattacctaaatcagagagttaatgaacctttatgtacctgtgtatgctaagtagggcagctaattcatttctgaagggaaaacaatctcctgttttgacagcagaggtgataacgtccctcgttatgcaaataggatggacgattatgaaagtgctatttgatatatgtaaatgtcaactaatttaaatctaaatcctttaatcttactttaaaaaaattattgctgtgagaacaccttaaaaataatatggaatatttaatcttagattacaagcatctatcagcagtgagatcttttctttttgaaagcccttaaactacatcttagataacaagaatcaaaaaagataagcattgacacaaaataaatggtgcaaaattaagattattcttcaatttataaccatattttttataacaagccatccttcctttaaatttaaatatttagaaacagacatatcatgtctttgtggagtaagatacaaaattgcagaagcttcacattacatactggagatctctgggtcaggaattaaaattagagaaatgatcatcaataacatgagataagcccaagaaacccagaatattaaaagtacatactttacttggttttaaattacatctgaaaatatttgaacacaacggaagttaattgctctgaaatgtgaaagttaacaagaaagcattccacaatgggtttttcaagcaacagctccaattattctacttcgttttaggtcaatgaatgcaacaactttacacactgctcagaatttccctgtttattttagctggtgtctgacaacggacctgataaattcccacatgtattatgtaatgctaagccaatgtcctggctatttaatagattgtttggctccaattcaaagttcttggaacaggaaggctgttacacattcggtctgaccattagctgtcttctgatttctttaatttaatttccaaattctttatcaccttgggtattttttttttttttagtttttggtgattatttaattgcagaagctattatgatataattacttctggtggattaagtgctgcttaaatactaagactatccattctcttttgcctcacgcctctctactaaactgcagctcagttctgcctctcataatatgtatgttgagtaacattatgaccacacagtgctcatcaaaaactattgctccagctgtaattttaaatgttggaggtggttcaaaattctaaagagttatagaaataacacacatttgacaaatacatataaaaatagttataacatattgaaatcacattaaaatatgaaaaacccacaaagcataattgcatcatatatttgatgttgctagacactgtccatctatttttagaaaacgtcttaaatgtcactcaatggggcaactttcctgtgtttcctatagtcttaccttagaagcaagcagtgtgttagaatggtatttcccatgcacgtttaagaccccaaagatacaaacaagctttctctatcacagaaagccaatccatgaatccacagcaaatgcatataggacaatttcctttcctttcatttagctgaggccggtggcactatcggcttacaggactatgcctgcctaagcgcttattcacttcaaggtggaaggtcagggtgagcagattagagtgtggtgataaggcagaagagacaagaacatctacagatcctgatttcaaaatacaaataaccaaacaagcagcaaaacatccttggagaaaagtctcagaaagacagagagagttcctgatgaaccaaacttaggagagttcctccatatcatcaccccatatttcacaactttgaatgagaccatttttaaaaagagcagagcaaggacttaaaaaaaaatttcttaaaacatgctggaaaaaaattttgccaaagagaatgtgtgtatgtatctatgtatatataagtggttgataaaaatgccattgaatatattttcttttttgaaatatgcaaagcaatgtagagagaagcaagtttaaatttcaatagaactaaacttttgttttctgtataaatatttcttgaggtattgccttcagaacatttctaaaatccaaaatttagtatgaagtacacgtgcagagtaatatgtggtgatgatgacactaagtaactggtcatgaagtaaagtctatcatgaaacgtggtttagaacatttgattatgggtcaccacatttcaaggctgtcactaaaaatttaaagaattaggaaggtcaacaatagctcacgcattgttttcttagcacaacattttctctaacctaatttttatgcaaaaactatattaaaaggtcagtttcaagtatcaatttgtaggaggcctagagaggcgaagaaagagattatttaactttagtaatctgtaaaactgttttgtgtgtatatgaaaaaggaatataacagctagcctacatgtagtaaaatttcaagttatgctgagaactttcattacgtacaatcaaccataagcttaaaataattccaacagccttgccactactttttttccacaggaaagaagcattcttagaaaatgacagagctacatataaataatcactaatttaaaaaaaaaaagatgaagaactgctctactatagttacactctatagaattacagtcttctgcattttttttttctaaagaaaaaatgccaacccagataaaagaaaactaaaatgaggctgcttactaaaaaggggaacttcattatggcaggcttctgctcattttgagtttggcataagcaggcagatgaaggcaaagtggtttgagacccaagtcgagaagaatttcttctggacagatgctaaagatcattctcccactgggctatctcatttacaaacaagttcccttgagtgacacatacctcccccctccatttccctcctccctccctcactctttcttgccctcttcctccctccttccctcctacaaatctctcccagtagcacagaagaattttgacagaatggcaggaaacacgcacacagactggtcagggaaggatatgatgtcagcaaccacgaacaataaaaggtgtaaaggtgcttccttccctaaactgttccagaagtgtaaaatgggaaccaaaactctccacttccttctctgagcagaaccgtctgagtgtgctgtgctgcacaccccacacacagaggccttggagaggttcagataagggacaatgaggacaattcagaccgggagcgtgatttttaatttccatctttaaaacacctgagaaaaattcatgtcagctctaggttagtgttttattatgattgctttaagaaatgaaaataagaaaacaaacacattgacttcattgaaatagcagatatatctcagttattgtttaccaggccttacaaaagtcatcgtacacagttaatgcagtcatataattggaatttaccctttgaggcaaatgaaaaatatgcaagcaaagaaccaaaatagatacattaaaacttttggttaaaaaaaagaattatgaaaaccggcaaaaaaaaaatcaatgcatgctggtaaaatatgctaatcatttgtttgctcccacattaaaaaaaaaaaaaagatatactgagggggaaaagattcttatggttattgagtttctcgaggttctttaaaaaaattcaaactaggaaccaaagtgaataacacaaactctgcatctatagtgaaactatttaatctcctcactattaggttctttctaacatggaaatggcattctacataaggtttctgtaggaagaaaaccacatatcaagcgtatctgagtcatcatcagatttcaatcatcttcccacaacactttgatttagaagttaaacataaccttcagttatgtgttttgatcttagagtgaaactgccatgccacattaaaagatgtgggaagaaattaattctcttctgctaaacttatctttgcaaagcatgtatttttctgcaataagtacaatgcagtcacttaaataaaaacagcctatgaataatggtaaaacattgaaatatgtgatgtcaattttcaaaaaaaaattccggttttctttgattcatattagcagatctttttgattgacttacattttcactaacactagtatcctcaaataatgttttgtaaaaactcaaagctgaaaactgagcacactctatcacacaacactaaataatactgttaaataaatacaagctggatacatcgtaaggggcaaaaatgatcataagcccagttgctgcaaacctagtattgctaaatcaaataattaaatgattcattatctttttaagtggaaaactttgctcaatatgttacatctagttacatttaggtttctattttgtgatttgtttgataaaatgtatgaagcatgcaattatattttggttaaaaggaacaggcagaacttttactttttttccattaggagctattctgaacttcaaaaggtataaccaaattactactcctattgatgctcgactgcgtgatgtcttgagttgaggaggatttctttggccttgaaagttgctccatttctctctaagcttaccatgtattttataaatataccattaccttagctatgagtgcattctgagtttatttccaaatcacatacccaagactcactcttctaagggtaataaaagaacagctattcttttccactagataaataccatcatgccatatgccaatttattttcctaatttattccaatttagtatcaatatgaatttcaaaccatcttcaagtctcagtaacatagtaccacatatacaaataatgttgaccatcttttccatttcctcacatctgccatgctccttcctgccactaggcctttgtgtactaggcaattctttctgcctggatgttcctcctttccttttgtacctccttgacttctcctcccttctgtctcagcttcagtttcacctcctcaggaagtactccacgccctcctgatgacatcgaatttccctctcataagatctaagcactgagtccttctcctttgcagcactcgcagcaattgaaactgtatgtttgcttgtcttcctcaacatctgttttatttgtttgtttcaccgttttatccacaatatataccctagtgtcaaacatatagaaagagctaatgactattcgttgactgacaatcagttaagatgtgtatctctcaactgacgtattttcttttcttcagcttctacttttactgactactactaaaaatattttactatttttgcttacacagaagcagattgataacctcacttaatacttcgccatatttacatagcatctcctatgtggaattagaataattgatactgagaattggaagttaaatggattttggggtcagaaaaaacagggttagaattctagcttggtacttggacgctgtgtgactccagactgattatttaatcccttggaactgttgtttccttgccctacccataactgggaaaaaaatcttcatttgtaggatggttatgatcataacatgtggtactatatgtgaatcctgggtacacagtagtactgggaacatggcctgctgctcgtatgattgcttccgtttgaaggcataaagtgaaagtcctatcatatagtaatgctatcaagtgaatagtgtagtccttacatttaccatgaagatctcactttccaaagctaatgattagcaattctgacagataatgcctcatttatcctgtaacaataatcaccaaatgaagaataaatttacagtgttaaaaaaattaagaagtttctcttacatatcagctacggaagagcttcaggctgcaaaagtggaaataactagggaaatacatcaattttccccatgaccacggctgctgaaaactctacattaatgcttctagtcctactttaatatctttccccaaggacaaaaagagatgaaatgtatgtcagaaatataataaggctaaaaaggaactcgttttcttaacccctgcaattaatttaataagtgggcctaacctgccattatccctgacatacatcattttatttacacagttccagaatttaggagacacatacctttatacaattgtattgcattataaacaatttaataactgtgagggaagcacagtctccctgtcatagttatccatggtctattttgtcttggacacttttttcacactgcagctaaaatagcattctctattcccatgccaaaataaactccaaatggtctaaatatgtgaagaaccttgtgctatccaaccctaccacagcttttagtctttccacatcatattaggtaattaattcagggttctatcatgtctttgtttttctaatttttcacaacagtgcagccaccatgttttctttcaaaggcctctgagtgatgtggtagggctcaccacaaaggtaaagcctgcactgtcttatgacaaagcaagagctacaatttaacatcagattgtgttctgttccccagctctaacctctcagtaagcacatgcagctggatttttgttgctgttattgaacaaagcaagttaagcactatacaacatcaacctcagtcaaacaaaatagtctgtaaagcaagctaggctagaagttggagatgttgctattatagattttcatgctattatgataaaaacatctaaattcccaggcatctcatgaccctgttagaaaaaaattatgttcgttatattcttcatctttaatatatcatatttcacgattaaaatggaaatactctaaaaatatttttctcatatgcctataagtgttgaacacatatttcagtcttactgatacatttgtgcatgtgtgcacatgtgtgcacagcacatggaaaaacacattttagtctgtcgaaatgtgtaaataaaacaataagagtacattttaagacacctgagttgtcttgagtattatcaccagtaaataatcacaatattattaagatcgtggtgtgaatgcctaaaaggacgttctcagtaaaagctttattttactctgcattcaaatattatgttaaatgattgaaaattatgtccttgaaaataatttgcttctttcattatttattttccaatttacttaacatttaaagatgaccttgaaatgggaagaaataccattgtccccctgccaatgtttttgttgtacattaaagagaaaatgctagataaatcatctgttatttaagtggaatgtcatttatttttatctctaaaccttcacatttagaaggtttacacagaaactttacatgctcaaatatgtgatgttcaaaatgctataatactatctctcaaaatatatatgatattgctattatatgtggctcaacatggaactcagtgattcatcaatttttctatttctcttcatctcttttacagcatcctaatcaacctaattaaggctttgttcatctgaaacctctgatgacaatttgtttaactctatcccactgtggtcttcttataaggagaattaaatctgatcttctgacagcaatcattaaatgatcccaactggccccaattaaaccacatggctcatgggcttccatacagtcaagtgccaagttctctgtttcattcacacattgttcttggtttattttcttaaagccagttaagcatgtgtcttatcaagtggaactaaatttccttatgtacattagctccagacacagtgtgtcaattgactgcacaccaaagtatcacataggacttctgaagccattctatacagctgcagaggtactagcgaaaaagaatctttacatttatttactcatcctgaaatggacccacatgtacattctcgaaataatacacgtgtttaaacagttctggctaacataaatcaataataacttttatttggcttgcttataatgatcttttaatagaaattctctgcatttagaagttgggcttaatattctattttttttttaacatttgaaattatctctttacctccctctaaaaaagcagtaccaaagtaagacttctgaagttaacctttcttacccttaatttctgctctaattttttcacatatgcccaattgtaagttctgtaatgatgttcccaggccttcctacaagcgcaggtagcctcaggatttagagctcattgattgtgtgctactccagggaaatgactgattaaaaacagcctcatgaggaggagtagctcctattcacatctggctcatctgattctaaagtctaatacctgtatgaagatttgatccatagatttagattttgaacaactgcagcagtttacctagaatattttgatgtcaaagcagaaacagttaaattaatcccactatgactggtgtctgacacaggttctgaaggctttaatcaattaccctactttcttgtgaatataaacaaatacactgtatttatatatatatgctaattatggctatcactgatcatctgctggtacttgatgcaggctgtcacagttctcagagcagatggattagaacatatctgttcatcctaatcatacattaaaaactgttagagaattgaaatacatgctatgcatcttataggacattagccttgatgggacatgtaattgttcttatgactcaaccaacagatgttaactgcaaagaaaaatgaaaatacaatggaatttttaacatagtgataaatttggtaatgccaggaaaaacattatgtgcattttctttatgataattaaatatatacctgatcatctattcacttaataactgtatccctctcaagaggaaaattcaaaatatttgttacaaaatgctgatgatatagaaaatacttaccagccttacaactgactgacttttaaaaatgtgtaataaatgtactaaaattttagcaaagcagtacagacactggatgttgaattatgaaatatttctcatgtattatagtaatctccaataagatttgatgttaattttagagcatgcttctgctaaaaagggcaaaccctgcaacagatttagtacaaagaagctgaaaatatcctgtggaaaaaaaaatctgtagagaaatcagccagcccaaatcctgccattactcagcactgtagtgacgtgcggatgtttgtagtggtttgaggagccagcaggggtggaaactctacgtactcgactccaacatgattgcaattgaacctcatcaaagtaagagctcataatttgtcacagaaaacagccaattaacatatgttagaaaaaggcttcataaagataatatatgattaaagacccagtgcagctgctgaaaatcaaaactatgcatttaaaaaagaaatctcagcctgagcttccgtatggttaaactgataatggctactacgattttttttaagtagaaaaatataattatagtgcttcttataagtttggggttatggcaagggagaactgggtactgtggcactatttactattccttacttagttctataaatagttgaagcccttgccaaaactctgtagttactttgttatagtgctattttaaaacacagaccttcattgtgagctaaatggccttcaggatgcactttgtagttatagcattcctctcaaaactatatcctccctttatctgtgcaaaactccagaacaagagacctctccatgactgccctggctcactgtaaaacatgctggggctgtgtaacacactgttcgaatacttcagaacttctctcagggtggtgggcaggcagggtgacagttaaatgtcagaaatgagattaaggcacacacatggagttcaggtcctctaacagaatgcagtccacgctacctgccacagctttggagcagaccaattacatgtaacatacttggtgtattctgattgtagatttcaggttggagtacatgggaatcaaaccctggctaagtcactgtaatggggtataccatgagccaaaatcatgatgcttaatatcacagatatcaatgacaaaattcaatcagtcacagagacatgaagttgtcaagcatgatgctacgtgccatggacaccactgaaaacaaaacagaaggtctcagtcttcatgaagcttacgttctaaggggaaaaagggcaacacacaagtgcaccaatatgatgattttaaatacagaagtgctatagagaaaatatcgcagtggaatggaccaaggggtgatgaagtggagaagggcagaggtggctatctattgggctgatttatagggaggggttatttgaggagatgacgtttgaggaaagccctaatccacaatggagtcagacattatttggaggatgaatactccgtcactgtgcctgtcactggtggtacaagcctggccaagtcatagttttctaaaccccagtctctttctctatagagtgggaatagtaacaacatacacattctattatgaggttgtgaggctcaaataaaagacaaaaccacactcatttgtaaaaattcagatggatacaactcaatttcatacactaattgtgtaaacttgcttccttcactgatattatataattttataaaaattgtaaatactttgaagctctaggaatatagcataatgcaaaatgtttctaaattgacatcaattgagtccaaaagcatccctcttcccttgaaatgtgagtatttcatgatggcaatggccactggttgaaacacctcttttcatttcacaatgctaactatggataacaccatgaagaatctgataaatacaatgcaaaatttctgcaagtgtaaaatatagaattatataaaaatcacactttttaaaatttgagaaaaaaacaatcttacaaccgtactaatgtaacttgtcagtgggctaggttgatttatttcatctctcaaaggacccaactcccaagtaatcagcagagctttgattaagatgtcagcagtatttgaaaatcccagtgtctcacagtattggaaatattcatgtatctttggacatccccacctatagattaagctgtgtagcctcaagcccaacagattaatttccaacttggaatgaatagacaaattgaattatctagtattttaaatgaaagcgtttttaagaaaaaaatacaggcctggcgcagtggctcatgcctgtaatcccagcactttgagaggccgaggcatgtggatcacctgagttcaggagttcgagaccagcctagcctacatggtgaaatcccgtctctactaaaaatacaaaaagttagccaggtgtggtggtgggtgcctgtaattccagctgctcgggaggctgagacaggagaatcactttaacctgggaagcagaggttgcaatgagctgaggttgcaccattgcactccagcctgggcaacaagagagaaactccatcttaaaaaaaaaaaaaaaaaaggaaggattataaattctaataaatagaaaattaaaggacaacaggctcccactttaatttttaaggttgtgaaacagaaatgcctaatgacaaatgatagtattttaaggaaaggtcaaaatttcctatgccttaaggaattaggggtatatattttcaattctccctcctcttttttggaggaagttataaatagatttgattctctattccaaaccatttcttctaatttcctgtttggtgaacataatttatcagttttaaaatagggtaagttatataatttaccatgaagcctaaatgaacacttatcgattttcatttacaatcaatcaaatgccctacaaaagaaacataaatctgaaagttttttaaaaataaaaactatatttttcttttctaaatgtatcatggtatagatattataacaaaaaattgcatttgattttcttctcagtgctaaccaatatttcacattgcattctcacctccctccctgtctatctagtaggatgacctctgggatacatttgcttcaccctccaaaacccagtcatgactgcatacaaaccagacatggaaatatgagtttctcctctctacttgtagcattccccactccagtttttcatttcatcacctttctttatctctttttccacatgtttggaactgaggggatatggaaagtgaaactgtcaaagagctaggaatagaggtgttctcagacgagcaaaatgtttcctccatacaatccaggcagggcaaggacaggcacgctgcagagggatgttgccctgggccagagtgagctgagacagtttctaggccgaaggcctagcaggaggctccttatctcagcatgtctacacattctgtcccaggctgttttcaaggatagcccaagtcatcctcggcagataacactaaacggaaagtattacagtgcttcccctgtaaaaaagatcaggtactatagatcagaagttactaaaatggatcctattttagcctgattctctcaaacctagactctaaaagaaagcactctcgggtggaggcaagctcacgactttcctttccttagagatcccaaagtgcctaaattagcattccccaaagtggattccagagattactggttcctaagattttaacaagctgtttctcaaaaaaaaaaaaaaaaaaaaaagtcaggaaatcaaatcaaatatatttggaaaactgatttatttgttataggacttttcatattcttctacatgctgaatgtcataatctggactatttcccaatatatttcagatatcccttggaaatgctagctttaaagaaaataacaagcttcttcccattgaccaatgaatacactgcagtgctgaaatacttcagaccaatacttggctcagtgcttggcacaaggaaaatacaatagtattgctgaagacatgataaaacaatggaaaacttttttttttcagttttataaaaaaagtgcaaacataagatcaggtgcagaaaattgctgttcacttgaagtaaaagtattaataaattattttgccattaaagagtgcaatttgtttccaaaccgcaaagcactaagcgcaaagcaatactgcacagtggaaagaaagctccatttggagtcagactctcagttgggttcgctagctgcatatctttgggccagtcaacttctttaagtctcattatcctcagacataaaaagggagccgggttcagtctctaagacccctttcaagttcctaaatggtatgcattcaataaaggaggaaaacaaaacaaaacaaaacaaaaatgagggttggaatgattctcacaaaagtatcatcctacagaaacaataaattgacaagttattgtttggataaatagaattgttttcttccatattttaaaatattgaaggatatgttcacctcagcctcaagcaatataaacagttaagactaaggtttcattatgcactttggaccactaatcacatttagaagtttaataaatacataatagctaggaaaatactaaggtattaaaagctttacatatattaactctaatcctcaaaacagcctatgaggaaggcactattacaatttccattttacagaaaagaaggctggaggacagagtggttaagtaacttacccaaggtcacacagctagtgttagagctataatcaatatcaatatatcaatataccaatattggatcaatatatcaatccagtctcacactcagagaatcgaatcacatactctgttacttctctatgctgctaagtaatattcaagggagtacttaaaacttaaaattctatgtagaaaatgtgatgttcaggagttggtggaatctacaaattatttttaaaatgagtgttcttcaactcatctcacattttcttattcttgatggcaaaaatgagtttacttccctgtgccagcaggggaatagaatgtaagttagatatttgtctttactattataatttactggatgatcatcagcagctgtttttggtttttttttttctactttctacaaatgaatgtgttcacaaggaaaaccaggtaaatgtatactgtataaatcagtatatattcttcacaattcccggaaaaagaaacccaaaagaattgtcttcctgataatgggtcaggagagtcattttcacttatgatgaagttaagaattacacagaattctcatctgagaattacagatgagaattacacagatatctcatccccaaagcttgaagcagtcattttgctttccttcaaagtaccttgagtaggtttctaaaacacacctaaccagctctggtatgaccctggccattatccttaccctcctccccttgccactcctctttttccttctcgttatgctctttctctttcttctccttatctcctcaaattatggtctactacaaatccttctatttacagggaagtttccacttcaaaattttatacagttacctacttcttcagaatactttgtgttttagagctctgagtttaattgtgcaattcaagctctttaggtacattattttagaaggaattttacggctttcaactttataagacacacgcctaataaaatatactaattgtataagaacagctgacataattggcgatatatttataattgttggaaaatactgcacattttggtgcattatagaagttaacatgacagttttttcacaatgtattgtgtagccttgctctatcagagcctacagcatgaggaagtaatcgtgtgtgtatatatatattcagcatttgtcagacttttttcctactttcataggcagaacaccatgtacctatgtttgtacatatatagtacatctatattcacttacataattatatatgttattgtagtagttgatgagaacaggtcagaaccattcaaaaactccataaggcaacaacgccacattatctctctctctctctctctctctctctctctctatctatctatctctacctacctacctatgtaagactgacttcaatttcagatgctaggcagttgatggtgcaaagcgaatgctcaaaatggctgcttctatatcccatgcactccaagaggacttctggtaaacaggaaatctctgagatttgtaattcagtaagaacgaatctgttggcaaatactgcctttcaaagtgaagacacctctaggataatttttatgtccgtgtccctcaggtatgtttgtgggtccagtaataagtgttctgaaaaggaaagagtgtgcatattactcttatatgctaaaaaagcggacatttccatcaagtaactagttcacataccaaattattatttggtcacaatcctgaggattctaactttcaaaattatataagagtatttgtcttttgtatcgtatgaaatagaaaaacaataagcataacaaaacctctaccaagtccctttgaaataaattagttaatatgaatattttgtgtttcactaaatttactatggagaattccagaatggacttggaaatttcaactgccttaaaatgaatctttatgaaaatgataaattttgccatgtcaaaaaagagaaaaaaatcttttcttttggttagaaatacatatttgtattttccattcatctaaggtaagagtagaaacaccggatattaatattggcaagagttatgcaaggtcatatcatttttccctccttcagataataccgtacccaaattatttcacaaagattccacctctcctatttttaaggccttccggaaaaggagcaacataaccttcctcagtatcctattttgatgtttcacaactctcactctcaggaaattcttacttatagctaatccctcacagaatactttatgtccactcctcttgttctgtcctttgtacagagaacaacatttggtgatcacgtcctcatgtcatacacttcaatattgtgtattgctttatgtctgttcttttaatctttccttacgctggtttttattttttcgccatctttgcagctcatcatttcacatcagatttgcctagatctctggagtccaaaaatatacatagtccttgaaaagtgcttttgttgtatattcttatcaaataaatatttttatttatccacactctgcatgaattttaaagtaaatgtttaccttttcacttatttcaattttgtaatttttcccttgccagatttgtttctagccaactcttccacattttgtatttagagagtttgtttttttttctccttggcttcaagacttctgaccacttctctagtttaccaaggttatgctgaattcctatctttcaagggccagacctcaagcactctttatacaggatttgttagcatttaaaatgtaatgactaaattatttaattcactattcctttagctaccattaaaatctgtgtgtggtttagatgatattttcccaatttatggatgaggatgtcatatggaagaaaatcaaaagccttagaaagttgaaattatacctatcctttttccttcacactttattaacaaagatgaaaatattctcatagcaccagttcttatatgatgctatgttgcttaatactcacgccctgaacttttaaagataaataacacatggatttcatggcaatatttccttgtacacttttaagtctgcaaataagagagttactaattgtggttcccagcgtcatccttcatttaagaaatgttatcagtgtgatagttaactcctagtctttactcaaaaattcttaagactaacagcctatggccccgtaatgccattatgttaaaatagttcctgctactgaaatgatcttagggccgggcactgtggctcacacctgcactccctgaactttgggaggctgaggcagatggatcacttgagcccagttcgagaccagtctgggcaacatggtgagaccctgcctctacaaaaaatttaaaaattaagtgggtgtggtggcgcatgcctggagtaccagctactcaggaagctgagatcagaggatcgtttgagcccaggagtttcaggctgcagtgagatgtggttgcacaactgcacctcagcctggatgatggaataaaactttgtctcaaaaaaaaaaaaaaaaagaagaaaaaaagaagcaaagaaaaaaaaatgatcttaggctttagtcaaacctttccaggaggagttccatgaaatttgttttgtttcttagtatcaatggattccataagtcacacatacttgtattacatttcatgtatgtggctacaagcatgtgttcatttcgctgcataataaaggtgaaaaataaagcaaagaagcatttcatttattccttcactcaacaatttttttctgagtcactactatgttcaaggcactattctatgtaatatgtcagggaataaaacagacaaaatttcatgccctggtggaacgtacacactcctgatagcacattaaaaatgggctacgttttattttatcttttgttgttgcttttggttaaacaaattcataaaaatcatcttttaattttgattctccttatccaactttaagccttatttcttagaacttttatttttatactatttgaaatttctcctattctcataatacattcagatttccattcctcatacagatctttctttagtcaaccagatacttctttttaaggcttgtgatttctgatgaagtgttctttgaccatttgtgcaatcctctatgctacatagtatattttataagaaatatcttgtaatatttacaagttctttgaaatctgatccattaaaattcatctttcctattgttggcttcttcagatctttaattcctacctgtatttgggtgctacaatattaagaatccggccaatcaccaggtttgatgaaaactaaactaattaattaataatattttcctagctttactgaaagaaaaaaaatctagtaaaacaagaaagctaactcactttcatgttttctgatattacatgtctgtggaatctgtgactgtaatatttagatatttctattatatgaggatgaaagcaagtaatcaatgactctctaacatataataaaagatagtggattagaaacagtgccattacaaacgtcaacaatatggaaaaaaaaaaagagaaattatacagtgaaaaaaaatttcctgagaattcattcaacagccacaaagttacagtaaataaagaaatgggaaatactgtgatagtttccttgtcataattttaactttcattaagtatgttgaaaaaattcgcagtaggaaaaaggtgagataaaggagaaaacccctcttatgtgtagctagatgtctgccagtatgtcaacttcctagatacatttttcatgtgcttatgagaatctaaataataataatcttctttaaaaatatgacattctgggttaggatctcaataatttgtgaagaaaaacaactttttcttttccagaatccttgaaattaagcgtgggttctattctggaacagtgaaatgtctggactggagagggcacgtgatgatgctgaccacaaccatctccccagagaaacacactgcccctccttcagtcctgctctagaaggagaaggagggtatgacagacagagatcatcagtggctactgattgggagctacaaaagacggagttattttggaacatcctgatatttagggggtggtatcttgtcaaccctaacgtttttcctatctcatttttgggagggatgaagggctttataaaaatctctctagttatatgtgtattttgcttgcttttttttttttttaattctatggtaaaaaaaaaagcatttctatttctatttgggtatcttactccattatccatgtgagatggatagacatgttacatcacgtaaaatattgtttgtgtgttatttaaatttggttccccccaaaaaaaaccctcaaaggtgaaccaacaaattgttgaaattaagctaaaaaaatcaatctatctttggaattctattgagacattgcaaaaatgaggcagaccaattattaggcagacaatttatgttacacaattacatttaaactacatttttcatgtgtctgaaattcaagttttataccttattcattttttctaagactcaatttctccacaacaaagtgagaggtgttaactatgtaatatatatgtttcttctatttctaattaaaatttttattagctatgatctattgaaacaaatatctatgactttctctaatccagaaaattatcatgttaacagattctatttcaagttggaaacacagaagaaaaaaatctgaagaaataaatttgaaaattggcaacaacgtcttaatttgtgtttgattgtttgttcctgtgaaactttttttttttttttttttgagacggagtcttgctgctctgtcacccaggctggagtgcagtggtgcaatctcggctcaccgcaacctctgcctcctgggttcaagcgattctcctgcctcagcctcctgagtaactgggactacaggtgcgcaccaccacgcctggataatttttttgtatttttagtagagacggggtttcaccatgttggccatgatgatcttgatctcctgacctcgtgatccaccagcctgggcttcccaaagtgctgggattacaggcatgagccatcgcacccctgcgaaacaattttaaatcatcctagtaaaagtggtaaaatttaatgagcatgccccaggcatgttatttctatatttcaattggaccttaatctcaggcaaattcgtaatctcatgattatacttcatattatatttctgttgaggaaatcaaggcattgaaaaaatgcacaacttgtccaactctatactgcaagtaagcaacaaaattgggttttgagataagggaggctgactccagagtccaagttctcaaaaaggcctaaggaaatatttttatcatgttgttttaaaatattatatgtcaaagtccgaaatcagttgacagtgacatacatatatcaaattcaagtacaaccacgatcagagcttttatctaaaaatacacctcgaagtttatttcttattagattagagaagggtttttgttttgtttctgcttggttttttgttaccactctttgaaaactgggaaaatatactgctatttgtagttttaacacagtacaccaaaaatactaagtaaatctaactttttctctgattcaaattatatttcttaatgcacttctatttaaagtcattccaaaaacaactcttttcctcatggttaaaattttaaatagtgttatagtataccagcaagtatttacttacaacttataactagggataagatatctctaattttccatttggtgtatgtcagtaatgtaaacataattaggaactctgactatatagattaacttgacaatgaattggaaaaatgtgctgctaaaggttaaatttatagaggaattggtgagaaatgccgtgttctgcaatttattgaacatgtcttatctaataaatgtctatgcctttcttatcaaatgattcttaagagttctgtgtatgaaaatagttcaccttgtgcatttaaaattacccattgattgtaagcaactttttaatactttacaatagataggatactaaaaaacgtcaaggaccagtgaacctgttttaattccatgttaattaatttgaactgcatgtaaaagttgaagccagaatgaacattacaaataacgaacgcttaactgcaactgtcatatcctcccgtgtcaatggtgcctataattgctgttgtcaacagctgcttcaaattgccaaaagaccccagaaacaattcaggaaggaaaagtttttaaatggatccacattatggaaaaaactcttcctttatagtcactgttcatttcctgcattgaaatatgacgtagaagcaactgtaagtaagaaattacgacctacttaagtgctttttaataagccaaactttcattatgtgaaatttcttttttgtagtcatttcagtatcgacataccactaaatctgagattacaacagcagtagaagttttgaggaagagtacactttcactatttgtcatgatcttttccattcatttacctgaatcttacgcatcacagttcccttcctgtgtgataagcttatctaaagtaggaaacaagcaataatgcatatgagtcttctatggtgaacatctcagaagttggtgataaaaatacacatttttatcttacataatctaaataaattttaaatggtaataacactaacttatggtgcagaaaacttttgttttttgagatggagtctcgctctgtcgccaggctggagtacagctcactgcaacctccacctcctgggttcaagtgattctcctgcctcagcctcccaagtagctgagactacaggtgcacgccacaacacccagctaattttggtgctgataatttttataaaatacataataaaagatttttcttaacattgaattttcagcctatatcttcttgatatgtactttcagcttattagaactttgttaaaagtggtataacattcaattacatatttactcctataataaaaataatatatacttcaagtctttttttttttttttgagatgcattctagctctgttgcccaggctggagtgcggtggcgcaatctcagcccactgcaacctccacctcccgggttcatgcgattctccttgccttagcctcctggtagctgggactacgggtgcccgccaccacgccaggctaatttttgtatttttggtagagatagggtttcaccatgttgatcaggctggtcttgaagtcctgacctcagatgatccacccacctctgcctcccaaagtgatggaattacaggcgtgagccaccatgcctggcctacttcaacactttacgaaagtgctacaaatatatggcatttccctataatgacagaaaaatgacagcagcaataccatgtagtaaactgtcatttcagagagcaaaaggaaaaagaaaatcattacaaaaatcactctgtaatgtctttgttagcataaaagaaaattaagcagtaaagttccaaggagaaatctctttgtgctcaacatggtagaaatatcattcaaacacagtttatccctgcagggagattacctgtaatgccgccaaggtcactgtcaagttgtattaatggccatattcagtatgtcagtcacatgagttggagctgccttcttcttttttctactgcataatgaccagcctctaaatgtacactgacaaactgaggtgagtgaatatgtttttccaaaatatagatggaagagtttcattccaccaactcttctattttaattgtaccaaacacgtggaatggatatagtctggcaggaaagaggttttaaatattctactttgaaaattgaaccatttttgaaatggcaccttgaatcttaaagggaattatttgtggctgcattgtgaattttctttcaaatgtacatttgcttatattgctgcaaaagcacaaaatattttttaaatgcaggaatgacgtctttttatatcaaaaatgtcactggaacatggagttagcaacagaatgatttagtattcaatagttaagctctattgcggatttgtaattttcatttatcaacattattcatcatttacagaagaaatgtgagagtgtagacatattggcttttgaatacatctactgactagagagtagcagtcatatttatgtagagtaaaaacagattaacacatcttctttacaggacttatatttaaatagaataaatcacaccctgaaagaataaatgatattctagtatgttataataagacttgctcgtaggagacatctctattaaaaatttatcactttagccctagaataccaatgtagtcctagttttgagattagcaatctattataatatctggaaatttagcaatttcaattttcaatttgctatcagaactcagcactgatttctttgtttcacttacatactttaattcaccaaaacattattgaaatgactgggaaagaaagaagacatgaagaagcacttccctgcttacatcagctgacctggacaatattttaagactatatttagaaaaagataaaaagagctgagtacagcgacaattctctgtgccaacttcctctattaccacttttcttttcttttttttcacttagtaacttgactataaaacacatgttaaaaaaaagggagagagaataatcccaggacctctagatagaattttaacatgtgaatctggtacataaaattaggatacaacatcagacaccaatctatacctttcatatgagaccaccatttctattttgtttatctcatttatatttacacaatttttggtaatgacttggatcacaaatgcattcaaagttcctcacatttgaatttgaacacaaacaatgattatctaaattacaaaagttagagtcaaataaattccacttataaagtacataactaaaaagtgggaatacacaaagtgcaaataaacttcattcagcacgcttacaactatgcttacaactagcgattgggcataaaatgtaactaaaaatccatatataatattttagctgagattttaaatctttaattgtcataacttttaaaaagatgatatagaataatttgccatttaaaaaaactcctcaaaggtaaagagcagaaagacattgtggagagaatctgctggatttaaaaacttaataatgatctgtatttgaaagaccaaagttatagtggccaaaaccattttagtagaggataataaagctagttccagaaaaatggttgaatggctacaactttctagttatgtaacatctcttattttatagaatattgggtaatcttacacggatgaaaaattacatccttaaggtaaaaactcccattttcacacatttctatctctctacatagtaatgataataggcaatatgctaagtgctttatgcatattatttaattcttataattattctagtcataataaggtagataagctgaggcacattttgaaatcttcagtagtataacttctcactccacactgttaactagtgatttgcaactggggtaagcacattataaaaatgggcacactgatgaaaattaagtttggattttggtaaaaaaattgacactcctggggatacaaattccatttgcctatgtcattcttctctgtgaaagagttaaaagattttctatactaatgaataaggtatttagagttcttaacgggtgatgtagaagtaagtagtatgtgttcttggatgacacaaagattcttcaatattggaaaatacttcttaaaataatattattgtgagccaggcgtggtggctaacgcatgtaatcccagcactttgggatgccgaggcaggtggatcacaaggtcaggagttcgagaccagcctgaccaacatggtgaaaccccgtctctactaaaaatacaaaaattcgccgggcatggtggcgcctgcctgtaatcccagctactcaggaggctgacgcaggagaatcgcttgaacccgggaggcagaggttgcagtgagccgagatcgcgccagtgcactccagattgggcaacagagtgagactttgtctcaaaaaaaaaaaaaaaaaaaaattcttgtgccaaatactttaaaatattttaaagtatttttaatttacttgtttctaaataatttaatttgaaaataaaaagcattcataaatccacatgctccaactgcttaacccttaaaattcacatatctaagagccagcacacatgattttggctaatctgttgaattctatgggaaatatctcttctttgtcctgcaaagattgcaaaacttatttgttaaaaataaataaataataaggtcatatgcacataatatatatacagagaatgagtgtgatatttgactaacatgcaatgttatctaagactcaatttaaaaatctacaataaaagtttgaacatatttattctatttaatctgtgtcttaagtgtttaactttgtatcaatcacattcatgattggccattattaaagttttgttttctctgtttcaggcaaatgaatctgcaagctgccttaagaaattatctatcgttaatcaatatttcgaaatgcagaaacttccagaaattagcaaatccagtatactctagatccatttttaatttaataatttgaattgaaaccattaacatttcactccaatacttttttaaaaaaacactgaagagataaatgacaaaagtaaagtcatatttaatgactttagggtagcttgtaggataatgtaggattatgtggtaattataaaatctatttcctagaccttcctctcaaaaggcaaaaaccaaaaatccttcaaagcaaaatttattttttttgtttgtttattatactttaagttttagggtacatgtgcacaacttgcaggttagttacatatgtatacatgtgccatgttggtgtgctgcacccattaactcgtcatttaacattaggtatatctcctaaggctatccctccccgccccccaaccccataacaggccccggtgtgtgatgatccccttcctgtgtgcatgtgcttttattgttcaacttccccctatgagtgagaacatgcagtgtttggttttttgtcctcaaagcaaaatttcttgactgtaaaagcttaaaaaggataatgattgttaattcttgttttgtgtcatgcactattctattcattttacatatattagttcatctaatctccagaaatatgctttgtagtattatgcccattttacagatgaaatggaggcaaagaggacttcttttgcccatggtaagaggtagatctagggtttgaagttacaggatctgactccagcatctgctttttaactattacactaaaaagagtccaacattttaatgaaaaataatggctattttgattgccataagaatgcagcatctgagtgggaactgccaaagtagatgagggtatggaggattcagagttgaagaggaccttcagggccactatgatgcccagaatgcccttcacttcaacatggagcagtaattgtaacctccagatttgtgtacacactctgattttggtgatctctatgacacacacacacgcacacacatatacacatacacacacacacatatatatgcacacacacacatacatataattatttaagaaagaatatatatgtacagttgacccttgaacaacacccacaggttagaactgagagagtccacttacacatgaattttcttccatctctaccacccgagacagcaagaccaacccctctcttcgtcgtcttcatcagcctactcaatgtaaagatgaggatgaagaccttaatgatgatccactttaacttaatattttctcttttctatgattttcttaagaacatttataacattttcttttccctagcctactttcttgtaagaatgcagtatattcctgtccaacgtggtgaaaccccatctctactaaaaatagaaaaattagctgggcgtggtggcgtgcacctgtggtcccagctactcaggaagctgaggcagaagaatcacttgaacccgggaggtggaggttgcagtgagccgagatcgcgcaactgcactccagcctggtgacagagtgccactccatctcacaaaaaaaaaaaaaaaaaaagaatgcagtatataatacatataacacacaaagtatgtgttaattgactgtttgtgttattggtagggcttccagtcaacagtaggctactagtagttaagcttttggagagccaaaagttatatacaaatcttcaactgcatggggggtcagtaaccctaacctccacattgttcaagggtcaattgtattttagtagaaaacttggctactttgcttcatttttgaataatgccatgacttcactttgtcttccattttgatgtcaatcaacctgtacaagtattggatgcagacttactaaacccactcaatataaacagcctatctgctaggatctggctaatttttctactagcttttagcttctgcttgctaaggttctatacgctactattcgtaataatttcacattctcgatgataagtcggctaacttaattaaggtttaaaaattcagtatttggtcatgtacgactccttattttatattttaaaattaaaatagtttcatgcatttatatttgtgtgaataggttgtaatatttattgcaagtactggaaattataaaatgtattttcagcatctcaaagagattaaagtattctaattgtactaaaatgtaccaagatgattattacttgaacctttataatgcaatcaatacaatcagactcaatcaataagtactttatatatctggaatataagcaatttatcaaactatttgtatttttgtttgcaacatttccataatgacaagtgaaaactcgaatgaccaaaagtaattgtacttggcagtcatatacattcctaagcactatagtgacaaaaaataacttactgctatcattatagacatcataacacgattaaaagaattttagaactgtatgttgaactgtatgttcaacattggttagtaacagaaaagatttataatattaaaaaacacatcctttaactaaatactttaaatcttttctatataattaaaaagttaattttaaagctatttcttctaaaaaatgttagaaaagcacacacctaaaagtaccagtggtggggtaaaagttgagatgaagaaaattcataaaacatgatgagaaaaggtagtcagaattgcactctaaacttagtgcccaaaaaagaccattcagagtagtggtctctctatttatttgaacactggattctggttgtattaaccatcacttgaaataagtatactgtacaacaataaaactttccttaacaaagatttttattttaattattttatttttccaagcgataattaaaatggtgcatgtgctgctcttaagaatgtagttctagctgggcacggtggctcacgcctgtaatcccaacactttggcaggccaaggttggcagataacctgaggtcaggagtttgagaccagcctggccaacatggtgaaaccccgtttcaccgtttttgtatttttaggagaaactaaaaacacaaatactaaaatacaaaatacaaaaatgagctgggcacgatggtgcacacttgtaatcccagctacttgggaggctgaggcaggagaatcactggaacctgagaggtggcgcttgcagtgagctgaaatagcgccactgcgctccagcctgggggacagggcaagactctgtctcaaaaaaaaaaaaaaagaatgtagttctagccagacacagaggctcatgttggtaatcccagctctttgggagaccagggttagaggattgcttgaatccacaatttcaagacaagcctgggaaacatagcaagacactgtctctgtaaaactgaaaaaaattaattgggcatggtggcctgtgcttgtagtcccagctactcaggacgctgaggtgcgaggatcacttgagcctagaagttcaaggctgcagtgagctaggatagcaccattgtactccagcctgagcgatggtgagactccatctgttttggatttttttgttcatttgtttttaaaaaaaagtaaagaaaaagaatgtagttctagctgagtgtgcaatgagtagtgagatcttctaggctggacttgtatacgtttaaacaagagttgattaccaaacagctgtgtacacagggtagccagggagcttccattaggaccattaagaagaaacgttctgttagctccataatgcctagacatttagtaagttgaaacagtataaagtcactataattaaatgggcacagataattgtaaactgcctgcaaaagtgaaatctatgcaaaataaaaatgacaatcattttaggcaacaatattattaaaacaaatatatcataaagactgctggtgaaaagtaaaacttagtgatttgaatatcattttgattttcttattcccatcatcatctgatattaaacagcaatggaaaatataaaggcatgatttagcttttattagatgtccacgtaatgaatttataaaagatataaaccctttccaatgtacttgaatcttcagatatttacaggaataagcgatccacatggtcagatgctcatcacaaaacaaataaaacaatttacatgaatgctttggataaagcttaaacttcaaacaaggataataagatgtactatgtctcctaataaatcataaatgtgtctttcaacattgttttatcagtgacaacattattgttatttcatgacctcacttgtgacacaaacaagaaccacaatcattcctaatttttacatgggggcaaaatctgaggaagaactgtaaaattataatttaggaaagaggtggaagcattctttatctattacctgcatgtaaaatgaattaaagaccattgagagcagctttttgcagctatataagaaccatatttttggtgagaccaaagctttaatctatgagacttctaaatctcagttttcttctctgtgaaatatgtattaggatacaataaatagatactattgccatgggtttatagagtagttatgatcaacatccttcagccagtcaggtagtatagcagatgtggtgcaaaaaataatttgttagttgagagattagaaatcaatcaggaagtatatcctgaatagaaaggtgaataaaacttaacctctgcacaccaaagagcctacattttatcaaacttggaaagatactttaaaaattaactttagtacaatgtagaaattagtaaacaccataaaagagacactcaaaaagttctctgaaagtcagatgtgggaaagataacaccattgggaaaagcctcatggtggaaatacttcatcaactacttttcctagatctctctcacctgaattaggataattattacccttcattcacttgcttcaaattaattcaacaaagatggaacatctattatgtgtaacagactcatacagaccatagagaaaacaaagatgagtaaggtgcagtctccaagctcaaggagtttacaatctaacttgggttgagaataatgtacatttgtacattatttccattttacagtgctatgtgcacatatcatttcacacagaccttgagaatcatgtttactgaagtcacaaaagttgatatttttctactgtgatatgaaaaaaggactgcaatgaatcacaactacctcagtagagcctttagggtcttgtgcttccgagaactgagattcattctaattttagtatttatgtgaatggcttgacccattctagaatagcttatgtgtggtttactacccaaagtggttctatgcacaataaaggagacaagcatggcaggaggtacacagaaagggtgctggaccccgtgctgtccttgctgaagaatcctgaagaagagacacaaatttaaaaagaagctttggaacttttcctcagctttatagttcatttttaaacagctgtttttaaatgttgggatttgaaagagttttgctaagtgctatatagaatatataggaagcatttaaatatatatccatattcaagtttattttcttaaataatttgaaaatatttttatctataaaacaaattacttccatttttagaaaagcatcattacatttttttgaatagcacaacatacagtaataagatgatatacttcttttaacgattttggatattttttccttaactgttcacagattatttttctgatacaaaagaataaactagttagttggataatttaaaagccagtgaataaaataatgcttttcatgttgcatgatttttattccctttctgatacagtttggctgtgtccccacccaaatctcatcttgaattgttcccataatctccacgtgtcatgggagggaccaggtggagataactgaatcataggggaggtttctcccatactgttctcctgatagtaagtgagttctcatgagatctgatggttttataagtggcttccccattcacttggcactcattctctttcctgctgccctgtgaagaggtgccttctgccatgattgtaagtttcctgatacttctacagccttgtggaactgtgagtcaattaaacttcttttctttataaattacccagtctcaggtatttcttcatagcggtgtgagaacagactaataaagtaaattggtactgcagagagtgggacactgctgtaaagatgcctgaaaatgtgaaagcaactttggaactgggtaacaggcagaggttggaacagtttggagggctctgaagaagacagatttgggaaaatctgaaacttcctagagacttgttgaatgcctttgaccaaaatactgatagtgatatggacaatgaaatccaggctgaggtggtctcagatggagatgagaaacttgttgggaactggtgtaaaggtaactcctgccatgttttagcaaagagactggaggcattttgctcctgacctagagatctgtggaactttgaacttgagagagatgatttaggttatttggtggaataagtttctaagcagcaaagtgttcaagaggtgacttgggtgctcttaaaatcattgagctttatgcattcacaaaaatgtggtttgaaatcggaacttatgtttaaaagggaaacacagcataaaagttcagaaaatttgcagtctgacaatgagatggaaaagaaaaacccattttttgatgagaaattcaagccagctgcagaaatttgcatcagtaacaagaagccaaatgttaatcaccaagacaatgggaaaaatgtctccagggcatgtcagagaccttcatggcagcccttcctatcacaggcccagaggcctaggaggaaaaaaaggttttgtgggccaggcccaagaccttgctgctctgtgcagtcttgggacttggtgccctgtgtcccagctgtggctaaaacagcctgagggaacagctcaggctgttgcttcagagggttcaagctccaagcctggcggcttacacgtggtgttgggcctatgggtacacagaagtcaggacgtgaggtttgggaatctctacccagatttcagaggatgtgtagaaatgcctggatgtctaggcagaagtttgtttcaggggtggaaccctcatggagctgctagggcaatgcagaagggaaatatgtggtcagagccctgacatctgtgtttccactggggcactgcctagcaaagctgtgagaagagagccatcatcctccagatcccagaatggtagatccactgacagcttgcaccatgcacctggaaaagccacagacactcaatgccagcctgagaaagcagccaggattggggggctggggggctataccctgcaaagccacaggggcagagctgtccaaggccatgggagcccaccttttgcatcagcatgaccttgatgtgagacatagagtcaaaggtgatcattttggaaatttaaagcttaatgactgtcctactggattttgggcttgcttggggcctgtagcccctttgttttggctaatttctcccagtttgaatgggtgtattttcccaatgcctatactcccattgtatctaggaagtaactaacatgcttttgattttgataggtggaactaactaacatgcttttgataggtggaagggacttgccgtgtctcagatgagactttggatttcgacttttgggttaatattagaatgagctaagactttgggggactgttggaaaggcataattgcattttgaaatgtgagaatatgagatttgggaggggccaggggagaaatgatatggtttggctgtgtccccacccaagtcttatctcgaattataggtcccataatccccacttgtaatgggagagaccaagtggagataattaaatcatgggggtagttcccccgtactgttctcctgatagtgagttctcatgagatctgatgtttttataaggggcttactccttcgctcaaaacttattccctctcctgccaccctgtgaaggggtgccttctgccacaattctaagtttcctgaggcctccccagccatgtgaaactgtgagttaattaaatctcttttctttataaattatccagtcttggctatttcttcatagcagcgtaagaacaaactaatacacttcctttcttcagatttcctgtaaagtagctgaatgtgtgcttaaattatggtccaagtctagaggacgcagagaaaaatctcaaagcatgattttaaaaacaatgaaatttataaaacagcaacaacaaaaactctgtgaattaaatacatgcagtattgtttttagactcataagaatatccagcaaagtattttcttcctattaatttaattttgacaaattgaggcatttcttgataatgaaatccaacttgtgaatatgtacttcaaatcaactcaatgcatacatctttcctccttgcaaaaacaggatctcctcaatcttccctccacgctcctacatatgcctatcacctcaagaccaacctctacattcaagcctcaccaatcttttttcctgtctctcatataggaattcatgtgtaatattcacctacaatatattcaaggtacttttccagtcatttcaggggacccttaaagaagcaagactccatagagattggaataaagggggtgacagaattcatttgctcattaatttagcaagttaatcatgggccttggctgcatttatagttggtgaccataggcaacaaaacttaaagcccacctgggatgtcaggaggaggcagcccagtaagagttaactagaagacaaagaagggagcaaagtgcatttgataagggtatggattctgggacccacccacctatgtccttatcctcattgtgtgcagaccttctctggccctcacttacatgcacacatccttgtcagtttcctaatcctggatcagttagttactccttggagaaatctctttctcatgtgttctgcatgtcagctaaagacaactaataaacatttagagtgatgcttattatacatctgcattaaggaataaaaaacgctatttttaaaaaaaacataaactaagaatacttgaatctttaagcagtaatcctcaaacttcacattctaattatttaaatatcatgttcaaagttctccccaggaaggtagtagtgagacgtgtattttgaaggagcactgcaaaccattctgaggcctatgtatggtggattacattttgcacatctcgacattgttttcattgtttccacaaaaattctgcctgtctcgtcagagtgctttgattaagcattactggttatggcaaacttgaactatataattgttatttgtattacaacatccatatggcttcttactatttttaaaattgttattaagagtgtacactaggtatttgtgggttcatgtgagaaaataacaagcatttaaaaaactctttccatgaaaaaataaattctggattttccaacataactttaaaacagaattttgggatgcaaattattcataagctgcagtgtgacggtattcctgggaacataatggtatgttagagtctttactcaaaagcaagacacccagtgacaaggcacattcaagctcttctgttaagatcccgctcaagtgttttctcctttgtgaagtatttccagaatcctcatgtagcacagattaggctttttatttcctgtgttatcaaaaatgtagaaccagcatgcaaggaaaatcaaggagaatgccgtttcacatatgaaagttcctgtattaattaactgaagatgacagtgttctatagcaagaggaaagcattaatgttttcagtatcctattttagttcatacctgacagaatgttatataactgctacaacctcatcctaaaagaagccaataatttgaaaattagattgatctaattaattgtacacattgggaagttgcgctcaacgagcaaaaactctttgcagacatgacagatgtaaagctaatggctacaagtctgcaaaaatatttgctcatttatgaacaagtcaacaaatttgaggttttattttcttgtgggagtcaattcagaagtgttcaacaaaaatatattttagtttattttctttttaaacagaacaaacacattggatactgtagcagatactaatattttctttaaacagcttcataaagttcgatagggcaattcatgataaagtttcttaaaccatacaggtctaatcattttattaaatgctttctctaagtaggaaagagtataaatttcctttaggtaatggaaatatgttacatttttatggccaattcagccttctaataatgactggaaatgcctgtgaaaccctatgtttcacaggtaggaaaggacaacagtttcttttacataatggcaatatgttccatttttacagtaggttccacattctaataattatggaaagtgccaaagaaatgaatgaagtaccttctaattttcttccacttctgtaaggctggtaagggggcaatcctgctacttctaatgtggacaggtgaataaatgcatgaaactatttgtatgcttttttttttttttatggtaaggtaggtttttggcaaccttgtctcaattgccaggaagctgtgcctgctggtcataatggtggatttgtccattctctatttcccttgacatttcccccctctaaaatcataaaacaaaatgaaatattttgtttttagaaattgtaatttttttttcactttaaaaaatgccatattccagggcttacctttcagacagtcttaggttatgtctgtgtgccaaatgcagcccaatggggtggtcagattcacccagcagagctgccccgctcagcagagcctagcagctatgatctggaagtgttggccccaccacatgcatgacattaagatgatacatagcaatcctgcaagactacagtttaagtagagcttccaatttgctgtggttggcatgacctaattctggcttgaaaggtacatttttccccctctgggtttcactgactacacattggagaaaaaaaaaatgttcttcaagggattctctttcctttcttaaggaaatttagagaatttaacaactgttggcctctggctaatacccaaactaaagtctttttccagcttcgcctacatcttgacccctcatgccaaatattttagggagtctatttataaagttcatcacttcccctgttacttcatctttagaaatgccgataatttagaaactggaatgatgcggctggtctcacagatgaaaaaaagcaggattctatagaaaattttcctgtcataacttaagaaattaatttattttcttctcaattctacagctagaatggaagtaacaccaatgttctgcatttgcttcaccctagtgttcaaagatgtttcaaagttgtagagattttgaatgttccactaacagtagttcttaatgctgactatacatttcaatcacttcaaacactttttaaaaacactgatacccagacccatcccagactgatgaaatcaggattgttggaccaggttccctggcattgttacttgttaaaaactctccaggagattccaatgtgaagccagatctgaaatgaatcatattaaaactcttagaaacataaccactgcaacacaggtatgttgttgcattatctcccttggatgtggtatgttcttgaaatttaccggtctatccagttctgagctaattcacctgagagagtttctcagctactgcacgaagtgagagaaaaaaaaattcatatggacaacctgacacttaatagatttataagttaaaatcacagaaagctttgcctttctgagacaacagtcctgataaatatgccccttttctgcagaaccagtattaggaactttcaagggcttgcaaagtaatcatttttatctggatcatattgactctttggagggttttcagttgtatttaaaaatataaatttcaccttgtgatatttactgacttgcaaatctctaatagtatgctaattaaattcaatgctgtatacttaatttactcaaggtgataattttctaattgcatgtatgatgttaatgtattatctatttgagatcaaattcactacattttgtgacttccaaaaaagtcaatccattagaccaaagttctcagtctttcacaactaatttatttctctacctcagtcactgggaaatggtattagtaagcagtgcaacccagttcttccacctccctccacatgaaacaggtcttttttcattaagtacctggtttgtgaaggtaacgttatctagcagctgcgaccaaaaggtttacagacttggaattttgttccattatataactgagatcattatctaatccctgctctttacataaaactttatgtggttcattttatggtaaggcttcctacgaaataataaaacaatctttttctatagaatttgtggaactagtatttttattttcctgtcatgtcttgccttttctgacttctgtcatacacacaaacacacacacacacagagatacatgtgtatgtttgtttggcaacataggagggacaagcttagtttctcgtattctacgtgtcttataagatcatggtttgctatgtttacagatttatccccttctattagagtacccgaagttcttttaaaatatacaagatgttttcctactggtatgacatccctgaagtacttgtctttctttagttttattcttttagaacaagaaggaaaaaaaaaacccgagaaataacctttaaagttttttaaaaattactttgtaagagatgtaagttgaatctcctctatataaagtattcttgggtagctccctgtttggcccttttctcttattcataacttgtcccatatcccttgtcaaaacagtgggttgcaggggaggacccggatcaggccatccttcctttcagctgtgtctaggaaatagggcaggagtgggcgctgaggaggagtatgtcctcccagttaccttgagatctgccacagtgaggtttctatggcataccagagaatggaaagaagattaggttggcacttcctacttctgataccatcttcacggcttcattaggtgcccccaatttccacagaatctgaagttctgggcaaggcctgcacagcttttctaaatgagaaagcaaagttgagaatatggcaggccatacgaaaaacatatgaaagtctgctatgcttccagagggcagactagcccccaaaacttttttctggagtactgccaggatttgactcatcatttaagactcaccttaggcatccttgactgaagattgacctaaccagtcatctcccaaaagagctgaacattctatcaattaagcgtttacctcattttcaacatgcctgcagtatagtgtttatcacattacatttataattgcactttgcatattcaactccctcatcagactgaattcctcaacaacagagtttccatctctcacttttgtatccctaatgaaacactcccatgaaacacttagtgaaaagttgactgatgtgttaataaatttatacagttgacgtccaagaagtgttgggcaatagcagtagacattttattggcagagccaaaggtagttttcaatttataggtttatttgtttctgaaactgtaagaatgcatggatttgtatgcccaagttcaagattcactattttgaaatatacaatacattattattaactatagtcaacacactgtgcaacagaataccagaacttattcctcctcctgtctcacagaaattttgtacctgttgacctatgtcttgtctcccctttccccatccactcccgcctccatttctggaaactgcctttctactctctacttctgtaaattcagcttttaacactacacgtacaaatgagatcacacagtatttgtctctctgtgcctgacttatttcacttaacgtaatgtcttttaggttcattcatgttgcaaatgacagaatttctttttctttttttttttttttgagagagagcctcgctctgtctctcaggttggagtgcaatagcaccatctcggctcactgcaacctctgcctcccaggttcaagtgattctcctgcctcagcctcctgagtggcagggattacagggatgtgccaccacgcttggctctattttgtatttttagtagagacgaggtttcaccatgttggccaggctggtttcaaactcctgacctcaggtgatcttccagccttggcctcccgaagtgctgggattatgggattacaggcctgagccaccatgcccagccatgttttctgtttttttttttgtttttttttttaaggctgaatggtatttcactgtgtattcaatgttctccacacaaagaaatgataaatatttgaggtgatagttatgttaattagccttatttgatcatgctataatgtatacatgtgtggaaatatcacatgtaccctatcaatatatacagttattatatgttatttaaaaataaaaattcacatttatcttcttttaactagtggttctcaacccaagctttacattaagagctcccaggcagctcggagaaactgcaatacctggatggcaggccaatttaatctgaatctgggagtggaacttgggcattggtgtatgtgtgtatatatttgtatatttgtaatatgtgtatttacatatttataaatacacataaatataaatatgcatattataaatatacataaatacacaaattatatatatgtatatttatatatttagagaccaggccttactctgtcaccagattggagtgcagtggcactactatagctcagcacagccttgaagtcctggctcaagagatcctccagcctcagtttcccaagtagttaggacaacaggcatatgccacaccatcacgcttgttttttcaaatttttttttttttttttgagatggagtttcgctctgtcgcctaggccggagtgcaatggcgcaatctcggctcactcaccgcaacctccgcctcccgggttcaagcgattctgcctcagcctcctgagtagttgggattacaggtgcccagcagcacacacagcaaatttttgtatttttagtacagacggggtttctccaggttggccaggctggcctcgaactcctgacctcagatgatccacctgcctccgaaagtgctggggttacaggcatgagccaccatgcctggccatttaaaaaaaaaaatttggagactggatctcactatgttgcccaggctggtctcaaactcctgacctcaagtgattctgtagcctcagtgtcccgagtagttaggattacaggcaagagccactgtgcccacctaacatcagtattttaaaataattctccttacagccaaggattcagaaccacttatctaagctaactgttcaaaggaaatccaatgttttatacctatgaccttgtcacttggcatataccaaagatcagttacagcccatagttttctaacgaattctgcttgtgagaaacttagttgattttagtctttggatgattaaattttttaaaaaggcttttgaagtgcagtattagctacatcgcaatcttcttcaaggaatattactaataagtttatgcaattatcttttatagaattagccaacagctataacttcctcctcagtcttagggtaatccaggcctttacagtgaataattatttcctgcatatttacaactcaaatggatattaatataaatatggtgttttatggagtcttagagcgtgctttacagttagaagattccaaagagacagaattcaaacaactttagtcaaaatcacattaggaagtagatataactggcctcagtggttttgctggaaagagaagaatgaacactgagtgttaccaatgggacttaatattgcataaagcacacaaaacttccccgccagtgggcatcgtaagtgacaggaaggctgtttatcactgaaatcaattaattccaaataacacattgaatccccaaatctttaagtcacatttcttttcttttttttttttttcttttgagatggagtcttggtctgtagcccaggctggagtgcagtgactctatctcggctcactgcaagctccgcctcctgggttcacgccattctcctgcctcagcctcccgagtagctggggctacaggcgcccgcaaccacgcccggctaattttttgtattttttagtagagacggggtttcaccgtgttagccagaatggtctcaatctcctaacctcgtgatccgccggccttggcctcccaaagtgctgggattacaggagtgagccaccgcgcccggcccaagtcacatttcaaatagacgaatttttaaatacagagagcatagattatttgcatgcttgcatggtaatccaaacaagcatttcattctcttcaacagtgaaacaaagcggaagcaaatgtagttactaatatgaactgtggaaatttggcaaggaatccatgacattaaagatatggtagctattaattttgaagtccaaagcttgtatatctggtaattcagaaatatctgagtcccatttgacctctggccagcctctctgtcctcacttctagtcagcagtacggcaatacttttatgaaaaaacaaggaaactgtttattagaataaagaaagttcatattgtttctcatggtaaaaattctaaaaatgatccttttcctttttcaaaaggtcttttactgaacccagaaaaattcagttaaaagctaaaagctatgcacttgatgaataaacttgatataatatttcttattttcaaatataatatgaccttgttctaactcatcagtagttatttcacatctaactttggttttaaagttttgttgttttccttttttaactacaaagaaaaagtttaaaggtgttcttgaagttgaattctctagaatatccatctgcactaattaaatttactgaataactcctgaaatccatttaatattcatttataggctctgttatacatctcacatttttgaattaaaaccatataaattactatgattcttgcaaatgaaggttaaaaattaaaacagctcaagaaatgaatagcaaagtggtcactagacagtgatgacataaaacgagattttcccatttcaattaacgctaatatcgtagctggaaaaatatattttcgcaaatagtaagacattgcttgtgaaaagatttatcaagcagttgataatatatgtttttctcacttcacatcaacaatgtggaagtatatatcacaggccaagaattaatacacttctttttaaaaacaatacaaacatgtttacacaaacttagttatattgtcattccaaggttactaaatatttttccctaagatgccaggcaaaattaagactcaataattgactctttccttcttcttatctaacagataagatcatgtatgtgagattttggcttaataagaagagagtggacttgagactatctggggttgagattctaggtctgccattaagtgggtaactttggacaagttactttgtaaatttttacctcagtttcctcatctatataatcgggatagtaactgcacctacctcattaagttttgaggaataaatgaattaatgcatataaaacttcaggcctatagaatagtgctcaagtatacggtatgctctcaaaaaaatgttagctgtggtttttattgtcttattataattagtaattctttcaaattaataatataagcttttacacacatatcataaaagttattaaaattattagagatattttgagtagtgacgctgaagaaagtaaaagtggaattcctaagtcatacttgaaagtatcaattatatttatagaagatcagtcctactttcaaccaccaagccagcaagaattgaaaaccaactggtcaacatatgtcgatgcagatggaaaaaggatacaactgtctttaaattccctaaagaaagctgagtggagagccttctggtcactgcagtccaacctatcattacgcgtgcagcgagactctttgatggatttcttagtctgtgaataatatatattttggggacagtgtcacaaaaataatctgtctttgctccaaaaagacctatgactaagcaaacgcaaagaaagaattacctcccaaccacaaaggagggtggtaccccctgtgttggaaatcaagacaactggcaaaactttaaaaagtatttttgagataaaaatggccccacggtgcatatcctggagaaccaggaaaatttcacgtttcggaactactcttcctttaactttaaaaaataaagctgggggaaaaatatctgattacttctttatgaagcattactaaataaaaaagcctacctttttagaagatctggtatttacaagcatttcacaaggcaaaacacaactgcaaatattcagtttcggtgaatactgctaagaggcgtaagcttttcccccagtgaaatttgggatgatatttacactttgagtgatagaagattttaaggattagtaaatcaggataagtataactaagtttgcctctggagttttgtcttgaaaggatgtcatgtatattcaaattgcagcaaaataaatgattctgcttgttctccaagtccgtgtgacaccccccacccaatactggcatagttagttagtgaggctgtctactttcttgtaacacactacaattctcccccacctctaccaccggtactttaaggagaagagagagaggctatgacaacccacatgattcaactagaacattcttatcagttcaccacctatgattcttggccttttatgccaagagcaaatattccgaattacccaaaacaaagcaatgaaattacttacaggttagataaaaagtcgagttatctgatgtgtaagattacagataaattaaaatgttggcagtaaaaagtgaactccagaattgttctttatgattcatcttaaatctatgtgctatgttcacatcgtcaaaaaacattataaaatcaacttacaataggcacgtatacattataatatttgatataaaacaaggattcctttttctttacgaattaagaaaacttactacaacaagcacatgatagaactctagaaagataatttagcaattaatctatatgatgtgacaacagtgccagtgagttctaactgtaaattattatcttgctataatggcaaagttgtttcacaaaggtcttaatttatattgctggatttgtctatgtgacaatatatcagtttcacaatcacgttatgtcttaaatgtattttgtaattttttcctaggcagaaatctaaaactagttttcatatatatatatatatatatatatacatatatatatatatatacacatatatatatatatatacacatatagcttcatttgtacaaattgtcattccttaaaatattttcttaatctgcatttttagtgcatgtgaactataacttatttaaaaaagtttaattttcctgaacgttgtattgttctccaagtcaaaaattattttaaaatgctaaaactagcacttaagtacctttttaaagccttcaattctgggagatatttaaataccatgaactgtacacaacatgtaaatatgtccattatctatctgcatatgcagtccctacttactacacatacttgacatttcaaattctgttaacttactacacttattaattcagaaacgaatgcaacttccattgctcaaatttttttaattcacatagtaccagaaaaattattttttatgaagacaacaaaaactgattttttattaagaacagtcaatagaaatagagaaatcttaacgaacaaaaattaatttcataactaattatctagtatgcttttaaaacatgcatgcttacaaaaataaaatgtcacattattttgtgaaaggatggtgtatcacgcgtctctatatgggctaagaaagttttggtagtttaactactttgggtttaacttagtggtgtcaaacacttagggaaatcagtactatatatcagatcaaataactggtacttacggccatatcctaagtattctattacaatacattttttaaacaatgctttgacttgagtaggaaggtaggtttgcttttagtatgagggaagatatgtattgaaggattatgcagtaaatttcataattggaaatttaataattttatctaaaaatctttggtttattttaaacaatcctataaaaatttactcaaattttaatataatacatttcataattaaagatgtttgtgaacttttaaaattttatttttaatggaaagtaaatatttggtcaaaaatatgtttggaagaaagcttttggtttatgaatataaaagtttcttagaaatctcttaagggctgagcacaataaaactagggcaatgcatatattctcagttactctttaaaaaaacctgtaaaagtgactatagtggcatgttctgacacattcttttcataaaccgaaccctgttagtgacagcagaacagattgtgtgcatctgctgggaatgagccagatgacagtggaaaaacgcacatggataccttggcacagcaaataaaaaatggagaaaaaaagacctggaagagaaagtgttcaactttaattgaaacattctttccaacatgatgaacatcatccaaccacctcttttagcctgtcaattttacatataaaaatgtgttttaaaggagttctttgtaaattagagctgttttgtcctctctcagcactaaatattgactccggttttgggttatttcttcaaattatggcaatgtaataagcattagggtagaaaaagaggccaaaccactctaccacagcctggtacaaaaacactaaacttataaaaaccctttcgggttcaagtcaaattttaaatatctggggtaagtttttgaattatgtgggtattgtattgacaagtgccaaagatgccacaattcaaatattctgcaaatgtgactattgtaaatgttgcttgtgctcaagagtgctacaatattttattttatgctgatcaaccacagtattgtttaaacagttggctcaatagcggtagagaggtccatacataaaaacaaatgtgcttctataaatcatatcaagaagttttctcggatgctctgattacaatgaaaatttattctatacagttacaatgcaaattttaaactgaagatgaagttgtttaatagattagtagtctgactgaagcagctgcagtcaaaaaaaattctggtgattaacagccattttccagtaatcataaccctggaaagggctactaagtagggggagggggttgcagatgggaataattctctaagcccatgtgccttagagggctccatcatcttcatgcagacttattattattattattatttttaaattaaagcttttagaggcgtccttgattgcagtgttgggagctgtccatgctgttttaccatagggaagtccactctgcaagtattccttgtgctgagcactctttatccaggcattaaaacagagttagaaaagaaagctgaaatgcaaggtgcacactaaaggggcattattcaaaagcatgataacaatttcaagtggttgcaactagccaggttgtataaactgggcatgtctcatcaatattacctgacatccaaaatatgattttttttgagaaaccatgtgaacagaaaagctgaacaaaaggggttccctgacaccagtaatactcacatttttaaatctacattttacctaaatttgtttgcgttatcagaaggtataatcctcaggtacaattctgcattttctatactttatgtttttttcttacataaataaaaatacccaaattaagacaagttcacttattcatcatctcaaagttgataagctgtggtcataatgaataagccctcaaatctagagaaaaataggataataagggtagcatttgctggttatattttcttttcaaataaaaaatgcatttcatctttatgggaaaatacaattcattcatttattcaacaaatatctatagagtacctattatatgcaagagttcttgtgaagaaatataaagactaaaagaacacacattcatcataaattaattccatttctacatataatcaaagttgtctaataagaaaaataaaaaaaaggttattaatgtatacaaaagtggataatactaagaaaaacacctagaactcttggcgaggctggtttcaccattaaaatcatctaataactgtacatgaaacatttcctccaaactgaactttcattaagactaaggaataatctacctgcaattcagaactttgagtaaatgacttttaaaattcatggatggtatcattttgtttctttggttccatttctggttctaaaaataatatatttatttaataacatcaaatctgtgaaaggttttgatttttttggagaaagaagtatattgaacttagcaatcattagaattgacccacgactgtgtaagaattagatacttgctctgaatgtgacccaaatttaatggactgaaagtattattgaaaaataattttaataaccatcccaccaaaaatttctaaatcaccattagcagaaacttaaaatgactaaaatatagtacaatgctatgataataatttaatatttactgatcatttactatgtatctgcattacggttttatatgtattatcctagtaaatccttaaaaaactttaagaggtgggtgattttataattcccattttacagatcctggtactggggctttctggtcattaaaacacctgcctaaaaccactaatcagtaaatgggaggctggcttttgaacccagttttggtcgttgttcttaatcattattctttattgtttatggacatgtttgtctaatagcataatatgtagaatcaaagaaatgatattaagtgtggaaatggagtctccaaactctttatgcttgtttaaacgatcttctctctcgagagtgtatcttcatcctttcatgctttttctctctctctgctctcccacaccgatgctccccacaccgtacacacatacacacacacacactcacaccgttggagttctggtctaacacttacttcatagagcaacctaaaaggcataatgtggttgaccttgtccaataactgtaccacttcctgggagttcatgaagctgttcatgtttgcaacgaatataccatccagtgactctaaagctgctgttgttctttacaaagacatgatcctatagccctggctatttcaagatcagtgtccgcagttgtttcaagacatggcattgggctgtgatgaaccacatcagtttctcaagtgtaaggaggtaagttagcatctaaaacaattctgtcgcccatgtgtagtcaaaacaagttaaaagtgcacttgctttcacgataccaaatactttgaagcaagaaggaagctcagacaggagagaatccaaaaacaatgaaaacggaaggaaaaaacactgaagtcaagaattctctgatttttttgaagctataaaatgagagaagcggagggaaaaaatcacataacgctcactctaaatcaagcaagatcaaacagtcttggaagggatattgccgattcatttcaacccaagagtcatagggaaacaattaatgggtactgagtatcttactcagccttctgcaaatctatcaatgtcgtcacggattttttttttttttttttttttttttttttggtttatgtaaagggggaaatattcaaacatgaaatgaaagaaaaaaatagtcaaaattatttactttaacttctaacctatatagagtctaagtgaacttccaataaatactagaaataaaaaaaagattcacttaaaaatagacaaatttgttagatttcatttagttaagaaaaatcatccagaataaattaggtctggatttatatagtaccttttaaagatattaatgttaactgtaatagaagggtgaaaagatctacttttttaaccacataaacctttacaaaaagaccacccaacaacttaataaggctcctcaaatatggatgaaaatccggtaccttaaagaagtaattgttttaatggttaacagagtttaaaatttcccaaattcttgaccagagaattacttactaggcgaacctctaatagagtcaacgttttaatcgggtatagttttatcatacttaaatggcaagatagcgaattttctattttaaaatttctattccatacatatgttcaatagttgaaactttacaatgtatctgacaataccaacgggtatgattcaaatgaccctactgttccagagaatttccaagaaaataaagaaatctcttacaatagcctaaatagaagcatagttttaatttgaatttttaaatgtgtgtaattttctaacaaataaatgtcagaaagtattgactcatatatatattagcatttacaaaacaaagtttaacatctttttcctcccttgctaatgggtcttgaaaaagtgccaggtgtaggaatatgccattgttatcatattcttataagctgccttatacattttttaagatctatgttgtattaatttcttaacaatttatcgggaacatttgcattcacagaaaaataaatgcttgatatttaaacataattaaaattatcattcttatctatttaagtttcaagagaaataaaattaaattacacttaactgttggtctaatttggtaaatttcatataggcaattaataattagtgtagtgggttaacaactaagctaacatttatacactattcatatactgttaaatcaataatttagtttaaaaataaaattagaacaaatatttattaagtggtaacactttctcctgaaggctcccatttaatacatttctaaagaagaaggctagttttagaaaggtgtgctggcaataatctgattgcacctcatacaaatgagaattctactgattgaaaggagccatggcagctagaaattattttttaataggattttttaaaaatcacatgggtaacagttgaaaatgtaactggtaattaaagcctgcttcttaacaaagttttactttattttttaaggagaagtacaagcttttagactatagtttcagatacaaggaatattagtgcagatatttagaagtcaatttattttgcatggtattatacacagaacttacactgtacctttcaaatgaaaagcataaaacaaatctgaaaactaaaagctcacattttctccccctgtactctctattttgacctaataatcatttaaagtgtgggtgtttatcaataaaaatttttgcagcaccacacattgtggtggaacgttgctatttcccgagataagtacaaaaaacctcaatgctaatttgcatcacaaaatgatctaacatatctggaatataatgcacaagcttcattgaaaagaaaccattatatttttcttttcgaaacaaaaagtacagatatctgattgggtctgggtgtgctggaggtagggggtggggaagaggtctcattttctatctcacacctattgttttatgtattctaaactgctatatgggaataaaaaggaaacatactgaatccactttgcagttaatgtcttagtaatttaagaggcagaattttcaagttaaagaagggaaacattatacttttcctttcccaaaggtatttcccctatttcccaggaagaaggccctctgttccttaccctatgtagggggaaataaaggacattagttagggctgaaatcactccgagacagaagaggggaagtttatgatgtggcactgtgcacagtatctggtctgcagccaggaagttttcattttgtagctctgctgccagtacctgccctgcatattcaggaataaaaatataccagaactctacctgaaaaactgtggatgttacaaagaattaaaagagtttatttttctttctttatcctgagtgtaattactgttttttaaaaagaaagagctgaaactgtagtaactggagttttttttttttttttttttcctttttaaactcctcaaactaccttcccacaaagccatttaagttaaatggtacatttacagactcacctacatgaaggatataacttaaaacatctgcttagacacatacgttctgttcagatataaaaaatgtggcaaaaatttttaaaaatataggaccactatattcttaaaatgtgtgttcttctgtgtgtgtgtgttcattcattcaagagatctttgactgcaattaggtagtcggtcctataaaggcttccttgtgtgacgataatttctaaaagtaaaatgctccagtgaatatttctgctaaataatcatatcttaaaattactttaaagaaattccaatccctcatgttacattaagcaataatgccagttttccataatatgccttagttgtaccaccttattcagggtcgacaattaattagaagacaaaaagtataaatcgcgtgtttattaagtagcagacaaatttctttgtctgtctcaacatatttacattaatgtgtttattttctaattttgaaaataaataagcatatttaagccaaagctgcctgtcttcggggtttggggaaggatgcacattctcttgctatccttctaacttgctgaaagaatcacaggtgtgaaaaaaagacaggcatagttcttggctgatttttaaaaaaacacttcacattctatcgaaggaccatatccacttcttttttaatccaatatgctaggaatccatagtatctgagagcaatttatatgaattcttcatgtgcatcttatctatgacaacaagatagaagaggaaaaccagaccaccacgctcatgatgctatttggaaaaagcaggttctcaaaagggactgattcaaagatcagttagttcctccagcctctaaaaacaagttttgggtacttaatttaaatcactgcttgaggacttgcactgtcattctacatgaatcccaaccacttgcaggaggaacaacattgctccattcatttcaaatttacagcattaagaattaataaagtctttataatgtctgcattatttaagagtaatgattcctgaagaaatctgcctgtaatatgtttactgtttttattgcttgtaatgtcgtcaatttccttttcaatgccctcaaaagattctcttcatgtactttgaactttgtttacattggctgtattttaaaaatatataccaagatttaacttgtacaataaaatgacaatgtacagcaaatgaattatggcgatgacaaataaatgttactcatatcacctaaaactaaaccataaatttgtataacatgtatcacctaatttccatatttaataggaatatgattttttgcagtaaacattaaaatagtatcaaggagatgtgagataatagtatattaaataaccttttctataatcttatttttacaatggtattctttgtcatagaacattctttaattatttttctttcacagacaaaaataacaaaagaacatcaatgccatcttcgtattcttaaaagagaggggtaaggaatgaatgcttccagcaccctttattttgttatgcctcaatattgtctgtaaaataacatggttactaaaaaattcttgatttgagcaagaccaaaattattacagtgtactttacagttatttcacgcatgaatgttaaaacatactgaaattataaaactttcatagactttttttcagtattcagtttaagataggttgtcaataagagctactttaaaaaaaactgacaattttctttgctcactaactataggagatcattgcaaattattttctttctcatgctgctattcacttacgtactgcatatttgcttcaattctccaagggaagaaatgtggctcttgtgggaaaggtccacccctttctacatgtttgcttccttgaacgaaaggaacacacccccttacattctttgaaatgtgtccaacaattgtaatagcactgtattattgactaaattagaaaatcttaagtgatagtcaaatattgttaatacactgtgtattttgagtcaggagaactaaatgacacatatacagaatgaagttcaatctagtgtctacacttggatgctatagaatgtttgtgttagtagaagaaactcatgaatgtttttgtgtacaggtatgttgtatgacacctcaggaagaggcccatgaatgttacaagtttttgatggcctcctttcaatttaagacccattacaggaatgacccctttctttcataagtatattggataaaaaacatttagaaacttaggaagtagaatcagagagctgtttgaaatcacaaacatgcaaaaatatcacaggtctacgcttaccatcctaatggcagaaaactcacaccaaagttggcacccactaacttctacctcattaaggcaagctgctggtcattggatattgtgttctaacacgacttccctttatgtagaataatatgtttccttccaaggaaagtttttcttttgttgttattttctaataaatatactccatatttatagaaaattttgcatttatctttgattttatcttttctaaatagtctttctttattccacttttacaaagaaattttcaagtgtaaagacacagcaggaaaaaaaattatatctcttttaagatattttagtgtgtaaatgaaatggatagtccttgtgcaatttatcaggcatttcagaatgaacccaactgtataattcccaggcctacaaaatgaaagctttgttatttacctatgtttctcacttgaaataagagtgaatataaagagtgaatatataactgcaactgaaggtaataaacttgttaaaacttagtaagatattgtgatggtcaaagaaaacctgcaagtgcgtgccacaaatccactcagatgaaacatctcattcactaaaattttctatcttattataatagtgcacagaaaattaaacacataaatattaattttatgtatcacagatgatgtaggcaatgaaaatgcaatgtttacatttatgggtgactcattagtgttttattgtgtgaaacactaggaggcatcagttgggtaaaaaaggacttcaattttagaagaagcaaaaaattactgtaaagttgggtgtgtaagaagttaagattttcaaaatgttattatgtaaaccaaaactttattctctgaaataaactctcaaaacatcatattctgttgtaaagaatgatctttatataacattcatgaaatatatatattatatatatatataaaatttgaccaatgaacttttatgaagatatgtttcacatatatggattcataactatgtaattacacatttttatgtagaatatatttggtaacagaataacataatggatattgactattatgcattttctgctgaattactcaataacatgagtgtatgttttatttctggcaaattctgttttgtgctctttataacgcctctgaaaatgtctaatgcatttaagccttacaatacctgcttcatgtaagcagacaatttaatgtttgttcataaagaaatgatggaacttaaaatttacacaatgaagacatacataaaaaaggacatgttttctcttacttcactactgaaagcctgtcatttgaaaactgaattttccattgtttgaatggatcataatgatgaagcaacagggtcaaagtatgcttatctaagcaatcatttgaaattgagtgtcttgccattcctcaacaatcagcttttatctttgacctatcaaaataacatgtgaactatgtaatctgccttttgtaacgtgcatagactctgttgttcctggttttgtgaatcacctctgtaatctggtttgatttcctaaaggtgacagatctcggtgaacagtcaagctttactgagtgcaagacagtccacgcgcctataagattaaggtacagtgctaaggacggggatcttaattacctgtctttccacatgcagcatactgatggaacaacagtgattaaatcatttcatcgtgtctaggcaatcaccacattagtatagaatgaatacgtgtattttgataagttttagatattaatttgtgtggtattttctcagaggatgtgcttttgaaaaaaaagtgtaactttattaataatctcttaacagttcatcttgtgaccattaattgcatattaaattcttctatgttgcttcgaatcatgtccccaaagccagaattctgtttaataactatgtctttgttgttatgtagcacaagtattgctgcacagctatttccccatttttgtcactttctgagatttcatagactcaaattataccacactttagagttgagaaataaaaccacaaaatatactacaataaacagaagaaagttttaaaagataatgttaagatatgctaaggagttattcagtgctgttctttataaaagaagtttaaataaagtatttattagaaagatacgtttgcagtgttatggaatttattgattccgttaagttagggccaaggaaaaaatttcaggtatcttttcccccaaatttttcaaaatgaacatgtttacaaagaagaaaagaggcaaagtgcctcttgttatctaagtttcatggagttatctagtattaatgtgcttctctcttgaaaagttaatatctgtgattgcacacttttaaaatatgaatagctcagaaaaggtggaaaactgtttttattataaattgctcatttgttattgaaataaaaaacaaattaacatttaataaaacttacactttaatattatctttcaatatattccacatgcacagcaatcaggacgtaaatggtgcaattaatgaatgaagtaaaatgctgcctttcctaagaagtctgaaaaaaagtcaaacattcgaatgctgtgtgaattatattaataaaaatagtaggtttttataaaatttagtaaaatttgaagtaaaggtaacagccacctactgtctctttgacgggagaaccaaattttaagcaaatgttatgtttaaagactgttttgatgaaaacttttagaattgagttagtagcagaatacatagctaaatgtacttttctacaaatagaatgagatatttgatttaaaatatttctttcctcttgaaataggatgttagatagggacatctcattttacctatcaagttctgagtcttgctttagaactacttcttttaacttaatttcatgcatacactggaagacaataatatggctttttaactgcattatctttagttgaaactgatggagaaacaaaaatactgcttataccatattggtacatgctgaatgtttttaaagactagccaaaactgacattttttaaaattaaataagatgttttagtttcaaattagagattgttgatctatttaaagctaaaattggtatgcaatacgaggttaaacggggttcacaggtggtcacatttccatgtcctaccaagtctctagggattggagttattatactccacataaacatctttactctgcaaccacaattccattgcaaggtgccagtgaaagtaggctagtcgctttttttttttttggactggtataatgaggtggctggagtttcctttatagcacttagaaattatatgcagtccccaagcatttcataagacagttactattagagttagtttcagattcacaatagtaaaacgcactttgtgtcaaagcaattctccactgaggaccggttaaggaactggcagagagcccaattctacttagtctactgtcagcatttacatataaagtattttatacaaaagacacgcattcctaaaatgtgacaaaaaaaggctctccccaaagaatgataactactggacttagaatagtcagaagtgattcagatataaaatttcctttaaaaagcaatagccatgttcagggaaggaaggtaacattagcattaaatttaaatacttccacaatatttaataataaaataaacaatgtgccacatctatatatacttcctttgtgacaaactttatcatcgagtttggtaactttcattccaagtccaaagagaaggcaatttaagtgacttaaccttgcttgcttttaaacagctatgtatttgacttgacctgaacagcaatccatatgctgaaatcgaacgtgaattgtgaaatgtgtagactactatggcagggatattactttttgtccacaccaattaagaagccctctgtcaagccggcactttggtgagggaaggaaatgcacaaaggtatactctgacagacagccatgctttaggtcaaactaatcccaagaattagtggctcagaagcataacccagggcaaatcagtgtctttggggggactcatgggagcatctttccacagtgaactaactgctaaatcttaaggcgtctacttcaaggtcacagaacatgctgtgaaatattaaaatccaccaggctccacacgctccaccatatcaaacatgctaatgacgtgaactaacttcatgaaactttaaatacactggtgtgacaggaacgagtcaggagtgatttcaatagctgatggcaaacggatacgactatctaaaaagttacttttagcaacaaacaaggaaatcatggaatctaacgaaaaagaatgcacaacgagcctcaacttcagccttcaaaaaaggcacagggatagatagacacagtgccgtggaatatattgatgcagattttagagacaatacccgggttttctatttcctcgagaaatatcaggggtacttacatgaaggaagacccgatcagattagtccttgggatattttcctttcttaagagagagagagagagaaaaaaaaaataacaacaataatctttacttcgtccagcgttgaagtgcttctccacctgattcaaacatgcagccacggcgacccacacagaaccttcaaagtcaatccaatagcagcccgaagatgtctgggtgtacgcgtgtgctcaagtgtctgtgactgcgagcagagcgagcagagagctggagacgatgtgtgcgtgtgtgcgcgcgcgcgaggggagcgcgcgcgagggggggggcgcggggccgcgcattcgcgcgcgccgaggccgctcggaagaggaggaggaggaggaagaaggaggaggaagagaaggaggaggaggaggaggaggagaaagtggctctcagcggccggtcggattaaaagtaaccagactcgtccagaaaactgcgtccaggaaggaagtgacagaagacgaatgggaaaaggagaacagctcacagcgtttgaaacatcgcgtaaaaaagactgggggtggtgggggcgggggggattgaaggatactgggaggggaggcgggggtggtagggaagacggagcacgaatggttggggttctaagcagcacgtccgatgaaatgtcttttgcctccttttttccccctttatttaattttgtccttgcctttgcttcgcgctgcctttttctctccgtctctctctcccccacaatcccaaaccgttgactctttcctcgcgagctggagaaatcatcagtttcactcttgcaaaaggggggcgggactagacctcggagcattttaataaaacaaacatacagcagctccctcctcacccctccagtctcaactagattgataaattactccactacactactttaattatgtatatggtatgcagaataaatcactgaacatcagtacctcaatcaagcacttttaaatgataattgcatcttggtgaatcaatctttccattcctgacattttgctaattttagttttacggtggggtaatagcacatgccatacgcaaacctaatgacaattctttattgcacgaaatgaagacaacacggcgagctgcggctccctgctcctctcgcggcgcctctgcggaggacgctcggagagaacctagtctcccgctgcggcgcgctcgcttgctctccggggacgctgcgagccagccagcaggaaagtccttctaaagtcgggatctttcctctgaccaataggagcgcgaccctaatagttgctcttgtgacttttcccccttttggacacgcgttagccacttctctcttccaccggtcggtgcgctcctccgttactcacgcgtaaaaaccacggtccaggatgtctgcagcactcgattccagcgtgcttttcctgcacgcccagaagtcgcggttttcaccctgagaggttggagcgctagaaagcgagccgaaaggtttctctaatgttagtaatgtacgaaataataaaataattaccagtatttgagatctcgacttcatcgcggggccatgaactttctaatcagtttggaaatatttaccgaggaagcagcttcctcggagttccccccctccccccactctatcttttccacaccttactggacttcatccaggtcattaacatgtaaaccaaaccaacttcccaaatgcattaggctaccctagccgatagctgatgacttcacttatcctgaagagtttcagctgcacaggaagcagaaatagagactgataagggaggatacttatgttaaggttaaagcatgataaacacttttccttacaaaaaaaaaaaaaaaaggctttaatatttaggctactagagattgggcacctcccgccctaaccaactgttaatatataccatgcccaataaagccaaagataaaatacatcaactagtatagaatcatgaaaagacaagattgcatgccagtagaattatagattacataaaatgtttaaaccaaactattttttaaaaaatattgtgaaagcaagaagggaaaattaatagaacatggaatatatgagattagacaatagtatattgaaatatctagctaactaaagatttcctcactttagaaaattccttttagcactacgtttaacccaatgactagttgtatttcctgttaagttcagcaatatgcctccagatgactattttaatatatgaggacagtatggttcaaaaagcctcctgcttcaatgtaggaggtatttgatgtgagtagcttctctcagaagagtggcctcaacatttaggcaactgtcccaaggcttcacttgaaaggggaaggtttattttataggcaagtacaactagatctgaacaatcttcaagttccagctcatcattgtgactatcagcaaaactaagaccattccctcccttttattataggaatgcatcacaaactgtcacaaagcaaaaaccatctgaaatagtagtatttcttgcagattagtatttacaatgtattttgtttgccggtttttcaaatgttgagtttgccattaccatgaattcattttaataatatggcagagaacatctgtatcaggtttccattcaaagtacaacttctctgaaaatccaaaaatttaaagggcaaagatatttcgaatactaagatatgtctatatatggtggtaaaaataaaattaattttcttcaagattcacgaaggtcctgaaaaagcaaagcatttgaaggaccatctaagtttattgccataatacctaaaattaatgcagtgagttacaacagtctatttgacatgagcaaacacatagccaatacatgaatttcagccctgctgtttttaatgaattatagagggtatttctgtttaccacagtacacttcagttttagatgttctttcaaaaagaaattattttattttaccttttcatattttaaataattatttaataatacccattataacaaacccataattattaatgatactgcaagcattcaaaaataagtataaccccacactggataatttgaaaataatttggatctggaatgtatcacagttggccttttaaaatacaggattttcccctcagcagatttagcttcttaattatgtgtgacctaagttaatattaccattagttttcttcccatgagcctttacagttgaagcagaagagatatgaagaaatatacattagaaaatcacctgagatttaaaattattcatgagtaatccacaaagtagttaatccagagtgtgctttgtattctttaaatacttctggacttttggtttctgtttctgtttttgttttttctttaaaatcatcctgatccttgccatctaatgatacttggttaggatcagactattttctcatgtagggaggagcttgtactaggtgtcaggagacctggattctctatctagttcaaaatttgtgccttactaagggatttgtcctttctaggcttcagttcgcttatgtgttaaatgagttctgtaacctattccagttctatcattggaaaacagaaaatgtttctaccctttaaaccaattggaaggtagggtctatccagttaaataataggtgacaattcctttaaaagaaaattatgtctgggattgatgtactactgtaccagcttttatttttttctaatcaccaaatatttctcctacattaagttgtaaatgctttattgttaatgtaaatatagagtcacttgtttttccctcaaaagaattatgtttagcaatatatttaattaaagtgtcatagaagttacagagagcatgctcctcgggattttaactccagggaaagctaatattgcaatttctgttcagagctgcataccatcttactccaacctcctctcttcactacttccctacattaaagcagcggtccactaaagccctgtgcactgggtctgcctgcttttaagcctggcccacgctgggtgtagctcttgaagtgagctttaaaaattattttaaagtgaactggggcggttgccacagcaacccaccctgagatgaagaaaggctatagattaatgtaccccttaagattattcaactgtatagtatttgttcctcagccagaatacttttaacacaaacatgataagtgaacatggtggtttagaaaaatctaaaaagcagtgaaacacaaattccaatagcattacatattttaatctttgtctaattatagtattgatgatacacaggacttcccatgaaatagattaattttataagatacagtacttgcaaaagtaggccctgaaagatgacatgatctttaagcaaaatgatatgtcattgcttataatataaagtgtatggtggtcatttaactctttattattgttatacacgtctattctgtaaatacctaaggccaaggagtttggcagttttacctttatggtaactctgtggtaaatgataaaaacaaatgtgagcactcaccacatacacttctttactgccacaatcatttgccttccgttctttacttcatctcttcatagaagttacttcacagtttgcaactcttctttggcaccttcaaatgtggaagtgcaaaacagtatatagtattttgttaatgctgatatgaaaatactttcaaatagatttatttctaaaacttctaatctgaagtaacaatattctgattttaaaccaaagtgttttgaatataagacaactgaaattgtcatgcattgtgataataatctttaacataaatagtgccaaatatctaaatttcaaaaattcactaggtgcagcattaacccaagaagaatatacagcatgtggaatgtctgtgattgagaatttgcaatatacaaaggatttgttatttcaagacaaggtttacacatatctaaggattctatgtttatctgtatttctgtaccttcagttttatatctgatagagaattacagaagaatgtcaaatccattatatccgaagctaacacaatttgtcaaatcgggaaatgtttgcaatgcagttgaggttactgaaagggcttattttatgcattgcctaaaggccaatttaaaatactttgggattagtgatgtgtattcagtacggtttataaattctattaccaataataccttatttttccaagcagtgtttaactatactgagcacagacaaatgctcctgtgttctgatttctgttttagtctggctttccatgactttgtgcacacaaatgaacctttccttggcttcagactgaggctagtcccagaaagagaaccagccttgagacacatcagaccaggatggtcaatatctcttttcccatttgtaatagcaggaggactttgcatagtgaagaatcatttataaagcctctatatttgggttgacatctctgaggtttatttttaagttgcttcagagtcaaagagaaatgaaaaattttggccagttttactttatgggtgttagttgagtttaggtttttaggcttaggcccacagtgagtgagtccaaacttggtcttgtagtcactaccaagtgatttggtgagttctctttcttccagttgtgcttcattttacagtctattaagtgagaatcataatacacatctcccagggcctattcaccttatagaaatgcaatcttcatgaaataacatctgaaaggtatggtaaggttttttttttttttttaaacgacactacaaattatgatacatttctttcttttcctgtaatcagtatgtccaaataaggcttgatcagtaatttgcttgcaagtgtgtggctgattcaaaaataaccacatgcatgaataaatttaatgcgactttacctttacttacaaaattgttaaatgttgttcatcagaacattgattctatcccatttcttgaaatatcacagaaaccttcaattcaaggaatggattttcacacttccccttttaactgtttcttctagataccttactatgtgtgtgctttttcattttaaaaaatctttacccggggttgtggtggaagtggggattaaaaatctcgtcctgcgttttggtgcccacttctttgtttggaaagcagagcgctgggactcaatccggacggccctcaaagacccagacgagggacgcctctagtttgagcaactcactccgctgagttattgattgcaggcagcaacaatccctccggttgatttgtgtgaaaagtgaatccgctctggctgggcgttcagcagaggcgcaacagctgcaacgccatccaattattgccgatcctcccctccaacactgctctcatcacctatatactcttctctctgcccgtctctgcttccccccccttccccccccccttttctcccggccgacggagctgaaggggcgggggttccttccttggagtgtttctagagctcggaggctgctggtagggggtgagtgcgccacgtgcgtgcgccacgggcgagcaggaggcaggctctgggccctcctggggacctgctggacctgctggacctgggtgcgacgagtgggcggccacgctggtttggcgcggggaaggaagggggtgtgccgacttgtatttagttgggggttgtggaagtcacggctgggggaaaagcgtccggtggtttgttggtaaagagggtgcgtgatgggctctggggaatggaggagggcgcaacggctgtgggtggactgtggaaacgggcggtggcagtgccggggtagttgtcctgctggtctggttttgggatcctgggctggagaaatgcgatccaaaagagctcgggatgggctcagagcgacccacgaaaataccaggggccaagtaaaatgaacccaccctttaacagtgcacaaagcgctggcacacggtccacgtctggtgacgcaggctgcccgaagcgctccaaccattttgcaaacctgggagagcaagaggggctctgcaggtctagccgccgcccctgtcccactctggccagccggagtttttcacctgacagaccaataggaaagaacacgggccccaaactggattttatagtctgagctctcagcatctaaggaattatatttcaaaaaacaaaagccaactcatagctctattaagctaacgcgtgtgcgagttttggctaggaaaaagccacaaagtaaagcaagaagtagggtattcaggataaaacacacactttaaagacaaaacagaaaacttcctttccccttgtaccccctttatttgttaacacaggggaacggttctgggatgtcttacaaaaatgctgtcactaaatgcagatatctgtgctgttctttgacctgtctggcattgtggaatactcaattacatcgaaggtgtaaaaacgtttatgttatcatgttcttgaaacatttagcggctaccaagatggtagctatttaaattaattaaaataagataaaataaaaataaattctgtccctcagttccactggccatatttcaagtgctcaatagccacatgtggctagtggctcccttactggacagcgacatgtcaaacgtttccatcactgcataaagttctgctggagaatactgctatagagttcaaaatgaatgctggttaaaaaaagaaagaaagaaagaaattactttatgactgataccagccacattttaggacactcttggagtttctgttacttggcactagtgtgagaagctttaaagtcagactttcagtatcttcctgctgaaagagaccttggggaacacttcacccagacacctaatttttttataggcaagagaaatcaggcccagagaagttaagtgatgcccccaaagttatgtcataaatttggaaagaagataaggtcccctaacagggtccagtatactttgtgccagacaaggacatctttctaggcaaattcatcttacagaaagtcaacttgactgaaaattttaggcaagagtacccttttacaagaaaaaatactgctaagtattcctccaggaagaaattccatttaacaaagaatgaggagcatggggaataatactatctcccaaactaaaaatgtattattggtagtgtcatagattcatataatgccttttctaagaggctaattgggataacactgtgcttcattctactttaaaaattctgaggaaatgggattatcctcttaaagagctaaaaagcattcttaaggtcagggaggaaaggtgtcacctaaagtgaaaatttttagcaaagcataatctttctcaaatttgataaagatatcggagacattgattatgatataactaggatggaattggctcagaaatgttaataaccaaccaaccttttttttttttttttttttttgagacgcagtctcgctctgtcgcccaggcttgagtgcagtggtgcgatcttggctcggctcactgaaagctccacctcctgggttcatgccattctcctgcctcagcctcccgagtagctgggactacaggcgtccaccaccacgcccagctaatattttctttttttgtatttttagtagagacggggtttcaccatgttagccaggatggtctcgatctcctgacctcgtgatctgcctgtctcggccacccaaagtactgggattacaggcgtgaaccactgcacccggcccaaacaaaacattattacaaattacactatctgaaacatataaggcaacagaatacatcataaagatttagacaaagcataagctttcttattagttttattgttttgttttgttctgtcttttgggtttgttttgtttttaatgccatgtttgtattctatatatcttattgttaattaggagtgaactgttggtattaattctgctcttttatagtagttaccttttaacttaacacttagttaaggatccccgaagtgtccaaataagagtacttatgaatattaaataattttaaattaataacaataaattattttaaaagtgtagatttacatttttatttgaattattgtctttattgctcttcttaatttaccatttgcgtgtggttcagcattcttcccattctccctaaaatccagtatccttagagaaaatgtttcacttcttcaggtgcttgtagacatggaagaaggcctcaccttctccatggctgacaaccgagaaggctggtctgacttggaagaagctgtgtggccaacagccaattggctgtatcacatggtaactgtttgattatgcatatggtttaaatctccctttgcctcagtttcctcatttgtaaaatgtggaacaaaatgtgctatcctcaaaactttgtttaaggattaaatgagctattcagcataaagcacagggctggaaaagtgacaaactgcggtaaaaattagccattcttaatctaatgcaaagaatttccacttctataccattaagttctttattcacctatactggggttatcacagcagaaagaagtaggtcatccgagaggtgggaattggttcaggatgagatttaccttggaagaggtaaaatgttttaaaataccatgacttaagtgtacaggttgccttatttccctttcactgacatcatgcctctaggatattttttcttttttggggggatgctttattatacttgttagccacttggttgctgaaaaggcactgaaaactcagagtctatcctcttttcaccctggttgacctttggaatgctattgtcagccaagatgacattgatatcttcagtctccccctagcttgaattctttaggtcagagtccgctcagattgtctcctgatgtcattccaagtgtctgatggccgtctatggcaactgggttgggcaaaagcctgctgggaaggggtagcccacagaatgcctaatggagcgttctgttcaagaggacctagaagtagttctgttagacatatgatcaacactacagctgtgttaggggactgtaccatttcttgaaaaacagaagcatagtcattttgcatttttggttctaataaagtcccacctgagatgtttatgatttatactgattttatgattaagtatgtattacagaaaaaaacagacttagagaatgtcaataaaaattttatatctgatattcacgctaacactagttattaagtgaagaccccaagttaagacagaagagtttagaaaagaaggaaaagagctaccgcatggcaaaatgtacattattctatctttctaggtatttttctttttctttcttttcttttttttttttatggagtcttgctctgttgcccaggctggagtgcagtggtgtgatcttggctcactgcaacctctgcctcccatagagatggggtttcaacatgttggccaggttggtcttgaactcctgacctgaggtaatccgcccactttggcctcccaaagtgctgggattacaggcttgagctactgtaccaagccatttctaggtaattttttaaatgactatgttctacttatctggatcttacaaaattatttataaaatattttatttataatcctaaattttaaaccaagcaatataatagaaaatgttatgttttcaagaaggtaagatcatgcatagatctatatgctttcaatacgtaattttatagaaattgtggaacaaggaggcacataattatatcaatattctaatttcttaggaagaaacagaattttcactgggaggagtttctaaattattttgtaatatggtgagaattaaaagtaaaactcaataaaacttttaaatttaagtgagtgattaaaaccagtttgtttcaccaaagtactgattgagtcaaagactcaaacaaaaggccagatttcctacggactattacttatttattcatttatactaaatgtgtagttaaatcttttaaatcagtaatgttcttagtcataatacaatgatatctggagtatatatgcaaaaataatactatcttattagaatgtgggttgaaatgaatatttgaagtacctaacatttaatggccacatactatttgtcaggctctgtattaattgctttataaacttttgtttccttttattcaaagaacaaccttttagacatgtactattattgtccccattttaagattttacacactaaagctgtgagtgctgacatgacctgcccagggccacatagttcctaagtgccaaacgacataaaaccaatgtgtttgtttccaatactctacccttagctatgatgctatactgcttccttgtattcataacgtttgttcacttatagtgataatataatagatatttttgtcccaccagaaaatatttcagaaatacatatctaaaggcatgtcatcctctttaaggtagacactttagaagactattcatttatttcagtaatgttgtctttgctcaagtctatttagaaatctcctcagggatttgctacacagtcttaaaactggcctgattgttggcaaatccttatcattaaggatgaattttttccaaaagtaaatccaagccaaatgtagtaaacaggatgaaaactaagatttgagtataaagcattagattatttgatatttgtctcataaattgacactaattgaagatataaaagaggaatttcaaagtatttttgatatgattttataacctttaaggagacagttttgacaagtaacactcgtaaaaggtctggtatttttttaaaaaagtcattttcactaaattaatagttatagatcatgtataaacagcatgggaaatgttcttttcaaagagtataaaatgggcagcggagggtaactaggaaactctggagcagaatccacgtttagacactaaataattgttttgaccttaattttctaaatgccctttttgtaaaatggggaaggtggcaggaactacccatgataatgattttgccgagagaagcacatgaaattgtacttctgtggccacttagtgcctcgcatatagaaaattctcaataaatgttagctattatataccatttcactttcaagaaataccccatattcctggaaaacatctcaatgttgtagttatgtaatgatattttaaaagatgttttcttttctgtcagtttcatgcttccaaacagttattttatgtaaagtatttgatatataaagtaaatataaacatttatggtcgtatgtttattcagttaatatgtattatatcaagaagtcttacatgttggactgctaactatattatccttgtcagtgttctatataatattgtctttagataaacttttttggggtattcttattggatttcatcagacttatgaaagtaatgacatacccatttgcccagaatgatgctccaagattttattttttagttacctcagacatcttctaaattgtttattcattatataatcttaaatttaagggaactgagcataaatatgttgaattagtggcttcctattagatcccagtgaactcctcttaaaacagggctcttatctgtgtagcatatgcgcagttgtgatgttgtgaaagtttgtctttacatcactctcttccctatactcaccttcagcaggccctgctttcactttggcatgctccactcacccagcagcaatttttacaatcagtaatagctctttcacgagtgcttctttctcctctgggccttccactgatgcgacctacaaagtcctttcatccctcagccgcccctttatgtccgcggaattctttccaactatgttctatcagaggagccggccactacagccgcctaatccatgacacggtatcattgtgcaatcactttaaatgaacctctcttcaaaagttttctgaaaagaattcataatccaaaggagtatccatgcttccacagataccctgctgtgttggtcaggtggtgttttagggagcactttcagtatgtctcaggtccctcccaccagcagccacttcatttgtccacacagatctaagccttggatgcaagcaaatgggaaacctggcccttacttgaggaagcaattttgtttttgaaaatgttgggattggaagatgaactctctatcagcaaaatattaagatactccttgaaaatttatatacttaaaaaattgtacattgcattacctgttcccctggtctctttttctattccctctttgcaatatgaggcaggcagccactgcgtgtcccttgtaccatagtgactatgttgtcactcagacttaccctgtgtgctctcccttctgccccaccaaagccaccagaggtgtaattagtgattatttatccagaaatgtcttgaacagggtttaagaactctttgaagagaatatgtaccacttgttggatgaaagagagaatttgaaacggttggggagaggtttagggacagagggcaaatttcattctgccttctatctcctctattaaatcacagataaagcatcttcctatgtgcaaagacagggtacataaacaaatatttcccaacttagtgtagtcttaaatctttaaataaagagtatccatatcaaatggaatgcaattttatattaaaaatcatcactcaagattcaaaaggaagaaataagattctaagtaaaagattttgaacactactaaagtaagaaacattctacaactttcttattccttttgacccctttagcaaaggctaaatagctagccaacagatttcctcccaactattccatttaacttcctttcttccttccatctgtcattcattcattctttccttccttccttcatcttttctgcttcctcttttcattttcaagttgtaaattctttagtatcagttgtgaactcagtaaagctacacacacacacacacacacacgcacaactggttattaacaggatttttcctttgcgttggaaaattacattttctgtttcagaaccatagggtattattcttttttgatttatcagaatcacttcaaaataaaataccttcactaaaggagcttatttctaaacaattgatgatgcatgttatagataatatggtcatagaataacttctatgattattttttgttattaatcactgtaattactctatgattgcaatgatgattaacttacaatgaataaggtctgtgcttgtgttggttatatagtatttgtgaaggatttatgttcatgcatccacacagtctcatctcatccttacgtagccgtgagattctagtctgtgtagcctacggccgcaaaataaactcacccacaggagaataaagcctatggtttctctcacattatcagtgggctataagctcttaaactccacaggtcagtgatgattaactgagcattctaaaacttggtgaatgtgtatgctctacactctcatacgttccataataagcactgtctgtattgtttgaatgactgtcctgaagagttcgctcaagccgttttatcacatttcaagctgtattatttagcatcttaaacttaagaaaaacttaagaatgattttttttctggcttttcactagtatttgatgacacttattttccagtctacataagataattaaaataaatgaactactcaacacagtagtgtttaattatagcagacaatacattttaaaaggtaaagtctatacttgtgtgcatatgctccctttcatcttttgggacttgggatcactaaatgttagttttcctgttactgtagagcaggagaactgatcctcttcacaaaagagggctccttgtgaggatgttaacagtctagctcaaagaaccaaagtgcctcagaatcacccaggtgcatgttaaaatccagattcatgggccccacctcaggcccacttagctgcaatctcaggaatctgcattataacaggctcctcaggtggttcttccatagcacttatttgcatgctactctcttaaggtgaggggaagcataagatccacaggtccctctaatgccataatttttttttctctccgtttgttattcactcctgttctctccactaatgttcacaaattttgtggaacttttaaagtcatgagaacctttcaagatagtaagatgaatcttgattcaaaattgtaaacaagaaaaaaagacatgccacaaatattctgcctgttgaaattagaaaaccagttaagcaatatggaaacctaattatctcaaatttctgtacaattcttcatctttacttaattgagggatagccattatcttttcttggatggaatcggttcattgggtcctgatacctctgcaaaacctgtaaaatgggcttcagatccagggacctctaccattggtgataagtgactcccaaacattttcatccttcagtgactgccacctgctgtgagcctagactccaggaaaataggactggcactggtcatagtcacttgaggaatgtggcttctctgtaaagagattttcaatcaatgcagatgttccttgtgacctcagtaatcacctccatctgccaagcagtcataaagggcctgcacatctttgccaaccttgtcaacagagtgatccatatcttaggtctttaacctcttttgtattaagattttttaaaaaatacattaatcatgttttaattctgtcctcatgaacataaaaatagcaataataaatgattattactattgcaaaagtattgctttagtttacaagttttccttaaaaatattgaactccccagctgtatttatccattctttcattccatttattcatcatacataacctaaatacctatatgtagcagacatattgtactaggattcagatatttttaacactgtttcttgttccaacattttcctgacataaataaatatattatcatgctggcttacagcattgtgtgtggagaatatctttctaagtttaaaaattttcctgtcattctataaaattaaaaatattaaatgaccattcagtacttttttgtcaattcagccttatagtgcatactgaaaagttcaaagcttcgtgtcataacataattttgagaatgagactttttgtattatgttactagggtccccaagtggaaaaaataaggcctgctgctctggagtatattgcaaagtgattttgttttccccactgacttcacaggctagatagtgtgtcagttttaattacttggaatgcttacatggtgggctacttatagcaatagggatagggtggggcccagtcattgcagacaggaacccaccaataatattccagattccttttgagacttcctcacatgaaacagaggaaatatctttcattggataactaaaacttactttcctatgatttgtacaaaatggccaaaaaggcccatccattcattagcctcacagaggttaagtgacttgtttccagtcacaaaatgactttgcagtgaaacagagagtctaactcaaatcttcctacttctgctctggtgctctttgaagaacactctttaactctaatgaggaagcctctatgatccttcaaaagcagataccggacaagtcacttattttcactaaaacccctttgggatgcagggcaatgattaaacttgcctatctttcaaattgctagaaatggatgctatttactattttgcttgcaattgatttgcatactgttattacatattgttaaatggtttgttgattaatgactaatgttgatttggactaaatgtaatggaataagcaaatatattttcaaatttagatatacaatttagttgctaaatggtgttgttagtcataaaaatgttgattattttagatcaatcccttgcaggggaaccctagccacaatttccctccatattttttctcaatattttaagctttaccccatctctttttcttattaatttacatgtctgggttttaaagctaatacttcttataagcaagtactgttccaaagcccaggactaaaataaattcttataaattcagaatgtggtagatttcaactaaacagtttcttttctggagatccagaagacaaatatttggcttgaatattaatattttcatgaccttgaccagatcaatatattgcacaaatattatcaacaaattatataaatagaccatatttactaatataattaataattttggaattaatataagatagttatatatacacacacataagctagtcagttgttaagtcagttatatgaactatataatgtattatgcacttgatatatacatatacttatgtgttagtatattttgtatttttaattactcccaatcttaaaaaaaaccctatattccaacttatatttttgatttctacatttatcttctaaatatatgtattacctttgataatttttttatttctgctatttcatatacattcataaatatttccagtttggaaatccatttaaatggtaagacaaataaaaaacttttgtaccatagatgttttagtacatttatagtctttgtattttttagaactacattttaatatgctgtgataaaaatgtgtatttctctaacaaggtattaaatttggtgactgaaaagggttcttcaaaggaatataattcacattaattttccatgtgatcattgttacttatagtttactagtcaacatgcttaaagtctaattagaaaaaaaatccctggatattaagttgggaaacagacccaagtctgtatctacataaaggtcaccaccttggtgacctttggtaaatttcatttttgttctttgatttcattttctttgaaaatgagaagctgaaagctttaaagctttcttcccataactccgaaatagtttatgagctcaaaagaaaatatgactaaaagaaatgtgtgggcatcattacctggctgcccagtattttcatggacacagacttgtaacatattctgaaagttcctttaaggaaaataactctatagatatggacagcaagggaaaagggatcaataagaaaaagaaagggaaatgagttaatgacaaaggaggaatggtaggcagtagaaatgattccccacttacttgttttttatctatagtctagttattcctatttgaaaacctactggcaccaggtattatcaacagggatgagtaatatgtaatttttatctttactgggttacatttggcacatggacagttgacagctgtcagtcaggtggctggtcaatgaggagatacatataaagctgccaaaatatttttgttgctttaaatacttacaagtaaaccattttagctggaaattttgttgcactgaaattaaataggctgatatttaaaatataattaattgaagttaactactgggagaatcaagattttccctattaatatataaggttaaataacatgtttttccaagtgtctttctgaaacaggaaaacaatttttctccactgtaaataagctatctgtaagataggaagataacttgcaaataatgtttaaaatgcatatgttttaatgttaaatatttagagcaggtgtaaatcaatgctactttaaactccaatattttattaaaataaaccattcccatacattgagggagttggcataggtttttttgtgacacaatgttgaagatttattagaaaggacaaacatagctgcatggtggacaagaatttacagcctctcataatgaaaattttaaaaaatgggattttagattaagtctacaattcaggcacagctaaaatgataaattttagttattttgaaatatttgagctatatttaatattatttccagtagcttcatttatacttaaataattgacagagtcataaacaatagtttggcagaagcttttggtttgcttatacttaatgacaatgtaataattatagccaatggtaatgcatgtgaaaacttaacaaatacaattctgaagttgacataagaacacatgttgttcagttttgcagtaactatcatctttaaaagtaaatattgtgattgtttaggaatatagtatttaacagactagaaaaataaaagtaaaattttcaagtgcatgaaatacatactaattctttaagagactaatgaagttattctaaaaatttagcgactatagttactcaggtgtctgaatcaatataatgaaacataatgaagcatgacaaaatatatatgaaagtagcagcttgaaatcgcaataaatacacatatatttttaaatgttttaatcatttgaaatatatatgtaacaatttataataaaaagtatatttgggttttaatgttttaaaataggggttcattaaaatgtttgtgggtaacgttatgtttttaaaatattagctattttgtttgggtggagtatttctgataattttttaaaccacaaatgtttcataattttcaacagcaattacaacagtttaaaagagtatgttagttatacatttgtggcatatccatgtcgtcactgatttaaaaatcatttcaggtacagtggtcattaaaaaagtcagaccttattttttttccactatacaatcatgtgttaaggatgtagatttaaagttatttatgggatcatcagaataaaacaattgcctcatagtattagtaatttatattggtaggagtcttttctttcttaagcaccaattctaccccccacagcccagaaaattgattttatccataataatttatagcattcttcatcaatgtatactgttgtttcttttaaattcattagcccatgttgcttgtgaatatggaatttggttattaaaatggtttcatatgtttactacgtataggctctagctttgagctgcttacttgcttaaataaatgttttcaatttactataatacaacaatttgtagagaaatgctgtgaagcatagttaaaagaatgaatccctgaaatagagtcactttttaaaaatatgtcctaacatgtggtctcattttttcatgttttgcattaattaaagtcctattctgaaaaaaatatttttgcctaaacttttgaattaacaaaataaaaataaaaaatatataaatatacgaattttggaaatcagtgatgtaaaaacatgctttaataccgtcttggttgttaatttcaaagatttttctcaaaagacgctctttgtaaagtaatgagaaaatattgccacttttaattattaaataatatttactacaatacaatttacttttatttaattattaaacatgcaatatattttaaattatttaattatacatgcaatgtatgctttaaaaatgtattaaaataaagttaattgcatgttctctctaatcatgttcttgtagcatgcacacattttaaaaaacccagtacatgtaatttttgaaaatagtatgtaccattacacctttttatttgggagatttattagaaaataactttttattcagaaaagattatgacagaattagataaaaaggagactaaaatgtgtgttaaatcgtgtaatattataaatgtaattaactcttcatcttccaaatattgaaaacagtaatgaaagagaccaatatttaaaaatagaatcttgttttaaacctaaaaaaaaaacctaaaaaattgttatatggtaacagctttactttcacacaaggcaaacccactgttgagtgagttggctctgattccaatggtctcatcaactttgtgaacacaggtacctcagtggtgcctctttcaagacaacaaaattaacttttagagattaaaaaatatattttggcaattgaaactcaccagtgcctttctgcttctccaggaagttgtacccgtcagcacctgctgagggctttgttgtccaaaccctgacaggtaaaaaaattcctgcagaataaagccagaccagctggctttgaagagaaaccccccagtttgggctgcgtttgcctcctctccttttctatgaagaccgaggctttgccccctt

SEQ ID NO: 2575 - DNA, 185865 bp, Homo sapiens; identical to SEQ ID NO: 2574
  source 1..185865: mol_type = genomic DNA

SEQ ID NO: 2576 - DNA, 105687 bp, Homo sapiens
  source 1..105687: mol_type = genomic DNA
tcactaagaaagccagtaactttactgaattgtctgcaaaatacaaattataccttatttccagcaggagaaacttttgaaaatttcccacttttattcactacagacagctgaattaagtcccttgagatacacagatgtggtttaacttagttataacatcttgtcatctagtggcgacaaagtccagcttatgccgctgtgagcctctatttgaatatttgttgcaaatgcttgtatgccctcatttacaagcgattttaattactctcatttaatggaaacaagtccccaggaaaagaaaaagaagaaaaatgatacagcaaaccatctgaagcaatccaagtcctatgcctacagtgacccaggtctactttgctcgaagagaacactggtactgcattcaaaccacaacagaatccgtcacttaactgacctctctgaattaaactgaggtatgaatcaatttgaggtatgaacagggaaggcaaaatgcaataccagattatgaaaataaccaaaatggaaaaatttgatgtagaagatatgtggcttggattgctccacatctttggttaaaacatattaagaaaagcctttaattacatctgtagtctgaagcattctaacagacaccagtattccagcaatcttcaaaagatctgtagtggcaggaaattaacgccataaaagtgacgacatcacggcagatggcacaaatgagaacagatgaagtatgccatgcttaggcaacagcctttattgagggttcaagtggcttcttcttctttaaaaaaaatgttttttaaagaaagaactacaaagcgtttactctctggagaaacaaacaacaaaataaagagggcaaaaaatgctatctctaagttaaaagatgggtatgtaagaaaaacaaatccataaaagtgtgtgagggcagacattcttttaaaaagtgtcttggaattttgttttttcattctcactttagttaacttttaaatgatctggggatgacaggtatttttatattcatcattacaaaatgctaaattccacctttgggaaaaaataagccattttactaaaaaacacaatttttaaaaaggttgaaataaacagcctccacgcagcaatgcatacaatatacaggttgtgcagcttgcgtatattgcatcactgttaccagtattcaagcttcatattaccaaaaatcttttaaaataggattagatataacaatactcgcagccgtgtaaaatgccacttatggatcttttacttgcaatgaagaatgttgcctaaaatgttactctaggacgggttatgtaaaataatactccctcagggctctgccctaaagtctggaatacaaaggatttactgtgattaaaaaccatactagctttgcaaatacaataaatggtaaattacagataaggtataagggtaaagatagaccaagattgtttacagaaagtgactcatcaaaatcaaaattgtgcttcttctcattaaatcatcttttaaaaattctcagattatcccttccctatcttgccaccactttataagaattcagtagtgggaacaagagatgactggcatccattttcaagtgattctgttctcttcatgttcttataaaactattgtcagaactgctataaatagccaaggcttctgctggtactttagcttactttatcttcagcattaaaaattcactttttctttgttgctgaggcaaattgcaggttaaaaaactaatatggctatttcttcatattttcatgtaatgaccctttcccacccactggtatctactgatattgatatactaaagtattttgaaatgacaaagaacatttgtgaaatgtttgcatattttatacacatcaagttagaaggatgggttgtaaggatgggatcaagtctatggtgaggaaaatgattttcttattttattcccctgtgcgtgtgtgtgtatgagtgtgtatattttcagggatgtttttgtttttcctctgcataaatgttattctttcatgttccatggataccttgagtagtgggatatatatgaaatggttgatagattttttttttttaatatataaaacattagtacaaggcaggctagcatcctttatggatacaaccaaaggtgcattgtggtctaattgtggatttcagatcaagttaagaaaaatatagcctagttaataaggtctcttggcttctgccacccagcggcagccttttacaatgagaaacacatagcaactatgcaagtaaaagagaaaaaatggataagaaatgtcctacacatgatatagcagtgttgatattactgcctatatcttctttgctgtgtatgtcaatgcatatgattggagatgaatcgacagatcttcacattccaagagaaggaaaatctttcctagactgaaatatcttttaaacaatatatattgactttcttatggcactcacttattaaagggtctgaaaattaatcccttatagacgaatattagacaagagtcattttttttaaattaaaaaaagggacatagagaggttctttatgggatttcttgaaatggctattaaatctctttattgaagaaaaaatagatgacatacatgctttatgcagaagtgacatttgggggtcctgacacaccgggattgttcaacagtcctatattgctgacaagattgtcaagggtcagttaaaataattaaaaacggatgacaaagcaactatccctttacctgcttccttcttgtctagcacccagtctttcacatttttcttctgtgggaatttataacttattcaccaagtaaattccatatcacttgtttctagggccatatttgcaggacatgtgccccaacatagcttttctattctgggcatatttctaaaaagcgtatcaaattctaggctgaaaaccaaccagatgatttagaatatgggcaagttaggatatgcacttactgaattccaagatgcatggtgaaatggtgagatcagaaaggggccctgcatttgataaaaatgcaaaaaacaaaataaaaatagcatgaaagaaactagtatatacaatggatgtcagttgacccaatagattgctaatgtattaaaaacaatttagggtgttgcaatgtgatatgttctaaccccacaggttatccttttgacagctgaccttaaacttataaaatgtaagcagagtaaaagaaaacagaaagaaaatagttactcaaatgtgcaactgcacaaatatacccccctcccgctattaagataacaaaacttctgctattaccataatattatatatattagaaagctatacacaagcatgttaatttcacagatttttttaaaagattcttaatattttatataattagaaatacacatttcaaaaacaaaacttctacaaagagaaaacagttatcttggttagcaaagcatggagttcttcatggcttagggtagtgctttctatacaaaaagtcctttttggttttttacaggactgtttaaaatattagcgaagctatcaaggggaaaaaaacacattttggcttaagtaaactacaaaaagccacaaatgctttgcaaactctgtcttaccttttatatgaaaataagcaaaatgtaatgtacatatttttatatttttatttaataagagatgcagacccagatttatttatttatttaattaaatatgttagccctccaactccacatttttttttaataggtatggtcctcttttaatggtctctgatcctttttaatgagtgccatacgccaatgatatgcctgcaggtttgtgagcattcttgggatgtcaggtgacctggtgtgttcctaacatttaccaatggccacccattaccgggtctgtccaagcatctatacatttttctatatgttgcataacagctgctctctctttcagtaaagatctgccgcttttggcaaatgtttccttttgtctatttacatgtaaataacgttgaacctgcaacatgacactatctattgtaacatacattttgcaaaggagcacaacagtgaaaagaagttagccttaaaatctattttgtacaagtgttctgttgtacaactcaagtgctaagcttatctcagcatttctgtttatctttatactgtatcactgaggcaatttaaaagtacttttacaaaacagagtacctgactttttttttttccacacacggcacatataatgcatatcgaccccccttccccattaaggtatagcacacacacacactgcaagaaaaaaaaaaaaactagtaagtaataatctgatcatgttgcccatccttcagaaagtcgcatgcgcttgactgagggactttccctttcgtccggcgaaggtctggtgagtccaatgggggagtggaattcgttccggtgatcctctcggtcgctcccgtcgtacgaactgctacagctgctcaagctgtcaacaggagatctccccgcctcgtggcgcgtgtgttgtgggtatctcgaaggggtggtggtacggtctctaggaggagaaacaggttctgacttgatgttgaggctttgagtagaaggcagggagagatttgaactctgagataaatgagtgctagtgcaagctctgtaggaggaaaggaaacccagttacagatgaaggaggcctggaggccccaggaactcacaattaaatcaaacatcagcttaaagactcgcatagacaccagagcatgcccagagtgaagaaaacgtgcttggaagcacataagggcatcgccttctcagggcgatttaggatgcctttgttgatttgcccggtagtaattacagcatttaactggtccaggcctcatgaattatatctctagtctccgagaggctccctaaacatataggttaccatttcagaaaggtttaagacacaatggaaaaagcattttctgtgttcatggactctatccctagactagttctaaaaattaaatttctaagcatttagatacagtgtttagctctggaattagacttccttgatttactaatgcttgtgtttgaatattatttttaaaagcttattatcaatataaatatttgcctccaattaataagcacatacagatggaatcacatagtcttcagagaaagtgaagggagttaaattttaaatgactagaactcaaatgctgcacaataactgtatctggtaaaaagctttggaggtggaaaaaatggaaagggggagggaaattgaaaattatctgcagaaagtttaaacgttggttttcaaacacttaagactttctactccattaaaactgataatttgactttcttcatccttttgcagttacatgagatgaaaatactttgtgttccacaatgacctcaattttattaatgttagtcactccctgatgcgtgcggttcttaggctaccactcctcttatttatcattggcattagttgatgaatctggtgttgcctaaggaaagcttgttgccaagaaggatgtagtgtgattttactgtgtttataatccttaatcctcatatattcccagagagaataatttttcctttttccaaaatctgggaaaatttagaaacttggaattctagaggaaaaaagtattaagcccttaagtgtagattagcaatcacaatgactttgatcaggataaaccatagtggcattgctcgcatcaattttaagatgcttttactcttcttacactaattacactgacttccagagctagagtcaggattacttgactatattgtcaaaagagcatggtactctcttttactgaggaagaatccaagtgaagaattatccatacagacacacccattttaaacaaaggaaagcaagcctacttactaatgtatgtaattatgctgctttccagtggagagaattagttggcactaacaatgtcattatgaccactgagagaaaaagtatatatttcagaaaaaaagtgaagtaacttggggctggctttttgggagatgcaatacaaactcaagatgtatagtgatataaaattagtcagaaacgagtttatctttgagtgatgttttgtacaaaagcaccacctactggcaaagaattactttccttctcctattaataaatagatgagctaatgtagagaataatataaaggagaattatttgtttccttaataagcgtctctttctctagcttttatgatcttatataatcaaagcagtgttagcatttatatcaagaaactacactgactgtatataattttcaaacacctgtttatatttggagctatttatttgtagcttattaatttatagtctatcagtttactaattttccaaaagttttaattaaataagccttgttaaaatggggagagggaacacctgtatttcaaaaggattcataatggtagactattttatcttggttcaaagttacttagtgattcattctgatgtttgaggaaatcgtcttttgatttctggaataaagaattttcctggctctaagaaagaccatttcactaaaatttaattaaatgcttctgctatgaatcacacaactatttaataatgaatatgaattaggagtctgaaaataaaaagtgatatgtcaataaatacttttgcttgctctttgacatacagattatgtcttcacagggagggtgacatagaaaattagaagaaaaaattggtgagttggacagtctaagcagttaatctagacaaggtaagggaaaaataatataaccaaaattctgtttctttaatacagtttttggaagctgcattattcacctctttgcatcatcttcctatgttaactggcctgtataggtttagctgtgtatcttccccatgaaagatgtaacaattattggttatcccttcctacaaacagactagcttaaatttatcttttggtggaatttcatttgacactgaaaacatacatgaagcattttgagtagttctggggactaaatccacagtagtaaaatgcaagtgatatcttagattcagcttcattatactgtgacataggatataaaatagaatggctagtctctgttaacaaagaagtattttcttgaaaagaaaaaagtagcattaaaataacttaactgcatatatgctaggttcagatataagcatgttggtctacttgagaacaaaatatagacacgaataattatagaccctgataattgtgaaatactgcatatgtgtgggtgggtgataaagaggtgggtggggagatagaagccagatatgcaagttacccatatcaagtcctctatgcaaattttcatctattacagatgcttttgaattgggaaaactcctaccctttcccataattgttcagaaatcaaacatgactggatagttttattcaaaatttttactgcctccgcctggaaattagactatcaaactatatttaacctaaccttttataagtcatctctactcagagttatctctctcagtatgtactgaacacccacatcaacaaagttgacgtatggaaatgcttccagaaaacaggctgccctttttataggtggtggtttagaaaaacactaaaacttagtgttacactaaatcaaatattagtattcaaaggactttcattaactcttgatggcaagttcctctgtcagccatctctctccctatagcaaataaatttgtgttgcttacttagcttggttagataaaatcagatactaggttttaaaagtatagctttgaagacttaaagctccaaaggacaaaatgaactttttttccatggacaaaatatgaagaactctgtttatggttttgcaattttgagaaagaattgtggtaaccatcttgggctgctgggaatatctactttggtggagctgaaatatattccactctgctatgaacattgtctctagccaaaagaatgtgagcccgcaacacaaatctctgcgacaactttggcctggaaaatgtatcaattctttttaaattgatttacactgtaaagaattaaggatgctcatgtgaattactttacataagtattgcagcttgggattttttaaaaaaacagtttaacatttaatcgtgtgaatatgaggtagtccatgtgaaggaacctcctttcaaaaagctactctgtgtgtgattgtgagagggagaaaagagtgtgtgtgaagcagagagagagaagggccaacagtggaaggactggaagggtcattccattgatttgaggggtaagggaagtgattaagtgcaattaaaactcacagagaaaactaagagtcaaattaagcacaacgaaattaagtgttgaaaggaaccgggagctgaacaaaatgcttaacctttggctgttgtaattcagttcctttctgtctaaggctgtccctcctttctcattttctgaaacctctattagaggcagcagagaattagattcttccttgtaatagaaaagagttttaaaattgtagtacagctaaaatatgtaaataaatatgtgtttatatgtaaaaatataaattatcaggtactattgaaaacaaaaaaaagccacattcagagaaaataatatggcttttgacattgataacttttagggaaatctagccctataatggatgaattttgtgaaaaaaatgggaaataagcagttatgtttatttttgacaagaatcatgttcagtggattccctgctaagccatagcagttgatactttgtacaaaatatgtatacatgtacatattttttagttgcctggatggaattatgtgcttggtgataattacctgaagaagttcccacagttaatgtctacttgaatagttaacattccagagaaaatttaagtgtcctaaaaagataaaactctgcgctgatcaatatgtaatgtatcttcaaagttaactatctttcaagaaagctgaccaacagtatcacgtgaatttatcttactatttaaatgaaaggttagattttcaatgacagtgattagcgggtaggatgaacataagcaaacagtgtacgggtgaatatttcataatcagatcactaatatatgctaaatcactatcatgtgaaagctagtgggtggggggagagagggcaccagcaaacataagagacacaaagttgtggtataaatcagtgacttttatactaatcagtgttttattctcactgtctccttagacatatggatatataactagttaactaatacagctaagtgattaacgataacaaatggctaagcagaaaagtaaaagtgggctaggcagacagaatatttttaaaatataaaagcttgttatctttaaatattttatatcctcctggtattttcttttgaagattaattgcaattttggacttattaaatttacagtcaggctttcagttaacgttttaagcttttttaaaaaaatgatttgttttatatgaaatagtgtgaattgtgaattcagagctttttaaaggtttgaacgtttccatagataaatgacaagagtcatttctatgataaagacatatctgaaaactaccacaagggggcagaaagatacatcctctgactacataaaacaaaaattatttttatatccaaatttaggtaattagtattatatgtactagttagtattatatacatatatttcttaaaatatctataagtatacaactatactatgagtacattataaatacatgaagcctgtgtatcaattgactagttgttcctatgtgtattaggttaacattagcataaaccatatggtttatgtgaaaaaagaaaaattctcaaatatctaagcttatactataaatgccttcttatgtcccaaatgaactgtgtgaaaactaaataaaaattatatcactgatagaagtggaaacaaatgtagcctaaaacaataaggaaagaatttacctcattattacagagctcgctgtcctcttaaaaaacaggtatataagatttaagctacttgaaaagtattgatctgaaaattacacttggatttcaataaagtagagttttatacccgttaatgggatattgaagcacatatttagagactgtcatttgtttttcaaaatacattctaaaattatattataaaaaataatattgcttaccccaactgactgagggcagatggtggcatgttatgtaggtgttgctgttgccagccagttactgaaccaaggtgaagagcgctggcggtgttaaacccagacagagatgacaggtctgcactactcagagagtactctagattaaagaataaaacaacaagggaaaatattaaatttagaaattatcaaatggtaaatagaataaacattttcaatttccaaaatattctattaggattatcgttattatagatatttttaattttgaggggaggggagataaagcatcagcgataattctaatttaaaaggaatatactataaaccaaaaataagtattccacgaatgctctgaagtagcatagtccgcaattctagtttattagaactacaatctagtataaaggtatgtacatatttgatgatgtagaaatgttaaacaatcctgagaaagtgagctttttattacatcaaagaaacagctcaattttcttgaaagtgtgtttctattttgaactcaggttgcataaataaaactttcagtcagttaagaaagaaaaatgtggatattcactttgtcttagtgaagaatgggtaatgctgcagtgctgtggacggcgcaggccctaaataaagcttcctaatagagtaaaagataactttttcatcttgattttcaataaaaagtatttagtgtactaattgcacatgacaaagctactcaccggtaccatatgttgttgaaatggctgatggatatcctcccattccttgtcctggtaaagtaggagttgctacggaaaccactggggtagccaatgactgagccgactgggagttatttatcctttgattcttttaaaataaataaaaagacattactgatgaatttttttaaaagttaaaaatattagatttcagtattagttttccacataaagagataacttggtacaaatctcatgaaattaatcatttaacatgtgtctctatgaactctgccaaccctatcatttacaatccttcaagagaccagctgttgccatagtaacccattacatcagtatctcctaggcaactgaactagtaacaagtaccatagctttattatgggtaaaaacagactatgttgaaaactgatgaaatatgtatactgtacttccattgtttcagttttcattcaaatgcaaattaaaaaaaaattaaaatcaaccatggtagtttttatgttcagttctacatacagcagagagcaaatgagtaggggctcatgttatattttgaccagcaggtggtgctgtgaccactttgttcagattcttctaaacttccctcaaactagatggcaaagcagctaatgcgaatatttaactcattacagtaaagagataaaagatccaccacataaacttaaaatcatgagactttaattcccagaagaagaaatattttagttttatgtaatgaaagaatatttttgtttgaattttactataaattgtcctaaaatattgaaaacagaaaaaatattgaaacaaaaaaaaaaacctgacattcttttcacctgtgagtgatgccagaaattaatggtatttaaacataatcaatgttgacatactgtggtaacttccaatatcttccaattttatcaaagctaccacctctacctaaaagtagctttgcacatgccatttgagggaagcgctctcaccacttaccaaaagcaggtcgacatcctcagactgagagcatgcggaaggagttttattaattagtgtccgtaaatatttataattgggcaaaatcttttcaacaaaaggaaaagcatcttccgatagacacaacagtttaaacagttttaaaacccagactccaaagataactccttacaaagacattctttgtttcccttaatgagctgtttgtctcaaatgtgaagacaatctacccggttttcagcccaggtcagtgtctcaatgttcattatttcatcacttcattttgaaggaaaaaaaaagactgtgctttgaaacctcacttgctggaggaaggggagctacacacctggctgccagagagggacctaactgacccatcacagattccctgggacagcatcagttttaagggacctggaataaatctgttgatagagatggcctgccatgcacggcccacactgcttggctgtagccctgtaggaggttatatttattagacccagtttttttctgaagggaatgttgcatattatgtgatgtttttggttgatattcaaaattaatctgcactgtgccataataaactaatcagctcacaggactgttttaccctgaagcttgccacagagcagagaaagaaaaaagaaataaatgtgtttgcagaatgatctaaatttgtctaccgaatcttggttttaaacgttcttgctcttaagcaaagctaatttgtagaacactgatgtaagtctctttgttgttgaatttggtcccataacattatcttcatcttaggcatgcagacccagaagaaagaaaaatgacagggtctggggatataacctctatttaaaatttcttatttatttatcttccttagaggtgctacaattcttttttgatgtaaaatataacctttgttcctaaaatgcctaggattttaatttgcttttgagagatagctattttcatgaagtaaatgtatggaaagatgaattgaggcagtgtgtaggcatgcgatgtattagatataatcattgcaatacatctaagaaaggatttgctaattaacaggagaaagttcatttagaaattgtggaaagtactttctcattgtcagcgtgttgaggacataaatattgtaaaaatactatgttataaagtacctcattacctattattactctgcttatgggacgtagagattgaccgatggtagtgtctgatttttttccaactataaattgaaagccttaaaagaaaatgtttttcttatcctagaacatcagcctagtgaagttcaccagatatatatatatattttttttacacggaaaagggaaatgcaaaccagttaccagaaataatagctaaatacaagcaaggctctgtcaatggcactgttatgttaattttctgggagaatgttaagtaattcatcaagttagacaaatataaaaacagcaaaacatatacaaaacattatcaatatttatttaaaatgtagttttgtattaccactgatggcatcgtattcttgctgcctggtggaataagaactcggagatctggtttacggttattcattcctaaattcattgggggaggagattttgcttgcatattcttgttcaagttaccaggtgagaccagcagacctggtgagtttcggggattgccatacccgttccctgttaacaaaaaacaataaagcatttaggaagaaatctaggtcaaatacgtttccgaagaatacacaacatgagaataaaaacaaaagcttaatggtaagacgtacattgcaaaaccataggatgactgatttgacctccatgggacaagtaacccaattaagtattcaatagtcctctgaaggaagattaaaaactttttatgagaagagagccaatatacatcaacttgctcagaagtcagcatatactttttttcctatcaaaaatattcaggaagaaagtcagacagtagttcagggtctaagaaaagcacagaactggtcttgcactttaattgactagcttggcggaggcctggctggcgtgactcactctttcagttcactggtttgggttttattttgtgtgtctgtgtgtccttaaatgaagaaagggcataccagcaagactgtaatttctaggacaggcaggaggaggggaagccgcttacacattttgctgttcagttccgcttttctctgagtgaattctctctatggtttttcttccatctgctttgccctccttactaagttcagtgtacaacccttgctttcctcctcacacagaacttcagaaagcaagactccttccctggagctgaaatgaagtgatgatgcctccgctaaagtgctgattcaccaaggcacaggaatagccattgaactggaagactgaaagggttttcttaggtctctgatgttcagtatcctactaacagaaaagtgggtatcccaaggtctgcgtttttcatatttcaaaatatgaccaagagagctagggaggagttgattacaaatgccagcagagctggcatgacagtggactcagaaagacatctgctgatttcctccactgcctctgaagggagaataagagaactcagctacctgattcaacaatccttgctagaaactagacagttgttttctgaagctttctaaaggagacagttaaacctcattgttattgccatcattacaaaacacaagtatctattacccctgcatgagtgagattgtgtgctacccagtgaggatgcaaagacaaggccccaggcttgaaaagctctgaaatctctttgtggtaatccaatacatactcatggaaaacataaagaccaatacaaggcagcgtagggtgaggtgcctgcagagtaatccagattaagtgttattgagttcccgggagagaagaggtgatccaataaaagattcacagaagaggcaggaattgatgagggccttaaagaaaggccataggaagatatgttaggcttgtgactgggcagtaggaaagggctgaggtaggagtttaaagagcatggtaaggggcactgagaggaacctgtttagaaggggacccgtgaaaagagaggggtgtcagaggctctggagggatgcaggggttgggctgtggagatctcaaattccaggctaaaagtccttgggtttatatggtggaaatgaaagtttcagagtagaggtatgacacagacctctaagtggtcagaaagatctactggcattggtatactcaggaattagtaaggcctgctagtgtggaccagtctggagactactttgatggcctgagatagaggccatgaggaactgggaaggcagagcaaaggtatatttcaggagatatttatgggaacatctttagaagcaaaatatatttgaggcacactgtataaagcagatttgttcttcatatcccattcatttacctgtctcattttatgcatgaataaacaggctgaatatataacaaataactacaagattaagtctgtcaattggattatgaataaaattatcccagttcctggggcaaaaaaacaaaaataaagcaaactggacacccccaaaacgtgtgttaagtgacaggactcacttaagaaatgttggttgaatctgaatatcaattcccttctataagaaaacttctggaatattagccaaattctctaaagctagataaatatgacaaacccccaaattttctttacagtaaattcgaacagtattccatggcaaaagctgttacataaaacaatgcatttacttcctctcactagaagaaaaaaacaaacaaaagagagtatgttcacttaaaaaaaaaaagcttgacaaaatggagtgcttagaggagttttatatttaatatgtcatcctgaatcattattgtgaatatgttatgaacttagtttgaattaatagattctacgggataaaaagagaataagaacatcaaggtcaattctgctctatactttgctgtcagctgaaggtcagatggacacactgaagacatatgtcacttatctattaagcctgtgtgagatctggtttatataaacaatcaaatggaaaattagctgggtaatttcaaaagaagggggagaaaaaagtctgttaagcagtgcaatgaagcttgaatagatcagaagaaactaaaaccccagctcggtagatgccgatactggtttgcatggaggagttattttgctaaaaggaagtaaaaccgcttcgtgaaatgtgttgtcctgtgatatgacaagcactgggccagtgtgcgaaaatggaaatgcttcacggaggccttgagaaaagtttgtttttttttttttttttttttttttttttttttagcattttctacagtaaactctctgagaaattccaacaaagcctatgtctttttgcccacattttaaacagtgattcagggcagcagtaggggaaaaaaaagtaaatatacattgtagcttttcattcagtaaatacctcaaaactaaaaaaattgattttaaaagccttctatttttctcttggaatatttcctgttatttggaaattacgccattttagaagattagtcacatattttaaggtgtttacatactgaaatgtaaaatattttgaaccatgatgacacttcttaaattcatatttttagagcatcaagttatttttaagaacaaataaattctgctttttgctagtgaatttctgctgtttttagcatattgtgccagctagcattttggagccgtataataaccatttctgtttccagccaccaaattgttattctttggacataatatagattcaggaatgcaagactgtggatcctaaaccagtgatatagaaacctatgatttgaaaatcaatgatgaatacatgcgtgtggtttactgctaagaagagcctgcatttaaaccggctgggaaaccgcagcctcctcctcactcagaatgctgcggcctgtgttgagcctgttgtcccaccttaagataaattcaccaaagagaatggtcgcatttaaattcaggggtccgggaggtgggaaacaccacctctcaacaaccttctaatatatggattcaaccttttttcatgctatgttttaaaattaccctctgcctggacaattatcaatttagacgtgactgtatgcagatgtcacattcctctgaccacttaaaggcacaaaaattataaagcaggagtgaatggatttcctgattatagattataagaaaatgaagtacagaccaactttagagtcagtttgttttatagtttcatttgattaaaaatattgttttacataaaaataacaaatttaagcatatatgagttaacttacataaaggattagagaatctacctcttctggttacaagtttgtatatactcatattagtgtcaatacatagaacttgaatgtggtgttaggagaaaaacatttttctccccagttaacttgcaaacacttgctgcattttttttattgactcctattttaagaagtcgtaaattcaaagaacatattcctggcttaagatattatgaggaaggcattttgccttgtctcacagagctcacttgaacatgtagctctctttgagctcaaagttctgaaactttcttttatttggatgtttaggcattttgagttttcttcacttgtttctttttcttttctaggactttgaattatgaatacaagcatataagactaataagcataaacagaattagtcactatggaccatggctaattctgccattggcataaccattttttaatctaccaaactgtcatcttctattatcccctctcctccttccatctccatatccaatgagataccaaatcttattcatttttcttcagaaatgcctgtctctacttccactgccaccatcttagctttggcttccatcaccatttgaataaatatttcagcaactcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaaatatttcagcaactctccatctgggcctctggtctctacttgaggggttcttcaccaggccttaagaggagtttcaggccttcagaggagttccttaaagctgtatgcaaacttttgtgcatttgtgtgatgctaaccaacccactcaaggaagtctttctgaactgctacttccatcatgttcctttttcatacatgagtgcttaacacagttgagtcagtgccctgcctggctctcagaactgtctacagttgacacactctatctatgaaacctaatttccaatggtcacagcctgccttatggtcctcggaatatatgcaaatctttgctctagcagttcaataactggcagtattggctctcctgtttaattcaaatttatcttttaaggatcaactaaagttccaactctttcatgatgcctttcagacaacttcagcccacactgaattcactcccctctgctgcaattagtggcagcgataatacacagagtactagttctttatatgtttcaggtgcttcacaaatagatatatagaatatgctagaaaaattaagaattattcaggaaaggcactaaaaggtaagttattgagggacaatgaggtgagaactgaaaatgtaatgagtaacttgttaaattgaaacatcaagggtctcttctctttatgctacttgagaaaattttatattttagataatgattgcaaattgatgaccaagtacactattgagacaaactgcttatctaccatatatatgaaagccaggaaatcatgtaagtgcccacctactaaatttgtttatagagagttaattaaagcgtcttttctacctgttgcacctgttaatcatttcacagcacattaccttagctaactgcaagtggtagaattaaacaagtcagacattttccctaatgaaaatgaaaagttgaagtctctgatattttcttccacactgacgagtatttgttgccacaggttgtcgttatatcaaggtaaatctcaatactaatttactcatacagaacttttcaccaaaagataagctgcatggtatcctagggaaaagaatggtggcagggtggctattaagagtgaacaggaatttatcagatggttcagagagaggctttgcggagagaaggaatgcaggacagagagatctcagagtttagaaggaggggcattcctctgaagatgaaacaatggatcttgaagagcagaaagttttccgaagttgaaaaagaaggcttggctaacatgaacctctaagattatgttaactttacactgtaggctttatactaagcttttaccaaattttatactctagaaaatgagtgcctaagatagcttcttagttgttagctttattaaatttgtgttaggaaaggaacaatgatggcagtggaaaggagagacaaaagggggttggactgctgttagagaagctagttagaacgccttgctctagaatacatgagaaatgatgtctgaatgaggcagcgcagagagaaaggtttacaggcatccaggagttggggacaaaaaaaagataaggcagagtaatctaggttctactcaaaatgtttctgttaagagttctctcaaccctacagagccttagttttctcaatagaagtatttccctagtgtgagagaagcatgaaagtaatctgaatgagaggctctcaggtactcatctgaggcagtcattgacaatcttaccatccaacaatattagcaatcgctaacacagtgtatagtattatttaccaacaacacaacattaagcatacacattaactgctcagaagagtaccaggcacttgtaactgctatgtaagtgctagatattgtacatggatataaagcacttttaatcttcacaagaacaaccctgtgggatactaatagtatccctatgaaaaatgagaaatgagaaaaccgaagaaaagagaggtccaggaatttgctcaatgtcaaacagctatcaactggtgaagctatgatttgaacccaagcagtatgtccagagtccatgccctgaagtacaacactacactgctccttcagaaccagtcatgctctgagatagtgaaagcctttctatgtcgagtctcatttgcaaattatggggatacaaatgaagagaggacacaactagggacaggacagtcaaggttgtcctaagccagaggtgatgtgcaagtttgagggacatgttgtaaggtcaacttgggcatagtaaatagtagttctggttcagaagacactgaattctcataaagaggcacagaatggtgatgttcaaaccatatttctggtctctttctggataaataaatatttacaagtaggaaatactgagtttagctacactgaacaccagagtagctgtttaacttttagtgtgctattttgagtggatgattaaatatgcttttaaaagtagattttgtaatattttagtcaataatcttctcccctgtaatatacttaaatggtaatgatgcttacttacttactgtcaatttaagagaccagcttctatcagaaacacccaatgttacagtgaaatgtccagtattttttagtatctgcgattagttgttacccgggaaataacttctaatatataaatgtataaaaataattttgtttagtaatttgttaatagtatctgattttgagggatttgaagcaaattgacacaggaaaacattaagctgaacacacagctggacctctgaagtatcaatttgctgcttttacttcaacaaaatgttttactcactttaaaaaaaaaataaagcaattttgaaaacagttacagcatactgggttgttagacaggaaatgtcacatacataataatgctcactatcatcaattaattttatattttagtttttaaagttttaagattaaaagttagtttccaatatcaggatattgttttgtgcctcaaatgaacatacatctttttatagaaaattactttaaattgtgtatcataaacttgctcatacaatcccctactctactggaagtgacagttgaaaaaaaaattagtggaaaaatatgatcttctagactgcagtcctagcctgaatgcctgaaaccttgttacatatgctaggaactgtgagttattcagctgttgtgtatcaaaatcagttttgtttttatttttatttttttgagaaaaaaagatattttacattgaatagctctaagagaaaaggcaaccacaaaacattcaggggtcagaaatctgggtatgatgaaaatttcaatatgcttaatgtagaaagggggcaaatcagatttctgattcttatcttgctaaagactcctaattagggattcttacacacaaaataaaggctccactttttctgggggtttcttagggaaattatataataatgcataatgttaaactatgaagaaacttctctgaaacctcagtgcattttgtggtatattcttagagaaataccccaagactataccaaagccaagaactattcttggccataccagttcaggggcatcagacgttctaaaaagagagctgtctcttctctttgaccatgtcacctgatgctggaccagagcttcaggaatttcatatctagcctatttgtccttgacgtttcttgggctgtgttttgttcagcgattttgcgtgtgtgtgtgtgtgtgtgtgtgtgtgtgtgtgtgtgaaattaacagtctgtcaatgagacaatgagcttttaacgtacagcacatactgtgtaagctctggattgtgagggagaggtaaagaaattttacttattactaagttgtttttccaaagattgagagtccatcaagtaggtttgtgttggcgaacattttctcatttgtcctaactgtcatgcggatttaggcatcaccatcccagcttttgacagatgaggaaactgaggcttaagaagcttccgttacttgactgagatcaccctgtcagcaaggaagaggctttgatttgaatccaaaatgcaggttgctaccactacattacaaaagccagatgtctgagatttagcatgcatccttgtatttgcaaataaggaagaaattgacaatctgatgtctccagtacaaaaaaaaaaaaaacccaaatatcattctcctttgggtactgatttactgaagggatagtttttaattgcaccataaaaatgctattgaaccacactatctttaaaaaattccatttaactatgaatgatagatttatgactcatttaattgttcacttcttgagattttggggctgtctctttgctaaaaatgagggggtgtcttcattattgacacaatcgctcattctttcagtcatttttataaacaaaaatattgagacagtataaattagagagagcatgacagaagagaaagaataattacttgtggttttaacatttacacaactgctgcgaacacatcagaagttcataacgttcaaagtgaaatgtgttgcactgtactgtactgctctcacattctgcttcagatttattaatacatccgctttacttccacccttgaggataggagccccgtgctggacatctctgtgaagcctactggtgtgctcccttcaccacacatttcataaatactactggaactgcattaagctaaacattataaccagaaaggctagaaaatcaagaatgtagatgattataaccatagctcacatttattaacaagcacttactctggggcagaaactgtgctagaccccttgcatcagttatctcatttaatttttacaacaatccggaaaaagaggagtttaacagacttttcaagggcaatagtgccatccctaaaataatttgtatatcacatactttccttggttgttttatttttttgaatatctgcctctggaatcttttcccaaactactccttgggcaaaaattttggtccatggttttacggttttcactgagttgcttaatattagagccaactaaagattcagttttcttgattgttatgtaaattaatgttataatgtttgaatatgtaaactggccatagatttagttttctcttactactatattataatgttctatattagtatagcagggctttttcctccttatactttaaatacaacataatcggttctttataataactggaggtggtgggtggactctaaggtcaagaaattgtaaaaagaaggcataatgtctagtaaaatagataaacttaaatttgagttcagttaaaacaattgaaatggagcaataataaataaacacagtgaacacttagcaccttttggacgtatcagttggttataaatttaaactgtttatccaaggttcttggtataatacttaagtttaacatagctaatgatctttcaaatatgatactgtatcatgactaaatattctttggattgaaattcaactgaaacatactatgtaagtgtaactgcaaaatttaagtgattggcaaaggtttgtctaaaaacagcagattatactcttggctgacagccttgaagcaccgagtgagaaagtccctggtaagtaaaaaactgatttccaaaagagggggtttttaaccaaatccccccttcagcatctgctctctactgatgcacaatgtcacatcactgatgattatgaaaaaagctttcctttctgtgttatctccaaataaaatcttatcatgatgccaaagatagggaagaggaacctaataggtgtataaagagaaaagactgctttgagaaaaaaagacaaattctgaataaaactagtatttcagggggaaatattaacggcttgaatttaatattaaaaacaaccaaggttttcttatccttcacactattaggttaaatcaatgggatatgagtaaagaaaccaatcttcacagtactttactgtagatatagaaggatagagaataaaaaggatacaatttgtgaagtcagaaatcaggataaacaaagggctctaaaatctgctaaaacactctctaggaagttataacctaaaattttctttttttcctctggaaatcaaactccttaagaatgaagtcaaaccaaaggggtcgaaggcatattttacaacatcctgacttaacctgtaacatttttcatttgtcttgtctttgacctgcctttcccacttcaacatgagcccctagagaatggtatcaaggtaatggtttatctataatttgcttggttttgtatatggaaagtgaacactgattttcttggcagtagctgcataccacatgctgtagctatctaatttgaggactaggtttttttttttctttaatcttgataaacttggtttgggttaaaaatatcattgttacttaatttcataaataataataataaagcaatgccgttagttatttacttatgttttgggtgaactcccaaggtaaaactgccaatgaattcagaatttttaattcagaacaattcaaactaatggaacaatactttcaaaacagaacccaactattaacctagatttttttcatttgctgcttaataatattttaaaaataatataaaaattatatctttatactaacaattagttttcttatttgagggtaattaagtatctttctccctttcttgaatattgcaatcttaagttatgttttcctgggcaacaaaaaatgcaaacttgttaaagccaactttttaaactaaatttttaaccacttcactgatattttaagtcactaagtaagaattgcagagaagtctttctggccaataagaaagtcagccaagaaatttttgataagtattcttgaaaacaaatacttgcaaaacaatggtgctggtacagaaaaattaagcattgtctgacctttcctctttccacttagttctattttgtaatatgctaagttttttctttttcaatgctagatgaattacaaaaacataagcaaaattttatgattatattatcataaaacattgcgtgtaaatggattgtaaaaatatttgtttcttatctccaatctgagtaagtactaagttcaaaggtgctgagtcatgacctaaggtcttgctagatggagtctttccagagtctggaaaccagatctcttattcactgctcaatatttatccacggcagtacactgccaccatcaactctccatgtatttagctgacataaattaagcattccagaagtgacaatgcttgataaccaaatgcataaaatagtcaacaattaacattcaaaataagaaaacagatgttagtttcttttttataaaattatatctaatttacaataaatgccaattaaaattattaaccaatatacataaatctcctttgccttactgtcaaatagctatgtagattgtaaaattatcttaaatgttcaaaggaattcctaaaggtttttcatttcttttttctctttttttgatctcaactatgaatcaataactccttgagcatactggtcctttctactcaataaaaggcaatcgtattatcaaagtgaaaacaaaggatactaacgggatagtgaataatccaacacaaggcattgctctgctaatggttatttccattaaatctaatgactacaaacaaccgaacttgatcttaccatcatcaataaccactcagattagcatgttaaaagctttaatgtggtcaggcatggtggctcacgcctgtaatcccagcactttgggaggccgaggtgggcggattgcctgagctcaggagtttgtgaccagcctggacaacgggtgaaaccccatctctactaaaatacagaatattagctgggcatggcagcgtgcacctgtagtcccagctactcaggaggctgaggcaggagagttgcttgaacccaggaggcggaggttgcagtgacctgagatcacaccactgcactccagcctgggtgacagaacaagactccgtctcaaaaaaaaaagttttatagagttatgacaaaatgttattttaaaagcagtgacttttcatttaggttgttaagaggaaagaattaagtagtggatgaataaccatcaactgaaaccttagaaaagtcactgttactaactaatgtattataatgacttgctgtatatttctcttataccaagagtacaactccatcctgctacttctttattaccctttgtcttcatctttgaaagtatttcaagttaagtgatgataagaagttgtattaagaggtgatttgtgatggtctgagataccaacccacatttcatttactactatatgtcagctcttcaggttttccgttaagaatattagaggagttaatgaaactttgctttattggcccagggtactcagccatttaatcaaatggttaattaaacattcgttgtatactgtttcagaagaatacattatttttgtgagttacagatcaagggtatatctttttttattgaaaattacataatttatttgaaatgttccttctggtttacatcaacactattaaaacttcatggctagaagatctatttttcccttactcagctaacaaacatttaccaagtatctgctgtgtgctaacgcttaggtgttaaactgggcatacaaactgaatgagaaagagtttgcctccacagagctgagcgtcctagagagatgtgcccagatgttgcaatcataatgcaatgagaaatgtaatgttggtacaggctactatgtaagcacaggaaagaggtgcataacttgtctgttagagtcaggaaaggcttttctcaaatggctgaactgaattctgtgggatgacaaagagtgctcaatagcatgaagcagaagaaggaaaggcatgctaggattgcataggtaagagtaagcggccgtgacattgccaagtggcggcacagtgtagcaattaagagcacacactgaggccgggtgcagaggctcacgcctgtaatcctagcactttgggaagccaaggagagaggattgcttgaatccaggagttcaagaccagcctgaaaaccatagcaagaccccatctctataaggaaaaaaattaaaaaattagccaggcatggtggtgcatgcctgtggtcccagctactcagtaggctgagggaggtggactgcttgagaccaggagattgaggctgcagtgagcctagatcgtgccactgcactccaacctgggtgacagagcaagacactgtctcaaaacacacacatacaaacacacagtatgggacctgactacctgggctcttccttgtgcaattacttaatttccctgtgcctcagtttcctaatctgtagaaagggcataatgtgaacacttaatttaaacgactattatgagaatgatgctttttgtagagtgcacagtaagagcagtttagatgtctactgttagtagagctggagggccgggttcttgatagcagtggcagaagggaagaaggttaaggctggagagtaggaatgggcctagggataagatattcactgttaattttcaaagagaagccatggctggatttttggcatgtgaatgatgacctacagttagcttaaggttttaagaaagaacaagcagtcctggggagactgaagcaggatgcaatataaagcagggagatgaattaggatgttctagaaacttactggatgatggtatgatgagaaaaggatggctcaggcactggatgggaaagatgctacactttatgataaaactgagctgaaaaaaagcatgcttacctttttggtcttttagtatttataggcacaaaataaatgttcaatttacttccttgcctcatgagactctccctccctctcactttttttttttttttaacaaagtgagatgacttgatttagaaaaaaactgcagctgctaaaaagtaacgtaattgcagtctcgccacttggcctcaagagtttcaaactttatctgaaaccttgaatttcaatgacaatatgcaaaatttggaagctatattttggcctttttgctttggttttcttctctgaaaatgtagcaacattctggctggccttgttttcctctggtgttatgtgattctctgacatcagcacggatatattcagcctgacatatgatactggttggcatgagaaagaaggggaagatggctgagtttatgagtaggacatgacagctaagcttgagactaagtggcatctgcaacaggtgttccttgggaccagagttagaaagggcttcttcctctatttttaaaatatgggtaacactttcacagctatatagaaactgtgaaaactacatgctcgtagctataatatgcaatcaagatataatatttattatcaccagggtggagtaattcagtatctttcttttggttttcttctatttctgaattagaagattctcatacctatggtagaggtcctgaggtaagaggatgaatttgctaagtgcataagattttgttagttcaatgttactatatcctacgtgtgtcaaacttttatgcctacaggattgagagtcttctctatccctagaggatcattaaacttagccaactgtctgggaattgacaatgacagaataattgaacaaccaaacactttttattttcaatataggattccaaagcattctagctattaagcagtaacaagccacttccatcaaagctgagtaggccatgttttcctccacattttttttttttttactactttttttttttttttttttttttttttttttttgagacggagtctcgctctgtcgcccaggctggagtgcagtggcgggatctcggctcactgcaagctctgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcccttttttactacttttaatgactttcagaaccactactagctgtttccataatggcaagcaaatcggtgcagtgagatattgggtaaaacatcataacatctaaaccatttttcttatattatatcttggtctttgtgaccacccaattctcagtcctcaccattctttctaatcatagtgtttggtagagacttggatccaagaaacattggtctggatttgatctggttctctcattttgaggctacaaaccacaaagtattttttgagggaaaaaatttcatttccatgtccagcaaaatactacgtgagtttacacactaatttggctcgacctaattttcaaaagatatataaaataggaagctagtgttattcatcttgtttgctaatcactgtgtaggtctaatactttttcttcattattcagtgaattagtgaagagccagcatcagaacagagaaactctaccctcaaatagatatatttataaaaatgtatttgtaaaccaattttctttatcttctttcttataattagcaggctattctacttgaccctggcaaaatattttaattaggctatccatgtctatttcaataaacttgattttttttgacatttcaaacataaccttgtgtcattcatgcctgcctcctactattttaaatgtatagcatgttccagctgcagaaattaccatggttacttgttatgccaatagtgaactgcagttggcatttgaaagtattgtgctatcttgcctctgcattgaaaatgacatcgatatctcaataatctcaatattacaaattaacacggaaacctggagaaatgtgactgagacaattattggtcacagtgtaagaagttcttagctgaaatatattttagggtcttttggggatgcattatattcatgttgtctaagagctcattttaatgccaatgtgattttattttattaacagtattgttgaataattaaaatcttaacccctccttttctttatgtactcttctttagaaatgcatagaagttcaatacttctttggctggaaaatgattcatatttaatgtgaaatgattaacagagaacacaaaaagtatggtttgctaaaggtactcttgtgtccaaggatggtatccaggattaagttgattggatcagagcccttaattctctgctgaccagttgaagctttattaaggaaggttctagttaataaatagttttcttctaagttactatttaaccactcctgcttcagaaaagtgctttaaaaattcttggtgtcatttttccatgcctctcacagatctcttaactttatttgttcaaaagactttgtcctgcaaatcacctagtagaagaactcagaacaatgatacatactgcagtatggagtctgggcttacctgcactggtgcctgcaccagacgtgaggtctccacccatcagaccacctatggattaaagaggaagatcaaaacgagaaaggctaaaggcccacagaacaaaacactttaccttcagcaacctcagtattttgtcctcttgcaatagtcataaacttgtaaagtacaacccaagtcagatggctgacatttgttttattgtgccatgctgtgctcaaacgttaaaaatacattcaatcactgacattttgcagaatcttttttctaagaaagttacatttaaaaaaatccagtctttggtctctgcatttttattatttctaagtctaggttttccctaagcagatgttttatagaaagtgaaagaaagagtaaggtctactatatgctcagatgacctcacatttgatgtttagttctttgtaaatatgttttatgccattaattttgtgcaatgttaattgtccagaaatttgatcgtttcatgaatctacccacatttactactaaaatcttattgactgacacaatataacaaatttttcaccggccacagattaagaaacatatgcttattcattgctaactttagacagtatgttaaaatttggcaatgtttatttatgagagtcaagatgtttcaataaggtattgaacataaaaattacttttagttttgggcctggcgcggtggctcatgcctgtaatcccagcactttgggaggcccaggtgggcggatcacgaggtcaggagatagagaccatcctggctaacacggtgaaaccctgtctctactaaaaatacaaaaaattagccgggcgtggtggcgggtgcctgtggtcccagctactcgggaggctgaggcaggagaatggcgtgaacctgggaggcagagcttgcagtgagccgagatggtgccactgcactccagcctgggcaacacagcgagactccgtctcaaaaaaaaaaaaattacttttagttttgaaaaaaacaacattcagccaaaagaataatagtgagaatatcatctagattttctaattgcctctaagtgatactctgtaattattagttggttcaggttttggaattaaaagaaaatgtttgtttatatatatacatatatatacacgatttttttttttttttgagacagagcttgctctgttgcccaggctggagtatagtggcagtaatatggctcactgcagcctcaacctcccaggctcaagtggtcctcccaccccagcctctcgagtagccgggaccacatacacaagccactgtacctagttaatttaaaaaaaaaatgtttgtagagatggggtttctctatgttgcccaggctggtcttgaattcctgggctcaagcaatcctcccacctcagcctcctaaagtgttgagattacaggcgtgacccactgcatctggccttcgttacagtttaagcaaatgtttattatttccaatcagataatattttggaaataccgtatcaaattcaaaaaaatgagcatgagtttatcaaataggaaagtgaactgcattctagtatgatctgaaaggaatacatgtggttactgaaaattcatacgaaaattttcaaatatattcaaaagtcaagagaatggctcaatgaagtcctttgtatacatttcccagactcaagattaaaattttttatttggatgaatttaactgtattttctatataaagcttctgtaacaaaaatagtaatacatgtttggttttaattgtaaggcagatatataagtattctacaggaaaattcctccatgaataaactattttcatacagctatgtgtatgtaggatacattaaaaatttcctatagagtacttttaaaaatatgaaatgcaaatatataatggtttgctgtatgtgacttagaaatacaattatttttgatgctgcttctggaaacataaaggaataattttgttatattcaatacgcattgacttggttcctactgttagtttagcaaatcaagagaacattcttcccttaaatgttctttaaatccagtatcaaaatagacatatattaaatacaattcatcataatgtattttgattgttctaagtactaagaatggatgaactttttctgagaaataatttatttttctcttggacactgtgaattgaacaacagcaagtaaaagtgcagagacaaatttgtggcaggtgtacatgtgtttaattaacttcatttctgattcagctttgtttttatttcacatgtcttacaaatgatgctatcttatcatatttcctttctgcctaagtcctttgtgggataagttactgtataaataaaaaaaaattgacccaaataataaataactaaatgggataaatactatcacagaacacaggggaaggtttcacagaagtggtagcttggccaggaggaagagggaaaatggcattttaggcagggaggacgagcagaagtaaaagtgtggagaaaggatatctgacatcctgtttgagagtatgtggttaaaatatagccacaggaggagataggtgacagaatgaaaaagataaacggcagattatgaaagatttcgaaaaacatactaaagaatttaggctctatcatgcaggagacctagctcgggggtggatggtaagccatgaaggagagtaagtggaaaaccagaaaacatctcgtagataaagcagtgttggctttgccgaaaatggttccttccaactatttgttagcattacatccttatgaggacatacctgtgttacctgcacttggaggtcgatgtgttacaccaggagacatactattcctctgcagagaagggtgagccagtggcaataggttggggtttcccagtgagctgacagggttgctgtacaccaaactgttgtggctggacactgggatggagactggcatctcgaagttgggaggtggaacagcctgcaggaacagaaaacaaaacaaaggtaaaagaaaagaattaataacagaagctcttcaagacagacagcccttatttttccaagaaaaattctacattccaaactactttgtgtctagaagaccattaagaagagctctcaagacgttcagatcataaattgatttcttaaatgtgcttagaactccttctttgcaaccattaaaaaatgtttcacttttgtttaaaacaaagccccatttcattagactccattgtctttggattccattctattaagtagtaattgttcatttgtgatatctgaatctggtgccagaaatgactgcaagatcaaaggtgcctgattgtgatgacttcacagagaaaaaggattaaaatgcaaaccgaagcctttgatttaattgcttattgaagcatatttatgtagaagtttaatgatagaaaatcatctccaagcatgtgcatagcacatataccttaattatcattttttaaagtctatgttttaaaagtaactctaaagataataggcattttaacatacaagattcaacagagcatgtatcattcaataattcacattttgaagtggcaattcagaaaacactatgcttcatattttggtgtgtaccgccactgacaaatggcaagacctgtatctcaattgtgaaagttggcaaatatttagtgaactgaagctgtgtggatgtctaattagattaatccaggtttcaatgattgatttttgagtaattattttgtcaatttaagcaaaatcatgtttatgtttctgctgtactaactagatgaacataggaacataattgtagctacttttttttaagcattacgagtaaaaatactctttgaatataatgccagagaactcatatggtatcaaaacatatggcattcttaatataaaatggacatatatatggaataggatttatagaaggcattaaggcattcccttgggggttctcaataagttattgtgcaaatttaaatgcatatgtgcttgaggctcagttggttgttttttttggtcccattttgtttttactattgtttgcccttagtgctgacatccactttctgttactgtttggttggctggcctgcatcatacatctttctgtgtaatatttctctgtttatcttggtgatgatcacaatacttttctttgtttatgtttatgctcccttattattaatttcccatttttcttttcttccatgttctggacatgtcaatcttgacaacagcaaatgctttacattcaaaactcttttctttcacacatctttgatttttcatttgtattttatttcatatttacttttattattatattattatttttagacacagtctcactctgttgcttaggctggagtgcagtggtgccatctctgctcactgcaacctctgcctatctggttcaagtgattctgctgcctctgcctcccaagcagtggttggcatgtgccaccacgcccagctatttttttgtatttttagtagagatggggttttgccatgttgcccaggctggtcttgaactcctgagcgcaggtgatccgcccacctcggcctcccaaagtactgggattataggtgtgagctaccacatctggcccaatctgtcattgttttagagggaaataaaaatgttcaagtgatataagtaatatggtcagtctttattaggatttatctacagtaaacaggggaaataatttttggatagacatcatgacataatggaatataaatgtttgataagacatcaaataatgaatttagccttacatgtccagcccccttttaacaacaaaaaatcagcatatgctgtaaagtcgaagtctatagcatgaataaaatattgtatttcttcattaaaaggccaaataaggattgctctagcatacccaagaaaacaaagtaaagtgattctactaggtatattctccacttgctccatccagacccaccctctagccccttcactgtactgtgtgcccaggagctgaccctccagactgcatcaaccaggctctcctgccctctggcttcccactggtcagtgggggaggcaccagcaacagcacagagagcaggaggggagcaaagtcagggtatttttttatagtggcatcatccttgctgggccacaggctggctgaggctgcgtttctctagcgaagaccccatctctttttgagttgttctctcctatacacatagatcttgctgtgatctggtacttttcccctccacttactctttcagatctagagataggaacagcttctaggttgcaagccctaatgtacttcattattctctcaggttttccttaactctacccatctgtaaacagtccttttaacaaactgtcttcaattaccctttagagtttgccatctgtttcctgctgcaaccttgggccataatagtaactctctagatctagaacactggtactctacaggggtgggactgtctccttagggagcattttggaaatctgttggactatctttgggtatcaaaatgactggagggtgtgactattacactggctcaagcagtgccatctcttgcctagataactgcagtcacgtcctaacagatttacctgctccggtccttgccatcctttatattttcaaaccagaaattagattgaccctttaaaagcttaagtcatgccaacactcctctgctcaaaaccctgtgagggctctcatcttagaataaaaactcaagatgagaatttttttcttccaagggtccacaggccctattaagctctagcttttgccaacctccgttatctcatcgcctaacaccttctgcctccctgcctcatttccatgacgaactgcatcacctccttcaagtctctgctcaaaatctggccttctcttggaagcccacgctgaccaccctatttaatcctgcaatttgtcctgccccttgcccatatcctgatctctttctcctgctcttctttctccttggttataaaatcatttatgatgttggttaaatagtgcccttttgctgtgaggcaatgcagagcctactctacttcttattatacgaacttaatatttttcttcaaaggagaatttttaggaagacactctactgacacaaaagtaaagcttctatttactgtatattacttattgagcaggcactgtgctgtatagttgacatacatgatatgatttaaccttttaaacatcccttgaccatagatataattctttccttttcaaattggtaagttaagtaagtgacccaaagtcatctaactagtgactgagtctgttgcttttgctaccaaacactatgcaacacagtataagtttttggatagaaataaaatactgtagtcagaaatcattctgttaagtgaataagggctagatattagcagtttattatctttggaccatgtaaataataaactaaatgggttctcatgaaatgtgggtgagtatctacactggagtgtctcaggttttaggaaaaaataaatcttaaagactccccttttccatatttgcttagagtttgtatttaaagccatctctgggctacaaatgttttaatttgaattcactgttactacttataaatgtttaactgttaataggtatctaaggatctgctataaaactatatcttccctgaatatgctatagaatgttggttgtgtctcattagagagcaaagcccatatcccctcacccttgggtgattatatgcacatccaaaataaagaggattattaataattatgtaatgagttcagaaccatccaaacaagcaggtcagtgaaagtcattctactccttccttcctctgactattatccccaagaattaattcttcagcttctagaattctggatcagaaacaactggatgataatgattattataaaactactttgtgattggctaagcagtcaaatataattatggtatcagagtatagttgaaaatttcaaaattcataaaatataccaagatcatttgtattctattaatcttttgctttacctgtatcaagaactacctataataattttttaaaatttaattttattttagatacatgtgcatgtttgttacatggatatattgcatactggtggggactggatttctagtgtacccattacccaaatagtgaacattgtacctaagagctaatttttcaaacttcaccccgccctgctaccttccccccttttggagtccccagtgtctattatttccatctttatgtccatgtgtacccattgtttagctcccacttctaagtgagaacatacggtattagattttctgtttctgagttaaaggaactatctataataattttgaaagcaaattataagcttaaaaatgagcacactgagaagatattttagagaatcagaataaacactagcctttctatcaggaatctcagttacagtccaggttatgtaataaattgccatctaaccaggcaggtcatttaatctcccttgaccttgattttcttatctaaggcatgaaatggttgtatctatgaagagatgaagctgctctaaacattttagggaatgcaaatgctataatcacatataaatatttctaagaaattggcattattctttttctccttgacttttcaaaattaggaaacttgaaagcatctacatttaaacaattttttttttttgtctaaaaaatgaaagccaaaaagtagttaaaaacaccaaacttgcaaagacttcagggccaggctccaacttttacaaacactcaagataggaagaaagagagaatttggggtgattaaatgaaatgctgtcagcagaactggctatgtaatttgcagggcccagtgcaaaatgaaaatgtgggggccctttttaaaaaagtattaagaacttcaagacaatgacagcagagtatttaaccaagtgcagccctatgagaacagggccaagtcgagggcccatgaagccggtcccagctttgaaggacacagacatgacagctaaaaaacttttagtttctatccctgaacaaagtgatcacggttactgtagtgagtcataatcagaaaagtatctgaactctcatccaaaacccactattttcccaaacttaccacaaggaaaagtccaataaaaaaatcaaataaaatagttaaagtaaaatatttttagttaatgggccctcttttatttaatgtgagtgattgaactgaatcttccccccaccctttttttgccactaatgacacctttaaattttgattaaccattaccagctgctgggctgtagtagaggaaaaaaaaaatcatacaactctgatgacttgtgagtaccaatgctggttatctaaattccctcaaggctgcctgacaagtctatcatggacttgttcattccctctccaactcctattcctcatgatgtctaacttctcggtcctttttcaatcacctgcttcccccttccctaattaactacagaagctaaactaaatacattaaaaaacaaaatagccaggcatggaggctcacacctgtgataccagcactttgggaggccgagacgggcggatcacttgaggtcaggagttccagaacagcctggccaacatggtgaaactccatctctactaaaaatacaaaaactagccagacctggtggcaggcacctgtagtcccagctacttgggaggctaaggcaggagaatcacttgaacatgggaggcggaggttgaggggagccaggatcacgccgttgcactccatcctgaggcacggggtgagaccccgtctcaaaaaataaaaaataaaaataaaataaaatagaggtcattatatggtcacctactcagcgtaattctacccagctaccaccttagctacacctggctccatctgtaacaccttcttgtttaggtcccatcctccttcccttccttgagaggctttgccattctatctccattgtacctgtatgttcaatcttttccttcctccaagcacttctcctctgcatgtaaataatctcaagcgctttcattttaactcctcccttgatcctacatacaacattatttctctctcttcacagcccattattttgaagaaaatacatactgtttctttccacttcctcccttcccttttactctcaaccaacttgcacccgcctctcattcattcagcccctttcctaacttctgctggttcctcagacggaggtgttttctcttgctgtgaagcccagcatgaaccatggcgaacccagcatgaggaaatgctgctcgacacagttccaaatcacccatgaattattttatgtaattgaggaatatgggcataaattacaatatactaacaggtgactgcaatattaaattttctgttttaaaagggaaactcttcaaactgggtcttcgaaatagaaaaacagtcttgtaatgtttttaaagaggtggagacactctctacatacaaagggcagagtgtccttgccctgctgtaaatgttttagcagctgtggaaactttcaacaaaattgacttccagcaactcagagcgatgtgcaaaaactgggcttttcatcgtgaagactgaagcacttactaaagagatggagactctgtggcatagctcggagctgggtggctccttctcacagctctgcccgtaaactctaatgtggtttttcagcccctaccacacaccactgcaccccttaagaaatcacgtatcttgatcttgaactctttacgtaacaggctgaaatcctgtgagggaatacaggtgtgtattacatgtctctctccctaaagtatgagaaacaagatccaatgtgcattcttccagaactttaggggttaaaactccacctatatgatcgcttccattgagtgatcagcagtactgcatacatctgtctttattccaactgtgcaggggattcttactatctgacacacctaaggtactccgccttaacatcctacacttacaaaccttaatgcacagctgctccacaccaatgtattatatagcaagataaactcagatcataagaactaaaaattggcccaaatggcgtggcgcagtggctcacgcctgtaatcccagcaccttgggaggcccaggcgggtggatcacctaaggtcaggagtttgagaccagcctgaccaacatggagaaattccatctctactaaaaatacaaaattagccgggagtggtggcacatgcttgtaatcctagctattcgggaggctgaggcaggagaattgcttgaacccgggaagcagaggttgcggtgagtggagatcgtgccattgcactccagcctgggcaacaagagtgaaactccgtctcaaaaataaaaatagataaataaaaataaaaattggcccaaatgagccgcttctttttttcttctaggcaaaataaaataccaatggatattttattatttaataattctggacataacaagtatgcatggctacatataatactaaatactccatttcataaagtgcccactatgaatgtgtgcatataatagttttatgaaacccttaagaatttatagcacttagctttccttcatgatacagtgtattaataattctgattcaacaaaagttctactgctgacatttcatttaacaaaagaagcagataggtatttataaggatagaaattttaatatgcacacattttgtaaataagttttaaagtgttcaatttaattcaattcaggtttgagtgtgcagctactatggtaaagtattaatttatcttgtgagtgcagttgtgaatttggcctcgaactttgtccccacatatctgcacttgtaatcaccaaaacatattttcacttcagtctctctcatttctcaggtttaggctgttttgctaacttacaaaaaatgaacttttttcaaaaggaactgattgcctactgaggagcttgtatacaattaaggttcagacactaacattagttatttagaaggtatgtgagccttgggtttcacccctttcagccacaaaattaacattatttgattgatgacagaatctaataaaaagtatgtactttcctcctatatatgtggacaacaaaataatacatgcagttatttctcttaaatatctggcaaggcatatgattgactgttagaatttttttcatttggttaaaacaaaaattagccaaatgttaaagcatggaaaatgttggtggcaaagcggataatattctgataaagctttaaaatcaccccagcacacaaacatgttgaaatcttaccattaggtttcatgcagtctgttccctgcagcgagcattagctttaacccttcagtgctgttgttgaatttcatgtatagggagaggggctgaagttttattcagaaatcagcttttatttaggtgatgattgtcagtttacatgaaagaattgctgacccacttgagtatctgctcttagcaaacaatgtataatctatgtattttatagcaattctcaaacttgcttggaaggaggttccagtgttttactcatgtattgtgatttgcatggactgtgtgtttaaaagattgtgtaaatttacggtgtgtctcataaatctttctcttcctgctgtgaactgttctacctcagaatgaacttttcgatggcaactctgttagattacataatctcagcatcctttagggtttgctttctaaatgagctgcccgtgggatgagatggctatttatctgtttgactttccgaagagtcttagagaaagccatcactgagagggttaaggtatgttactgcagcagttatcagcagaccagccatctacctttggtacttacaggaattttatgactcttgatcatattatcaaattcttcattaatttttttgtatttttcttcagtgcgtggggtgagtgcataagaggagtcgggatcggggctttcacagcctttgttttctttcttgttcaatgcctgccaggttcagagaaatatcaagagtaaaaaaaatgaagggtgttctgagtacttacacacaatctttgcctgctgatcattagatcaatatcttcgttaattttcctgtacttgtcctcagactcagggctgtgacctacggaatcgtccgcatcggggtctgggctgtcacagccattaaggcccttctttctcaacgtctgaaatacataatttggaaagttcaaacctagacaaaggctgtaagagacattcaggggcattaaagaagttcaagctgtccagtatttcaggttattacatatgctttattctattagggaagagaaaccacagatgaaagctgagtcatttcaatcgagtgctcatcagcagtttaaaaaaataaaagcgaaagattcctcttgcaactaaattcagtcaatgaacagagggtataaggactcaagtttcatgatacagaattcttacgtgcttcaaatatctagtgagagacaattacagcagaatacaattaaggtggcaaattgcaacactctcttcccacagaaaaatcagaaatcaggacattacacaatgatttccgaacctgtgatgatgacaaaagcagaaatgttggaaacagatccaagtgtgaatttaaactaatggttggcattagtggtgtcctgtccccacagcctccacttctgatgtacttgacagctaaagggtgtaagagaacacagctaatatccccaccaagcatcggtgaagaatgctcagacgctgtgcttatatggagaactacttttgtttgttagggttctatatatgtgaaaatcttatcaaaatttataatactgagaaggtctcttcctaaacacaggtggaaagaaaagtgaaaacagctgagctgagtaaggaagacgaagaacactgaaaacaggtaaccaagtcaataactaccaaactagcaagggttcctcctagtttttcagctgagtaggaatcaccctgagactgacacatgaaagtaaaaagtcagtgcctcatcttgaacctcctgtctcctggatgtgggtctggtctagtctcagctgtcacagaagaataaatactaatgtaacattgtaacagaaaaagtataagttaggagtcttgagttttacttggttttttaaatttgagacaggattttgctctgtcgcccaggctggagtatagtggagtgatcttggctcactacaacctctgccttctgggttcaagtgattctcctgcctcagcctcctgagtggctgggtacatcaccatgcccagctaatttctgtatatttagtagggaatgggtttctccatgttggccaggttggtctcaaattccttgcctcatgtgatctgcctgcctcagcctcccaaagtgctgggattacaggctgagccaccacaacctggcctgctttattattattatttttttttactaacggttgtcaacttaattgtatacaattcgatttacagagataatgttatgtttttagagatcataaaacttctgattaatcatagtttgtcatgttaattattaatagactagcaacatttctgaattttcctggtaccaccaagatccgttataaagagatgcatacctaagtgtctctcattaatggaaagttcagcagagctcatctttattaaagacagaattcacatacaaataaagcaaaagctgtgacatcaagctaaggaattcaaagctgagataacaccccatctttaattcatgcaattggggaaaataaataaaacaacatgagttaaaaaggggggtgtcagtcttaaaaatctaaactccttggctcttatcaatgtgtaacaaatgtaacattatttaaaattagtttctgaggcactgaatattttcacttaaaataaaaaatcaagaaagctatgatttctaatatatctgggatacacagtggctctgtaaatatttattaatgttatagtggtataatataacaaataaacatatggttacagcttattatgtggtaaaatgtttgaatattaaaatgaatattttgacacagcatgataaaatatacatttacaatcttggggaatttataattggtggggccacctgtccccttatcttggatctacaggcatcatttttcactcataacaagtacttttagagactttctacagtaatactataaagaacatcacaatacattagaataataattttatttactaacttaacttcctgtgcttcatactcttttcttattatctcaaccacaaaaacattcttctggctgataactattgtattatgatgtgtttctgctttgatctctgcatatctttgagcttttaagaatactttctgattgtttttgcattatattccacatatttttcattagaattcatttgtatagagaaaaatatgtcagatcaagaaaatattatttgatatttttcaaaagttatctataagacatgttaaaaatattctttctttcttttttttttttttgagtcagagtcttgctctgttgcccaggctggaatgcagtgtggcgtggtcatagcttactgcagcctccacattgtaggcccagacaatccttccaactcagcctcctgggcagttggtactacaggtgtgtgccaccacacctggttaaaaattatttttgtagaatcagggtctcattatgttgtccaggctgctcttgaactcctagactcaagggatgctcctgcctcagcttcccaaaatgctgggattacaggcatgagccatggcaccctgccaataattttcttatataaacctttaatttaaagccttccataatgttaatttatagtcttatccaggcagtagatttttcagtgtgcacccaaatcttttaaccaataaatcttattgtaaaaattatagttgttttgatatgcagatttctgacaacagaatgcaagggtgaggagaggcctatcaactgtcattacaatccatctggcacatacatgtgtgctaaatattctcacaaagctttcagggggtagatattgtgtttggtttataaaaattcaaacatcaattacactttgttgaaagatctccacaaatattaacccattatctctcacaagtcttccatgaagagattaggtaaacctatgccaggtctcaaacccatatggccaagcatgatggtccaaggtcagtcaacgagtatttgcctcctgcctggagacagtgtggggcctgactttcccctgcccgttttcccacccgtgtgaagtgatgagtgcagactagatctctctcactcatatgtaactatagttaggacactggacgctgaaataaatgaagtagaaattgtccaggcgtggtggctctcgcctgtaatcccagcactttgggaggccgaggcaggccgatcacgaggtcaggagtttgagccaagcctggccagcatggtgaaacctgtctctaccaaaaatacaaaaaataagccaggcatggtggcgcacgcctgtaattgcagctacttgggaggctgacacaggaaaatcacttgaacccgggagccagagattgcagtgagccgagatcacaccactgcacttcagcctgggcaacagagtgagactccatctcaaaaaaaaaaaaaaaaaaaaaaagaagtagaaattttaaaaaattaggctgagggaaaatttcaagtatgaaaatagagctaaaatattgattttcttagatgtcaaattttagtcaagagttggaatgcatattggtcaataaaacacatcagtttatgaatgaaaaaaaccaattaggtcagtggctcactttgtacctgaagaattatataaactattaaacaaacaaggcaggtggcatggagtcacaaaggaaatggcagtgatgagaaggaaaaatgtggctcattttctcccaatacattcttcttgtatctgactgcattatcttgctatgaatatcacccgaatctaagtaatgattcaagttaaattgtgttatttaaaaaagagcattttgagatatacaaacacaaagctgaagagcaaattaatattgagttccaaattcccataatcacataaccagaaagaacattgaaaaaaatgttcaaaaatattatcctcagctgagtgcttgtataacacatttctgccaagaacaaatgattatggtggaattataaagctctgaaaatggaagtgatggcacaaacttgaatatcatagtgtgaatgtggaactataagagcagttttatctttattatattaaaaatctacagctgtttaatgataacaaaagaatttctgttagattcagccaagtctgtctttatcacagtaatgaatagtcgatatgaacgaaagggctgactaaatggataaataagcattattccttcgggcccttttctagcaaaatcaaaatctctgctgttggcctttgaaagcttctctgatcttttacaagtgtcactggtcaggtaatgtaggtacttcaattgtcattcttttacaggggctggaagtcctaaatgtatatactgtctctcagctgactgactacgttttgaaaagatttattcatgtatgtcaagataaggcaagagatctcctaaaaccaccagcttctctccttacgtatctgaagaaactctttcctcagagaactcaagtaaatcttgagcaagcctgtatactgaagtcagctttccacgtcagagtgacactgttgaggtagatccatcaactacagaggcttctgggatattttcacaagacagcgattgtcatactgtgagctgagaacagccgtttcctagaggagtaattagattgacagaaggtgacatattccaagcaataaatgggagaaagagtccagacaggtaatccaaaaaccacgtggaatctttcctcccagacatgtggacatatggaccctgcattattccatttgctcatcggaaaaacttgaaatacgtacaaactgatgatgataggtgacaggtgcttcaaaaattctaatgaaatagaatttcattaggggaacagattctatttcgttactgaaaggaatataaatgaaaaagaatgctacatggagctctcatttcttgttttaggcattacgttatcaactagaaaatccttttcttatgcagtgattaaaactgatttttcccttcttaaatactattttgttatttaaaaaattttttccttttattctttcaaaaattatctcgttagtaaaaagaaataagtaaattattgacctttttcgattatatgaagctgtatttttatattaatgctatttaagtaaaattcagctttttttcagagaaccaccatcacagactaaaagctttcaaccactcaatttctttacatgtctgcagtctcagtcctcaagaatgtatattttcatcatcatccttttcctgtgcctgcccattctacatgcagagaaacctggagaaacccccaaattactcctattaacctttgttaaaaatccaagtaatcacactttgttgcataggtagtgtgatctttacttcagagggttgatgtgtcaagaacacatgcaggaattattactattagttgcatcaatgtcatgttcacacaaaaaccaagaaaaaaaagcatcaacttagaaaaggtagtttcctttcctctgatcctgaatcatttttttgcttgtcgttcacagctttatgaagataagtatctactcttaacaagctgaataatctttagaaagtagtaaattcatgtaggaataggaagtgcagttgaaatgaatactgcctataaattgagtttctaagaatatttcctgaaagtgtttccatattggtgtgctggtactcacgctgctgctgtttcctgaccctttagtatctacagagaggtgctttgaggactgtgcccagtgccttacttcatttaaaatttattcggcaaacaattattgaaaacctaccatgtgccagatactgttttgtacgcttatgtgttaggaaagcagccaaatttaaaactaaaaagctctgacctgacttataacattgtatggtttttgccttaggctgagggaagattagatgccaagaaatttctccacaggttttaataaaactgtaagcattgtctatactatctctccctgtagtaccatagtcccttttctttgttcttattctagaaatgaagacacattaatatattaaatctagtataatcagcaggtagactttaattaggcaagcaaatcatatccaatacagagtacaaaaagttagattttaacaaaaattattcacttgtggtaaaaattttaataaaaagttgaaaatataaaactgtacaatactgtatttctctaggttatttattaatgctcattctagccagatatcaacttctactggggaaggggtggatggggttggatattgtcattgtttttatttttatatgcttcctcaaaagataatcttaatattggagctgaaatttttttgactgaatcattttcatcttcaaataatggaaataaaagacacactaattaaagatttgaaagccttttcatgtattgaacacaaggaaacatccaccaactctgtcttaagggccacaaattatttgacataaacattcaaatggtgctaattattgatactctagtctggatgagaccgccaagcatcatccggcccttcctcatgcccacagtgggtgaggaataatggtgcaaacgctgcatgcctttccttctgcatcccttctcaagctgggctctccttcaggaatgagcccaccaatatctgttcctccttcaaagagcagctgacacattgtctcctctctttagactttctgatcgctcaggctgaatcagtttctccttcattcaggcactcattttattctacacattttcccactatagtcttaatcatacattattgatcctttatgtgctttttcccctctgctagattgagaggtccttaacaaagcactttgctttattcactttggagtttcaccagagagcagtctgacctactgtagttgctcaataaatgctagatgaatgaatggaacacacatttccacttcaatgttaatgtatgtggaggtttcttgacttgaccaaggctgtctggctggctggaggcaaaggctgtagtagggtccagaccccttgatacatatttactaactgctactatatgtcaggtgctgccagtggtcctctggatgctaagatgatttttctggacatttgataaagatgatttgtttatgtatgtgtttttcttcctgctactatgagctactagaggttaggaatagtttatttgtcatctcgtatcaccagaacttagcacaaggcctggcaagtggtcggaacttactagatatttgcagcattcatgacaaactgaaatgaatagatgaacagaacagaaaagaatgttcaaatgttagagggaggaagattagtctcagtgcagtattttgcaactgcaatctcttttttttccatttattactaccatttcacactacgttaaaactcaatgtttttattccctcttaataactcccaaatttactactttttgaaatgtacagtttttaagttagaaagcagtgcaatgtaggtgtgatttgtactatgtatgaaacattataactcacaaattttacattattgaacgcttaaaatttaggggtactagtctaaatagacaccctcagaaaaactgagcagtcagtgaaatcttttaatgccagaaagtcataagcatataatctcagtgatcaaaagtgtagctgaaagagggcacagaattttcagcatggaaagagaaaaaagggagtgatattttaggcagaaggtaaaggttagcaaaggaaaaacaaaacctttgtaggaaagagcacagggaaatttgtgaatgtgagtcagatactataaatctgaattaagcatgctttcaaattcttgggcaaagttcatcattttcccccattcttggatgctagtctactgctccactattctcctgggcttttacattggtcttattctgggccaacatttgcctgagggaattcatggaaaatcagggtgattctggggccaatcagatgattcaggcttcctcaggacagatcaaggatttggtgtttgtaaggattcttccgccaaacctctattggaacccggacagggcatgcatcatgagttggcctagaatgggactgagatggggaagtctggcacacgttagctgtaaaacactccctgagatcctcaatccagcagagatgtgaagtgaaatactaaagagagaacatttaatatataataattgaaatgcatgataggatatgcagttaatcctatatatctatatctatagctatagttgttgttgttgttagacagagtcttgctctgtcacccaggctggagtgcagcggcatgatctcagctcactgcaacctctgcctcctgggttcaagtgatcttcccacttcagtctcccaagtagctggaattacaggtgtgtgccatcaagtctggctaatttttgtagtttttggtagagatggggtctcacaatgttgtccaggctggtcttgaactcttgacctcatgtaatccacccacctaagcctcctaaagtgctaggattatgggcatgggccactgtgtccagcctatcctaataatctttataatgcaagttaagaaaagaaaggctggaatgcaaagaatcaagttgtaggttgttttgaagaatgggcaatgttagtgatttcttaaatgaggaaggaaaagacaagacagaactataaattaaacaaaggttgagagaggaaaggagtaaattaatataagatcagagaacaggttttttgaaagtataaaatgtataataattgtaacttcacatactaaacattttagactatggcattttacttgcaaatgggttggttacagggacaaaaaggctgtatcttgaggcactgatgctttacaaataacatgttggagcatctttcataaaccattaatgacttattttaacaaaagatgtagatgttatcctgggtcatcaaaataagtcaaatcattatttttatttcctagttgtaaatgcctttttattcaatttgagtctatgcgtgattagtcatttgaaatgcgagtagcttatatcctacatctttgcattcaccagtcacttctgagctatcttttgagtcaccacatttcctcatttctacaggatttcccacgatctcttctactatatcatttcttttcccatttattttctggattccagcctaccccttcatccatttctctcccatctttcccttcctagcaaatgtcacaatgtacttgttcaagctgaaaactcagaaatcacccttgattccgtaatttcttgactcacctatcgttattctttctatttggtcttctgtgttttgtctgtttgtttttggactcccaccttccagtcaatcttccttcatacttctggcagggtctaattaaaatgcacatctaattggatggctgttctccttgaaaaccctccacctgcctctaggctcatttcctcttttctccagcctactgtgtgtattagcttgttctcacactgctaataaagacataccaagactgagtaatttataaagaaaaataggtttaatggcttcacagtttcacatggctggggaggcctcagaatcatggcagaaggcagaggagaagcaaaggcatgtcctacatggcggcaggcaagagagcttgtgcgggggaacccccatttataaaaccatcacatctcataagacttattcactatcatgagaccagcatgggaatgatccatccccaagatttaattacttcccactgggtccctcccatgacatgtggggactgtaacaattcaaggtgagatttgggtcaggatacagccaaactatatcgctgggttttggccaagggggaaatttcatgtcatttggcaagtcagctcaatcctttagaaacactgctttgatatacgccattccatccttcctagaatatccttatttactcctcctctcagttacacaaaccttaattgtcctaggacaccctattacctaatgccctcacttacttggtgaagctttttcctaacgcttgtagaaggcactcaggaactcccttttctgtacctgtacagtccttgacctcttttttatatgtggtatgttatactgtaatttattttttaacatgtctgcttcaccaccaggtagtgagttctgtgaaaaatgggcatctctggtccctaacacagggcttgggtaatatgtgtggactcaaccaagattctcagttatggttcactggataaatgaataagcaaacaaacttgacagtcatactttctaacagtgacagacactaattcaaatgagttgggtggtcttgtagagtgacagtactatttatttgttttaataagattattacctcaaaatgtaaggagtacaagttctggtaggttaaagcaatatctggaatgacttcaagattgcggcacaggacatccctgtgggagctgagggaatggaggaggtgacacagactattgtaactggttcacaaatggtgggatttctctgtgtttagacctgctcagagtctggggcatgatgggcttccaagccatctgtggctgctgctgctctgttactgccaggaagacacaaacatgttgagaacaaaacttactgcaatagacacctttgtgcattctcttctctatttctacgtctcccctccgaaacaaggcattacccttgatgtactttacagaatatctgtcagttgggatctccagtttattaccagcttatcagaaaagcagagtatacacagaactttccataaggcattgcaaaataaagtcttgaggttggcaactgattgacttatgtcatgactattttaatcatacctgagaacttaagatatcaaattcctcatttctgagacagtcaggaactcccaagataaagattgagctgtttcctttaattccttgtctcccaacctaaagtggtggaatttacgttcagttgacagccaggcttaagagaggtaaagacatctaatgggcttgaccctggcccacttttctcctgggctggcccttgtcctgatggggaacattctctatgttgtggttgtcatgtcttaagtcacaggaccaacatcaccaataacagttttcaatttgggacagcaccaaaaatactgcaagttatttctattcttcaatttcttaaatagcaggcagagagatttttcaaggaccaattctggattgtgaacacagatttcatttatggtatcctcaacttcttcccacataatacgtgacattcaaatctttttaaaattgatttctccctcttcctaataaaccagcctgctcttcaaggagtggctataagtcattcactcttgaaaattttcactttggttttggttattctatagtgatctgacagcaatgagcagggagggtctcttatagtctatctccccagttaatatgccctgtgaagaacaaacacacttagatgctaattgagggttttgcctgagcttgtgatatgccatcccagagactgccattgacaactgttaacacatactgctcaatacccatattgttctgattagagaaaagtgaagtatcaggagtgcagagcgtcactgggattgtgggaacacaatacgtaagtcacagccgcctgtggctgcctggggagagaagagtttcagtgtgttagaacgaagttctatgagagcagaatctttgtctttttcacctctgtatccacagcatcttgaatgttcccagcacatggatgacactcaataaatgttgttattgtcgatgaaagaataatggaattcaaggctgtagcaacagaagttcttatttaaaatggaattacaatgaaatctaaaaacacatagagggcacttattaggtttgtatacatactgtacatatacactgattctacccttagcaacatctgcccctcaaccccaccatcccccatcctcgtacataaacttaaattataaaaggaaaaaatcacgtggaagagagagttaatagaattaatgtctcttttattcttccttagaactatataatgaacagttatttcatattgttgctatctgttttctgcttttatatcattttctagattataagattcttgcagacaggaagtctcctgacgactttccatccttggcaactagtaggatatctgacagtagaatgttgctacaaattggttaacttttctggataggtgtcctacaggggactaatggtaaggacagcctgatgatatacaatggagaggctcaggcagactaagcaaaagctagtggctaggaatccaaatgttcccccttgaaaaccaaacctctctcgcgttttagtcaggtttgccaggtctgtaaaaggtgagcagtcttggtctctagtcttacttgtatattacttctccctttccatgtaaaatctctcctgggacttggctaatgcaatattagtgttttcactgtattggttcatatactggcaaaccttctgcttaacagaggcagtgaaaggtataatgggtagatggttgctggtcaggggacagttgctgatccagggccagttaagccagcagacagacatcctggggtttcatcagacttagcataaggacaggaaaccaggatgtactctctagtgaacaagaggcagaaaggccgactggaagtcagagatctggggaaaaggctccttgcaggttcaacagttgacctggaggtagaagttgttagagtttcaggatgttgtcaaatggtcagagaacaaacctctatctaccaacaactacatcatgcattaagaaagtctcacagactaaatctccaaaactcacagcagtaaacttaaaatgcaaataattgtttcttttctgcaaataagtttctacctcttttttttttttttctcgctctgtcgcccaggctggagtgcagtggggcgatctcggctcactgcaagctccgccttccaggttcaggccattctcccgcctcagcttcccgagtagctgggactacaggcgcccgccaccacgccaggttaattttttgtatttttagtagagacggggtttcaccgtgttagccagcatggtctcgatctcctgacctcgtgatctgcccgcctcggcctcccaaagtaagtttctaccttttatctctcctgtcacattatagattacttgtagagatggagagaattgaatccatttatcctctgtagctgttatctcattaccactcacctaatatgtgaatttataataagtggtggattttacgttcagttgacttgggtaggtgtctgatgaaagaaagtttgataggactgtttgataagagcttcaggtgcttaaaaataaatgtgcttcaaaattctgaggcagtttctcaaggcttctgctgcaaacacactgacatcattccagtggctttctttatttaaactcgtctttcctgcagtcctgtcgtagttctgcatgctgcaatgccactgtgtgcctgcctctgttccacacaaggctgcgctccttgagggcaggtctgtgccttgtgtcggggtatccttagtacctggcagagtactgggccctgggaatttcataatttaatgtaaatttcaagtttgctaattagagggcctttatttgcttacctaacaatataattatttccagctagtaccagaaaaataatcagagtatttctaggaccgacatcaaaagtgccagtagcatttcagagttagggtcctctgctcaactttccactgggacttgcctgctagtttcctggctcatttgttattgggggttgctgtgcctggactcacattgcagttcctgctgttttatggtattaatgtgaaggatcctttttcactagtgtaggcaattatgaattgagtgtaattgctcggagaggacacgagtcatgaataaatacaatctgaaaattcctaacatacattgcattatggcaaatagatccttctttctaggttaaatacttacaaataaaatataattcataagaaatattttgcaaagtgtactattactgatactgcatgctaatcaaggcctatatagactaagttactttattatcaggttaatttttttcaaaatttatgtttccaaattaaattaataattaaaatcaaattcatctcaatttattttccttattctctgaatgctatccatatatgaatcgacagtccagaatcatggaccaattattacttcacaaaatctcatttcccatgactgcatatattatgcagatgataatattcttaggtgtgcattgtcaccttggatttcacatgatgctataaaagctagagtgacactgagaactgaaaaatggaagggtatagagagtatttttgtgtgtgtgatttatatacattttatttttttatctcattttgttccattgactaggccctcagtatgacttaaagcagagatgggagcatatttatctcatttataactttaaaaggaatgagccaaatgtttcaccattatacacttactatgaaccctttttgttgatatatttcataaacttaaggaaatttctattcctagtccattaagaatttttattaatagaaactgaatttcatcaaatgcctcttctacttttattttgatgatgctttggtgttcataaaattgttaagataaatttcattaatcaatttgttaactgttatgatgaacttttccccataattaaaaaaattattagtaatattattttaaattgacaaacaatacttgtatatatttatatggtataatgtgccattttgttatgtgtatacaatgtggcatgattaaatctaactaattaacatatctatcacctctcttattttttatggtgagacatttgaaatttattctcttagttattttgaaatataaatacattattattgaccatagccaccctgctgtgcagtagctctcaaaacctattccctctgtctatctgtaccctttgatcaacaactcctcattcccgccctcatcaacctcttccagcctctggtaacctcaaccccttccggcctccagtaaccgtcattctacttagaaaatgtttaaaaataagaataccaagaatgagagacagaggttataaatagatagaaaaatactggaagggggagaggaaagaaagggagggagggagagagggaaggaatgaaaatgagtgaaaaagagagaatttgaagatcgtgtgaaagacagggaggggaaaatcaagtgaacacttcaagtgatcccttgctatgtgaactcatctctcatcatatgggctcagcactttatgatctaacataaagctttatgacaggccatcagcaattttgttcatcctgatatccacacctggcagtggctcggcacctgttgtctaactcaacaaggccaagtgcatgctgccagccccacggcgcactctgtcctgtggccccagacagccttctctgaacagactctgtagacctggcctcctggctgcctgattttgtagtcatgatggcttcaataacttcaggcattatccatggaaatgtactgcaaacttgactttttaaattaggtatttcaatttccataacttatgaaatctcagttattttgttagttcagtgatgagcttaagggtatcatttgcaaaatcatttcttccagattcttcattaggtaattataaaaacaacatttcctcttctatggcatgaagaggaaattaaaccagtcttccatcactatcaaaatattaattttcttaatattttaattgaatccattcctcagcaataacacctaccatttaccaagcatgtacatgtgccagggactgagcccgtggctttgcatgggtctttttttaatcctcacaagctactcttccacaatgactgccaatctacagatgaaaaaaagaggcacacagtggcccaagaacttgctgaagtttacaaagttagtgagtggtggaaccaagtctatgaacccatgaatgagctccagaattttctctcttagctatcaaattattctgcgtctgcaaggttgtttaacaataaggattgcctaaaccatgcctgtgtatctgtgtatcctttgaacacttactctcagctgaaattggtgaaatgactgacaaatcttattttttcataaagggatgtgtttgtaacggaattcattttctgataaaaaatattatctaaaatgtttttcctactattttgctataatatcaactgaatagatgggaaggcccttcaccaatatgtaggtactatctagaatagatgggaaggcccttcaccaatatgtaggtactatctatctagttaaaatgaagtgtaggttgttgaagccccaaggaaaagaaagggtgctaaatttttcttttctttttttttttttttttttttttgagatggagtctccctttgtcacccaggctggagtgctgtggcacaatcttggctcactgcaagctccgcctcccaggttcacgccattctcccacctcagcctcctgagtagctgggactacagatgcccgccaccacgcccggctaattttgtttttgtatttttagtagagacggggtttcaccgtgttagccaggatggtctcgatctcttgaccttgtgatccacccgcctcagcctctcaaagtgctgggattacaagcgtgagccaccacgcccggctgctaaatgtttcaactcctaacattcctaagcctaggaaggaagtccttcccaataatatacagactgtacctatctgcataaaatgaagcacaggtttattacaatgattagagtaatactagcaagaacctcaagtctctgtgactaacaaaaaggtccactttattattttggcacctatattcttcagatgcagaagccaaccacttgcctcttctcttcaatttgcttgagcagatgggggatgcaaaggctggtaactacaagactacattttctcttgggttgagggaatagattggggaaaagagaaaaatgtatgcttttatggagaaactattgtttctccctgggcaaagcgagggatcatcgagaaatcttgtatgctgtataaaaattattttcaaaatcatgggtatataatctcttccctttcctgtttgttgaaaaacatgcacataacaccaagttactttataggccagatgagaggaaaaataaagtaaatgacttaaacttcccaattttttcaacagttacaaggaagacacagtaagatgtgatcttctaaagtgaaaatttcccaaagtaccaaggaaaaggagaaactgcagaagagcttcaagaaccacaaacacttgggttttgcatcttgccagaaaatctgcactgttggtagaagcctggggtagggctggcaggacctgactcagcggagaaaatgccacccacagtcactgactctgcttccgcagtagcggagctcccctgttttctctggaggtttcccacagccgggccaatacccatgtctctcagatgggaaactggacttttggaaaattgaaactaaataaagttgtataacttttaaaagaagtttacaattatgatgctttgcttttcacatgcgcttaaagtccattttctgttgaataaataatattaaccacatattaaccacctaatagttttaaaatgtctcaaacagccatcaccatcattctgaacagaatcacacttctttttaaaagatcactgttaaaagatgaggggaaacagtaccattaaaaggaagcaaaacatagttcaaagtctgcttccatgaggtaatgtacactatcgactaattgtcaaaggaatccagtctataccgagatgaatgaagcatgaggttaaggcaggtggctgggagaagttagaaactctccctccccgattgcattacattattgtcgaagccaagcagatagatagaaatcaatgaaagttttgttgatctgacacaggaacttgtgcacagtgaaatggaagctatgtattttgtgctggaaactgccagtctcacattaactgcatgtatatgtgaatatatgtaggtttgtgtaggtttgtgtgtgtgtgtgtgtgtgtgtgtgtacagcatgaagcagaacatctgaaagaatcttcagaattatttctcgttagatgtacttttgggtagattttatctttttcccccagaaagtaatatttcaatatagaaatttaggcctcagcaaagtgaggttttttttttttttatgttacaatgcttgcaaacttaatggtggtttctaatggaaaacaaatttcttcccctaatcataatataagaatttgcaggccaggcacagtgtctcatgtctcacgcctataatcccagcactttgggaggccaaggcgggtgggtcacttgaggtcaggagtttgagaccagcctggccaagatggtgaaaccccctctctactaaaaatacaaaaaaattagctgggcatggtggcaggagcctgtaatcccagctacttgggaggctgaggcaggagaatcgtttgaacttaagaggtggaggttgcagtgagctgacattgcatcattgcactctagcctggatgatagagtgagaatccatctcgaaaaaaaaaagaaaaagaaaaaagaaaaaacgaaaaactacagttttctttaatataaataaaatctcttgtatttgtacaaacgcaattgtggaaaacactgaaatattttcctatttatttttatgctggtcagcaagtggtttgatttcggtagccagactccaggtgcagagttcagaactataaatttgttgtacctcctatcagttaaagttgactgagatggccatccctccccaaatcacagttcgtcttgaaaatcttcagagtgtgaaaaaggtatggctcagaacaaacaccagtggttaaaaatgatatccttttcccagtagcgatatacattgtgggtatgtgattagaatatttaaaatacctgttcacctggtattaagccacatgtgtaatacattagagtgttcctggctcatttccaagagtatgtatcctcactgccatgaaaatactgcgggagccagggcaaagatacttaagtttcaccctagaagcaatgcacaacatatatatttcactgttaacaatatcatcacactaagcattgttgactgactaatacttcaatgaaatcaattatttatttttgtgtcagaagagaaactggcagcatagggacacttgtgttatccttgctaattacttccattgtcttgaaatctcaatcaacctacccccttctctttctccctacatctctctcgttctttcactttctctctcattgtctaactcctcttcttggatacaaagtagttcaaaggggacaccaggaaataaattatatcctaatgctatctaccagagttcactaagagaacttgggcaagcccctctatttggcagagttccactttttttttcttttaactctattttgactggacttaatagaattacttttgactcctagtttttttcctttttctaccctttccctagtttaaaaatctgtgtagtgaggaccttatttctgaagaatttcatcacgttattacacaagaaatatacatacattatatgataatttataaaatgtgacattttatttaaatgtaagcaccaaatacactgaagatttcagtgtccaaagtatgcgtgtgtatatacaagtgaaagtttaaaatttttgcctaaatttacatatgcaaaaaggaacagcaggaaaataaataccagttgtatgagcatcatgtgctaatggctatatatgtacataagttaattcttacaggaagaccaaaagtgagttttattatcccttttttactgcttcagaagctgaagcttggtggaaattcagaatgttgcccaagatcacagagtttatgaaagtggcagaaaccaggtttgtctgacgctaaaatgtgtgtctgtccctcctccagcaccacactgtcttttttatgaaagggcagggcttttattatatggatgtgaaagtgtaaggggagagttttcatatttggcagtattgtattcagaatcctgacctgtttaggtgatcattaaaagtgcacatgtcctggctgggtgtggtggctcacacctgtaatctcagcactttgggaagccgaggcaagcggaccacttgaggtcaggagttcaagacccagcctggccaacatggtgaaaccccgtatctactaaaaatacaaaaattagccaggtgtggtggcacatgcctgtagtcccagctactcgggagactgaggcaggagaattgcttgagcccaggaggtggaggttgcagtgagccgagatcgtgccattgtactccagcctgggcaacagagtgagactctgtcaaaaacaaaacaaaacaaaacaaaaaactgcacatgttctgaggaaggaggatcttttgatcccaggagtttgagaagagcccaggcaacctagcgagactctgtctaaaaattaaaaagtgcactacttcattaggaacttctaaatttataagattttgatttatgtttcaatttactgtaaagaagcttatatagtttaaaataaacctcctaggccaggcacagtggctcactcctgtaatccaagcacttgagaggctgaggtgggaggatcacttgagcccaggaattcgaacagcctgggcaacatggcaaaatcctgtctctacaaaaaatacaaaaattcgttgggtgtggtggtatgtgcctgtggtcccagccacttgggaggctgaggcaggagaatcacttgagcccaggagttggaggttgcagtaagccaaggctgtgccactgcattgaagcctgggcaatgggcatgaaatcatctcaaaaaaaaaaaaaataaaaacaagcaaaacgaaaacaacaaacgcaacaaaaaacctcctgaggcctctataatttgcttttttaatacactgtatgtgataaatagtcctcagtcacagaaatgcatgtgcaccttattagtgcaaactaaaattatatgaatatttctgaagcaacttgtcctatgaaataaaaatataagtttggtgaaagctttcaggctttttagcacacacacatatacatacttacaaaacgtaaaatattttggcacttccacttttcacaactgtttctgtcttttccagcggaacctctctcaagaattgtcattatgctaatttactgctcgagaccacggagtgtctttctgatgccaattgtatcacatttaattccacatcaaatatttagagtgcttgatttccctgtctcttcttcccattttcattgccatctttcttatatctttttatttatgtgaatattctcttcatatcaagctaatacttttcatgcccttgtttcttttttcttgtgactctttgcatacttggttttttgaaagtttgcccacgtttttcatcaattgatatccatctttctgaatttgacttgtttgagcctaaaaaggactaccaatcatggctgcctgtcctgaccttttaaacttctttctaccacttattgcttgatgacatggtatcaggagcggcactgccatcatggtcgtcgttatcattattgtaaaccttaccaagtgtcagaccctgttctaagcattttataaatgtttatccatttaattctcataacagctaagcagaagatagtattattaacctctatttacagacgatgggattaagaaacagagagttggccgggtgcagtggttcacgcctgtaatcccagcactttgggaggccgaggctggcggatcacctgaagtcgagagttcaagaccagcctgaccaacatggagaaaccctgtctctactaaaaatacaaaaaaaatttagctgggcgtggtggcacatgcctgtaatcctagctactcgggaggctgaggaagaattgcttgaacccgggaggtggaggttgcggtgagctgagatcacgccattgcactccagcctgggcaacaagagtgaaactccatctcaaaaaaaataaaataaaataaaaaataaaacagacagtctaagtaatttgcccaaggacatatagaactcaggcagtctatctccagaactgatgctcctcaacactgtgctatgttgcctccctctaaataccccatagttctcattacgttgttttgtccagttgattcccacatgtattttctaccttaattggactgtaagttttgtgaggtcacagacaatgtcttccaaacttgtatttctcctggcatcaatataaagttctgtatatcctaagaatttaataattattgcttgaataaaacaaaatctacatataaaagtggaagcaaatttttaagatatacatactggaaggccactttcagaaatgaaggtaaaaatataacaaaaatcttgaatgctttaatgaataatttgcaatataagtctaactgcattgaaaatcgataatgaaattgctgtattaatttctttgcacttctatttaatatttcttaactgtcattataagcatttgatgcatagaataagcatactttcttttgtttaagccaagctgcttgcattattttggctttctattacagataatactgtagacatttcaaatccacaatgatttggaggtagtcaaatcaatatcagctacataatacataaaggatggatgcaaattttatagcaaagaaattaataatttatatctgtttactgtaacaaaattttttgtcagctttttctgaagtttaacaatgcttgagccaatattgataaattatgtataacatataactgtttaagataaaatgctactaaaataactatattatttcatgtttataaatgttacagaatctattatatgtagtaattcacgtagtactctttctgtatgatagcctagcatagttaccatagctcatatcactattacatctaaaaatattttttatttcagcagttaaaaagaaccaatattttccatattacagactttgctgaagagtcagaaatgaataatataatatcaaaggtaataatttcccaaactgaatttatcctgcatggtacaaatgactcaacaatgaaaattttgtttaaaaagtattcatgtaaaaggctttgtccctggaatacagctctaagtggctcactatctaggttgaaaatggtttcgcagggttgtatgtcctatttttccatgcctgcagtaaagatacaatatgggaattcagcttggtaattactaatacaccacacagacacaattacaccctgtatgctgcataaaggaatcacttgtggtctgcatccattacaaagagcagtagggggccaacatgcaagacgacaaaatgctttacaagacggaaggagaccagaagagtcgatgtacacagatacaaggaccttgattcttctagcaatgatttaagcctctttccatcaattatcgtcttttgtctcaagagtcttatcaccagcagcattacaggaactgaacataacaatgctcagactcgtataaccctatgaactgtgctgacatttccacaccctgttgctatgtttgacctggtttacagattacttaagcaaaacaaaatagaaaaaaaaagcattcccattgcaaaactggcatacacacacacacacacacacacacacacacacacacacacgtatttttttatgacttactcagaattccatttgttgaaactaaaagccatcctactccagaaatgctatttttcaaagtagtttctacatcattttaaagattaaaagtaaaaatctgcttgagtgaaaataataattttaagaaagagactaaatgttggcatgttaaggggatacagactgaacaagagaatttcatgtctcagggagctaaactaaaatgagtcagctgctctcttaaggtacaatgagtcacaggaataattttcttgctgtgaaactccttaaagttttgagtttaattgcaagcagtaagtggtttttattataacagagtttcctctgttaattattacacgacgtacattattttacaatactttcatttaagattctcttttaaaatacatcttacaaatatgaatttttaagaccttaggaaagttagttatttatggcagtttgtcaggttccctgaaacaaagccttgtctttcagaaaatgtttacaacctatgaggaaaaaaaaaaaagtatcctggggctaaaatgtttattggcacctagaagtctgaagagagagtcgggcctgtggttttttgagggcactttatcatcgcccgcattctcaaaggtttctctgaatgaatagaactggattactcagccttctattccacgcctattcctctccattttccttggcacgactgagagccaggctatttttagttaagcagttttctatttttagacaactaccagttagaagacatttgttagggaaaaattaaaaaaaaagcacacacacacaaagggaggagggaaagaagcttcctccacatattgtgaagcagccttcaacctgtaactccaggcatttcagctgctttcaatcttggaaaaataaagaaaaattcagagttcagggttttaaaaataaacctaccctctggcaaacagaccaaaatacaacaagctgttactatgtgaaacagtgactacaaaaacaaagaacattctccaatgattaaactgcgagaaaagttgaagaactgattaggttgtaagaatgttgcacaggcatgtaacaattttccagcctctcagccagatgtatcatgttttagaatttagagaggggaaaaaaaaatctcatctgtaaagttaaactaacgatgtgggatgcaactttaaggttgaaccttttattaagcttaaaggcaatgaaattcactgcatttttctaacatttgtgttctatggaatttctctagaaattataaccatctgtttatagaaaaaccatacattaaaaaatccagtgctaacagaaaacaaaaaataaaggctgctacatatacatactacatatatgtgtgtatatatatacatatatgcatttaatgtccatatatcactacatttattagtctcacttttagtttaaatgggaaaaatggttctcagattggcttagcatatcaaattattctacttattcaaggccatgccttcatctgaaatctacagtaagatttttcaggtgctcacagttgtaactgctttccttctcctctgttagcccactgtactttgtctatatcttattatggttcagataattgggtatcataatcacagatgcatcaccagtaactggcagaatgcttagcaaatgatcttcatgtccatcaatatctactgaatgagagaacaaatactgtgtatattctgtccaccatggactgctactggccctggagggccgtgaacaccatactttgcacatacacttaataaatacttgtggaaaagaaaaaaaaaatcaattcgttgacctttgttagatcttcttaatttatgtaaaatgctacagttatttatataatcattcaatatttacttataaataatacacttattagcataaactatgcagtcgtaaattaagaatttttgtctttcttttggttagcattttttcttctctgaactttttctcttgactttgaaaataaaactaattttttaaaacttaagggttgacaatgggctctgacagctgttataacctgcaatcctcatgacagccccgtaaggagctcagggtagacagcattaactcatgaggaacctaaagcccagcaaggttacataactcgccctccgttagagaatgagagtgtgtgatgttgctgtaactggaactgaatttttaatctccatctttccttcaaatttgtggagcttttaaagtcctatatcctagaagtaaaatttgaaagatgaactctcataacaatgcttcaacaatattctttagaaaaatcactttgtagctttatttttcccccacatgaaattaattcagaacaactacagttaaggaaaaccaatcatggagtctggatgaagataaaattccgcacatactaattaagaaaaatcagaagaaaccgtgtgcacgcatgatcttttctttcctgttggaaaagttcacaagggacctagcttatttctacgttcttactactcatttttcctgtgccttttccattttctcttcttcctcagggcaattccagcttcagtgatccctccattttctcgtctttctccacaaaatcacatagactttaacaaatattctgttccttggagtaaatgccaactgagtgattcaactttcctggttggatttctctgccctggctcaggtcctgactgacgcacagtgggcatgtcataaatgcctgctgcaggaatggaaggtgaagtagccaggtgcaacctctccagtttacatatcctttattgggctgtatctattaaccatcatgccagtttgtttgtttgtttatttatttatttatttatttatttatttagagactgtgtctcgctctgtcacccaggctggagtgctggagtgcagtggcacaatctcagtttactgcaacctccgcctcccgggctcaagcaattctcctgcttcatcctcccgagtagctgggattacaagcgtgtgccatcacgcctggctaattttttttttttttgtatttttagtagagatgaggtttcaccatgtaggccaggctggtcttgaactcctgacttcaaatgatccgcctgcctcggcctcccaaagtgctgggattacaggcatgagccacctcggccagcccatgccagttatttgaatgaaagagaacactagatgcaccagtttcgtcatttactgtccaacagagggtttctttcataatggacaattatatttgggagccactagtcacatcttgcttgaaatgtggatagtgagactgaaaagctgaacttttaattttatgtaatttaaattatatttatatttgtatagccacatgtggctaggctaccttacagattaatgcagatctatgtcttttcatctgaagtctggttatattatccaaagaaaatttacatgacacaaatgagtttataattgtcatagtataggtgctaaatataccatttatttacaaatgtgtacagtaactttcaaaggggttgggtttctggaactaaccacagagtcaatcaataaacttatgtcctattgaaataactgagagtgaagttggctttagattagtagtagctcatgcatagggtaactttggtctatttttctatgaaatggtttcctccttgacatcatagtgatggaacttgtttatgattaaatagtaatatgcacacttttatttttgaaaaataaagtaattcagaaattataaaataagttactattattaaaataagttactattattaattcatatatctacttttttgtaatactttttttttttttgagatagagtcttgctctgtcactcaggctggggtacagtggcatgatcacagctcactggagcctcaacctctcatgctcaggtgattctctgacctcagtctcctgcgtagctaggagtacaggtatgcaccaccacatccagctaatttatttttatttttgtagagttggagtctctgtatgttgcccaggctggtcttgaactcctaggctcaagtaatcctcctgtctcagcctcccaaagtgctgggattacaggtgtgagccaccatgcctgctataactatttttttttttaatgtgaggaaaaaacccaaacacccattgtgtagttttactgtttacaacgtttcttaccctagaacagtagctctaaatagttattcagtttatttactaaaacataaagataagagatttaattgatatgaagaggttttcagaatctaattaaccttccagctagtcattaactctatgacctttagaaataattgacagagaattttttttcttattcataacttcttccaggtggttaaatttcagagtagtgcagaatacactaaacaccattgagacatgactggataatatgccaaatagctataaaatggggtatatttccaataatataatctatttacttaatctgttgtacacatatgcagcatttacctaattacagtccttttaatgactgactttgattaagtcttttcccagaatgtcctattgattattttgaccaagaaaataatgaaaaagttatgggtactactatctctctgcacccaaggcacatgcccctaaccaatcacatcacacttcctgaatgtctggacttggactcagcatcttccttaactgtgtgctccaggcagccagtacaaagtgatgggcacacactaaggagtgaaatgtgccagagtcccacctcactgggtagtgatgtgccttttatgaatgtatcacacttccagaaaaacctaagacacttcctttcaagaattagtttcacagaatttcagttgtaagaacctgttttatagcatgattctaaccctccataaaattacaaagaggaaatagtctacagacacactttcaaattccatgaagaaggaaatacatgtttggaaaaggaaatctagatcctttctactccagcagcatcagcatcacctggtcagaaataaagggatcctgggccctgccctatacccactgagttagaatcagcattttagcaagatactctggtgattcacactgggccacaggcatttcatttgacccaatactggccaaagcactaacaggtttcttctctcttctccagtaatcaaaatactgtaccttggtctggaagtcctttcctttccaccagcaccacaagcaatacttttacttggtttcctgtgccttgtaatttaattatttatttatttttgatgcaaaacaacatttactcactctagctgacttgaaagattctcacttttattattagaacacatcggatctcaccaaagaaaaaattgtatatttaaaaattttatttatgctaatgatcatcagtaagttgatatatattgaatgtccacaatatgctaggcattgagctggcagctggaggtacagagatgaacaaagcttcgtcatgcccttcagggaaaggagagggatttgtaattagacaaaacaaaaacaaaccccccaaaaccaacagtggggtgaagaaattaaaataaacactccttaatgaaaagagccatcatcttagaattctgcttctaggcaagcctcagaatcattcttagaactttacttttgaatatttcatgactatatattcagtaacttttcctgaggaagtaagaatattctacactttgattcttattcggcaccttttagagccaatgttagttttacttagatgatatcaatggctagaatgtaacatttggttcaaatatgctgcttaccaccaagttccatatgccatgaaatttgtaaatatcattaaaaattgacaattatcatccaggctatatatttttctcttttcatttccaggtatggtgggagtcaggtgaagagagatcacatgagatctttgttttgctctagttcaggaaggttcatgtaaaataataatgatgacaaaatggtaatgattaatattgataaagaaattatattactgataaaagtctatattttgaaccctgtcttttctgcttctactattattaagtaattatctgctcactgtgttcatactaatgcttgcaaactattagagctgtgtaataacagagactagaggaagctcagttttattgcctcacattactatttgttcaacaatgattattttcttaataaatgagatgtgaagcagctcttcgtgtttataaaacatgtaaattaagcaagaagattatttttaaaaaagaaatggctcttcaaatttgatctatacaaatcattgtggtatagttatgagaaatatgaatacatttaaaaaattttagactcatttcttctttaagactttggggaacaagtaaaaatattatttacaggtactaataaaagtcttttaaagatatataaacaaaattatattaaaattcaggaaaataaaaaactttttaaataacaaaatctttttccccttttccctcagaagccacaacatagaaggtttaaatctttatggaaaatactaatactttgttaatttttcaataccatgtattgaaaagcaattatatgcttggcttaacagaggggagggtagacttacttagtcactagcagtaagatctatatcaattatgttttatagtaaatctaagaaggatttgtaatgtatctcaagaatactatttctctaaatttttttataatgaaaaatacttttctggagaaattaatttactaattatataggtaaatactggtccaatgttgcttcaagtaaattaaaaatagtaataagacagaactatcatctttccattcacaagcttcaagttaaaaaaaaatacagtatacttcacccagctcacacagttaatgttccctgtcagcctggacaacttgcaagtgctttctgaccagatcataagtttactgattgactctgtggttataggttaggggtaaagtgtgcttttagttttatggtgagtgtttagttccagatcagagtctctcgaagtgaacatttatgctctgaattccaaaatcacaaggtacacagttactcacttccgaagtgactcctcaaattttatattgaagaattaattttggtattaatttgaaaacacaatttgtttaaatatctccctcttcatatttcagtctagaccagtgctgtctcatagagctttctgtgatgatcaatgcattctgttgtatatcttccctgtttaattcagtagccactagccacacatgactactgaatgcttgaaacatgactaatgcaactgaggaactgaattggacattttatttaattttaattcatttaaatgtaaatagtctcatgagcctattggctactatattggagagtatggacctagattacttgagtgtttttaaattgtgctttgataaactctatcaaaatttaatgaattgtttcattggaactgtaaaaacattttttcatactttaaatgtgcaacgttatgccacatgataatcacttgattatatgtctgtctttcctgtttgtttattctataaatatattctgaggaggtaactttctctagacctcatgttaagcactgggaatatgatggtgagcaaaacgtgtacagtcccttgccctttgggagtttagaatctagtgtgggacaggcaattggataacaacttcaacagtgctctgatgggaaagatagaacacatgatgactgtaatacaggggaagcacctaacctaagttatgggggcttcaaggatgactttccaaagtgtaattgggacctgacttgagtgaaggataagtaacagccaagtagagatccagtaaggaattttaagacaaaacagagcttggagaggttgaggaatgtacgtatgtacgatgtggcttgagtataggatgggggttgtaagggcaggttaatggcagggaaattgcaaaaagtgaggctgaagagtaagagaaatacatggatcagatcatgcatggccttgtgagccaacttaaggactgagagtccttgagggaccttggttatatctgtatctccaggcatttcatagcatataacacagagcaggaattcaacaaatttttgttcaatcaatgactgaaagaaggaaaatctgcaaatgattaggtaagtgaatctgtttttttctcttaagaaaagtatccttgtataatatgtatctatatagcacataaaaataattttgtacatatatatttatttactttaagttctgggatacgtgtgcagaacatgcagacttgttacataagtatacacgtgccatggtggtttgctgcgcccataaaaccgtcatctacattaggtatttctcctaatgctatccctcccctagccccccaccccacgacaggccctgctgtgtgatattcccctccctgagtccatgtgttctcattgttcaactcccacttatgagtgagcacatgtggtgtttggttttctgttcctgtgttagtttgctgagaatgatggtttccagcttcacccaggtccctgcaaaggacatgaactcatccttttttatggctgcatagtattccatggcgtatatgtgccacattttctttatccagtctatcattgatggacatttgggttggttccaagtctttgctattgtgaatagtgccgcaataaacatacatgtgcatgtgtctttatagcatcatgatttatactcctttgggtatatacccagaaatggtatggctgggtcaaatggtatttctggttctagatccctgaggaatcgccacactgtcttccacaatggttgaactagtttacagtcccaccaacagtgtaaaagtgttcctatttctccacaccctttccagcatctgttgtttcctgactttttaatgatcaccattctaactggtgtgagatgttatctcattgtgcttttgatttgcatttctctaatgaccagtgatgattagctttttttcatatgcttgttggttgcatgaacgtcttcttttgagaggtgtctgttcatatcctttgcccactttttgatggggttgtttttttcctgtaaatctgtttaagctccttatagattctggatattagccctttgtcagagggatagattgcacaaattttcttccattctttgggttgcctgttcactctgatgatcgtttcttctgctgtgcagaagctctttagtttaattaggtcccatttgtcaattttggcttttgttgccattgcttttggtgttttagtcatgaagtctttgcccatgcctatggcctgaatggtattgcctaggttttcttccagggtttttatggttttaggccttacgtttaagtctttaatccatctacagttatttttttgtataaggtgtaaggaaggggtccagtttcagctttttacatatggctagccagttttcccaacaccatttattaaatagagaatcgtttctccattacttgtttttgtcaggtttgtcaaagataagatagttgtagatgtgtggcattatttctgaggcctctgttctgttccattggtctgtataactgttttggtaccagtattatgctgttttggttgctttagccttgtggtatagtttgaagtcaggtagcgtgatgccttcagctttggtctttttgcttagcattgtcttggctatacgggctcttttttggttccatatgaaatttaaagtagtttttttctaattctatgaagaaagtcaatggtagcttgatggggatagcactgaatctataaattactttgggcagtatggccattttcacgatatagattcttcctatccgtgagcatggagtgtttttccgtttgtttgtgtcctctcttatttctttgggcagtggtgtgcagttctccttgaagaggtccttcccatctcttgtaagttgtaatcctaggtattttattatctttgtagcaattatgaatgggagttcactcatgatttctctgtttatctgttattggtgtataggaatgcttgtgatttttgcacattcattttgtatcctgagactttgctgaatttgcttatcagcttaaggagattttggggtgagacaatggggttttctaaatatgcaatcatgtcacctgcaaacagaggcaagttgacttcttcttttcctatttaaataccctttatttctttctcttgcctgattgccctggccagaacttccaatactatgttgaataggagtggtgagagagggcctccctgtcttgtgcagttttcaaagggaatgcttccagcttttgcccactcagtatgatattggctgtgggtttgtcataaatagctcttattattttgagatacattccatcaatacctagtttattgcgagtttttagcaggaaggagtgttgaattttatcgacgcccttttctgcatctattgagataatggtgtggtttttgtcattgtttctgtttatgtgatggattacattttttgattggtgcatgttgatccagccttgcatcccagggatgaagctgacttgatcatggtggataagcttttgatgtgctgctggattcggtttgccagtattttattgaggatttttgcatcgatgttcatcagggatattggtctgaaattttctttttttgttgtgtctctgcctggttttggcaacaggatgatgctggcctcataaaatgggttagggaggagtccctctttttttattatttggaatagtttcagaaggaatggtaccagctcctctttgtacctctggtagaattcagctatgaatccatctggtcctggacttcttttggttggtagcctattaattactgcctcaatttcagcacttgttattggtctattcagtatttgacttcttcctggttttgtcttgggagggtgtgtgtgtccaggaatttattcatttcttttagattttctagtttatttgcatagaggtgtttatagtattctttaatggtagtttgtatttctgtgtgatcagtggtaatatcttctttatcattttttactgcatctgattcttctctctcttcttttttattaagtctggctagcagtctattttgttaatcttttcaaaaaatcagctcctagattcactgattttttgaagggtttttcgtgtctctatctccttcagttcggctcttagttatttcttgtcttctgccagcttttgtttgttcttgcttctctagttcttttaattgtgatgttagggtgtcaattttagatctttctcactttgtcctgtaggcattcagtgctataaattcacctcctctaaacactgctttagttgtgtctctgagattctggtacactatgtctttgttctcattggtttcaaagaacttacttatttctgccttaatttcattatttacccagtagtcattcaggagcaggttcttgaggttccctgtagttgtgtggttttgagtgagttttttaatcctgagttctaatttgattgcattgtggtctgagagactgtttgttatgatttgcattcttttgcatttgctgaagagtgttttacttccaattatgtcagttttaggataagtgtgatatggtgctgagaagaatgctgaagtccaacgttgatctggggtagagagttctgtagatgtctattaagtcagcttggtccagagctgagttcaagccctgaatatccttgttaattttctgtctcgctgttctgtctaatattgacagtggggtgttaaagtctccgactattattgtgtgggaatctaagtctctttttaggtctttaaggacttgctttatgaatctgggtgctcctgtattgggtgcctatatatttaagatagttagctcttcttgttgcattgatccctttaccattatgtaatgcccttcttgagtctttttttatctttgttggtttaaagtctgttttatcacagactaggattgcaacccttgcctttttttttttttttttttttttttttgctttccatttgcttggtaaatattcatccatccctttattttgagcctatgtgtgtctttgtacgcgacatgggtctcctgaatacagcacacagatgggtcttgactctatccaatttgccagtctgtgtcttttaattggggcatttagcccatttacatttaaggttaatattgttatgtgtgaagttgatcctgtcattatcatgccagctggttattttgcccgttagttgatgcagtttcttcatagtgtcaatggtctttacaatttgatatgtttttgcagtggctgttaccagtttttcctttccatatttagtgcttcctttaggagcccttgtaaggcaggcctagtggtgacaaaatctctcagtattcgcttgtctgtaaaggattttatttctccttcacttatgaagcttagtttggctggatatgaaattctgggttgaaaattcttttctttaagaatgttgaatattggcccccattctcttctggcttgtagggtttctgtagagagatctgctgttagactgatgggcttccctttgtgggtagctcgacctttctctctggctgcccttaatattttttccttcattccaaccttggtgaatctgattgtgtcttggggttgctctttttgaggagtatcttgtggtgttctctgtatttactgaatttgaatgttggcctgtcttgctaggttggggaagttctcctggataatatcctgaagtgttttccaacttggttccattctccccatcacttttaggtacaccaatcaaatgtaggttttgtctttccacatagccccatatttcttggaggctttgttcattccttttcattcttttttctctaatcttgtcttcatgctttatttcattaaatttgattttcaatctcttatatcctttcttccgcttgatcgatttgggtattgatactcgtgtatgcttaacaaagttcttgtgctgtgtttttcagttctatcaggtcatttatgttcttctctaaactggttattctagttagcaattcccttaaccttttttcaagtttcttagcttccttgcattgagttagaacatgctcctttagctcggaggagtttgttattacccaccttctgaagcctatttctgtcaatttgtcaaactcattctccatccagttatgttcccttgctggagaggagttgtgatcctttggaggagaagaggcattctggtttttggaattttcagcctttttgcactggtttttcctcatcttcatggatttatctacctttggtctttgatgctggtgacctttggatggggttttggtgcagacatcctttttgttgatgttgatgctattcctttctgtttgttagttttccttttaacagtcaggcacctctgctgcaggtctgctggagtttgctggaggtctacttcagaccatttgcctgggttaacaccagcagaggctggagaacagcaaagattgctgcctgttccttcctctggaagcttcgtcccagagtggcacccaccagttgccagccggagctctctcgtatgaggtgtctgtcgacccctgctgggaagtgtctcctagtcaggaggcacggggggtcagggacccacttgaggaagcagtctgtccctcagcagagctcaagtactgtgctgggagatccgctgctctctttagagccagcaggccagaacatttaagtctgctgaagctgcgcccacagctgccccttcccctaggtgctctgtcccagggagatgggagttttatctataagcccctgactggggctgcttcctttctttcagagatgctctgcccagagaggaggaatctagagaggcagtctggctacagtggctttacatctatatttttataagtataaaattagaagctaattagatataatgaatggtcaagtaaagtagacatattttcacatttacatccatttccaaattttgtgatactgagtttgtaaagaagtccaatttcgctatttgctgcatttgcttttcaacaaaaattgtatttagtattttcactaaactatgtaagagcacttagctcgttgataactttcatcaccattgtgaagctatacaagttataaactattttaaggcttttcccatcccaatttaggccttaattattactgtgcagaaaacattttgctgcagcaactgttcttagatgtctctaaatcaaaacagaagtcaggattcaggtgacagcaaataaaatttccaaaataataaaatatcaggtaaatataatctctcatctctcatcttctctccatctccctatgtccctttccttctctctctctctctctctctcacacacacacacacacacacacacacacacacacacacacacagagagagagacacacatgttcttcctctaaaaagaaaaaccaataatcctctactgagacagttgtgaatcaaaggtttcttctgcaggagttacatccatctctgaatttcctagagagcagcaaagggccttgtgttttattccccttccacacttaatcactggactgtgggcccagactgaatgagtagctcattagaatcactgagttcactgaggggatgagagattccttcctggctgggtgctaagtgatactcccataaggattttgtggttacaaaacgtgctggatatggaggtaacctgtctgggagtcctgtcactccaaggatcacttggaatgctctggaaaaacacatgacctggctgaatgagttctgttgaattgtttagcctacaccttcatttcagcagcttatactgcattaatgaggttattgttcctttgccgtccaattgttcccaagctgattttttgcatatatgttttacatccttaacaagaatgcctgtctcctgctgtttcagagtctcttccacagtgctgagcatgagtggagcttgctaaatcattgctaaatgaagcaatgggctgtaagcatgtcctgtgggatctgcatcttcagatcatcctgaagtactcaacaaccacatcttcttccaggaacagagcccaacataaactggtagggtttgctgtcttagacagctaagagaacgaggagtggagctagtgaacaagcagtgaagggggcagttccttaatgccatccgaactgaatttcaacagtctgacaagctagcgttttgggtaaatatcccagtatacttgtcacagagttaagtaaaatggacttccttcaaaggaagtgcttttaatacaataactgtttttgtttttttaaccaatggattaaaaatttaacacatttactaaatctggcatatttatatattgtatctaaacagatattcaagctgcattataatataatcataaaaaaactgatctcagtctgtctgttaagcctttgtgagtctttgtgccattgttggagtagtgctaattatcaagcaaagacatgataattacgcagagcttttttgctaaaagaaggaatctttttcaacacccacgcactgcacaatttcctatgaccctgtagcactactctggtatggcccagaaatttgtatttctgtgtaaaggctggaaattatattatttctatctctcccgataccttttcttcttgtgagtaaactgtttttagagggttaaggaagaggggtaatggtccaaatgggaaatataaaactaatgacccttcatgaaacatattatgctcctcattaaacttattcagttaaatgtattccattaaattaaaataaataggatttaaaattttacccaggagcagtaaacaatcttaacttttgactttatggtagatccattctaagaacgaattcaaatccctgatgtatcataggtctttgcctccagcacaatttatgtactagtgctgcagaggttttcaaatttagtgtgtctaagaattacttgggaacttttttttttttttttgagacggagtctcaccctgtcgcctgcgccagagtgcagtggcgcgatctcggcttgctgcaagctctccctcccgtgttcaggccattctcctgcctctcgagtaactgggactacaggccccctccaccacgctcggctaattttttggatttttagtagagacggggtttcaccatgttagccccgatgatcttgatctcctgacctcatgatgcgcctgccttggcctcccaaagtactgggattacaggtgtgagtcaccgtgcctggcctacttggggaactttttataaatgcaacttccaatccagattccctcttcaccaagtgtctcaagtatcctaatttcagtgatgcagcactttgaaaaatattccatgtgaagatgatgtaaattttatcaagcttagcggtcccatcttacttctttttccatgatctctgttattactaaaatgtggaaaagccaaatatgtgaagaatgcataattcagggagttgaacaggacggacccacaatgtgttagacttacatgttatgttcatccaaataattgagccatccaatctctagatttggcccaaaagcctcgaagtgtctttttgagagattcagagatttaatctattgatgttaacaagaaaatggaactggttctttactcctgttttacaagtattgcttttttaaaaattataatcttgcaaaagcactttcaaatccaatgccttcatttttgagatgagaaaacgtcagcccagagaggtacccaactcaccacactgcacaaaagtgcaagacaaggattcaaatgaaaaacaatgactcttaacccagtgctgtttttgtggcatttaaagaagtctgactttcaaatatccacctatcaaaaaatatgaagttttcatacaatatatgaagtgggtttttttgttgttgttgttgttaaacagacagggtcttgctctgtcactcaggctggagtgcagaggcacaatctaggctcactgaggccttgacctctcaggctcaagccatcttcccccttcagccccccaggtagctgggaccacacatgtgtgccaccatgcctggctaatttttgtattttttttgcagagacggagttttgccatgttacccaggctgctctcaaactcctgagctcaggcaatctgcccacctaggcctcccaaagtgttggcattataggtgtgagccaccacacctggccaatatatgaagttttaagttgccttcaagtcatataatatattcctaagaaaaaccctcagaagatgaatgttctaggttttaaactcctttaagaaagcaaattttagaagtcaacatattttccaattggctcattatggatctacagcatttcacatgacattaaggactagcagttccagtgtaatgataaattccaactcaaattcttttgttaccctgacttttgttataatggttttagtaatgagatggagtttttagtaaatagttgttttgttttctgaatttattttacataagtattagtgcacacacacaagcagtgttcaccttcatatttttgtactttcatatttatatgcaaataaaaaactatctgaaatgcataggtaaattttatcagtgatcctaaatttcaagatcaaggcaagcacacaattcaaattatcaatgaaaaactaaaataatgcatagtattttaagcacatatcaccctaggtctatttatcattcacttttgtttctctgaaattatttccttggcctcgttaaggcaaaaataaaatataataatcagctcaatacttttgaaaaactttcaaataaaaacaaagaaatgagaattagtcttagacaattgtaacaggtaaaagggagatggatgtgggaggcatattcatttgatcaggattagcactacatttttttacaatgtggaaccagtctaagcaatggcaagaatgacgtgtactctggcaaactggctcttgagtacatacttttgaaacacttattaattttcttttcattctgagaaagcaggcacaatctagggaagccagagtagacaaatagattaagaaaataggcagatgggaaccatccttattatacctcttcctttgttttgtagtcttaatcattgctcatgaagggtactacaaagtatttaaataggatcgatgctgaaaaggtttaaaatgttccagccaatgtaactaacctgcacaatgtgcacatgtaccctaaaacttaatgtataataaaaataaaataaaataaaataaaatgggaaaaaaaatgttccagccaaaactgtatggtatgttacttatgctaacacatctaaaacatttttgactttcagcatcatgcttatttattttgggcacaataaaacaattttttaaatctgacattgattaaacactgagctaacatttagaaattcattttcatctgatttctgattccatgtatattaacagttttcattgatatatataatgatataatttttaggaaaaaacatttctaggagaataattgcctttactcttccagcaagaaagcattcagaataatgagttacaaagaagagacataaatcgaaaaactgaaagtgtaaggttggggtgagttcatttttaaatacgttttttctttgatgatgccgggaaactattatatacctaaaataaatgatcagaagtgtctaaaatatggatgagctattccctggcaagagttcccaaccatggtgtcctgatacacagctgtggacaatgaccacttgccaaagatgaagcaaatagtttgacactggtacttgatttctagcaaagaccagatcttacatggtctctatcatcacatcactctaacttttgaaggggagagaaaaggtggagtaagagttgcgatagataataatcctgggtctatctatgggactatgaacatcttaagaaaaagaacatgatgtgtgtatgtgtgtgtggcagggggaggtccaaactcccctgcttgcggaggcttggggctcaccacgcatgctctctcacctccacgatgtctgagtttgtccggctctcatgcggctcgttgtactccgtgtacttgagaagcactttgtccatgtcggtgctggcatactggaacagcttgttggtgctgttgaagatgatcagcgcaatctcacagtcacacagcacgctcagctcataagccttcttcatcaacccaaatttcctctttgtaaatgtcacctagaaaaaagaaagcagccaagattttttaaaaaatattcatgcatgtgtggtttttttcttttcttttttcttttccttcacaaaacaatggtgtgtagttgtcagagccctgggcactaacacattcagaaagaaagcaaataaatctaatattaatttctgcttatcatttgaaaatgtgtgatttctagcttgctgctgaatgtgagactctaaatgcaagatttaatgtagggtattttaatgaaggtgaccagggaactggtcatgtttctttgagcaagttaagatttaaaaaaaaattaatttcagcatggttagcatatttcccaattaataattagtttggagcttgtttttgactatttgaagagtggacatgacattaggaacttagcattttagatctgtgttcaaacaagtcttaaaattgtctagtctcatgtcatttaattgaaaacacttgaagggatatgactgtgatctcagacgatgttgtattctgttttctagaaacccaacagggcactgggaagtccgttagccatcatatgcttagggttttggtttcattcttctgtgtatctttcttcttctctcaggtcagaaactgtattgttaatgccaccattttcttcttttaatctaatctattaccaagacccataattcctttcctcaaaatatttctcaggttcacactatttcccaggcaactctatcactgatgtccttatcacttcaattttggacagcctagcagcttcctgtcctcgatgatctccctgcctggaatcattccttcctcaatttaactcaaactgcaaagcctcactcttcctactgtctttttcctgatgagctgcctacaacagctccctctccctggctttgaaaacttcctacctgccaatcctaccaaatgcaaaaatacatttcactcttcccaatttcaactctcttttaattgaacttcagcttgttgctccagtctggctactgaaaaggcgtgaacattctttttttttttttttttttttttttttggagacggagtctcttataaacctttatatggtccagtgtttcccatctacagaatgaatacctgtttcccaacaggtattcattctgtagagtactgttcctataaaatactccttaagaaaaaagttcagtggcctaatatgtttggaaaaagaggcacattggtatatgaaaggctatgaaaccttttaaactttgtttaacttgcttttcgaacctattgctgacatatcgtttgtttctttgcatatttatttattttgaggagcacttactatcactcttcagaactaggtttttgaggcacatattctgggaaaagctaatttacttaattaagctactgttttcagaatgaatcatttaaacttttttcataccttcaaatccaacccaccttgcagagaggccagctcattttatcacagatttgtgtgtaattcctaattgcatattcctacccttcatctttctctttgtctccagacacccaatgcatgtcctccagttccacacctgtctaaacatcctggattctcaaaccttccaaagttcaacctcattatcttcagtctagaatctgcagccccttttggaatccccatctcaccataaactcagtcatccaaactagaaacctcagagagaactctgaatcctggcctgccaccttctcccactccccaccctcccccacaactaaatagatttatgttgacaaggactgtggactagcagacagaaagcctgacctcccagtctcctcattcctccacattttgttaattattgttttacttatcaccttttatttttccttcatgttacaatcacattttatattttcaaatatacaaaatatacacaaaaatataccaaatatatacaaaaatatgcaaaatatattttgtatataaaatatgcaaaataaaaaatacaaaactgtttatattttcctgtgtgatctgtttaacctctcttccactacagcgcatgctccacaagggtatatgccgtttttattttgctcactactttatccccagtgcttagaccagtagacatgtgtgggcacatggtaaaaatccatggtataaaaattgataggggaagctactatgtgaaatcttcagaaagatacaattgatgtatgtatatatgtgataaattttcccatgaaatttttttaacaactcatatgcaaaatgttttaacaatacatatattccttacttaataataattacactattttatcatatgacattgaaggtagtatggtagaaagcaaagaacatagggtttgtatttagagaactctgaatttgaatgccgaatttgctagtcatgcgaaattcacttaacaacttctcttttgtttgtttgttttttgagacagggtctccccgtctcctaggctggagtgtagcggtactagaatagctaactgcagcctccactttccagggtcaaaccatcctcccgcctcaacctccggagtagctggtactacaggcgtgcaccaacatgttctggctttatctttgtttgtatttatttttactagaaacgaggtttccctatgttacccaggctgttctcaaacttctgagctcaagcgatcctcccgcttaagcctttcaaagtgctaggattacaggcataagccaccgtgcctcgcctcactttaaataaagttctttgagtttgatttttcacatttgtaaaacagagatttatacctactcttaaggctgttgtgaggattgtatccaataatgtgtgtatagtattgagtataatgcttagagtaggtgctcaataaatattagttcccccaaatttcttagttgacttaaccaaaaaagaagaactagcaaaatatacttgtcttggtgacttgaagagtctaccagttatggctatttgaagatgttattatgactgatagaaagataaagctgtagtgaccatcgtttggaaaataaggcatttagatatttactagcccatatcaactagtcaatatttactcagttacgttatttacatttcaacttggataattcttctttcttgtaattgtcagtgtttttcaccttctatttcatctttattgattgtctttctaaagtacttctgaaaaaatatagctagtgttttattttcatatctgattatcatactactttagaaacttttattctgttttatgcagatgagtcataattgatattaaggatgggctgaaaaccatctttttggaatgaataaagaaacataatcattaattacacagagctgcactaaatgtcttttaatatttcttttagatccaattttgatatgaaaatgtacctgcatattggcattttacttagtgaaataggctacagaatacgttcaatacagaaggcactgacctagactactttcatatatctaaaaccacttttaatcagacttcatgaccacaagctatatgtggaatgtctcaatacagtatggtttctgttgtactcagacctcagaattttgcacgttacaacactcataatcaaagtacatttcagtacagaaatatcattaatgtcactatttgtgtttacttttagtgctcctcaatttttgtgtaaccaaataggctgctggataatgaatacttatttaataatacccatcaaagaagtcagtgcatatagcttcttctgcaatttaaaactgcaaactgaaatgatgactgtattaaagcacgtaagaaaatatcttcaaaatctactcttaattgctctaaatttaattctgcattatgttcatattcttcatagcattctcaaaatgtattttataatgctttttctcattgttcatagttagataaaattatttttaagcattaggctttctaaagagatctggaatataactcttcatttaaaatatgccactcaataacaaagatttcaattctgcgcttttatacttaaataatgccttgtgatggttacatttttcttaacttgataatagtttgtaatggggacaagtccatatttctttttaaataacatgtttggaaccttaggtgaggcagaaagaggtttttacagtagttaggcaaagagtctctcttttccagtatttacataagtcaacatgttatcaaattaaagagacttaatgtgtgatatagcatagaaagcagaactactctgtatgttttttattttatgtttttcctttatatttttgaatctttaaatagccccaaatgtgatgatggtatgttaagttttatagtggccctgacttttaaatcctagagtaaggacagataccatacatcttatgttgataatggctctagaacctattaggtgcgaaggaaaaacagaaattagaagttgaaattgagaaaagaaacattcattaaatatagcaccatacaaatcagttactaaaaatttaagaaagtctattcacaaaaaatataaaaataatttggccaagttttatggagcattttccgcatgtcaaacattatgctaagcaatatttattgaatattctctatgtcaggcatttgtgctaggtactgtggcttccattacataaaataatatctcccttgttcatatcagttccttgtggctggacaaaaaaaagtcatttaattccataacgtttaaaaggaattttctttatttggaacaaaatgcatgacttggccaacagagttatattttcagtcatatctaataatctgaattcgtatttttatttagagttgggtgaattcagtttttttttcagactaactttttctctggactgagctagaaaaataatagtagatgtaaattcagtcaagatgagtacgaaatgaaatctaccttactggttatttctaatcttgacttggtgaaagctgattgtggtattactcccatctctccttttccacctggccactggatgcacccatcacgctgtaagggttagtttaaatgccaacttctttctttgatgctttccttgtcacattcagataaaactcattcctttctcattgtagtcctccagcactttttacaaatctttattatgagacttactccagtattacaaagttggttgtatatgagttttcccttctgccagatttgaattccccaaagaccatccctcaggcctctcacagactctgaccagtggccactcaatgaacctttgctgaacgaatggattatggaatggaaatactccattttgaagtctgaatgtttcggtataattttatgttagagtagatgcttttttacttgccttttaaataatttaatctctcaaaaatagagattttggacacatatacctttattttactacaatgtttagcttattagtgacacaaatcttaagataaagtaattacactatcttggaatttataataaagaaggtaaatgatgtctggagaaaaatatatatgtaaatatgctgtagacttcaagaaaaatatacttcaaaaaattcagagaaaagtttttttcttttttatcccttgcctggataaaaaagatgaaagataaaaaagtctgaagataaaaatttaattttacaatcacaggatacagaaagaatggggaggatccatgggttcaggatgactgagtttgttcagcaaaaatgtactgaactttctgatgagttcagattttcaaagaataagcatttggaaaagtgatgaaatcctcatgcacaatttgagactggatggtagtaatttagctgatttaaatatggctgatgaactataattaatgaggccgacttaattgatcaatgttaagtttatcaaaaagtctctagtaaagtgccatagaattcagtacttttcccatcccaggagacatttttgtcattggtttagatgggtatataggaaggcaggcttatcagatctgcatgcaacgtaaatctgggtgcttgagcaaacccagtaggtgataagagtctatatccatagcgccttctacagcctttagaaagctgggtcacaatcaagatgaatcaaatgaaggtaattttaaagtccacattcatatttttaaaaaacaattacaaaagttcaggttggggataattaaggaattttgggaaaggatctaaagttttagcgttctatagtggtaattaattatcctactgatctttttgtttgtcagaaccatctttggtagcatattcagttctgagggtgacattttaagaaagcactgacaaaattagagcatctacaggatggtaaacagactgatgtagggtctgagaacaatctggcatgaggaaccattgaaagaatctggaatgtataactcagaaaaaaatagaattaaaagtgaaatgctaaacattttctaaggtctgaagcatatgtccatgcgaagaggcaaaattagtaagcattgttgaaaattagaaagagattcaaaacaagggaaaatctagtgatgagaacttcccaccaagcaggaagcagctcatttctgaatatgttcacatagagctgcatatcaaggaaggtgtagaaggggctcctgaattaagcaggaagttggactagagacctttaaaatatttattctaatttttagatgttcttaatctatgcctaagtatcatagggctttgagttaagagcaaatggcaatatggttcaccaagcatgcaccctacagaatctcctatgttttagttactcaatcccacccatacattatcgcctctaatttccatatttcaagaaataaaataactttttttgtagctagacgagacacaaaagactgtaaagaatttgagtagacaacattaaatgatgtactgaaaatgcacagaaaaataattatccagattgataaaacagcaaattcacattattaaagacattttaaagaaacaggatacatgcatcatgactggggcagtacaatgtagaaagaaaaacataaaaattgaaaaccaagtcccagctctgccttttatgagctgtgtgcccttgcgtaaaattgcttaacttaccggaaccccagtttcctcacctggaaagtggagataataacaggcatcatatagagttttgtgagaggtcaagtaagggatataataccagtgtaaataacttgttaactgtgaaacactttacaaagcaagtagtatcttctctgatgcaccaggcttagtcgctccttgaaacatactgtaaaagactggtctcctaggacctgtcagcttgtgttaccattatttacttaggtctagattagagtgtctctctcagctatatcctagtttttctcgagtacctgggccatcttttgctcattcttgtaacctgacaaccaataataatacttggctaaataaataaatgttgatagaatgaatagatatatggacagaggaattatagtgttttttgtaatccaaaatgaatagctgaaaataaatttctatggatgctcagactatgttaacaagaagtttgctactgagagagggaaatttcacatacttgttttattttatttttttgtcattttaacttacagtagaaacttacatttggtaaaattaatcaggagaaaaaactggacttggtcaaattttgtgtgtgggttggttggtgcaagtgaagcatatcagatttcttatattattttttagataacagtgttgcttatttgataattttttctaagaagttcaacgattttataattaattatctccctacattcgacagtatctctttgaacttattctttagcacagtttatcatccctatttttcagatgaataccgtaaacaaagacatgaatagccttatccaaggtccccagacttgttcctggatggactagaaaaccaaccctcttcacacaaagtgcatctttctttctgttagttagtgttccttccctcttttagataactatggattttaggggctgaagttcagctcaatatggacccagtcaactgtttattgagcagtatgcaggcactgtcatttgtaatgttacattaagaaccatcagaaattctgataagtgcaagcacagtaatgcataacattttaattaacgtaaggactgctttctaggttaaagtcaaaaaataatactaagaacactaaattgagagccagttggtttctaggttctgacagtaaatcaaagctacttttgtatagactctgcagccaactctgccctcagacgctccggccattcccactacagccactgagaaccacatgcatgcactagtgggcacaaactagttctatatttatggatgtttattttaatttcagaaaatgggaagaattttggttggtagtaaatacaggtctgcttacagctagaataaaaaaaggtggccctctgatttacacaggcaatgtaaataacaagttctaaaaacagagaaggagtcctgtatcatttcctacagggtagggaaattagtttgactactgtgaaatggaaagggcatttcataatctttctccactccacacgcctgccccctccctcaccctcccaggcccagccccattcataaagtcacctcagaagaactttcctgccattttaactgtggtaactgttcttgcaccttgcaggaaagagttctgaaagaaaaggacctttagaaacagcagctactcacatctataataataattgaggcccaactgcaaattgcctcagacatatcactaagggaagcaacaaaaatctgatctatgggtcccaaatacttctttccaccaaacacaatatttttagcctaatcttaattgaaccttacagtgctcaatgaatggataattttttatttttttattttcaccattctttaactcataaatagtagtttctttgttttaggatgtgtttgggattcgtatacccagctaattctattttcaaaggtttgaggtttgatcattttttttccctccaaataagagtcatgataaatataaccctcattatgtgaaaatatttcaggtcggctactccacctcatccccccacctagataatctctcagtttcctcccagttgaggaaacagaatgactaatgagtgacagatggacagttcacagatacaatacactctgtaatccaggagccacaggtcttcctatgtgtttaaagggttagggctggagtcaagagtctgcaacgacaatctttaattgggaaaaagggaaatgccctcctaaatgctctttctccacctcccttgttcctgacagtaagtaatggcacaaatgttctaaagtattcttcttcagttttattttgtttaattcagtctgtcattagaaaggctcgcgagctttaggcccgatgattactctcggtgggaggaagcagtgcctctgcagacttgtgttctagacaagcgttcctttatacaatgacggggcctgccatcgtaaatgaaaggctctttaaagagcagcgagggactcttttaagcagactgctaccacgtgcttgtaaccctccagcataacttgcgaggatgagacagcagtgtgttctgccgcaaaggggactattgtcctcgttagcctcaagcaaattgagcctccgtttcgctgaaatacagtagtatttccaaaggattttcaagcagtagttcctaaaattctgaacatgataaaaggattaaaataaggggcttagagtgtggaatttagaactctaccaacccctcaccctaagtcaacatcccaaatcccaaaataaaactccaaatcttatgcattggagggaaaataataaatcacagttagatctaaattaaataatcgaatgcacattaatgaaacgagtgtttattaacaaactcataaaagtttgagttttaaaatttgtgacagctgaattctgatgcatttgtctgcatgaggaaaaggaagaaggatgaccgaaaattgttaacttgatcaggatataagagattttactgtggcccattttaaggcctaggaatgttttgccttttgaaaagagaagactaacacagcaggcttcacattttttatatgggctgctcaagtctgcctggtttgttaaagggctaattttcattctaaatccaatctgtagatgcagtcataaaataaatacctttgtttctctgtatctcatctacataagagatataatttgaatctgagaagaatcaaataaaccagattaatattttgggggcaaaaacatgtttactagttcaacaaagccaaatgtacctaagggaaaggtcaaaggatacttcattccctgctgagcaaatgctcaggaagcacatttgtctacattttcctgtcataacaggaagagtgtaacttcttcctttccacaatagcctaggttttacctcctaactccaatattttctcccccagggccttccaaatcaatccttgcaagacagaaggctgtctcccttatagtttccaaacagttacatttgttgaaatgttatttaaatgttagtgatttctttagttaaactgttccaatttaaaattaaaagtcaaatttccaaacatttagactggttctctaattcttattaatggtccaacatatttcaaaagaaacacaaatacacattacatattatcaatttttaatttttttccttaatgatgtcatttacttaattttttaaaatttttgccaaagccattatcctcagaaaaaataagtttccaaactaccttcaacaagaatacattgggatgcaaactttaaaaataccctaataatttttgaagtagtttcattttgaactaaatgttaaagaagtgcagactgcagaggacatggcttttgaaacaattagcatcatgtcttttaatctacagtttggaagaaacttctcggtgtatgtagtctatttataatgttaatatttttagtgttggtttctcagtaatacaatgtcacacagtttgtgcatttgcaaagctaaaggtgacttgtagcagacagagtggtgtgtgcatgcattcccagaggtgaaaggggccattcagtatcaactttcttcacaaaatgagatacaataaataaaagcatcagattctttttaaattacagttttaagtagaaattatatgagatatacaaattagaactggaaacaataaaaacccttgaggccctcaagttcaaagaagagtgacagaattctagaagtgacaattattcttttccttatgaaaatgttggcctctctcagatttcctaccaaaggaaagtgaatgaatgagattgacgggagttggagcaatatctttctggcagtaaaggagtagatctagctgacataaatataaaatatcatgcaccgaacaggataaatagtaatatgtgtggcacactgttgctgtgatcctactacatggtggggagattatttgtgaattcttttcaaattgctaagggataaaatggaaatgaatggcctgaggccacagctgttaaacatacatctgagcattctgcctactgctttttttttttttttttttttttttaatttggaaactcttacaagtattatttaggtcattttcccttctggttttctttttcaactcttcaatcaccagcaattccaaatctttgaataaaaacttttcccttggtaattttaagattaataaaagaatgatttaacttatatgcatgaggagcttttaagaaggcatccccaatatgtggcaatagaccctataattcaattctgatgggtatgatgtcctaaaatattactatgacacacccttattttatttatatgaaataagtttagtataatttttaatacaagtgttggggaggcaggcatctgttaagaaatgatactaagaaaaaacaatcatcatcatcattattatgaggtatttgcaggcttattttggattaaaagataggaaaatcaataatttttcactgattgagctttttttcactaggtctgaaagagattccagatacttcttgattaacaagtataattcttctacagtatttaaagaaaaactcacaagtctggaaattctgtttgtggaggtggccaaaaaaagtgcatttagcagtggagactgcatcttccatctattctccaacttatggtttggaattcaccgaaaaattatttttttgaagcaattaatttgtatttctcaattatccagttactcacatttaaagagtgaatgtatctctctttcaacaaattttctattaggttattaagatgtaactcccaaatttagaactgtaattaacttgatgaaaaccaggaaaaagtaaggagtaaaattttttctttttaaagagtcacttgagggaatctatacatctctttttatttttcagtttagtgtcgaatagaccagatttagtttgaaaacacatcagtatgtagaaactgtcagaagctgcatctacactgaacacatttttccagcttttttcctagttcatcttatataatttataattcatatgaagagactgagatggggacataagaagagggaaagttagaaaatgtaacagctatgaactctgaattcttttagtcataaggggattctcctgttctattaacagaatgttgcaaattgtctttagtttgtgctccagttattgcactgataattacatgaagttttgtttgctggcaaaaactattagtgtgccagatctgatgaaagaaaagaaaacttaaggcatttaaatatatttctttcttaacttactattttaagccctaactgtgttatctgacaaatatttaaatgtctttttataacaagttgcacaaataaatttgggcttacctctcctatcctttcaaagtaggaaagctgaaattttcaaatacaaacatacaagtaaataggtttaggctaagcatgcctaatttttatatatctttcttcctaatataacagatttctaaatatattgtttgtagaaagagtcatataaggacaatattcatttaaaaactgttaaaggacccaaaattacagctaaataagacaaatgcattcaagtgttctatcccaccaaaggatgactacagttaatatatcttacagtttgaaatagctagaaggaggatattggaggtttccaagacaaagaaatgataaatgtttgagatgatggatatgctaactaccctgatttgatcactatacattatacatattaaaacatcactgtgcaccctatgaatacgtacaattatttgttaatttaaaaaattttaaacacaaaagaaatgaaacaagcacccccaaaaccatctgttcataaaaaccagtttgttgttgaactttttaaacctttgcatatatatgttactgtaaaatacaataaaagtgtcacagaaaaaaatctgtttcaggagcatgattaaaaattggtaccatgtgaaagagggtaagactgcctaactgatggaggtatttcaagggtaaaaaaaaaatgccgacggagagactgaaactgtagtgttagcataagctagaagctggtagtgataaaaatggtgaggagtagttaaaaataatttggtcagtaacatatatttgaaaacaggtcccacaagcataacatttaggaaacgacttctccccatccttgtcataaatcctctgcaaacgtcctgtgtgatctttccttcttgtccacaaactatcctctctgcatcagctcactcctgctctggtatcattctctagccccttgttggcttctgaaggctcctttgtgctcctgctctacctgttccacttttccatccatctcctcaatacccttttaaaataaaaccctcatgaaatgaaggtttaggtaacattctttattgtgctacacagtacaagagttgttttgatagaaatcacattaactataatagctaatggttcaaagagcctgagtcttaataggaatagctaataggtaaatttattgagcacttattatttggtgggtgctttacatttattgcttcatttaattgtcttaaagacctaatgagaaaggtactaactttttttcatcctcactctagtgatgagggtactgctgaagctcagagggtctaagtaacttgctagagggtcacatagctagtaagtggcagaactgggacaagaacgaagtttgtgtgtctctaaaaactatgcctcttagccatttgattatactggatgcagtataattgggaaaagtaatgacacaaaaccatgctcttagttattatattacactagatgcatcatgacataattttaaaaagcataatttgtttcgtgttgaatatgagagatccgggctcagatcttggtcacttcccagttttaactgtacaatcttgagccagttatttagaacttaacaggaccttcaaagctttgcgatatctgggtcctgtctaacatccaatcttttctctcatttctctacagtcatacaccaggcttaagtcccactgatcttccttcagctcctcagtcaagctctttcctctcttaaggaactttgcaaatactgcttctggaatgctgtcacctgcctaactctgaatcatcttttagctcatcttttagcacttcctcaggcctttctccaaccctgatgtaaataaagtacctcctattattctttcatagcacatataagtgaaatttttgttatatatttttatatttcatgtctgtttaactcaatcaggggtccataaactgtagcctacaagtgaaatccaaacgccctgtttttgtcagtaaagctttattggagcacagccacacaggttcatttacatactgcatacggctttcagactactagggcagagctgagtagttgagacaaaaactatatggctcacaaggctaaaaatatttgctatgtggtcctttacaggaaagctcgctgaacccctaaagcagaggataagctggatgagattcttgttcaccactgaatacttggtgttaggtacactgcagtctagtaatatttgttgatttcacagataaatgaattattcagccataaaatgggacttattaataaaaattatttgtaattatatatatatatatagttcttggcacataattggtaactacttttattaggttgtctgaaaatttctgtaagataaattaacaattcataatgttatttttacatacttgcttaagaaatccatgttgtctaagcttgaaactaagaaagaaatagtttttgtaaacttggaaatgccaaaaaatttttttaaataaaaaagctgtcaatttttattctcacctaaactattttacgtattgatgtttctgaatttgagctgtcaatttttattctcacctaaactatttcatgtattgatgtttctgaatttgagctgttccctacttccattatgaaagacagctaaagtaaaggtaaaattcaatttaaacagccattctatttcacaacagttttatttcttaatgatatacaacttataacatcagtgctgtaatatttcatttcacacttgaagtcagtatttctttttctggaaaaaacataacttattctgtgtatagctaaataaacaagtgcaatggcagagcagtctttgacaacttttaagaaaagatgacagtgagccattgcatgaggttctactggacagtctacagtggggcagcttcaaagagggcaaagcatttttctttgcaacatgtgaatacacagttgaaagaaagcccaggttacgggtgcctctacacagtatgatatgctgtttcggatttgctggttttgtttattagaagtgacctacataatttaggctctttcccaaatgactcttacaactgctctcatagtaggtgagaggtgcacaagacaagcatttatatgtaagatgtttgaaattgtcaacagcctctaaaataatcactgaaatatatattaaaacatggtggatttcaagtttactaattctgtttaaaagtattgaacttacaggcctactgtatctaaagactggagaaaagaataaatataccctaaattctaaagaataaaatcaagaaatctgtcttcagaatttaaaaaaatgataagtcaaactaagctgaatttaaataagttttcttcttctaaagttattatgacttctaacctggatgagggtaacagccactgtagctgcaactatatataaaaaaagaaaagatattcaattattagctcaaaagtgcgacattaagattctttgtttgtttgttttttgtttttttgagacagggtctcactctgttgcccaggttgaagtgtagtagtaacatgatcacggctcactgcagttttgacatctcgggtcctagtggtccccaagtggttgggaacacaggtgcatgccactaccacacccagttaatttttttttaactttttaaaataagagattgcatctccttatgttgcccaggctggtcttgaactcctgggctccagtgatctgcatctcaaagtgttgggattacaagcatgaactaccactcccggctttaaaattattgtatccctagaaatcctgtcatttgttacaacatgagtgaaactaactggaggacattatgttaagtgaaataagccaggcacagaaggacacattttgcatgttctcactcgtgtgggagctaaactttttttttttaaaaattgaactcactgagatagagagtagactgatggttactataggctgggaagggtagctgggcatggagtggggaggggataaagtggggatgtttaatggatacaaaaataggtaaaatgaataagatctagaatttggtagtacatagggtgactacagttaacaagaatttatcatatatttgaaagtaattaaaagagtagaattggaatgttcctaatacaaagaaatgataaatgcttgaggtaggtatacctcaattaccctgattttgatcactgcacattgtatacctgtatcaaaacatcacatgtattccatattatatacaactattatgtacccataattaaaaatagaaattaaaaaatcttgtatccctgttttttctaataaagcataataaaagctcatgaattcaacctgcaaaaattttcttctaactttgcaagcaaaagaagatataatgaatatcataaacctaaaaattatctggtattggtaataaagtgcaaatgctaattcatatgtttttgactatactcaaaataggttctggtccaaataacaaggtccaaacagtgttacatgacattcaatatttcagtcttaatttcaatttcaagctataggccaattaaaaaatagcggttttctattgacacaatgattgctctttggcttgatccacagcaagaaacgatgtgcatgaaaacactaaaggaatccaccataaatcttagtattattcaccctctagctaaacatgcagccaaaaatagttcaagttgtgtgtacctgaaaatatataataatttagaggagtataaacttgaaaacctaaaagtttctctactttttaatggcgtactgactttgatgcaagaaataattaattcctattcattatagtttacacatgaaacaacattacatttaaaaaaatgaatcaatcagttctagtcctatttgtatgtccaagaagacaaaacaggacaatagaggacatgagtgtctacatttgtggggaaattacagtctggtggttgtccccagggctactgtgtagccttcttcagtgtaaccgaaaagtaggcaaaacactcttctcttccacagtccagaaacgtcttctctgcaggttccatgatccatatgagatggttgggacccagcagtactataatttctcccaggaccattatttgatatttaacgttatacaaactacccagctgtccttacatagcctaactaaatccactctcccctagtgtgaagaaaaatagagtcaaattgcaggcattcatgatatacaagtctttaatgccaaactgagcatttgaatgtgtaaagtcttcacaacagattaattgtatcacacagacattatcattggcattctagaaaaaaattataacaccatctgcctctatgtttatcaaattcagatttaaaatggtatgaattaaccgatagtccttgcctatatgttttaagttattaatatcttgtgtgggtgttttctttgttgttgttgtcagcacaatgttaaaatgtttggatgtgtttcaaaatctcatttactatgaataaaatgaaagccattttcatacaggatatttatcctatattataaacctttaagtgaatgaccacaaaaggtctagttcccatgaatataagaatatctttgtttgatgatgcgtgcaatgtagcaatgttatgctgattaactcttaattatcaagctattcatgtcacacaactacacttcccatttcaaatttgtgttgaagtaaaaagtgaataatgacaaatgtgtaaactatgtttctgacagataaagtgatttttttctcctttatatataagagactatcagcactttaactggtcacatttaattaacccaaacttctcttaatagatatttacagattcaagatattttctgtacccttaacatatgtggagaaaatataattaataaataatgatacaaaaaaagtttactccactcacctgtctgttacgttcatccataatcctcgtaatctgaatcttttttctccccatagtccccgtttttcttctctctctcgtccctgaaattatgtattttttccttccttttctttctctttcctgtttcctccaaacaaatctccttcttcagcacttgcacagctcagttcccaaattcctgcattcgttc

SEQ ID NO: 2577 - DNA, 105687 bp, Homo sapiens; identical to SEQ ID NO: 2576
  source 1..105687: mol_type = genomic DNA

SEQ ID NO: 2578 - DNA, 165226 bp, Homo sapiens
  source 1..165226: mol_type = genomic DNA
tcactaagaaagccagtaactttactgaattgtctgcaaaatacaaattataccttatttccagcaggagaaacttttgaaaatttcccacttttattcactacagacagctgaattaagtcccttgagatacacagatgtggtttaacttagttataacatcttgtcatctagtggcgacaaagtccagcttatgccgctgtgagcctctatttgaatatttgttgcaaatgcttgtatgccctcatttacaagcgattttaattactctcatttaatggaaacaagtccccaggaaaagaaaaagaagaaaaatgatacagcaaaccatctgaagcaatccaagtcctatgcctacagtgacccaggtctactttgctcgaagagaacactggtactgcattcaaaccacaacagaatccgtcacttaactgacctctctgaattaaactgaggtatgaatcaatttgaggtatgaacagggaaggcaaaatgcaataccagattatgaaaataaccaaaatggaaaaatttgatgtagaagatatgtggcttggattgctccacatctttggttaaaacatattaagaaaagcctttaattacatctgtagtctgaagcattctaacagacaccagtattccagcaatcttcaaaagatctgtagtggcaggaaattaacgccataaaagtgacgacatcacggcagatggcacaaatgagaacagatgaagtatgccatgcttaggcaacagcctttattgagggttcaagtggcttcttcttctttaaaaaaaatgttttttaaagaaagaactacaaagcgtttactctctggagaaacaaacaacaaaataaagagggcaaaaaatgctatctctaagttaaaagatgggtatgtaagaaaaacaaatccataaaagtgtgtgagggcagacattcttttaaaaagtgtcttggaattttgttttttcattctcactttagttaacttttaaatgatctggggatgacaggtatttttatattcatcattacaaaatgctaaattccacctttgggaaaaaataagccattttactaaaaaacacaatttttaaaaaggttgaaataaacagcctccacgcagcaatgcatacaatatacaggttgtgcagcttgcgtatattgcatcactgttaccagtattcaagcttcatattaccaaaaatcttttaaaataggattagatataacaatactcgcagccgtgtaaaatgccacttatggatcttttacttgcaatgaagaatgttgcctaaaatgttactctaggacgggttatgtaaaataatactccctcagggctctgccctaaagtctggaatacaaaggatttactgtgattaaaaaccatactagctttgcaaatacaataaatggtaaattacagataaggtataagggtaaagatagaccaagattgtttacagaaagtgactcatcaaaatcaaaattgtgcttcttctcattaaatcatcttttaaaaattctcagattatcccttccctatcttgccaccactttataagaattcagtagtgggaacaagagatgactggcatccattttcaagtgattctgttctcttcatgttcttataaaactattgtcagaactgctataaatagccaaggcttctgctggtactttagcttactttatcttcagcattaaaaattcactttttctttgttgctgaggcaaattgcaggttaaaaaactaatatggctatttcttcatattttcatgtaatgaccctttcccacccactggtatctactgatattgatatactaaagtattttgaaatgacaaagaacatttgtgaaatgtttgcatattttatacacatcaagttagaaggatgggttgtaaggatgggatcaagtctatggtgaggaaaatgattttcttattttattcccctgtgcgtgtgtgtgtatgagtgtgtatattttcagggatgtttttgtttttcctctgcataaatgttattctttcatgttccatggataccttgagtagtgggatatatatgaaatggttgatagattttttttttttaatatataaaacattagtacaaggcaggctagcatcctttatggatacaaccaaaggtgcattgtggtctaattgtggatttcagatcaagttaagaaaaatatagcctagttaataaggtctcttggcttctgccacccagcggcagccttttacaatgagaaacacatagcaactatgcaagtaaaagagaaaaaatggataagaaatgtcctacacatgatatagcagtgttgatattactgcctatatcttctttgctgtgtatgtcaatgcatatgattggagatgaatcgacagatcttcacattccaagagaaggaaaatctttcctagactgaaatatcttttaaacaatatatattgactttcttatggcactcacttattaaagggtctgaaaattaatcccttatagacgaatattagacaagagtcattttttttaaattaaaaaaagggacatagagaggttctttatgggatttcttgaaatggctattaaatctctttattgaagaaaaaatagatgacatacatgctttatgcagaagtgacatttgggggtcctgacacaccgggattgttcaacagtcctatattgctgacaagattgtcaagggtcagttaaaataattaaaaacggatgacaaagcaactatccctttacctgcttccttcttgtctagcacccagtctttcacatttttcttctgtgggaatttataacttattcaccaagtaaattccatatcacttgtttctagggccatatttgcaggacatgtgccccaacatagcttttctattctgggcatatttctaaaaagcgtatcaaattctaggctgaaaaccaaccagatgatttagaatatgggcaagttaggatatgcacttactgaattccaagatgcatggtgaaatggtgagatcagaaaggggccctgcatttgataaaaatgcaaaaaacaaaataaaaatagcatgaaagaaactagtatatacaatggatgtcagttgacccaatagattgctaatgtattaaaaacaatttagggtgttgcaatgtgatatgttctaaccccacaggttatccttttgacagctgaccttaaacttataaaatgtaagcagagtaaaagaaaacagaaagaaaatagttactcaaatgtgcaactgcacaaatatacccccctcccgctattaagataacaaaacttctgctattaccataatattatatatattagaaagctatacacaagcatgttaatttcacagatttttttaaaagattcttaatattttatataattagaaatacacatttcaaaaacaaaacttctacaaagagaaaacagttatcttggttagcaaagcatggagttcttcatggcttagggtagtgctttctatacaaaaagtcctttttggttttttacaggactgtttaaaatattagcgaagctatcaaggggaaaaaaacacattttggcttaagtaaactacaaaaagccacaaatgctttgcaaactctgtcttaccttttatatgaaaataagcaaaatgtaatgtacatatttttatatttttatttaataagagatgcagacccagatttatttatttatttaattaaatatgttagccctccaactccacatttttttttaataggtatggtcctcttttaatggtctctgatcctttttaatgagtgccatacgccaatgatatgcctgcaggtttgtgagcattcttgggatgtcaggtgacctggtgtgttcctaacatttaccaatggccacccattaccgggtctgtccaagcatctatacatttttctatatgttgcataacagctgctctctctttcagtaaagatctgccgcttttggcaaatgtttccttttgtctatttacatgtaaataacgttgaacctgcaacatgacactatctattgtaacatacattttgcaaaggagcacaacagtgaaaagaagttagccttaaaatctattttgtacaagtgttctgttgtacaactcaagtgctaagcttatctcagcatttctgtttatctttatactgtatcactgaggcaatttaaaagtacttttacaaaacagagtacctgactttttttttttccacacacggcacatataatgcatatcgaccccccttccccattaaggtatagcacacacacacactgcaagaaaaaaaaaaaaactagtaagtaataatctgatcatgttgcccatccttcagaaagtcgcatgcgcttgactgagggactttccctttcgtccggcgaaggtctggtgagtccaatgggggagtggaattcgttccggtgatcctctcggtcgctcccgtcgtacgaactgctacagctgctcaagctgtcaacaggagatctccccgcctcgtggcgcgtgtgttgtgggtatctcgaaggggtggtggtacggtctctaggaggagaaacaggttctgacttgatgttgaggctttgagtagaaggcagggagagatttgaactctgagataaatgagtgctagtgcaagctctgtaggaggaaaggaaacccagttacagatgaaggaggcctggaggccccaggaactcacaattaaatcaaacatcagcttaaagactcgcatagacaccagagcatgcccagagtgaagaaaacgtgcttggaagcacataagggcatcgccttctcagggcgatttaggatgcctttgttgatttgcccggtagtaattacagcatttaactggtccaggcctcatgaattatatctctagtctccgagaggctccctaaacatataggttaccatttcagaaaggtttaagacacaatggaaaaagcattttctgtgttcatggactctatccctagactagttctaaaaattaaatttctaagcatttagatacagtgtttagctctggaattagacttccttgatttactaatgcttgtgtttgaatattatttttaaaagcttattatcaatataaatatttgcctccaattaataagcacatacagatggaatcacatagtcttcagagaaagtgaagggagttaaattttaaatgactagaactcaaatgctgcacaataactgtatctggtaaaaagctttggaggtggaaaaaatggaaagggggagggaaattgaaaattatctgcagaaagtttaaacgttggttttcaaacacttaagactttctactccattaaaactgataatttgactttcttcatccttttgcagttacatgagatgaaaatactttgtgttccacaatgacctcaattttattaatgttagtcactccctgatgcgtgcggttcttaggctaccactcctcttatttatcattggcattagttgatgaatctggtgttgcctaaggaaagcttgttgccaagaaggatgtagtgtgattttactgtgtttataatccttaatcctcatatattcccagagagaataatttttcctttttccaaaatctgggaaaatttagaaacttggaattctagaggaaaaaagtattaagcccttaagtgtagattagcaatcacaatgactttgatcaggataaaccatagtggcattgctcgcatcaattttaagatgcttttactcttcttacactaattacactgacttccagagctagagtcaggattacttgactatattgtcaaaagagcatggtactctcttttactgaggaagaatccaagtgaagaattatccatacagacacacccattttaaacaaaggaaagcaagcctacttactaatgtatgtaattatgctgctttccagtggagagaattagttggcactaacaatgtcattatgaccactgagagaaaaagtatatatttcagaaaaaaagtgaagtaacttggggctggctttttgggagatgcaatacaaactcaagatgtatagtgatataaaattagtcagaaacgagtttatctttgagtgatgttttgtacaaaagcaccacctactggcaaagaattactttccttctcctattaataaatagatgagctaatgtagagaataatataaaggagaattatttgtttccttaataagcgtctctttctctagcttttatgatcttatataatcaaagcagtgttagcatttatatcaagaaactacactgactgtatataattttcaaacacctgtttatatttggagctatttatttgtagcttattaatttatagtctatcagtttactaattttccaaaagttttaattaaataagccttgttaaaatggggagagggaacacctgtatttcaaaaggattcataatggtagactattttatcttggttcaaagttacttagtgattcattctgatgtttgaggaaatcgtcttttgatttctggaataaagaattttcctggctctaagaaagaccatttcactaaaatttaattaaatgcttctgctatgaatcacacaactatttaataatgaatatgaattaggagtctgaaaataaaaagtgatatgtcaataaatacttttgcttgctctttgacatacagattatgtcttcacagggagggtgacatagaaaattagaagaaaaaattggtgagttggacagtctaagcagttaatctagacaaggtaagggaaaaataatataaccaaaattctgtttctttaatacagtttttggaagctgcattattcacctctttgcatcatcttcctatgttaactggcctgtataggtttagctgtgtatcttccccatgaaagatgtaacaattattggttatcccttcctacaaacagactagcttaaatttatcttttggtggaatttcatttgacactgaaaacatacatgaagcattttgagtagttctggggactaaatccacagtagtaaaatgcaagtgatatcttagattcagcttcattatactgtgacataggatataaaatagaatggctagtctctgttaacaaagaagtattttcttgaaaagaaaaaagtagcattaaaataacttaactgcatatatgctaggttcagatataagcatgttggtctacttgagaacaaaatatagacacgaataattatagaccctgataattgtgaaatactgcatatgtgtgggtgggtgataaagaggtgggtggggagatagaagccagatatgcaagttacccatatcaagtcctctatgcaaattttcatctattacagatgcttttgaattgggaaaactcctaccctttcccataattgttcagaaatcaaacatgactggatagttttattcaaaatttttactgcctccgcctggaaattagactatcaaactatatttaacctaaccttttataagtcatctctactcagagttatctctctcagtatgtactgaacacccacatcaacaaagttgacgtatggaaatgcttccagaaaacaggctgccctttttataggtggtggtttagaaaaacactaaaacttagtgttacactaaatcaaatattagtattcaaaggactttcattaactcttgatggcaagttcctctgtcagccatctctctccctatagcaaataaatttgtgttgcttacttagcttggttagataaaatcagatactaggttttaaaagtatagctttgaagacttaaagctccaaaggacaaaatgaactttttttccatggacaaaatatgaagaactctgtttatggttttgcaattttgagaaagaattgtggtaaccatcttgggctgctgggaatatctactttggtggagctgaaatatattccactctgctatgaacattgtctctagccaaaagaatgtgagcccgcaacacaaatctctgcgacaactttggcctggaaaatgtatcaattctttttaaattgatttacactgtaaagaattaaggatgctcatgtgaattactttacataagtattgcagcttgggattttttaaaaaaacagtttaacatttaatcgtgtgaatatgaggtagtccatgtgaaggaacctcctttcaaaaagctactctgtgtgtgattgtgagagggagaaaagagtgtgtgtgaagcagagagagagaagggccaacagtggaaggactggaagggtcattccattgatttgaggggtaagggaagtgattaagtgcaattaaaactcacagagaaaactaagagtcaaattaagcacaacgaaattaagtgttgaaaggaaccgggagctgaacaaaatgcttaacctttggctgttgtaattcagttcctttctgtctaaggctgtccctcctttctcattttctgaaacctctattagaggcagcagagaattagattcttccttgtaatagaaaagagttttaaaattgtagtacagctaaaatatgtaaataaatatgtgtttatatgtaaaaatataaattatcaggtactattgaaaacaaaaaaaagccacattcagagaaaataatatggcttttgacattgataacttttagggaaatctagccctataatggatgaattttgtgaaaaaaatgggaaataagcagttatgtttatttttgacaagaatcatgttcagtggattccctgctaagccatagcagttgatactttgtacaaaatatgtatacatgtacatattttttagttgcctggatggaattatgtgcttggtgataattacctgaagaagttcccacagttaatgtctacttgaatagttaacattccagagaaaatttaagtgtcctaaaaagataaaactctgcgctgatcaatatgtaatgtatcttcaaagttaactatctttcaagaaagctgaccaacagtatcacgtgaatttatcttactatttaaatgaaaggttagattttcaatgacagtgattagcgggtaggatgaacataagcaaacagtgtacgggtgaatatttcataatcagatcactaatatatgctaaatcactatcatgtgaaagctagtgggtggggggagagagggcaccagcaaacataagagacacaaagttgtggtataaatcagtgacttttatactaatcagtgttttattctcactgtctccttagacatatggatatataactagttaactaatacagctaagtgattaacgataacaaatggctaagcagaaaagtaaaagtgggctaggcagacagaatatttttaaaatataaaagcttgttatctttaaatattttatatcctcctggtattttcttttgaagattaattgcaattttggacttattaaatttacagtcaggctttcagttaacgttttaagcttttttaaaaaaatgatttgttttatatgaaatagtgtgaattgtgaattcagagctttttaaaggtttgaacgtttccatagataaatgacaagagtcatttctatgataaagacatatctgaaaactaccacaagggggcagaaagatacatcctctgactacataaaacaaaaattatttttatatccaaatttaggtaattagtattatatgtactagttagtattatatacatatatttcttaaaatatctataagtatacaactatactatgagtacattataaatacatgaagcctgtgtatcaattgactagttgttcctatgtgtattaggttaacattagcataaaccatatggtttatgtgaaaaaagaaaaattctcaaatatctaagcttatactataaatgccttcttatgtcccaaatgaactgtgtgaaaactaaataaaaattatatcactgatagaagtggaaacaaatgtagcctaaaacaataaggaaagaatttacctcattattacagagctcgctgtcctcttaaaaaacaggtatataagatttaagctacttgaaaagtattgatctgaaaattacacttggatttcaataaagtagagttttatacccgttaatgggatattgaagcacatatttagagactgtcatttgtttttcaaaatacattctaaaattatattataaaaaataatattgcttaccccaactgactgagggcagatggtggcatgttatgtaggtgttgctgttgccagccagttactgaaccaaggtgaagagcgctggcggtgttaaacccagacagagatgacaggtctgcactactcagagagtactctagattaaagaataaaacaacaagggaaaatattaaatttagaaattatcaaatggtaaatagaataaacattttcaatttccaaaatattctattaggattatcgttattatagatatttttaattttgaggggaggggagataaagcatcagcgataattctaatttaaaaggaatatactataaaccaaaaataagtattccacgaatgctctgaagtagcatagtccgcaattctagtttattagaactacaatctagtataaaggtatgtacatatttgatgatgtagaaatgttaaacaatcctgagaaagtgagctttttattacatcaaagaaacagctcaattttcttgaaagtgtgtttctattttgaactcaggttgcataaataaaactttcagtcagttaagaaagaaaaatgtggatattcactttgtcttagtgaagaatgggtaatgctgcagtgctgtggacggcgcaggccctaaataaagcttcctaatagagtaaaagataactttttcatcttgattttcaataaaaagtatttagtgtactaattgcacatgacaaagctactcaccggtaccatatgttgttgaaatggctgatggatatcctcccattccttgtcctggtaaagtaggagttgctacggaaaccactggggtagccaatgactgagccgactgggagttatttatcctttgattcttttaaaataaataaaaagacattactgatgaatttttttaaaagttaaaaatattagatttcagtattagttttccacataaagagataacttggtacaaatctcatgaaattaatcatttaacatgtgtctctatgaactctgccaaccctatcatttacaatccttcaagagaccagctgttgccatagtaacccattacatcagtatctcctaggcaactgaactagtaacaagtaccatagctttattatgggtaaaaacagactatgttgaaaactgatgaaatatgtatactgtacttccattgtttcagttttcattcaaatgcaaattaaaaaaaaattaaaatcaaccatggtagtttttatgttcagttctacatacagcagagagcaaatgagtaggggctcatgttatattttgaccagcaggtggtgctgtgaccactttgttcagattcttctaaacttccctcaaactagatggcaaagcagctaatgcgaatatttaactcattacagtaaagagataaaagatccaccacataaacttaaaatcatgagactttaattcccagaagaagaaatattttagttttatgtaatgaaagaatatttttgtttgaattttactataaattgtcctaaaatattgaaaacagaaaaaatattgaaacaaaaaaaaaaacctgacattcttttcacctgtgagtgatgccagaaattaatggtatttaaacataatcaatgttgacatactgtggtaacttccaatatcttccaattttatcaaagctaccacctctacctaaaagtagctttgcacatgccatttgagggaagcgctctcaccacttaccaaaagcaggtcgacatcctcagactgagagcatgcggaaggagttttattaattagtgtccgtaaatatttataattgggcaaaatcttttcaacaaaaggaaaagcatcttccgatagacacaacagtttaaacagttttaaaacccagactccaaagataactccttacaaagacattctttgtttcccttaatgagctgtttgtctcaaatgtgaagacaatctacccggttttcagcccaggtcagtgtctcaatgttcattatttcatcacttcattttgaaggaaaaaaaaagactgtgctttgaaacctcacttgctggaggaaggggagctacacacctggctgccagagagggacctaactgacccatcacagattccctgggacagcatcagttttaagggacctggaataaatctgttgatagagatggcctgccatgcacggcccacactgcttggctgtagccctgtaggaggttatatttattagacccagtttttttctgaagggaatgttgcatattatgtgatgtttttggttgatattcaaaattaatctgcactgtgccataataaactaatcagctcacaggactgttttaccctgaagcttgccacagagcagagaaagaaaaaagaaataaatgtgtttgcagaatgatctaaatttgtctaccgaatcttggttttaaacgttcttgctcttaagcaaagctaatttgtagaacactgatgtaagtctctttgttgttgaatttggtcccataacattatcttcatcttaggcatgcagacccagaagaaagaaaaatgacagggtctggggatataacctctatttaaaatttcttatttatttatcttccttagaggtgctacaattcttttttgatgtaaaatataacctttgttcctaaaatgcctaggattttaatttgcttttgagagatagctattttcatgaagtaaatgtatggaaagatgaattgaggcagtgtgtaggcatgcgatgtattagatataatcattgcaatacatctaagaaaggatttgctaattaacaggagaaagttcatttagaaattgtggaaagtactttctcattgtcagcgtgttgaggacataaatattgtaaaaatactatgttataaagtacctcattacctattattactctgcttatgggacgtagagattgaccgatggtagtgtctgatttttttccaactataaattgaaagccttaaaagaaaatgtttttcttatcctagaacatcagcctagtgaagttcaccagatatatatatatattttttttacacggaaaagggaaatgcaaaccagttaccagaaataatagctaaatacaagcaaggctctgtcaatggcactgttatgttaattttctgggagaatgttaagtaattcatcaagttagacaaatataaaaacagcaaaacatatacaaaacattatcaatatttatttaaaatgtagttttgtattaccactgatggcatcgtattcttgctgcctggtggaataagaactcggagatctggtttacggttattcattcctaaattcattgggggaggagattttgcttgcatattcttgttcaagttaccaggtgagaccagcagacctggtgagtttcggggattgccatacccgttccctgttaacaaaaaacaataaagcatttaggaagaaatctaggtcaaatacgtttccgaagaatacacaacatgagaataaaaacaaaagcttaatggtaagacgtacattgcaaaaccataggatgactgatttgacctccatgggacaagtaacccaattaagtattcaatagtcctctgaaggaagattaaaaactttttatgagaagagagccaatatacatcaacttgctcagaagtcagcatatactttttttcctatcaaaaatattcaggaagaaagtcagacagtagttcagggtctaagaaaagcacagaactggtcttgcactttaattgactagcttggcggaggcctggctggcgtgactcactctttcagttcactggtttgggttttattttgtgtgtctgtgtgtccttaaatgaagaaagggcataccagcaagactgtaatttctaggacaggcaggaggaggggaagccgcttacacattttgctgttcagttccgcttttctctgagtgaattctctctatggtttttcttccatctgctttgccctccttactaagttcagtgtacaacccttgctttcctcctcacacagaacttcagaaagcaagactccttccctggagctgaaatgaagtgatgatgcctccgctaaagtgctgattcaccaaggcacaggaatagccattgaactggaagactgaaagggttttcttaggtctctgatgttcagtatcctactaacagaaaagtgggtatcccaaggtctgcgtttttcatatttcaaaatatgaccaagagagctagggaggagttgattacaaatgccagcagagctggcatgacagtggactcagaaagacatctgctgatttcctccactgcctctgaagggagaataagagaactcagctacctgattcaacaatccttgctagaaactagacagttgttttctgaagctttctaaaggagacagttaaacctcattgttattgccatcattacaaaacacaagtatctattacccctgcatgagtgagattgtgtgctacccagtgaggatgcaaagacaaggccccaggcttgaaaagctctgaaatctctttgtggtaatccaatacatactcatggaaaacataaagaccaatacaaggcagcgtagggtgaggtgcctgcagagtaatccagattaagtgttattgagttcccgggagagaagaggtgatccaataaaagattcacagaagaggcaggaattgatgagggccttaaagaaaggccataggaagatatgttaggcttgtgactgggcagtaggaaagggctgaggtaggagtttaaagagcatggtaaggggcactgagaggaacctgtttagaaggggacccgtgaaaagagaggggtgtcagaggctctggagggatgcaggggttgggctgtggagatctcaaattccaggctaaaagtccttgggtttatatggtggaaatgaaagtttcagagtagaggtatgacacagacctctaagtggtcagaaagatctactggcattggtatactcaggaattagtaaggcctgctagtgtggaccagtctggagactactttgatggcctgagatagaggccatgaggaactgggaaggcagagcaaaggtatatttcaggagatatttatgggaacatctttagaagcaaaatatatttgaggcacactgtataaagcagatttgttcttcatatcccattcatttacctgtctcattttatgcatgaataaacaggctgaatatataacaaataactacaagattaagtctgtcaattggattatgaataaaattatcccagttcctggggcaaaaaaacaaaaataaagcaaactggacacccccaaaacgtgtgttaagtgacaggactcacttaagaaatgttggttgaatctgaatatcaattcccttctataagaaaacttctggaatattagccaaattctctaaagctagataaatatgacaaacccccaaattttctttacagtaaattcgaacagtattccatggcaaaagctgttacataaaacaatgcatttacttcctctcactagaagaaaaaaacaaacaaaagagagtatgttcacttaaaaaaaaaaagcttgacaaaatggagtgcttagaggagttttatatttaatatgtcatcctgaatcattattgtgaatatgttatgaacttagtttgaattaatagattctacgggataaaaagagaataagaacatcaaggtcaattctgctctatactttgctgtcagctgaaggtcagatggacacactgaagacatatgtcacttatctattaagcctgtgtgagatctggtttatataaacaatcaaatggaaaattagctgggtaatttcaaaagaagggggagaaaaaagtctgttaagcagtgcaatgaagcttgaatagatcagaagaaactaaaaccccagctcggtagatgccgatactggtttgcatggaggagttattttgctaaaaggaagtaaaaccgcttcgtgaaatgtgttgtcctgtgatatgacaagcactgggccagtgtgcgaaaatggaaatgcttcacggaggccttgagaaaagtttgtttttttttttttttttttttttttttttttttagcattttctacagtaaactctctgagaaattccaacaaagcctatgtctttttgcccacattttaaacagtgattcagggcagcagtaggggaaaaaaaagtaaatatacattgtagcttttcattcagtaaatacctcaaaactaaaaaaattgattttaaaagccttctatttttctcttggaatatttcctgttatttggaaattacgccattttagaagattagtcacatattttaaggtgtttacatactgaaatgtaaaatattttgaaccatgatgacacttcttaaattcatatttttagagcatcaagttatttttaagaacaaataaattctgctttttgctagtgaatttctgctgtttttagcatattgtgccagctagcattttggagccgtataataaccatttctgtttccagccaccaaattgttattctttggacataatatagattcaggaatgcaagactgtggatcctaaaccagtgatatagaaacctatgatttgaaaatcaatgatgaatacatgcgtgtggtttactgctaagaagagcctgcatttaaaccggctgggaaaccgcagcctcctcctcactcagaatgctgcggcctgtgttgagcctgttgtcccaccttaagataaattcaccaaagagaatggtcgcatttaaattcaggggtccgggaggtgggaaacaccacctctcaacaaccttctaatatatggattcaaccttttttcatgctatgttttaaaattaccctctgcctggacaattatcaatttagacgtgactgtatgcagatgtcacattcctctgaccacttaaaggcacaaaaattataaagcaggagtgaatggatttcctgattatagattataagaaaatgaagtacagaccaactttagagtcagtttgttttatagtttcatttgattaaaaatattgttttacataaaaataacaaatttaagcatatatgagttaacttacataaaggattagagaatctacctcttctggttacaagtttgtatatactcatattagtgtcaatacatagaacttgaatgtggtgttaggagaaaaacatttttctccccagttaacttgcaaacacttgctgcattttttttattgactcctattttaagaagtcgtaaattcaaagaacatattcctggcttaagatattatgaggaaggcattttgccttgtctcacagagctcacttgaacatgtagctctctttgagctcaaagttctgaaactttcttttatttggatgtttaggcattttgagttttcttcacttgtttctttttcttttctaggactttgaattatgaatacaagcatataagactaataagcataaacagaattagtcactatggaccatggctaattctgccattggcataaccattttttaatctaccaaactgtcatcttctattatcccctctcctccttccatctccatatccaatgagataccaaatcttattcatttttcttcagaaatgcctgtctctacttccactgccaccatcttagctttggcttccatcaccatttgaataaatatttcagcaactcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaaatatttcagcaactctccatctgggcctctggtctctacttgaggggttcttcaccaggccttaagaggagtttcaggccttcagaggagttccttaaagctgtatgcaaacttttgtgcatttgtgtgatgctaaccaacccactcaaggaagtctttctgaactgctacttccatcatgttcctttttcatacatgagtgcttaacacagttgagtcagtgccctgcctggctctcagaactgtctacagttgacacactctatctatgaaacctaatttccaatggtcacagcctgccttatggtcctcggaatatatgcaaatctttgctctagcagttcaataactggcagtattggctctcctgtttaattcaaatttatcttttaaggatcaactaaagttccaactctttcatgatgcctttcagacaacttcagcccacactgaattcactcccctctgctgcaattagtggcagcgataatacacagagtactagttctttatatgtttcaggtgcttcacaaatagatatatagaatatgctagaaaaattaagaattattcaggaaaggcactaaaaggtaagttattgagggacaatgaggtgagaactgaaaatgtaatgagtaacttgttaaattgaaacatcaagggtctcttctctttatgctacttgagaaaattttatattttagataatgattgcaaattgatgaccaagtacactattgagacaaactgcttatctaccatatatatgaaagccaggaaatcatgtaagtgcccacctactaaatttgtttatagagagttaattaaagcgtcttttctacctgttgcacctgttaatcatttcacagcacattaccttagctaactgcaagtggtagaattaaacaagtcagacattttccctaatgaaaatgaaaagttgaagtctctgatattttcttccacactgacgagtatttgttgccacaggttgtcgttatatcaaggtaaatctcaatactaatttactcatacagaacttttcaccaaaagataagctgcatggtatcctagggaaaagaatggtggcagggtggctattaagagtgaacaggaatttatcagatggttcagagagaggctttgcggagagaaggaatgcaggacagagagatctcagagtttagaaggaggggcattcctctgaagatgaaacaatggatcttgaagagcagaaagttttccgaagttgaaaaagaaggcttggctaacatgaacctctaagattatgttaactttacactgtaggctttatactaagcttttaccaaattttatactctagaaaatgagtgcctaagatagcttcttagttgttagctttattaaatttgtgttaggaaaggaacaatgatggcagtggaaaggagagacaaaagggggttggactgctgttagagaagctagttagaacgccttgctctagaatacatgagaaatgatgtctgaatgaggcagcgcagagagaaaggtttacaggcatccaggagttggggacaaaaaaaagataaggcagagtaatctaggttctactcaaaatgtttctgttaagagttctctcaaccctacagagccttagttttctcaatagaagtatttccctagtgtgagagaagcatgaaagtaatctgaatgagaggctctcaggtactcatctgaggcagtcattgacaatcttaccatccaacaatattagcaatcgctaacacagtgtatagtattatttaccaacaacacaacattaagcatacacattaactgctcagaagagtaccaggcacttgtaactgctatgtaagtgctagatattgtacatggatataaagcacttttaatcttcacaagaacaaccctgtgggatactaatagtatccctatgaaaaatgagaaatgagaaaaccgaagaaaagagaggtccaggaatttgctcaatgtcaaacagctatcaactggtgaagctatgatttgaacccaagcagtatgtccagagtccatgccctgaagtacaacactacactgctccttcagaaccagtcatgctctgagatagtgaaagcctttctatgtcgagtctcatttgcaaattatggggatacaaatgaagagaggacacaactagggacaggacagtcaaggttgtcctaagccagaggtgatgtgcaagtttgagggacatgttgtaaggtcaacttgggcatagtaaatagtagttctggttcagaagacactgaattctcataaagaggcacagaatggtgatgttcaaaccatatttctggtctctttctggataaataaatatttacaagtaggaaatactgagtttagctacactgaacaccagagtagctgtttaacttttagtgtgctattttgagtggatgattaaatatgcttttaaaagtagattttgtaatattttagtcaataatcttctcccctgtaatatacttaaatggtaatgatgcttacttacttactgtcaatttaagagaccagcttctatcagaaacacccaatgttacagtgaaatgtccagtattttttagtatctgcgattagttgttacccgggaaataacttctaatatataaatgtataaaaataattttgtttagtaatttgttaatagtatctgattttgagggatttgaagcaaattgacacaggaaaacattaagctgaacacacagctggacctctgaagtatcaatttgctgcttttacttcaacaaaatgttttactcactttaaaaaaaaaataaagcaattttgaaaacagttacagcatactgggttgttagacaggaaatgtcacatacataataatgctcactatcatcaattaattttatattttagtttttaaagttttaagattaaaagttagtttccaatatcaggatattgttttgtgcctcaaatgaacatacatctttttatagaaaattactttaaattgtgtatcataaacttgctcatacaatcccctactctactggaagtgacagttgaaaaaaaaattagtggaaaaatatgatcttctagactgcagtcctagcctgaatgcctgaaaccttgttacatatgctaggaactgtgagttattcagctgttgtgtatcaaaatcagttttgtttttatttttatttttttgagaaaaaaagatattttacattgaatagctctaagagaaaaggcaaccacaaaacattcaggggtcagaaatctgggtatgatgaaaatttcaatatgcttaatgtagaaagggggcaaatcagatttctgattcttatcttgctaaagactcctaattagggattcttacacacaaaataaaggctccactttttctgggggtttcttagggaaattatataataatgcataatgttaaactatgaagaaacttctctgaaacctcagtgcattttgtggtatattcttagagaaataccccaagactataccaaagccaagaactattcttggccataccagttcaggggcatcagacgttctaaaaagagagctgtctcttctctttgaccatgtcacctgatgctggaccagagcttcaggaatttcatatctagcctatttgtccttgacgtttcttgggctgtgttttgttcagcgattttgcgtgtgtgtgtgtgtgtgtgtgtgtgtgtgtgtgtgtgaaattaacagtctgtcaatgagacaatgagcttttaacgtacagcacatactgtgtaagctctggattgtgagggagaggtaaagaaattttacttattactaagttgtttttccaaagattgagagtccatcaagtaggtttgtgttggcgaacattttctcatttgtcctaactgtcatgcggatttaggcatcaccatcccagcttttgacagatgaggaaactgaggcttaagaagcttccgttacttgactgagatcaccctgtcagcaaggaagaggctttgatttgaatccaaaatgcaggttgctaccactacattacaaaagccagatgtctgagatttagcatgcatccttgtatttgcaaataaggaagaaattgacaatctgatgtctccagtacaaaaaaaaaaaaaacccaaatatcattctcctttgggtactgatttactgaagggatagtttttaattgcaccataaaaatgctattgaaccacactatctttaaaaaattccatttaactatgaatgatagatttatgactcatttaattgttcacttcttgagattttggggctgtctctttgctaaaaatgagggggtgtcttcattattgacacaatcgctcattctttcagtcatttttataaacaaaaatattgagacagtataaattagagagagcatgacagaagagaaagaataattacttgtggttttaacatttacacaactgctgcgaacacatcagaagttcataacgttcaaagtgaaatgtgttgcactgtactgtactgctctcacattctgcttcagatttattaatacatccgctttacttccacccttgaggataggagccccgtgctggacatctctgtgaagcctactggtgtgctcccttcaccacacatttcataaatactactggaactgcattaagctaaacattataaccagaaaggctagaaaatcaagaatgtagatgattataaccatagctcacatttattaacaagcacttactctggggcagaaactgtgctagaccccttgcatcagttatctcatttaatttttacaacaatccggaaaaagaggagtttaacagacttttcaagggcaatagtgccatccctaaaataatttgtatatcacatactttccttggttgttttatttttttgaatatctgcctctggaatcttttcccaaactactccttgggcaaaaattttggtccatggttttacggttttcactgagttgcttaatattagagccaactaaagattcagttttcttgattgttatgtaaattaatgttataatgtttgaatatgtaaactggccatagatttagttttctcttactactatattataatgttctatattagtatagcagggctttttcctccttatactttaaatacaacataatcggttctttataataactggaggtggtgggtggactctaaggtcaagaaattgtaaaaagaaggcataatgtctagtaaaatagataaacttaaatttgagttcagttaaaacaattgaaatggagcaataataaataaacacagtgaacacttagcaccttttggacgtatcagttggttataaatttaaactgtttatccaaggttcttggtataatacttaagtttaacatagctaatgatctttcaaatatgatactgtatcatgactaaatattctttggattgaaattcaactgaaacatactatgtaagtgtaactgcaaaatttaagtgattggcaaaggtttgtctaaaaacagcagattatactcttggctgacagccttgaagcaccgagtgagaaagtccctggtaagtaaaaaactgatttccaaaagagggggtttttaaccaaatccccccttcagcatctgctctctactgatgcacaatgtcacatcactgatgattatgaaaaaagctttcctttctgtgttatctccaaataaaatcttatcatgatgccaaagatagggaagaggaacctaataggtgtataaagagaaaagactgctttgagaaaaaaagacaaattctgaataaaactagtatttcagggggaaatattaacggcttgaatttaatattaaaaacaaccaaggttttcttatccttcacactattaggttaaatcaatgggatatgagtaaagaaaccaatcttcacagtactttactgtagatatagaaggatagagaataaaaaggatacaatttgtgaagtcagaaatcaggataaacaaagggctctaaaatctgctaaaacactctctaggaagttataacctaaaattttctttttttcctctggaaatcaaactccttaagaatgaagtcaaaccaaaggggtcgaaggcatattttacaacatcctgacttaacctgtaacatttttcatttgtcttgtctttgacctgcctttcccacttcaacatgagcccctagagaatggtatcaaggtaatggtttatctataatttgcttggttttgtatatggaaagtgaacactgattttcttggcagtagctgcataccacatgctgtagctatctaatttgaggactaggtttttttttttctttaatcttgataaacttggtttgggttaaaaatatcattgttacttaatttcataaataataataataaagcaatgccgttagttatttacttatgttttgggtgaactcccaaggtaaaactgccaatgaattcagaatttttaattcagaacaattcaaactaatggaacaatactttcaaaacagaacccaactattaacctagatttttttcatttgctgcttaataatattttaaaaataatataaaaattatatctttatactaacaattagttttcttatttgagggtaattaagtatctttctccctttcttgaatattgcaatcttaagttatgttttcctgggcaacaaaaaatgcaaacttgttaaagccaactttttaaactaaatttttaaccacttcactgatattttaagtcactaagtaagaattgcagagaagtctttctggccaataagaaagtcagccaagaaatttttgataagtattcttgaaaacaaatacttgcaaaacaatggtgctggtacagaaaaattaagcattgtctgacctttcctctttccacttagttctattttgtaatatgctaagttttttctttttcaatgctagatgaattacaaaaacataagcaaaattttatgattatattatcataaaacattgcgtgtaaatggattgtaaaaatatttgtttcttatctccaatctgagtaagtactaagttcaaaggtgctgagtcatgacctaaggtcttgctagatggagtctttccagagtctggaaaccagatctcttattcactgctcaatatttatccacggcagtacactgccaccatcaactctccatgtatttagctgacataaattaagcattccagaagtgacaatgcttgataaccaaatgcataaaatagtcaacaattaacattcaaaataagaaaacagatgttagtttcttttttataaaattatatctaatttacaataaatgccaattaaaattattaaccaatatacataaatctcctttgccttactgtcaaatagctatgtagattgtaaaattatcttaaatgttcaaaggaattcctaaaggtttttcatttcttttttctctttttttgatctcaactatgaatcaataactccttgagcatactggtcctttctactcaataaaaggcaatcgtattatcaaagtgaaaacaaaggatactaacgggatagtgaataatccaacacaaggcattgctctgctaatggttatttccattaaatctaatgactacaaacaaccgaacttgatcttaccatcatcaataaccactcagattagcatgttaaaagctttaatgtggtcaggcatggtggctcacgcctgtaatcccagcactttgggaggccgaggtgggcggattgcctgagctcaggagtttgtgaccagcctggacaacgggtgaaaccccatctctactaaaatacagaatattagctgggcatggcagcgtgcacctgtagtcccagctactcaggaggctgaggcaggagagttgcttgaacccaggaggcggaggttgcagtgacctgagatcacaccactgcactccagcctgggtgacagaacaagactccgtctcaaaaaaaaaagttttatagagttatgacaaaatgttattttaaaagcagtgacttttcatttaggttgttaagaggaaagaattaagtagtggatgaataaccatcaactgaaaccttagaaaagtcactgttactaactaatgtattataatgacttgctgtatatttctcttataccaagagtacaactccatcctgctacttctttattaccctttgtcttcatctttgaaagtatttcaagttaagtgatgataagaagttgtattaagaggtgatttgtgatggtctgagataccaacccacatttcatttactactatatgtcagctcttcaggttttccgttaagaatattagaggagttaatgaaactttgctttattggcccagggtactcagccatttaatcaaatggttaattaaacattcgttgtatactgtttcagaagaatacattatttttgtgagttacagatcaagggtatatctttttttattgaaaattacataatttatttgaaatgttccttctggtttacatcaacactattaaaacttcatggctagaagatctatttttcccttactcagctaacaaacatttaccaagtatctgctgtgtgctaacgcttaggtgttaaactgggcatacaaactgaatgagaaagagtttgcctccacagagctgagcgtcctagagagatgtgcccagatgttgcaatcataatgcaatgagaaatgtaatgttggtacaggctactatgtaagcacaggaaagaggtgcataacttgtctgttagagtcaggaaaggcttttctcaaatggctgaactgaattctgtgggatgacaaagagtgctcaatagcatgaagcagaagaaggaaaggcatgctaggattgcataggtaagagtaagcggccgtgacattgccaagtggcggcacagtgtagcaattaagagcacacactgaggccgggtgcagaggctcacgcctgtaatcctagcactttgggaagccaaggagagaggattgcttgaatccaggagttcaagaccagcctgaaaaccatagcaagaccccatctctataaggaaaaaaattaaaaaattagccaggcatggtggtgcatgcctgtggtcccagctactcagtaggctgagggaggtggactgcttgagaccaggagattgaggctgcagtgagcctagatcgtgccactgcactccaacctgggtgacagagcaagacactgtctcaaaacacacacatacaaacacacagtatgggacctgactacctgggctcttccttgtgcaattacttaatttccctgtgcctcagtttcctaatctgtagaaagggcataatgtgaacacttaatttaaacgactattatgagaatgatgctttttgtagagtgcacagtaagagcagtttagatgtctactgttagtagagctggagggccgggttcttgatagcagtggcagaagggaagaaggttaaggctggagagtaggaatgggcctagggataagatattcactgttaattttcaaagagaagccatggctggatttttggcatgtgaatgatgacctacagttagcttaaggttttaagaaagaacaagcagtcctggggagactgaagcaggatgcaatataaagcagggagatgaattaggatgttctagaaacttactggatgatggtatgatgagaaaaggatggctcaggcactggatgggaaagatgctacactttatgataaaactgagctgaaaaaaagcatgcttacctttttggtcttttagtatttataggcacaaaataaatgttcaatttacttccttgcctcatgagactctccctccctctcactttttttttttttttaacaaagtgagatgacttgatttagaaaaaaactgcagctgctaaaaagtaacgtaattgcagtctcgccacttggcctcaagagtttcaaactttatctgaaaccttgaatttcaatgacaatatgcaaaatttggaagctatattttggcctttttgctttggttttcttctctgaaaatgtagcaacattctggctggccttgttttcctctggtgttatgtgattctctgacatcagcacggatatattcagcctgacatatgatactggttggcatgagaaagaaggggaagatggctgagtttatgagtaggacatgacagctaagcttgagactaagtggcatctgcaacaggtgttccttgggaccagagttagaaagggcttcttcctctatttttaaaatatgggtaacactttcacagctatatagaaactgtgaaaactacatgctcgtagctataatatgcaatcaagatataatatttattatcaccagggtggagtaattcagtatctttcttttggttttcttctatttctgaattagaagattctcatacctatggtagaggtcctgaggtaagaggatgaatttgctaagtgcataagattttgttagttcaatgttactatatcctacgtgtgtcaaacttttatgcctacaggattgagagtcttctctatccctagaggatcattaaacttagccaactgtctgggaattgacaatgacagaataattgaacaaccaaacactttttattttcaatataggattccaaagcattctagctattaagcagtaacaagccacttccatcaaagctgagtaggccatgttttcctccacattttttttttttttactactttttttttttttttttttttttttttttttttgagacggagtctcgctctgtcgcccaggctggagtgcagtggcgggatctcggctcactgcaagctctgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcccttttttactacttttaatgactttcagaaccactactagctgtttccataatggcaagcaaatcggtgcagtgagatattgggtaaaacatcataacatctaaaccatttttcttatattatatcttggtctttgtgaccacccaattctcagtcctcaccattctttctaatcatagtgtttggtagagacttggatccaagaaacattggtctggatttgatctggttctctcattttgaggctacaaaccacaaagtattttttgagggaaaaaatttcatttccatgtccagcaaaatactacgtgagtttacacactaatttggctcgacctaattttcaaaagatatataaaataggaagctagtgttattcatcttgtttgctaatcactgtgtaggtctaatactttttcttcattattcagtgaattagtgaagagccagcatcagaacagagaaactctaccctcaaatagatatatttataaaaatgtatttgtaaaccaattttctttatcttctttcttataattagcaggctattctacttgaccctggcaaaatattttaattaggctatccatgtctatttcaataaacttgattttttttgacatttcaaacataaccttgtgtcattcatgcctgcctcctactattttaaatgtatagcatgttccagctgcagaaattaccatggttacttgttatgccaatagtgaactgcagttggcatttgaaagtattgtgctatcttgcctctgcattgaaaatgacatcgatatctcaataatctcaatattacaaattaacacggaaacctggagaaatgtgactgagacaattattggtcacagtgtaagaagttcttagctgaaatatattttagggtcttttggggatgcattatattcatgttgtctaagagctcattttaatgccaatgtgattttattttattaacagtattgttgaataattaaaatcttaacccctccttttctttatgtactcttctttagaaatgcatagaagttcaatacttctttggctggaaaatgattcatatttaatgtgaaatgattaacagagaacacaaaaagtatggtttgctaaaggtactcttgtgtccaaggatggtatccaggattaagttgattggatcagagcccttaattctctgctgaccagttgaagctttattaaggaaggttctagttaataaatagttttcttctaagttactatttaaccactcctgcttcagaaaagtgctttaaaaattcttggtgtcatttttccatgcctctcacagatctcttaactttatttgttcaaaagactttgtcctgcaaatcacctagtagaagaactcagaacaatgatacatactgcagtatggagtctgggcttacctgcactggtgcctgcaccagacgtgaggtctccacccatcagaccacctatggattaaagaggaagatcaaaacgagaaaggctaaaggcccacagaacaaaacactttaccttcagcaacctcagtattttgtcctcttgcaatagtcataaacttgtaaagtacaacccaagtcagatggctgacatttgttttattgtgccatgctgtgctcaaacgttaaaaatacattcaatcactgacattttgcagaatcttttttctaagaaagttacatttaaaaaaatccagtctttggtctctgcatttttattatttctaagtctaggttttccctaagcagatgttttatagaaagtgaaagaaagagtaaggtctactatatgctcagatgacctcacatttgatgtttagttctttgtaaatatgttttatgccattaattttgtgcaatgttaattgtccagaaatttgatcgtttcatgaatctacccacatttactactaaaatcttattgactgacacaatataacaaatttttcaccggccacagattaagaaacatatgcttattcattgctaactttagacagtatgttaaaatttggcaatgtttatttatgagagtcaagatgtttcaataaggtattgaacataaaaattacttttagttttgggcctggcgcggtggctcatgcctgtaatcccagcactttgggaggcccaggtgggcggatcacgaggtcaggagatagagaccatcctggctaacacggtgaaaccctgtctctactaaaaatacaaaaaattagccgggcgtggtggcgggtgcctgtggtcccagctactcgggaggctgaggcaggagaatggcgtgaacctgggaggcagagcttgcagtgagccgagatggtgccactgcactccagcctgggcaacacagcgagactccgtctcaaaaaaaaaaaaattacttttagttttgaaaaaaacaacattcagccaaaagaataatagtgagaatatcatctagattttctaattgcctctaagtgatactctgtaattattagttggttcaggttttggaattaaaagaaaatgtttgtttatatatatacatatatatacacgatttttttttttttttgagacagagcttgctctgttgcccaggctggagtatagtggcagtaatatggctcactgcagcctcaacctcccaggctcaagtggtcctcccaccccagcctctcgagtagccgggaccacatacacaagccactgtacctagttaatttaaaaaaaaaatgtttgtagagatggggtttctctatgttgcccaggctggtcttgaattcctgggctcaagcaatcctcccacctcagcctcctaaagtgttgagattacaggcgtgacccactgcatctggccttcgttacagtttaagcaaatgtttattatttccaatcagataatattttggaaataccgtatcaaattcaaaaaaatgagcatgagtttatcaaataggaaagtgaactgcattctagtatgatctgaaaggaatacatgtggttactgaaaattcatacgaaaattttcaaatatattcaaaagtcaagagaatggctcaatgaagtcctttgtatacatttcccagactcaagattaaaattttttatttggatgaatttaactgtattttctatataaagcttctgtaacaaaaatagtaatacatgtttggttttaattgtaaggcagatatataagtattctacaggaaaattcctccatgaataaactattttcatacagctatgtgtatgtaggatacattaaaaatttcctatagagtacttttaaaaatatgaaatgcaaatatataatggtttgctgtatgtgacttagaaatacaattatttttgatgctgcttctggaaacataaaggaataattttgttatattcaatacgcattgacttggttcctactgttagtttagcaaatcaagagaacattcttcccttaaatgttctttaaatccagtatcaaaatagacatatattaaatacaattcatcataatgtattttgattgttctaagtactaagaatggatgaactttttctgagaaataatttatttttctcttggacactgtgaattgaacaacagcaagtaaaagtgcagagacaaatttgtggcaggtgtacatgtgtttaattaacttcatttctgattcagctttgtttttatttcacatgtcttacaaatgatgctatcttatcatatttcctttctgcctaagtcctttgtgggataagttactgtataaataaaaaaaaattgacccaaataataaataactaaatgggataaatactatcacagaacacaggggaaggtttcacagaagtggtagcttggccaggaggaagagggaaaatggcattttaggcagggaggacgagcagaagtaaaagtgtggagaaaggatatctgacatcctgtttgagagtatgtggttaaaatatagccacaggaggagataggtgacagaatgaaaaagataaacggcagattatgaaagatttcgaaaaacatactaaagaatttaggctctatcatgcaggagacctagctcgggggtggatggtaagccatgaaggagagtaagtggaaaaccagaaaacatctcgtagataaagcagtgttggctttgccgaaaatggttccttccaactatttgttagcattacatccttatgaggacatacctgtgttacctgcacttggaggtcgatgtgttacaccaggagacatactattcctctgcagagaagggtgagccagtggcaataggttggggtttcccagtgagctgacagggttgctgtacaccaaactgttgtggctggacactgggatggagactggcatctcgaagttgggaggtggaacagcctgcaggaacagaaaacaaaacaaaggtaaaagaaaagaattaataacagaagctcttcaagacagacagcccttatttttccaagaaaaattctacattccaaactactttgtgtctagaagaccattaagaagagctctcaagacgttcagatcataaattgatttcttaaatgtgcttagaactccttctttgcaaccattaaaaaatgtttcacttttgtttaaaacaaagccccatttcattagactccattgtctttggattccattctattaagtagtaattgttcatttgtgatatctgaatctggtgccagaaatgactgcaagatcaaaggtgcctgattgtgatgacttcacagagaaaaaggattaaaatgcaaaccgaagcctttgatttaattgcttattgaagcatatttatgtagaagtttaatgatagaaaatcatctccaagcatgtgcatagcacatataccttaattatcattttttaaagtctatgttttaaaagtaactctaaagataataggcattttaacatacaagattcaacagagcatgtatcattcaataattcacattttgaagtggcaattcagaaaacactatgcttcatattttggtgtgtaccgccactgacaaatggcaagacctgtatctcaattgtgaaagttggcaaatatttagtgaactgaagctgtgtggatgtctaattagattaatccaggtttcaatgattgatttttgagtaattattttgtcaatttaagcaaaatcatgtttatgtttctgctgtactaactagatgaacataggaacataattgtagctacttttttttaagcattacgagtaaaaatactctttgaatataatgccagagaactcatatggtatcaaaacatatggcattcttaatataaaatggacatatatatggaataggatttatagaaggcattaaggcattcccttgggggttctcaataagttattgtgcaaatttaaatgcatatgtgcttgaggctcagttggttgttttttttggtcccattttgtttttactattgtttgcccttagtgctgacatccactttctgttactgtttggttggctggcctgcatcatacatctttctgtgtaatatttctctgtttatcttggtgatgatcacaatacttttctttgtttatgtttatgctcccttattattaatttcccatttttcttttcttccatgttctggacatgtcaatcttgacaacagcaaatgctttacattcaaaactcttttctttcacacatctttgatttttcatttgtattttatttcatatttacttttattattatattattatttttagacacagtctcactctgttgcttaggctggagtgcagtggtgccatctctgctcactgcaacctctgcctatctggttcaagtgattctgctgcctctgcctcccaagcagtggttggcatgtgccaccacgcccagctatttttttgtatttttagtagagatggggttttgccatgttgcccaggctggtcttgaactcctgagcgcaggtgatccgcccacctcggcctcccaaagtactgggattataggtgtgagctaccacatctggcccaatctgtcattgttttagagggaaataaaaatgttcaagtgatataagtaatatggtcagtctttattaggatttatctacagtaaacaggggaaataatttttggatagacatcatgacataatggaatataaatgtttgataagacatcaaataatgaatttagccttacatgtccagcccccttttaacaacaaaaaatcagcatatgctgtaaagtcgaagtctatagcatgaataaaatattgtatttcttcattaaaaggccaaataaggattgctctagcatacccaagaaaacaaagtaaagtgattctactaggtatattctccacttgctccatccagacccaccctctagccccttcactgtactgtgtgcccaggagctgaccctccagactgcatcaaccaggctctcctgccctctggcttcccactggtcagtgggggaggcaccagcaacagcacagagagcaggaggggagcaaagtcagggtatttttttatagtggcatcatccttgctgggccacaggctggctgaggctgcgtttctctagcgaagaccccatctctttttgagttgttctctcctatacacatagatcttgctgtgatctggtacttttcccctccacttactctttcagatctagagataggaacagcttctaggttgcaagccctaatgtacttcattattctctcaggttttccttaactctacccatctgtaaacagtccttttaacaaactgtcttcaattaccctttagagtttgccatctgtttcctgctgcaaccttgggccataatagtaactctctagatctagaacactggtactctacaggggtgggactgtctccttagggagcattttggaaatctgttggactatctttgggtatcaaaatgactggagggtgtgactattacactggctcaagcagtgccatctcttgcctagataactgcagtcacgtcctaacagatttacctgctccggtccttgccatcctttatattttcaaaccagaaattagattgaccctttaaaagcttaagtcatgccaacactcctctgctcaaaaccctgtgagggctctcatcttagaataaaaactcaagatgagaatttttttcttccaagggtccacaggccctattaagctctagcttttgccaacctccgttatctcatcgcctaacaccttctgcctccctgcctcatttccatgacgaactgcatcacctccttcaagtctctgctcaaaatctggccttctcttggaagcccacgctgaccaccctatttaatcctgcaatttgtcctgccccttgcccatatcctgatctctttctcctgctcttctttctccttggttataaaatcatttatgatgttggttaaatagtgcccttttgctgtgaggcaatgcagagcctactctacttcttattatacgaacttaatatttttcttcaaaggagaatttttaggaagacactctactgacacaaaagtaaagcttctatttactgtatattacttattgagcaggcactgtgctgtatagttgacatacatgatatgatttaaccttttaaacatcccttgaccatagatataattctttccttttcaaattggtaagttaagtaagtgacccaaagtcatctaactagtgactgagtctgttgcttttgctaccaaacactatgcaacacagtataagtttttggatagaaataaaatactgtagtcagaaatcattctgttaagtgaataagggctagatattagcagtttattatctttggaccatgtaaataataaactaaatgggttctcatgaaatgtgggtgagtatctacactggagtgtctcaggttttaggaaaaaataaatcttaaagactccccttttccatatttgcttagagtttgtatttaaagccatctctgggctacaaatgttttaatttgaattcactgttactacttataaatgtttaactgttaataggtatctaaggatctgctataaaactatatcttccctgaatatgctatagaatgttggttgtgtctcattagagagcaaagcccatatcccctcacccttgggtgattatatgcacatccaaaataaagaggattattaataattatgtaatgagttcagaaccatccaaacaagcaggtcagtgaaagtcattctactccttccttcctctgactattatccccaagaattaattcttcagcttctagaattctggatcagaaacaactggatgataatgattattataaaactactttgtgattggctaagcagtcaaatataattatggtatcagagtatagttgaaaatttcaaaattcataaaatataccaagatcatttgtattctattaatcttttgctttacctgtatcaagaactacctataataattttttaaaatttaattttattttagatacatgtgcatgtttgttacatggatatattgcatactggtggggactggatttctagtgtacccattacccaaatagtgaacattgtacctaagagctaatttttcaaacttcaccccgccctgctaccttccccccttttggagtccccagtgtctattatttccatctttatgtccatgtgtacccattgtttagctcccacttctaagtgagaacatacggtattagattttctgtttctgagttaaaggaactatctataataattttgaaagcaaattataagcttaaaaatgagcacactgagaagatattttagagaatcagaataaacactagcctttctatcaggaatctcagttacagtccaggttatgtaataaattgccatctaaccaggcaggtcatttaatctcccttgaccttgattttcttatctaaggcatgaaatggttgtatctatgaagagatgaagctgctctaaacattttagggaatgcaaatgctataatcacatataaatatttctaagaaattggcattattctttttctccttgacttttcaaaattaggaaacttgaaagcatctacatttaaacaattttttttttttgtctaaaaaatgaaagccaaaaagtagttaaaaacaccaaacttgcaaagacttcagggccaggctccaacttttacaaacactcaagataggaagaaagagagaatttggggtgattaaatgaaatgctgtcagcagaactggctatgtaatttgcagggcccagtgcaaaatgaaaatgtgggggccctttttaaaaaagtattaagaacttcaagacaatgacagcagagtatttaaccaagtgcagccctatgagaacagggccaagtcgagggcccatgaagccggtcccagctttgaaggacacagacatgacagctaaaaaacttttagtttctatccctgaacaaagtgatcacggttactgtagtgagtcataatcagaaaagtatctgaactctcatccaaaacccactattttcccaaacttaccacaaggaaaagtccaataaaaaaatcaaataaaatagttaaagtaaaatatttttagttaatgggccctcttttatttaatgtgagtgattgaactgaatcttccccccaccctttttttgccactaatgacacctttaaattttgattaaccattaccagctgctgggctgtagtagaggaaaaaaaaaatcatacaactctgatgacttgtgagtaccaatgctggttatctaaattccctcaaggctgcctgacaagtctatcatggacttgttcattccctctccaactcctattcctcatgatgtctaacttctcggtcctttttcaatcacctgcttcccccttccctaattaactacagaagctaaactaaatacattaaaaaacaaaatagccaggcatggaggctcacacctgtgataccagcactttgggaggccgagacgggcggatcacttgaggtcaggagttccagaacagcctggccaacatggtgaaactccatctctactaaaaatacaaaaactagccagacctggtggcaggcacctgtagtcccagctacttgggaggctaaggcaggagaatcacttgaacatgggaggcggaggttgaggggagccaggatcacgccgttgcactccatcctgaggcacggggtgagaccccgtctcaaaaaataaaaaataaaaataaaataaaatagaggtcattatatggtcacctactcagcgtaattctacccagctaccaccttagctacacctggctccatctgtaacaccttcttgtttaggtcccatcctccttcccttccttgagaggctttgccattctatctccattgtacctgtatgttcaatcttttccttcctccaagcacttctcctctgcatgtaaataatctcaagcgctttcattttaactcctcccttgatcctacatacaacattatttctctctcttcacagcccattattttgaagaaaatacatactgtttctttccacttcctcccttcccttttactctcaaccaacttgcacccgcctctcattcattcagcccctttcctaacttctgctggttcctcagacggaggtgttttctcttgctgtgaagcccagcatgaaccatggcgaacccagcatgaggaaatgctgctcgacacagttccaaatcacccatgaattattttatgtaattgaggaatatgggcataaattacaatatactaacaggtgactgcaatattaaattttctgttttaaaagggaaactcttcaaactgggtcttcgaaatagaaaaacagtcttgtaatgtttttaaagaggtggagacactctctacatacaaagggcagagtgtccttgccctgctgtaaatgttttagcagctgtggaaactttcaacaaaattgacttccagcaactcagagcgatgtgcaaaaactgggcttttcatcgtgaagactgaagcacttactaaagagatggagactctgtggcatagctcggagctgggtggctccttctcacagctctgcccgtaaactctaatgtggtttttcagcccctaccacacaccactgcaccccttaagaaatcacgtatcttgatcttgaactctttacgtaacaggctgaaatcctgtgagggaatacaggtgtgtattacatgtctctctccctaaagtatgagaaacaagatccaatgtgcattcttccagaactttaggggttaaaactccacctatatgatcgcttccattgagtgatcagcagtactgcatacatctgtctttattccaactgtgcaggggattcttactatctgacacacctaaggtactccgccttaacatcctacacttacaaaccttaatgcacagctgctccacaccaatgtattatatagcaagataaactcagatcataagaactaaaaattggcccaaatggcgtggcgcagtggctcacgcctgtaatcccagcaccttgggaggcccaggcgggtggatcacctaaggtcaggagtttgagaccagcctgaccaacatggagaaattccatctctactaaaaatacaaaattagccgggagtggtggcacatgcttgtaatcctagctattcgggaggctgaggcaggagaattgcttgaacccgggaagcagaggttgcggtgagtggagatcgtgccattgcactccagcctgggcaacaagagtgaaactccgtctcaaaaataaaaatagataaataaaaataaaaattggcccaaatgagccgcttctttttttcttctaggcaaaataaaataccaatggatattttattatttaataattctggacataacaagtatgcatggctacatataatactaaatactccatttcataaagtgcccactatgaatgtgtgcatataatagttttatgaaacccttaagaatttatagcacttagctttccttcatgatacagtgtattaataattctgattcaacaaaagttctactgctgacatttcatttaacaaaagaagcagataggtatttataaggatagaaattttaatatgcacacattttgtaaataagttttaaagtgttcaatttaattcaattcaggtttgagtgtgcagctactatggtaaagtattaatttatcttgtgagtgcagttgtgaatttggcctcgaactttgtccccacatatctgcacttgtaatcaccaaaacatattttcacttcagtctctctcatttctcaggtttaggctgttttgctaacttacaaaaaatgaacttttttcaaaaggaactgattgcctactgaggagcttgtatacaattaaggttcagacactaacattagttatttagaaggtatgtgagccttgggtttcacccctttcagccacaaaattaacattatttgattgatgacagaatctaataaaaagtatgtactttcctcctatatatgtggacaacaaaataatacatgcagttatttctcttaaatatctggcaaggcatatgattgactgttagaatttttttcatttggttaaaacaaaaattagccaaatgttaaagcatggaaaatgttggtggcaaagcggataatattctgataaagctttaaaatcaccccagcacacaaacatgttgaaatcttaccattaggtttcatgcagtctgttccctgcagcgagcattagctttaacccttcagtgctgttgttgaatttcatgtatagggagaggggctgaagttttattcagaaatcagcttttatttaggtgatgattgtcagtttacatgaaagaattgctgacccacttgagtatctgctcttagcaaacaatgtataatctatgtattttatagcaattctcaaacttgcttggaaggaggttccagtgttttactcatgtattgtgatttgcatggactgtgtgtttaaaagattgtgtaaatttacggtgtgtctcataaatctttctcttcctgctgtgaactgttctacctcagaatgaacttttcgatggcaactctgttagattacataatctcagcatcctttagggtttgctttctaaatgagctgcccgtgggatgagatggctatttatctgtttgactttccgaagagtcttagagaaagccatcactgagagggttaaggtatgttactgcagcagttatcagcagaccagccatctacctttggtacttacaggaattttatgactcttgatcatattatcaaattcttcattaatttttttgtatttttcttcagtgcgtggggtgagtgcataagaggagtcgggatcggggctttcacagcctttgttttctttcttgttcaatgcctgccaggttcagagaaatatcaagagtaaaaaaaatgaagggtgttctgagtacttacacacaatctttgcctgctgatcattagatcaatatcttcgttaattttcctgtacttgtcctcagactcagggctgtgacctacggaatcgtccgcatcggggtctgggctgtcacagccattaaggcccttctttctcaacgtctgaaatacataatttggaaagttcaaacctagacaaaggctgtaagagacattcaggggcattaaagaagttcaagctgtccagtatttcaggttattacatatgctttattctattagggaagagaaaccacagatgaaagctgagtcatttcaatcgagtgctcatcagcagtttaaaaaaataaaagcgaaagattcctcttgcaactaaattcagtcaatgaacagagggtataaggactcaagtttcatgatacagaattcttacgtgcttcaaatatctagtgagagacaattacagcagaatacaattaaggtggcaaattgcaacactctcttcccacagaaaaatcagaaatcaggacattacacaatgatttccgaacctgtgatgatgacaaaagcagaaatgttggaaacagatccaagtgtgaatttaaactaatggttggcattagtggtgtcctgtccccacagcctccacttctgatgtacttgacagctaaagggtgtaagagaacacagctaatatccccaccaagcatcggtgaagaatgctcagacgctgtgcttatatggagaactacttttgtttgttagggttctatatatgtgaaaatcttatcaaaatttataatactgagaaggtctcttcctaaacacaggtggaaagaaaagtgaaaacagctgagctgagtaaggaagacgaagaacactgaaaacaggtaaccaagtcaataactaccaaactagcaagggttcctcctagtttttcagctgagtaggaatcaccctgagactgacacatgaaagtaaaaagtcagtgcctcatcttgaacctcctgtctcctggatgtgggtctggtctagtctcagctgtcacagaagaataaatactaatgtaacattgtaacagaaaaagtataagttaggagtcttgagttttacttggttttttaaatttgagacaggattttgctctgtcgcccaggctggagtatagtggagtgatcttggctcactacaacctctgccttctgggttcaagtgattctcctgcctcagcctcctgagtggctgggtacatcaccatgcccagctaatttctgtatatttagtagggaatgggtttctccatgttggccaggttggtctcaaattccttgcctcatgtgatctgcctgcctcagcctcccaaagtgctgggattacaggctgagccaccacaacctggcctgctttattattattatttttttttactaacggttgtcaacttaattgtatacaattcgatttacagagataatgttatgtttttagagatcataaaacttctgattaatcatagtttgtcatgttaattattaatagactagcaacatttctgaattttcctggtaccaccaagatccgttataaagagatgcatacctaagtgtctctcattaatggaaagttcagcagagctcatctttattaaagacagaattcacatacaaataaagcaaaagctgtgacatcaagctaaggaattcaaagctgagataacaccccatctttaattcatgcaattggggaaaataaataaaacaacatgagttaaaaaggggggtgtcagtcttaaaaatctaaactccttggctcttatcaatgtgtaacaaatgtaacattatttaaaattagtttctgaggcactgaatattttcacttaaaataaaaaatcaagaaagctatgatttctaatatatctgggatacacagtggctctgtaaatatttattaatgttatagtggtataatataacaaataaacatatggttacagcttattatgtggtaaaatgtttgaatattaaaatgaatattttgacacagcatgataaaatatacatttacaatcttggggaatttataattggtggggccacctgtccccttatcttggatctacaggcatcatttttcactcataacaagtacttttagagactttctacagtaatactataaagaacatcacaatacattagaataataattttatttactaacttaacttcctgtgcttcatactcttttcttattatctcaaccacaaaaacattcttctggctgataactattgtattatgatgtgtttctgctttgatctctgcatatctttgagcttttaagaatactttctgattgtttttgcattatattccacatatttttcattagaattcatttgtatagagaaaaatatgtcagatcaagaaaatattatttgatatttttcaaaagttatctataagacatgttaaaaatattctttctttcttttttttttttttgagtcagagtcttgctctgttgcccaggctggaatgcagtgtggcgtggtcatagcttactgcagcctccacattgtaggcccagacaatccttccaactcagcctcctgggcagttggtactacaggtgtgtgccaccacacctggttaaaaattatttttgtagaatcagggtctcattatgttgtccaggctgctcttgaactcctagactcaagggatgctcctgcctcagcttcccaaaatgctgggattacaggcatgagccatggcaccctgccaataattttcttatataaacctttaatttaaagccttccataatgttaatttatagtcttatccaggcagtagatttttcagtgtgcacccaaatcttttaaccaataaatcttattgtaaaaattatagttgttttgatatgcagatttctgacaacagaatgcaagggtgaggagaggcctatcaactgtcattacaatccatctggcacatacatgtgtgctaaatattctcacaaagctttcagggggtagatattgtgtttggtttataaaaattcaaacatcaattacactttgttgaaagatctccacaaatattaacccattatctctcacaagtcttccatgaagagattaggtaaacctatgccaggtctcaaacccatatggccaagcatgatggtccaaggtcagtcaacgagtatttgcctcctgcctggagacagtgtggggcctgactttcccctgcccgttttcccacccgtgtgaagtgatgagtgcagactagatctctctcactcatatgtaactatagttaggacactggacgctgaaataaatgaagtagaaattgtccaggcgtggtggctctcgcctgtaatcccagcactttgggaggccgaggcaggccgatcacgaggtcaggagtttgagccaagcctggccagcatggtgaaacctgtctctaccaaaaatacaaaaaataagccaggcatggtggcgcacgcctgtaattgcagctacttgggaggctgacacaggaaaatcacttgaacccgggagccagagattgcagtgagccgagatcacaccactgcacttcagcctgggcaacagagtgagactccatctcaaaaaaaaaaaaaaaaaaaaaaagaagtagaaattttaaaaaattaggctgagggaaaatttcaagtatgaaaatagagctaaaatattgattttcttagatgtcaaattttagtcaagagttggaatgcatattggtcaataaaacacatcagtttatgaatgaaaaaaaccaattaggtcagtggctcactttgtacctgaagaattatataaactattaaacaaacaaggcaggtggcatggagtcacaaaggaaatggcagtgatgagaaggaaaaatgtggctcattttctcccaatacattcttcttgtatctgactgcattatcttgctatgaatatcacccgaatctaagtaatgattcaagttaaattgtgttatttaaaaaagagcattttgagatatacaaacacaaagctgaagagcaaattaatattgagttccaaattcccataatcacataaccagaaagaacattgaaaaaaatgttcaaaaatattatcctcagctgagtgcttgtataacacatttctgccaagaacaaatgattatggtggaattataaagctctgaaaatggaagtgatggcacaaacttgaatatcatagtgtgaatgtggaactataagagcagttttatctttattatattaaaaatctacagctgtttaatgataacaaaagaatttctgttagattcagccaagtctgtctttatcacagtaatgaatagtcgatatgaacgaaagggctgactaaatggataaataagcattattccttcgggcccttttctagcaaaatcaaaatctctgctgttggcctttgaaagcttctctgatcttttacaagtgtcactggtcaggtaatgtaggtacttcaattgtcattcttttacaggggctggaagtcctaaatgtatatactgtctctcagctgactgactacgttttgaaaagatttattcatgtatgtcaagataaggcaagagatctcctaaaaccaccagcttctctccttacgtatctgaagaaactctttcctcagagaactcaagtaaatcttgagcaagcctgtatactgaagtcagctttccacgtcagagtgacactgttgaggtagatccatcaactacagaggcttctgggatattttcacaagacagcgattgtcatactgtgagctgagaacagccgtttcctagaggagtaattagattgacagaaggtgacatattccaagcaataaatgggagaaagagtccagacaggtaatccaaaaaccacgtggaatctttcctcccagacatgtggacatatggaccctgcattattccatttgctcatcggaaaaacttgaaatacgtacaaactgatgatgataggtgacaggtgcttcaaaaattctaatgaaatagaatttcattaggggaacagattctatttcgttactgaaaggaatataaatgaaaaagaatgctacatggagctctcatttcttgttttaggcattacgttatcaactagaaaatccttttcttatgcagtgattaaaactgatttttcccttcttaaatactattttgttatttaaaaaattttttccttttattctttcaaaaattatctcgttagtaaaaagaaataagtaaattattgacctttttcgattatatgaagctgtatttttatattaatgctatttaagtaaaattcagctttttttcagagaaccaccatcacagactaaaagctttcaaccactcaatttctttacatgtctgcagtctcagtcctcaagaatgtatattttcatcatcatccttttcctgtgcctgcccattctacatgcagagaaacctggagaaacccccaaattactcctattaacctttgttaaaaatccaagtaatcacactttgttgcataggtagtgtgatctttacttcagagggttgatgtgtcaagaacacatgcaggaattattactattagttgcatcaatgtcatgttcacacaaaaaccaagaaaaaaaagcatcaacttagaaaaggtagtttcctttcctctgatcctgaatcatttttttgcttgtcgttcacagctttatgaagataagtatctactcttaacaagctgaataatctttagaaagtagtaaattcatgtaggaataggaagtgcagttgaaatgaatactgcctataaattgagtttctaagaatatttcctgaaagtgtttccatattggtgtgctggtactcacgctgctgctgtttcctgaccctttagtatctacagagaggtgctttgaggactgtgcccagtgccttacttcatttaaaatttattcggcaaacaattattgaaaacctaccatgtgccagatactgttttgtacgcttatgtgttaggaaagcagccaaatttaaaactaaaaagctctgacctgacttataacattgtatggtttttgccttaggctgagggaagattagatgccaagaaatttctccacaggttttaataaaactgtaagcattgtctatactatctctccctgtagtaccatagtcccttttctttgttcttattctagaaatgaagacacattaatatattaaatctagtataatcagcaggtagactttaattaggcaagcaaatcatatccaatacagagtacaaaaagttagattttaacaaaaattattcacttgtggtaaaaattttaataaaaagttgaaaatataaaactgtacaatactgtatttctctaggttatttattaatgctcattctagccagatatcaacttctactggggaaggggtggatggggttggatattgtcattgtttttatttttatatgcttcctcaaaagataatcttaatattggagctgaaatttttttgactgaatcattttcatcttcaaataatggaaataaaagacacactaattaaagatttgaaagccttttcatgtattgaacacaaggaaacatccaccaactctgtcttaagggccacaaattatttgacataaacattcaaatggtgctaattattgatactctagtctggatgagaccgccaagcatcatccggcccttcctcatgcccacagtgggtgaggaataatggtgcaaacgctgcatgcctttccttctgcatcccttctcaagctgggctctccttcaggaatgagcccaccaatatctgttcctccttcaaagagcagctgacacattgtctcctctctttagactttctgatcgctcaggctgaatcagtttctccttcattcaggcactcattttattctacacattttcccactatagtcttaatcatacattattgatcctttatgtgctttttcccctctgctagattgagaggtccttaacaaagcactttgctttattcactttggagtttcaccagagagcagtctgacctactgtagttgctcaataaatgctagatgaatgaatggaacacacatttccacttcaatgttaatgtatgtggaggtttcttgacttgaccaaggctgtctggctggctggaggcaaaggctgtagtagggtccagaccccttgatacatatttactaactgctactatatgtcaggtgctgccagtggtcctctggatgctaagatgatttttctggacatttgataaagatgatttgtttatgtatgtgtttttcttcctgctactatgagctactagaggttaggaatagtttatttgtcatctcgtatcaccagaacttagcacaaggcctggcaagtggtcggaacttactagatatttgcagcattcatgacaaactgaaatgaatagatgaacagaacagaaaagaatgttcaaatgttagagggaggaagattagtctcagtgcagtattttgcaactgcaatctcttttttttccatttattactaccatttcacactacgttaaaactcaatgtttttattccctcttaataactcccaaatttactactttttgaaatgtacagtttttaagttagaaagcagtgcaatgtaggtgtgatttgtactatgtatgaaacattataactcacaaattttacattattgaacgcttaaaatttaggggtactagtctaaatagacaccctcagaaaaactgagcagtcagtgaaatcttttaatgccagaaagtcataagcatataatctcagtgatcaaaagtgtagctgaaagagggcacagaattttcagcatggaaagagaaaaaagggagtgatattttaggcagaaggtaaaggttagcaaaggaaaaacaaaacctttgtaggaaagagcacagggaaatttgtgaatgtgagtcagatactataaatctgaattaagcatgctttcaaattcttgggcaaagttcatcattttcccccattcttggatgctagtctactgctccactattctcctgggcttttacattggtcttattctgggccaacatttgcctgagggaattcatggaaaatcagggtgattctggggccaatcagatgattcaggcttcctcaggacagatcaaggatttggtgtttgtaaggattcttccgccaaacctctattggaacccggacagggcatgcatcatgagttggcctagaatgggactgagatggggaagtctggcacacgttagctgtaaaacactccctgagatcctcaatccagcagagatgtgaagtgaaatactaaagagagaacatttaatatataataattgaaatgcatgataggatatgcagttaatcctatatatctatatctatagctatagttgttgttgttgttagacagagtcttgctctgtcacccaggctggagtgcagcggcatgatctcagctcactgcaacctctgcctcctgggttcaagtgatcttcccacttcagtctcccaagtagctggaattacaggtgtgtgccatcaagtctggctaatttttgtagtttttggtagagatggggtctcacaatgttgtccaggctggtcttgaactcttgacctcatgtaatccacccacctaagcctcctaaagtgctaggattatgggcatgggccactgtgtccagcctatcctaataatctttataatgcaagttaagaaaagaaaggctggaatgcaaagaatcaagttgtaggttgttttgaagaatgggcaatgttagtgatttcttaaatgaggaaggaaaagacaagacagaactataaattaaacaaaggttgagagaggaaaggagtaaattaatataagatcagagaacaggttttttgaaagtataaaatgtataataattgtaacttcacatactaaacattttagactatggcattttacttgcaaatgggttggttacagggacaaaaaggctgtatcttgaggcactgatgctttacaaataacatgttggagcatctttcataaaccattaatgacttattttaacaaaagatgtagatgttatcctgggtcatcaaaataagtcaaatcattatttttatttcctagttgtaaatgcctttttattcaatttgagtctatgcgtgattagtcatttgaaatgcgagtagcttatatcctacatctttgcattcaccagtcacttctgagctatcttttgagtcaccacatttcctcatttctacaggatttcccacgatctcttctactatatcatttcttttcccatttattttctggattccagcctaccccttcatccatttctctcccatctttcccttcctagcaaatgtcacaatgtacttgttcaagctgaaaactcagaaatcacccttgattccgtaatttcttgactcacctatcgttattctttctatttggtcttctgtgttttgtctgtttgtttttggactcccaccttccagtcaatcttccttcatacttctggcagggtctaattaaaatgcacatctaattggatggctgttctccttgaaaaccctccacctgcctctaggctcatttcctcttttctccagcctactgtgtgtattagcttgttctcacactgctaataaagacataccaagactgagtaatttataaagaaaaataggtttaatggcttcacagtttcacatggctggggaggcctcagaatcatggcagaaggcagaggagaagcaaaggcatgtcctacatggcggcaggcaagagagcttgtgcgggggaacccccatttataaaaccatcacatctcataagacttattcactatcatgagaccagcatgggaatgatccatccccaagatttaattacttcccactgggtccctcccatgacatgtggggactgtaacaattcaaggtgagatttgggtcaggatacagccaaactatatcgctgggttttggccaagggggaaatttcatgtcatttggcaagtcagctcaatcctttagaaacactgctttgatatacgccattccatccttcctagaatatccttatttactcctcctctcagttacacaaaccttaattgtcctaggacaccctattacctaatgccctcacttacttggtgaagctttttcctaacgcttgtagaaggcactcaggaactcccttttctgtacctgtacagtccttgacctcttttttatatgtggtatgttatactgtaatttattttttaacatgtctgcttcaccaccaggtagtgagttctgtgaaaaatgggcatctctggtccctaacacagggcttgggtaatatgtgtggactcaaccaagattctcagttatggttcactggataaatgaataagcaaacaaacttgacagtcatactttctaacagtgacagacactaattcaaatgagttgggtggtcttgtagagtgacagtactatttatttgttttaataagattattacctcaaaatgtaaggagtacaagttctggtaggttaaagcaatatctggaatgacttcaagattgcggcacaggacatccctgtgggagctgagggaatggaggaggtgacacagactattgtaactggttcacaaatggtgggatttctctgtgtttagacctgctcagagtctggggcatgatgggcttccaagccatctgtggctgctgctgctctgttactgccaggaagacacaaacatgttgagaacaaaacttactgcaatagacacctttgtgcattctcttctctatttctacgtctcccctccgaaacaaggcattacccttgatgtactttacagaatatctgtcagttgggatctccagtttattaccagcttatcagaaaagcagagtatacacagaactttccataaggcattgcaaaataaagtcttgaggttggcaactgattgacttatgtcatgactattttaatcatacctgagaacttaagatatcaaattcctcatttctgagacagtcaggaactcccaagataaagattgagctgtttcctttaattccttgtctcccaacctaaagtggtggaatttacgttcagttgacagccaggcttaagagaggtaaagacatctaatgggcttgaccctggcccacttttctcctgggctggcccttgtcctgatggggaacattctctatgttgtggttgtcatgtcttaagtcacaggaccaacatcaccaataacagttttcaatttgggacagcaccaaaaatactgcaagttatttctattcttcaatttcttaaatagcaggcagagagatttttcaaggaccaattctggattgtgaacacagatttcatttatggtatcctcaacttcttcccacataatacgtgacattcaaatctttttaaaattgatttctccctcttcctaataaaccagcctgctcttcaaggagtggctataagtcattcactcttgaaaattttcactttggttttggttattctatagtgatctgacagcaatgagcagggagggtctcttatagtctatctccccagttaatatgccctgtgaagaacaaacacacttagatgctaattgagggttttgcctgagcttgtgatatgccatcccagagactgccattgacaactgttaacacatactgctcaatacccatattgttctgattagagaaaagtgaagtatcaggagtgcagagcgtcactgggattgtgggaacacaatacgtaagtcacagccgcctgtggctgcctggggagagaagagtttcagtgtgttagaacgaagttctatgagagcagaatctttgtctttttcacctctgtatccacagcatcttgaatgttcccagcacatggatgacactcaataaatgttgttattgtcgatgaaagaataatggaattcaaggctgtagcaacagaagttcttatttaaaatggaattacaatgaaatctaaaaacacatagagggcacttattaggtttgtatacatactgtacatatacactgattctacccttagcaacatctgcccctcaaccccaccatcccccatcctcgtacataaacttaaattataaaaggaaaaaatcacgtggaagagagagttaatagaattaatgtctcttttattcttccttagaactatataatgaacagttatttcatattgttgctatctgttttctgcttttatatcattttctagattataagattcttgcagacaggaagtctcctgacgactttccatccttggcaactagtaggatatctgacagtagaatgttgctacaaattggttaacttttctggataggtgtcctacaggggactaatggtaaggacagcctgatgatatacaatggagaggctcaggcagactaagcaaaagctagtggctaggaatccaaatgttcccccttgaaaaccaaacctctctcgcgttttagtcaggtttgccaggtctgtaaaaggtgagcagtcttggtctctagtcttacttgtatattacttctccctttccatgtaaaatctctcctgggacttggctaatgcaatattagtgttttcactgtattggttcatatactggcaaaccttctgcttaacagaggcagtgaaaggtataatgggtagatggttgctggtcaggggacagttgctgatccagggccagttaagccagcagacagacatcctggggtttcatcagacttagcataaggacaggaaaccaggatgtactctctagtgaacaagaggcagaaaggccgactggaagtcagagatctggggaaaaggctccttgcaggttcaacagttgacctggaggtagaagttgttagagtttcaggatgttgtcaaatggtcagagaacaaacctctatctaccaacaactacatcatgcattaagaaagtctcacagactaaatctccaaaactcacagcagtaaacttaaaatgcaaataattgtttcttttctgcaaataagtttctacctcttttttttttttttctcgctctgtcgcccaggctggagtgcagtggggcgatctcggctcactgcaagctccgccttccaggttcaggccattctcccgcctcagcttcccgagtagctgggactacaggcgcccgccaccacgccaggttaattttttgtatttttagtagagacggggtttcaccgtgttagccagcatggtctcgatctcctgacctcgtgatctgcccgcctcggcctcccaaagtaagtttctaccttttatctctcctgtcacattatagattacttgtagagatggagagaattgaatccatttatcctctgtagctgttatctcattaccactcacctaatatgtgaatttataataagtggtggattttacgttcagttgacttgggtaggtgtctgatgaaagaaagtttgataggactgtttgataagagcttcaggtgcttaaaaataaatgtgcttcaaaattctgaggcagtttctcaaggcttctgctgcaaacacactgacatcattccagtggctttctttatttaaactcgtctttcctgcagtcctgtcgtagttctgcatgctgcaatgccactgtgtgcctgcctctgttccacacaaggctgcgctccttgagggcaggtctgtgccttgtgtcggggtatccttagtacctggcagagtactgggccctgggaatttcataatttaatgtaaatttcaagtttgctaattagagggcctttatttgcttacctaacaatataattatttccagctagtaccagaaaaataatcagagtatttctaggaccgacatcaaaagtgccagtagcatttcagagttagggtcctctgctcaactttccactgggacttgcctgctagtttcctggctcatttgttattgggggttgctgtgcctggactcacattgcagttcctgctgttttatggtattaatgtgaaggatcctttttcactagtgtaggcaattatgaattgagtgtaattgctcggagaggacacgagtcatgaataaatacaatctgaaaattcctaacatacattgcattatggcaaatagatccttctttctaggttaaatacttacaaataaaatataattcataagaaatattttgcaaagtgtactattactgatactgcatgctaatcaaggcctatatagactaagttactttattatcaggttaatttttttcaaaatttatgtttccaaattaaattaataattaaaatcaaattcatctcaatttattttccttattctctgaatgctatccatatatgaatcgacagtccagaatcatggaccaattattacttcacaaaatctcatttcccatgactgcatatattatgcagatgataatattcttaggtgtgcattgtcaccttggatttcacatgatgctataaaagctagagtgacactgagaactgaaaaatggaagggtatagagagtatttttgtgtgtgtgatttatatacattttatttttttatctcattttgttccattgactaggccctcagtatgacttaaagcagagatgggagcatatttatctcatttataactttaaaaggaatgagccaaatgtttcaccattatacacttactatgaaccctttttgttgatatatttcataaacttaaggaaatttctattcctagtccattaagaatttttattaatagaaactgaatttcatcaaatgcctcttctacttttattttgatgatgctttggtgttcataaaattgttaagataaatttcattaatcaatttgttaactgttatgatgaacttttccccataattaaaaaaattattagtaatattattttaaattgacaaacaatacttgtatatatttatatggtataatgtgccattttgttatgtgtatacaatgtggcatgattaaatctaactaattaacatatctatcacctctcttattttttatggtgagacatttgaaatttattctcttagttattttgaaatataaatacattattattgaccatagccaccctgctgtgcagtagctctcaaaacctattccctctgtctatctgtaccctttgatcaacaactcctcattcccgccctcatcaacctcttccagcctctggtaacctcaaccccttccggcctccagtaaccgtcattctacttagaaaatgtttaaaaataagaataccaagaatgagagacagaggttataaatagatagaaaaatactggaagggggagaggaaagaaagggagggagggagagagggaaggaatgaaaatgagtgaaaaagagagaatttgaagatcgtgtgaaagacagggaggggaaaatcaagtgaacacttcaagtgatcccttgctatgtgaactcatctctcatcatatgggctcagcactttatgatctaacataaagctttatgacaggccatcagcaattttgttcatcctgatatccacacctggcagtggctcggcacctgttgtctaactcaacaaggccaagtgcatgctgccagccccacggcgcactctgtcctgtggccccagacagccttctctgaacagactctgtagacctggcctcctggctgcctgattttgtagtcatgatggcttcaataacttcaggcattatccatggaaatgtactgcaaacttgactttttaaattaggtatttcaatttccataacttatgaaatctcagttattttgttagttcagtgatgagcttaagggtatcatttgcaaaatcatttcttccagattcttcattaggtaattataaaaacaacatttcctcttctatggcatgaagaggaaattaaaccagtcttccatcactatcaaaatattaattttcttaatattttaattgaatccattcctcagcaataacacctaccatttaccaagcatgtacatgtgccagggactgagcccgtggctttgcatgggtctttttttaatcctcacaagctactcttccacaatgactgccaatctacagatgaaaaaaagaggcacacagtggcccaagaacttgctgaagtttacaaagttagtgagtggtggaaccaagtctatgaacccatgaatgagctccagaattttctctcttagctatcaaattattctgcgtctgcaaggttgtttaacaataaggattgcctaaaccatgcctgtgtatctgtgtatcctttgaacacttactctcagctgaaattggtgaaatgactgacaaatcttattttttcataaagggatgtgtttgtaacggaattcattttctgataaaaaatattatctaaaatgtttttcctactattttgctataatatcaactgaatagatgggaaggcccttcaccaatatgtaggtactatctagaatagatgggaaggcccttcaccaatatgtaggtactatctatctagttaaaatgaagtgtaggttgttgaagccccaaggaaaagaaagggtgctaaatttttcttttctttttttttttttttttttttttgagatggagtctccctttgtcacccaggctggagtgctgtggcacaatcttggctcactgcaagctccgcctcccaggttcacgccattctcccacctcagcctcctgagtagctgggactacagatgcccgccaccacgcccggctaattttgtttttgtatttttagtagagacggggtttcaccgtgttagccaggatggtctcgatctcttgaccttgtgatccacccgcctcagcctctcaaagtgctgggattacaagcgtgagccaccacgcccggctgctaaatgtttcaactcctaacattcctaagcctaggaaggaagtccttcccaataatatacagactgtacctatctgcataaaatgaagcacaggtttattacaatgattagagtaatactagcaagaacctcaagtctctgtgactaacaaaaaggtccactttattattttggcacctatattcttcagatgcagaagccaaccacttgcctcttctcttcaatttgcttgagcagatgggggatgcaaaggctggtaactacaagactacattttctcttgggttgagggaatagattggggaaaagagaaaaatgtatgcttttatggagaaactattgtttctccctgggcaaagcgagggatcatcgagaaatcttgtatgctgtataaaaattattttcaaaatcatgggtatataatctcttccctttcctgtttgttgaaaaacatgcacataacaccaagttactttataggccagatgagaggaaaaataaagtaaatgacttaaacttcccaattttttcaacagttacaaggaagacacagtaagatgtgatcttctaaagtgaaaatttcccaaagtaccaaggaaaaggagaaactgcagaagagcttcaagaaccacaaacacttgggttttgcatcttgccagaaaatctgcactgttggtagaagcctggggtagggctggcaggacctgactcagcggagaaaatgccacccacagtcactgactctgcttccgcagtagcggagctcccctgttttctctggaggtttcccacagccgggccaatacccatgtctctcagatgggaaactggacttttggaaaattgaaactaaataaagttgtataacttttaaaagaagtttacaattatgatgctttgcttttcacatgcgcttaaagtccattttctgttgaataaataatattaaccacatattaaccacctaatagttttaaaatgtctcaaacagccatcaccatcattctgaacagaatcacacttctttttaaaagatcactgttaaaagatgaggggaaacagtaccattaaaaggaagcaaaacatagttcaaagtctgcttccatgaggtaatgtacactatcgactaattgtcaaaggaatccagtctataccgagatgaatgaagcatgaggttaaggcaggtggctgggagaagttagaaactctccctccccgattgcattacattattgtcgaagccaagcagatagatagaaatcaatgaaagttttgttgatctgacacaggaacttgtgcacagtgaaatggaagctatgtattttgtgctggaaactgccagtctcacattaactgcatgtatatgtgaatatatgtaggtttgtgtaggtttgtgtgtgtgtgtgtgtgtgtgtgtgtacagcatgaagcagaacatctgaaagaatcttcagaattatttctcgttagatgtacttttgggtagattttatctttttcccccagaaagtaatatttcaatatagaaatttaggcctcagcaaagtgaggttttttttttttttatgttacaatgcttgcaaacttaatggtggtttctaatggaaaacaaatttcttcccctaatcataatataagaatttgcaggccaggcacagtgtctcatgtctcacgcctataatcccagcactttgggaggccaaggcgggtgggtcacttgaggtcaggagtttgagaccagcctggccaagatggtgaaaccccctctctactaaaaatacaaaaaaattagctgggcatggtggcaggagcctgtaatcccagctacttgggaggctgaggcaggagaatcgtttgaacttaagaggtggaggttgcagtgagctgacattgcatcattgcactctagcctggatgatagagtgagaatccatctcgaaaaaaaaaagaaaaagaaaaaagaaaaaacgaaaaactacagttttctttaatataaataaaatctcttgtatttgtacaaacgcaattgtggaaaacactgaaatattttcctatttatttttatgctggtcagcaagtggtttgatttcggtagccagactccaggtgcagagttcagaactataaatttgttgtacctcctatcagttaaagttgactgagatggccatccctccccaaatcacagttcgtcttgaaaatcttcagagtgtgaaaaaggtatggctcagaacaaacaccagtggttaaaaatgatatccttttcccagtagcgatatacattgtgggtatgtgattagaatatttaaaatacctgttcacctggtattaagccacatgtgtaatacattagagtgttcctggctcatttccaagagtatgtatcctcactgccatgaaaatactgcgggagccagggcaaagatacttaagtttcaccctagaagcaatgcacaacatatatatttcactgttaacaatatcatcacactaagcattgttgactgactaatacttcaatgaaatcaattatttatttttgtgtcagaagagaaactggcagcatagggacacttgtgttatccttgctaattacttccattgtcttgaaatctcaatcaacctacccccttctctttctccctacatctctctcgttctttcactttctctctcattgtctaactcctcttcttggatacaaagtagttcaaaggggacaccaggaaataaattatatcctaatgctatctaccagagttcactaagagaacttgggcaagcccctctatttggcagagttccactttttttttcttttaactctattttgactggacttaatagaattacttttgactcctagtttttttcctttttctaccctttccctagtttaaaaatctgtgtagtgaggaccttatttctgaagaatttcatcacgttattacacaagaaatatacatacattatatgataatttataaaatgtgacattttatttaaatgtaagcaccaaatacactgaagatttcagtgtccaaagtatgcgtgtgtatatacaagtgaaagtttaaaatttttgcctaaatttacatatgcaaaaaggaacagcaggaaaataaataccagttgtatgagcatcatgtgctaatggctatatatgtacataagttaattcttacaggaagaccaaaagtgagttttattatcccttttttactgcttcagaagctgaagcttggtggaaattcagaatgttgcccaagatcacagagtttatgaaagtggcagaaaccaggtttgtctgacgctaaaatgtgtgtctgtccctcctccagcaccacactgtcttttttatgaaagggcagggcttttattatatggatgtgaaagtgtaaggggagagttttcatatttggcagtattgtattcagaatcctgacctgtttaggtgatcattaaaagtgcacatgtcctggctgggtgtggtggctcacacctgtaatctcagcactttgggaagccgaggcaagcggaccacttgaggtcaggagttcaagacccagcctggccaacatggtgaaaccccgtatctactaaaaatacaaaaattagccaggtgtggtggcacatgcctgtagtcccagctactcgggagactgaggcaggagaattgcttgagcccaggaggtggaggttgcagtgagccgagatcgtgccattgtactccagcctgggcaacagagtgagactctgtcaaaaacaaaacaaaacaaaacaaaaaactgcacatgttctgaggaaggaggatcttttgatcccaggagtttgagaagagcccaggcaacctagcgagactctgtctaaaaattaaaaagtgcactacttcattaggaacttctaaatttataagattttgatttatgtttcaatttactgtaaagaagcttatatagtttaaaataaacctcctaggccaggcacagtggctcactcctgtaatccaagcacttgagaggctgaggtgggaggatcacttgagcccaggaattcgaacagcctgggcaacatggcaaaatcctgtctctacaaaaaatacaaaaattcgttgggtgtggtggtatgtgcctgtggtcccagccacttgggaggctgaggcaggagaatcacttgagcccaggagttggaggttgcagtaagccaaggctgtgccactgcattgaagcctgggcaatgggcatgaaatcatctcaaaaaaaaaaaaaataaaaacaagcaaaacgaaaacaacaaacgcaacaaaaaacctcctgaggcctctataatttgcttttttaatacactgtatgtgataaatagtcctcagtcacagaaatgcatgtgcaccttattagtgcaaactaaaattatatgaatatttctgaagcaacttgtcctatgaaataaaaatataagtttggtgaaagctttcaggctttttagcacacacacatatacatacttacaaaacgtaaaatattttggcacttccacttttcacaactgtttctgtcttttccagcggaacctctctcaagaattgtcattatgctaatttactgctcgagaccacggagtgtctttctgatgccaattgtatcacatttaattccacatcaaatatttagagtgcttgatttccctgtctcttcttcccattttcattgccatctttcttatatctttttatttatgtgaatattctcttcatatcaagctaatacttttcatgcccttgtttcttttttcttgtgactctttgcatacttggttttttgaaagtttgcccacgtttttcatcaattgatatccatctttctgaatttgacttgtttgagcctaaaaaggactaccaatcatggctgcctgtcctgaccttttaaacttctttctaccacttattgcttgatgacatggtatcaggagcggcactgccatcatggtcgtcgttatcattattgtaaaccttaccaagtgtcagaccctgttctaagcattttataaatgtttatccatttaattctcataacagctaagcagaagatagtattattaacctctatttacagacgatgggattaagaaacagagagttggccgggtgcagtggttcacgcctgtaatcccagcactttgggaggccgaggctggcggatcacctgaagtcgagagttcaagaccagcctgaccaacatggagaaaccctgtctctactaaaaatacaaaaaaaatttagctgggcgtggtggcacatgcctgtaatcctagctactcgggaggctgaggaagaattgcttgaacccgggaggtggaggttgcggtgagctgagatcacgccattgcactccagcctgggcaacaagagtgaaactccatctcaaaaaaaataaaataaaataaaaaataaaacagacagtctaagtaatttgcccaaggacatatagaactcaggcagtctatctccagaactgatgctcctcaacactgtgctatgttgcctccctctaaataccccatagttctcattacgttgttttgtccagttgattcccacatgtattttctaccttaattggactgtaagttttgtgaggtcacagacaatgtcttccaaacttgtatttctcctggcatcaatataaagttctgtatatcctaagaatttaataattattgcttgaataaaacaaaatctacatataaaagtggaagcaaatttttaagatatacatactggaaggccactttcagaaatgaaggtaaaaatataacaaaaatcttgaatgctttaatgaataatttgcaatataagtctaactgcattgaaaatcgataatgaaattgctgtattaatttctttgcacttctatttaatatttcttaactgtcattataagcatttgatgcatagaataagcatactttcttttgtttaagccaagctgcttgcattattttggctttctattacagataatactgtagacatttcaaatccacaatgatttggaggtagtcaaatcaatatcagctacataatacataaaggatggatgcaaattttatagcaaagaaattaataatttatatctgtttactgtaacaaaattttttgtcagctttttctgaagtttaacaatgcttgagccaatattgataaattatgtataacatataactgtttaagataaaatgctactaaaataactatattatttcatgtttataaatgttacagaatctattatatgtagtaattcacgtagtactctttctgtatgatagcctagcatagttaccatagctcatatcactattacatctaaaaatattttttatttcagcagttaaaaagaaccaatattttccatattacagactttgctgaagagtcagaaatgaataatataatatcaaaggtaataatttcccaaactgaatttatcctgcatggtacaaatgactcaacaatgaaaattttgtttaaaaagtattcatgtaaaaggctttgtccctggaatacagctctaagtggctcactatctaggttgaaaatggtttcgcagggttgtatgtcctatttttccatgcctgcagtaaagatacaatatgggaattcagcttggtaattactaatacaccacacagacacaattacaccctgtatgctgcataaaggaatcacttgtggtctgcatccattacaaagagcagtagggggccaacatgcaagacgacaaaatgctttacaagacggaaggagaccagaagagtcgatgtacacagatacaaggaccttgattcttctagcaatgatttaagcctctttccatcaattatcgtcttttgtctcaagagtcttatcaccagcagcattacaggaactgaacataacaatgctcagactcgtataaccctatgaactgtgctgacatttccacaccctgttgctatgtttgacctggtttacagattacttaagcaaaacaaaatagaaaaaaaaagcattcccattgcaaaactggcatacacacacacacacacacacacacacacacacacacacacgtatttttttatgacttactcagaattccatttgttgaaactaaaagccatcctactccagaaatgctatttttcaaagtagtttctacatcattttaaagattaaaagtaaaaatctgcttgagtgaaaataataattttaagaaagagactaaatgttggcatgttaaggggatacagactgaacaagagaatttcatgtctcagggagctaaactaaaatgagtcagctgctctcttaaggtacaatgagtcacaggaataattttcttgctgtgaaactccttaaagttttgagtttaattgcaagcagtaagtggtttttattataacagagtttcctctgttaattattacacgacgtacattattttacaatactttcatttaagattctcttttaaaatacatcttacaaatatgaatttttaagaccttaggaaagttagttatttatggcagtttgtcaggttccctgaaacaaagccttgtctttcagaaaatgtttacaacctatgaggaaaaaaaaaaaagtatcctggggctaaaatgtttattggcacctagaagtctgaagagagagtcgggcctgtggttttttgagggcactttatcatcgcccgcattctcaaaggtttctctgaatgaatagaactggattactcagccttctattccacgcctattcctctccattttccttggcacgactgagagccaggctatttttagttaagcagttttctatttttagacaactaccagttagaagacatttgttagggaaaaattaaaaaaaaagcacacacacacaaagggaggagggaaagaagcttcctccacatattgtgaagcagccttcaacctgtaactccaggcatttcagctgctttcaatcttggaaaaataaagaaaaattcagagttcagggttttaaaaataaacctaccctctggcaaacagaccaaaatacaacaagctgttactatgtgaaacagtgactacaaaaacaaagaacattctccaatgattaaactgcgagaaaagttgaagaactgattaggttgtaagaatgttgcacaggcatgtaacaattttccagcctctcagccagatgtatcatgttttagaatttagagaggggaaaaaaaaatctcatctgtaaagttaaactaacgatgtgggatgcaactttaaggttgaaccttttattaagcttaaaggcaatgaaattcactgcatttttctaacatttgtgttctatggaatttctctagaaattataaccatctgtttatagaaaaaccatacattaaaaaatccagtgctaacagaaaacaaaaaataaaggctgctacatatacatactacatatatgtgtgtatatatatacatatatgcatttaatgtccatatatcactacatttattagtctcacttttagtttaaatgggaaaaatggttctcagattggcttagcatatcaaattattctacttattcaaggccatgccttcatctgaaatctacagtaagatttttcaggtgctcacagttgtaactgctttccttctcctctgttagcccactgtactttgtctatatcttattatggttcagataattgggtatcataatcacagatgcatcaccagtaactggcagaatgcttagcaaatgatcttcatgtccatcaatatctactgaatgagagaacaaatactgtgtatattctgtccaccatggactgctactggccctggagggccgtgaacaccatactttgcacatacacttaataaatacttgtggaaaagaaaaaaaaaatcaattcgttgacctttgttagatcttcttaatttatgtaaaatgctacagttatttatataatcattcaatatttacttataaataatacacttattagcataaactatgcagtcgtaaattaagaatttttgtctttcttttggttagcattttttcttctctgaactttttctcttgactttgaaaataaaactaattttttaaaacttaagggttgacaatgggctctgacagctgttataacctgcaatcctcatgacagccccgtaaggagctcagggtagacagcattaactcatgaggaacctaaagcccagcaaggttacataactcgccctccgttagagaatgagagtgtgtgatgttgctgtaactggaactgaatttttaatctccatctttccttcaaatttgtggagcttttaaagtcctatatcctagaagtaaaatttgaaagatgaactctcataacaatgcttcaacaatattctttagaaaaatcactttgtagctttatttttcccccacatgaaattaattcagaacaactacagttaaggaaaaccaatcatggagtctggatgaagataaaattccgcacatactaattaagaaaaatcagaagaaaccgtgtgcacgcatgatcttttctttcctgttggaaaagttcacaagggacctagcttatttctacgttcttactactcatttttcctgtgccttttccattttctcttcttcctcagggcaattccagcttcagtgatccctccattttctcgtctttctccacaaaatcacatagactttaacaaatattctgttccttggagtaaatgccaactgagtgattcaactttcctggttggatttctctgccctggctcaggtcctgactgacgcacagtgggcatgtcataaatgcctgctgcaggaatggaaggtgaagtagccaggtgcaacctctccagtttacatatcctttattgggctgtatctattaaccatcatgccagtttgtttgtttgtttatttatttatttatttatttatttatttagagactgtgtctcgctctgtcacccaggctggagtgctggagtgcagtggcacaatctcagtttactgcaacctccgcctcccgggctcaagcaattctcctgcttcatcctcccgagtagctgggattacaagcgtgtgccatcacgcctggctaattttttttttttttgtatttttagtagagatgaggtttcaccatgtaggccaggctggtcttgaactcctgacttcaaatgatccgcctgcctcggcctcccaaagtgctgggattacaggcatgagccacctcggccagcccatgccagttatttgaatgaaagagaacactagatgcaccagtttcgtcatttactgtccaacagagggtttctttcataatggacaattatatttgggagccactagtcacatcttgcttgaaatgtggatagtgagactgaaaagctgaacttttaattttatgtaatttaaattatatttatatttgtatagccacatgtggctaggctaccttacagattaatgcagatctatgtcttttcatctgaagtctggttatattatccaaagaaaatttacatgacacaaatgagtttataattgtcatagtataggtgctaaatataccatttatttacaaatgtgtacagtaactttcaaaggggttgggtttctggaactaaccacagagtcaatcaataaacttatgtcctattgaaataactgagagtgaagttggctttagattagtagtagctcatgcatagggtaactttggtctatttttctatgaaatggtttcctccttgacatcatagtgatggaacttgtttatgattaaatagtaatatgcacacttttatttttgaaaaataaagtaattcagaaattataaaataagttactattattaaaataagttactattattaattcatatatctacttttttgtaatactttttttttttttgagatagagtcttgctctgtcactcaggctggggtacagtggcatgatcacagctcactggagcctcaacctctcatgctcaggtgattctctgacctcagtctcctgcgtagctaggagtacaggtatgcaccaccacatccagctaatttatttttatttttgtagagttggagtctctgtatgttgcccaggctggtcttgaactcctaggctcaagtaatcctcctgtctcagcctcccaaagtgctgggattacaggtgtgagccaccatgcctgctataactatttttttttttaatgtgaggaaaaaacccaaacacccattgtgtagttttactgtttacaacgtttcttaccctagaacagtagctctaaatagttattcagtttatttactaaaacataaagataagagatttaattgatatgaagaggttttcagaatctaattaaccttccagctagtcattaactctatgacctttagaaataattgacagagaattttttttcttattcataacttcttccaggtggttaaatttcagagtagtgcagaatacactaaacaccattgagacatgactggataatatgccaaatagctataaaatggggtatatttccaataatataatctatttacttaatctgttgtacacatatgcagcatttacctaattacagtccttttaatgactgactttgattaagtcttttcccagaatgtcctattgattattttgaccaagaaaataatgaaaaagttatgggtactactatctctctgcacccaaggcacatgcccctaaccaatcacatcacacttcctgaatgtctggacttggactcagcatcttccttaactgtgtgctccaggcagccagtacaaagtgatgggcacacactaaggagtgaaatgtgccagagtcccacctcactgggtagtgatgtgccttttatgaatgtatcacacttccagaaaaacctaagacacttcctttcaagaattagtttcacagaatttcagttgtaagaacctgttttatagcatgattctaaccctccataaaattacaaagaggaaatagtctacagacacactttcaaattccatgaagaaggaaatacatgtttggaaaaggaaatctagatcctttctactccagcagcatcagcatcacctggtcagaaataaagggatcctgggccctgccctatacccactgagttagaatcagcattttagcaagatactctggtgattcacactgggccacaggcatttcatttgacccaatactggccaaagcactaacaggtttcttctctcttctccagtaatcaaaatactgtaccttggtctggaagtcctttcctttccaccagcaccacaagcaatacttttacttggtttcctgtgccttgtaatttaattatttatttatttttgatgcaaaacaacatttactcactctagctgacttgaaagattctcacttttattattagaacacatcggatctcaccaaagaaaaaattgtatatttaaaaattttatttatgctaatgatcatcagtaagttgatatatattgaatgtccacaatatgctaggcattgagctggcagctggaggtacagagatgaacaaagcttcgtcatgcccttcagggaaaggagagggatttgtaattagacaaaacaaaaacaaaccccccaaaaccaacagtggggtgaagaaattaaaataaacactccttaatgaaaagagccatcatcttagaattctgcttctaggcaagcctcagaatcattcttagaactttacttttgaatatttcatgactatatattcagtaacttttcctgaggaagtaagaatattctacactttgattcttattcggcaccttttagagccaatgttagttttacttagatgatatcaatggctagaatgtaacatttggttcaaatatgctgcttaccaccaagttccatatgccatgaaatttgtaaatatcattaaaaattgacaattatcatccaggctatatatttttctcttttcatttccaggtatggtgggagtcaggtgaagagagatcacatgagatctttgttttgctctagttcaggaaggttcatgtaaaataataatgatgacaaaatggtaatgattaatattgataaagaaattatattactgataaaagtctatattttgaaccctgtcttttctgcttctactattattaagtaattatctgctcactgtgttcatactaatgcttgcaaactattagagctgtgtaataacagagactagaggaagctcagttttattgcctcacattactatttgttcaacaatgattattttcttaataaatgagatgtgaagcagctcttcgtgtttataaaacatgtaaattaagcaagaagattatttttaaaaaagaaatggctcttcaaatttgatctatacaaatcattgtggtatagttatgagaaatatgaatacatttaaaaaattttagactcatttcttctttaagactttggggaacaagtaaaaatattatttacaggtactaataaaagtcttttaaagatatataaacaaaattatattaaaattcaggaaaataaaaaactttttaaataacaaaatctttttccccttttccctcagaagccacaacatagaaggtttaaatctttatggaaaatactaatactttgttaatttttcaataccatgtattgaaaagcaattatatgcttggcttaacagaggggagggtagacttacttagtcactagcagtaagatctatatcaattatgttttatagtaaatctaagaaggatttgtaatgtatctcaagaatactatttctctaaatttttttataatgaaaaatacttttctggagaaattaatttactaattatataggtaaatactggtccaatgttgcttcaagtaaattaaaaatagtaataagacagaactatcatctttccattcacaagcttcaagttaaaaaaaaatacagtatacttcacccagctcacacagttaatgttccctgtcagcctggacaacttgcaagtgctttctgaccagatcataagtttactgattgactctgtggttataggttaggggtaaagtgtgcttttagttttatggtgagtgtttagttccagatcagagtctctcgaagtgaacatttatgctctgaattccaaaatcacaaggtacacagttactcacttccgaagtgactcctcaaattttatattgaagaattaattttggtattaatttgaaaacacaatttgtttaaatatctccctcttcatatttcagtctagaccagtgctgtctcatagagctttctgtgatgatcaatgcattctgttgtatatcttccctgtttaattcagtagccactagccacacatgactactgaatgcttgaaacatgactaatgcaactgaggaactgaattggacattttatttaattttaattcatttaaatgtaaatagtctcatgagcctattggctactatattggagagtatggacctagattacttgagtgtttttaaattgtgctttgataaactctatcaaaatttaatgaattgtttcattggaactgtaaaaacattttttcatactttaaatgtgcaacgttatgccacatgataatcacttgattatatgtctgtctttcctgtttgtttattctataaatatattctgaggaggtaactttctctagacctcatgttaagcactgggaatatgatggtgagcaaaacgtgtacagtcccttgccctttgggagtttagaatctagtgtgggacaggcaattggataacaacttcaacagtgctctgatgggaaagatagaacacatgatgactgtaatacaggggaagcacctaacctaagttatgggggcttcaaggatgactttccaaagtgtaattgggacctgacttgagtgaaggataagtaacagccaagtagagatccagtaaggaattttaagacaaaacagagcttggagaggttgaggaatgtacgtatgtacgatgtggcttgagtataggatgggggttgtaagggcaggttaatggcagggaaattgcaaaaagtgaggctgaagagtaagagaaatacatggatcagatcatgcatggccttgtgagccaacttaaggactgagagtccttgagggaccttggttatatctgtatctccaggcatttcatagcatataacacagagcaggaattcaacaaatttttgttcaatcaatgactgaaagaaggaaaatctgcaaatgattaggtaagtgaatctgtttttttctcttaagaaaagtatccttgtataatatgtatctatatagcacataaaaataattttgtacatatatatttatttactttaagttctgggatacgtgtgcagaacatgcagacttgttacataagtatacacgtgccatggtggtttgctgcgcccataaaaccgtcatctacattaggtatttctcctaatgctatccctcccctagccccccaccccacgacaggccctgctgtgtgatattcccctccctgagtccatgtgttctcattgttcaactcccacttatgagtgagcacatgtggtgtttggttttctgttcctgtgttagtttgctgagaatgatggtttccagcttcacccaggtccctgcaaaggacatgaactcatccttttttatggctgcatagtattccatggcgtatatgtgccacattttctttatccagtctatcattgatggacatttgggttggttccaagtctttgctattgtgaatagtgccgcaataaacatacatgtgcatgtgtctttatagcatcatgatttatactcctttgggtatatacccagaaatggtatggctgggtcaaatggtatttctggttctagatccctgaggaatcgccacactgtcttccacaatggttgaactagtttacagtcccaccaacagtgtaaaagtgttcctatttctccacaccctttccagcatctgttgtttcctgactttttaatgatcaccattctaactggtgtgagatgttatctcattgtgcttttgatttgcatttctctaatgaccagtgatgattagctttttttcatatgcttgttggttgcatgaacgtcttcttttgagaggtgtctgttcatatcctttgcccactttttgatggggttgtttttttcctgtaaatctgtttaagctccttatagattctggatattagccctttgtcagagggatagattgcacaaattttcttccattctttgggttgcctgttcactctgatgatcgtttcttctgctgtgcagaagctctttagtttaattaggtcccatttgtcaattttggcttttgttgccattgcttttggtgttttagtcatgaagtctttgcccatgcctatggcctgaatggtattgcctaggttttcttccagggtttttatggttttaggccttacgtttaagtctttaatccatctacagttatttttttgtataaggtgtaaggaaggggtccagtttcagctttttacatatggctagccagttttcccaacaccatttattaaatagagaatcgtttctccattacttgtttttgtcaggtttgtcaaagataagatagttgtagatgtgtggcattatttctgaggcctctgttctgttccattggtctgtataactgttttggtaccagtattatgctgttttggttgctttagccttgtggtatagtttgaagtcaggtagcgtgatgccttcagctttggtctttttgcttagcattgtcttggctatacgggctcttttttggttccatatgaaatttaaagtagtttttttctaattctatgaagaaagtcaatggtagcttgatggggatagcactgaatctataaattactttgggcagtatggccattttcacgatatagattcttcctatccgtgagcatggagtgtttttccgtttgtttgtgtcctctcttatttctttgggcagtggtgtgcagttctccttgaagaggtccttcccatctcttgtaagttgtaatcctaggtattttattatctttgtagcaattatgaatgggagttcactcatgatttctctgtttatctgttattggtgtataggaatgcttgtgatttttgcacattcattttgtatcctgagactttgctgaatttgcttatcagcttaaggagattttggggtgagacaatggggttttctaaatatgcaatcatgtcacctgcaaacagaggcaagttgacttcttcttttcctatttaaataccctttatttctttctcttgcctgattgccctggccagaacttccaatactatgttgaataggagtggtgagagagggcctccctgtcttgtgcagttttcaaagggaatgcttccagcttttgcccactcagtatgatattggctgtgggtttgtcataaatagctcttattattttgagatacattccatcaatacctagtttattgcgagtttttagcaggaaggagtgttgaattttatcgacgcccttttctgcatctattgagataatggtgtggtttttgtcattgtttctgtttatgtgatggattacattttttgattggtgcatgttgatccagccttgcatcccagggatgaagctgacttgatcatggtggataagcttttgatgtgctgctggattcggtttgccagtattttattgaggatttttgcatcgatgttcatcagggatattggtctgaaattttctttttttgttgtgtctctgcctggttttggcaacaggatgatgctggcctcataaaatgggttagggaggagtccctctttttttattatttggaatagtttcagaaggaatggtaccagctcctctttgtacctctggtagaattcagctatgaatccatctggtcctggacttcttttggttggtagcctattaattactgcctcaatttcagcacttgttattggtctattcagtatttgacttcttcctggttttgtcttgggagggtgtgtgtgtccaggaatttattcatttcttttagattttctagtttatttgcatagaggtgtttatagtattctttaatggtagtttgtatttctgtgtgatcagtggtaatatcttctttatcattttttactgcatctgattcttctctctcttcttttttattaagtctggctagcagtctattttgttaatcttttcaaaaaatcagctcctagattcactgattttttgaagggtttttcgtgtctctatctccttcagttcggctcttagttatttcttgtcttctgccagcttttgtttgttcttgcttctctagttcttttaattgtgatgttagggtgtcaattttagatctttctcactttgtcctgtaggcattcagtgctataaattcacctcctctaaacactgctttagttgtgtctctgagattctggtacactatgtctttgttctcattggtttcaaagaacttacttatttctgccttaatttcattatttacccagtagtcattcaggagcaggttcttgaggttccctgtagttgtgtggttttgagtgagttttttaatcctgagttctaatttgattgcattgtggtctgagagactgtttgttatgatttgcattcttttgcatttgctgaagagtgttttacttccaattatgtcagttttaggataagtgtgatatggtgctgagaagaatgctgaagtccaacgttgatctggggtagagagttctgtagatgtctattaagtcagcttggtccagagctgagttcaagccctgaatatccttgttaattttctgtctcgctgttctgtctaatattgacagtggggtgttaaagtctccgactattattgtgtgggaatctaagtctctttttaggtctttaaggacttgctttatgaatctgggtgctcctgtattgggtgcctatatatttaagatagttagctcttcttgttgcattgatccctttaccattatgtaatgcccttcttgagtctttttttatctttgttggtttaaagtctgttttatcacagactaggattgcaacccttgcctttttttttttttttttttttttttttgctttccatttgcttggtaaatattcatccatccctttattttgagcctatgtgtgtctttgtacgcgacatgggtctcctgaatacagcacacagatgggtcttgactctatccaatttgccagtctgtgtcttttaattggggcatttagcccatttacatttaaggttaatattgttatgtgtgaagttgatcctgtcattatcatgccagctggttattttgcccgttagttgatgcagtttcttcatagtgtcaatggtctttacaatttgatatgtttttgcagtggctgttaccagtttttcctttccatatttagtgcttcctttaggagcccttgtaaggcaggcctagtggtgacaaaatctctcagtattcgcttgtctgtaaaggattttatttctccttcacttatgaagcttagtttggctggatatgaaattctgggttgaaaattcttttctttaagaatgttgaatattggcccccattctcttctggcttgtagggtttctgtagagagatctgctgttagactgatgggcttccctttgtgggtagctcgacctttctctctggctgcccttaatattttttccttcattccaaccttggtgaatctgattgtgtcttggggttgctctttttgaggagtatcttgtggtgttctctgtatttactgaatttgaatgttggcctgtcttgctaggttggggaagttctcctggataatatcctgaagtgttttccaacttggttccattctccccatcacttttaggtacaccaatcaaatgtaggttttgtctttccacatagccccatatttcttggaggctttgttcattccttttcattcttttttctctaatcttgtcttcatgctttatttcattaaatttgattttcaatctcttatatcctttcttccgcttgatcgatttgggtattgatactcgtgtatgcttaacaaagttcttgtgctgtgtttttcagttctatcaggtcatttatgttcttctctaaactggttattctagttagcaattcccttaaccttttttcaagtttcttagcttccttgcattgagttagaacatgctcctttagctcggaggagtttgttattacccaccttctgaagcctatttctgtcaatttgtcaaactcattctccatccagttatgttcccttgctggagaggagttgtgatcctttggaggagaagaggcattctggtttttggaattttcagcctttttgcactggtttttcctcatcttcatggatttatctacctttggtctttgatgctggtgacctttggatggggttttggtgcagacatcctttttgttgatgttgatgctattcctttctgtttgttagttttccttttaacagtcaggcacctctgctgcaggtctgctggagtttgctggaggtctacttcagaccatttgcctgggttaacaccagcagaggctggagaacagcaaagattgctgcctgttccttcctctggaagcttcgtcccagagtggcacccaccagttgccagccggagctctctcgtatgaggtgtctgtcgacccctgctgggaagtgtctcctagtcaggaggcacggggggtcagggacccacttgaggaagcagtctgtccctcagcagagctcaagtactgtgctgggagatccgctgctctctttagagccagcaggccagaacatttaagtctgctgaagctgcgcccacagctgccccttcccctaggtgctctgtcccagggagatgggagttttatctataagcccctgactggggctgcttcctttctttcagagatgctctgcccagagaggaggaatctagagaggcagtctggctacagtggctttacatctatatttttataagtataaaattagaagctaattagatataatgaatggtcaagtaaagtagacatattttcacatttacatccatttccaaattttgtgatactgagtttgtaaagaagtccaatttcgctatttgctgcatttgcttttcaacaaaaattgtatttagtattttcactaaactatgtaagagcacttagctcgttgataactttcatcaccattgtgaagctatacaagttataaactattttaaggcttttcccatcccaatttaggccttaattattactgtgcagaaaacattttgctgcagcaactgttcttagatgtctctaaatcaaaacagaagtcaggattcaggtgacagcaaataaaatttccaaaataataaaatatcaggtaaatataatctctcatctctcatcttctctccatctccctatgtccctttccttctctctctctctctctctctcacacacacacacacacacacacacacacacacacacacacacagagagagagacacacatgttcttcctctaaaaagaaaaaccaataatcctctactgagacagttgtgaatcaaaggtttcttctgcaggagttacatccatctctgaatttcctagagagcagcaaagggccttgtgttttattccccttccacacttaatcactggactgtgggcccagactgaatgagtagctcattagaatcactgagttcactgaggggatgagagattccttcctggctgggtgctaagtgatactcccataaggattttgtggttacaaaacgtgctggatatggaggtaacctgtctgggagtcctgtcactccaaggatcacttggaatgctctggaaaaacacatgacctggctgaatgagttctgttgaattgtttagcctacaccttcatttcagcagcttatactgcattaatgaggttattgttcctttgccgtccaattgttcccaagctgattttttgcatatatgttttacatccttaacaagaatgcctgtctcctgctgtttcagagtctcttccacagtgctgagcatgagtggagcttgctaaatcattgctaaatgaagcaatgggctgtaagcatgtcctgtgggatctgcatcttcagatcatcctgaagtactcaacaaccacatcttcttccaggaacagagcccaacataaactggtagggtttgctgtcttagacagctaagagaacgaggagtggagctagtgaacaagcagtgaagggggcagttccttaatgccatccgaactgaatttcaacagtctgacaagctagcgttttgggtaaatatcccagtatacttgtcacagagttaagtaaaatggacttccttcaaaggaagtgcttttaatacaataactgtttttgtttttttaaccaatggattaaaaatttaacacatttactaaatctggcatatttatatattgtatctaaacagatattcaagctgcattataatataatcataaaaaaactgatctcagtctgtctgttaagcctttgtgagtctttgtgccattgttggagtagtgctaattatcaagcaaagacatgataattacgcagagcttttttgctaaaagaaggaatctttttcaacacccacgcactgcacaatttcctatgaccctgtagcactactctggtatggcccagaaatttgtatttctgtgtaaaggctggaaattatattatttctatctctcccgataccttttcttcttgtgagtaaactgtttttagagggttaaggaagaggggtaatggtccaaatgggaaatataaaactaatgacccttcatgaaacatattatgctcctcattaaacttattcagttaaatgtattccattaaattaaaataaataggatttaaaattttacccaggagcagtaaacaatcttaacttttgactttatggtagatccattctaagaacgaattcaaatccctgatgtatcataggtctttgcctccagcacaatttatgtactagtgctgcagaggttttcaaatttagtgtgtctaagaattacttgggaacttttttttttttttttgagacggagtctcaccctgtcgcctgcgccagagtgcagtggcgcgatctcggcttgctgcaagctctccctcccgtgttcaggccattctcctgcctctcgagtaactgggactacaggccccctccaccacgctcggctaattttttggatttttagtagagacggggtttcaccatgttagccccgatgatcttgatctcctgacctcatgatgcgcctgccttggcctcccaaagtactgggattacaggtgtgagtcaccgtgcctggcctacttggggaactttttataaatgcaacttccaatccagattccctcttcaccaagtgtctcaagtatcctaatttcagtgatgcagcactttgaaaaatattccatgtgaagatgatgtaaattttatcaagcttagcggtcccatcttacttctttttccatgatctctgttattactaaaatgtggaaaagccaaatatgtgaagaatgcataattcagggagttgaacaggacggacccacaatgtgttagacttacatgttatgttcatccaaataattgagccatccaatctctagatttggcccaaaagcctcgaagtgtctttttgagagattcagagatttaatctattgatgttaacaagaaaatggaactggttctttactcctgttttacaagtattgcttttttaaaaattataatcttgcaaaagcactttcaaatccaatgccttcatttttgagatgagaaaacgtcagcccagagaggtacccaactcaccacactgcacaaaagtgcaagacaaggattcaaatgaaaaacaatgactcttaacccagtgctgtttttgtggcatttaaagaagtctgactttcaaatatccacctatcaaaaaatatgaagttttcatacaatatatgaagtgggtttttttgttgttgttgttgttaaacagacagggtcttgctctgtcactcaggctggagtgcagaggcacaatctaggctcactgaggccttgacctctcaggctcaagccatcttcccccttcagccccccaggtagctgggaccacacatgtgtgccaccatgcctggctaatttttgtattttttttgcagagacggagttttgccatgttacccaggctgctctcaaactcctgagctcaggcaatctgcccacctaggcctcccaaagtgttggcattataggtgtgagccaccacacctggccaatatatgaagttttaagttgccttcaagtcatataatatattcctaagaaaaaccctcagaagatgaatgttctaggttttaaactcctttaagaaagcaaattttagaagtcaacatattttccaattggctcattatggatctacagcatttcacatgacattaaggactagcagttccagtgtaatgataaattccaactcaaattcttttgttaccctgacttttgttataatggttttagtaatgagatggagtttttagtaaatagttgttttgttttctgaatttattttacataagtattagtgcacacacacaagcagtgttcaccttcatatttttgtactttcatatttatatgcaaataaaaaactatctgaaatgcataggtaaattttatcagtgatcctaaatttcaagatcaaggcaagcacacaattcaaattatcaatgaaaaactaaaataatgcatagtattttaagcacatatcaccctaggtctatttatcattcacttttgtttctctgaaattatttccttggcctcgttaaggcaaaaataaaatataataatcagctcaatacttttgaaaaactttcaaataaaaacaaagaaatgagaattagtcttagacaattgtaacaggtaaaagggagatggatgtgggaggcatattcatttgatcaggattagcactacatttttttacaatgtggaaccagtctaagcaatggcaagaatgacgtgtactctggcaaactggctcttgagtacatacttttgaaacacttattaattttcttttcattctgagaaagcaggcacaatctagggaagccagagtagacaaatagattaagaaaataggcagatgggaaccatccttattatacctcttcctttgttttgtagtcttaatcattgctcatgaagggtactacaaagtatttaaataggatcgatgctgaaaaggtttaaaatgttccagccaatgtaactaacctgcacaatgtgcacatgtaccctaaaacttaatgtataataaaaataaaataaaataaaataaaatgggaaaaaaaatgttccagccaaaactgtatggtatgttacttatgctaacacatctaaaacatttttgactttcagcatcatgcttatttattttgggcacaataaaacaattttttaaatctgacattgattaaacactgagctaacatttagaaattcattttcatctgatttctgattccatgtatattaacagttttcattgatatatataatgatataatttttaggaaaaaacatttctaggagaataattgcctttactcttccagcaagaaagcattcagaataatgagttacaaagaagagacataaatcgaaaaactgaaagtgtaaggttggggtgagttcatttttaaatacgttttttctttgatgatgccgggaaactattatatacctaaaataaatgatcagaagtgtctaaaatatggatgagctattccctggcaagagttcccaaccatggtgtcctgatacacagctgtggacaatgaccacttgccaaagatgaagcaaatagtttgacactggtacttgatttctagcaaagaccagatcttacatggtctctatcatcacatcactctaacttttgaaggggagagaaaaggtggagtaagagttgcgatagataataatcctgggtctatctatgggactatgaacatcttaagaaaaagaacatgatgtgtgtatgtgtgtgtggcagggggaggtccaaactcccctgcttgcggaggcttggggctcaccacgcatgctctctcacctccacgatgtctgagtttgtccggctctcatgcggctcgttgtactccgtgtacttgagaagcactttgtccatgtcggtgctggcatactggaacagcttgttggtgctgttgaagatgatcagcgcaatctcacagtcacacagcacgctcagctcataagccttcttcatcaacccaaatttcctctttgtaaatgtcacctagaaaaaagaaagcagccaagattttttaaaaaatattcatgcatgtgtggtttttttcttttcttttttcttttccttcacaaaacaatggtgtgtagttgtcagagccctgggcactaacacattcagaaagaaagcaaataaatctaatattaatttctgcttatcatttgaaaatgtgtgatttctagcttgctgctgaatgtgagactctaaatgcaagatttaatgtagggtattttaatgaaggtgaccagggaactggtcatgtttctttgagcaagttaagatttaaaaaaaaattaatttcagcatggttagcatatttcccaattaataattagtttggagcttgtttttgactatttgaagagtggacatgacattaggaacttagcattttagatctgtgttcaaacaagtcttaaaattgtctagtctcatgtcatttaattgaaaacacttgaagggatatgactgtgatctcagacgatgttgtattctgttttctagaaacccaacagggcactgggaagtccgttagccatcatatgcttagggttttggtttcattcttctgtgtatctttcttcttctctcaggtcagaaactgtattgttaatgccaccattttcttcttttaatctaatctattaccaagacccataattcctttcctcaaaatatttctcaggttcacactatttcccaggcaactctatcactgatgtccttatcacttcaattttggacagcctagcagcttcctgtcctcgatgatctccctgcctggaatcattccttcctcaatttaactcaaactgcaaagcctcactcttcctactgtctttttcctgatgagctgcctacaacagctccctctccctggctttgaaaacttcctacctgccaatcctaccaaatgcaaaaatacatttcactcttcccaatttcaactctcttttaattgaacttcagcttgttgctccagtctggctactgaaaaggcgtgaacattctttttttttttttttttttttttttttggagacggagtctcttataaacctttatatggtccagtgtttcccatctacagaatgaatacctgtttcccaacaggtattcattctgtagagtactgttcctataaaatactccttaagaaaaaagttcagtggcctaatatgtttggaaaaagaggcacattggtatatgaaaggctatgaaaccttttaaactttgtttaacttgcttttcgaacctattgctgacatatcgtttgtttctttgcatatttatttattttgaggagcacttactatcactcttcagaactaggtttttgaggcacatattctgggaaaagctaatttacttaattaagctactgttttcagaatgaatcatttaaacttttttcataccttcaaatccaacccaccttgcagagaggccagctcattttatcacagatttgtgtgtaattcctaattgcatattcctacccttcatctttctctttgtctccagacacccaatgcatgtcctccagttccacacctgtctaaacatcctggattctcaaaccttccaaagttcaacctcattatcttcagtctagaatctgcagccccttttggaatccccatctcaccataaactcagtcatccaaactagaaacctcagagagaactctgaatcctggcctgccaccttctcccactccccaccctcccccacaactaaatagatttatgttgacaaggactgtggactagcagacagaaagcctgacctcccagtctcctcattcctccacattttgttaattattgttttacttatcaccttttatttttccttcatgttacaatcacattttatattttcaaatatacaaaatatacacaaaaatataccaaatatatacaaaaatatgcaaaatatattttgtatataaaatatgcaaaataaaaaatacaaaactgtttatattttcctgtgtgatctgtttaacctctcttccactacagcgcatgctccacaagggtatatgccgtttttattttgctcactactttatccccagtgcttagaccagtagacatgtgtgggcacatggtaaaaatccatggtataaaaattgataggggaagctactatgtgaaatcttcagaaagatacaattgatgtatgtatatatgtgataaattttcccatgaaatttttttaacaactcatatgcaaaatgttttaacaatacatatattccttacttaataataattacactattttatcatatgacattgaaggtagtatggtagaaagcaaagaacatagggtttgtatttagagaactctgaatttgaatgccgaatttgctagtcatgcgaaattcacttaacaacttctcttttgtttgtttgttttttgagacagggtctccccgtctcctaggctggagtgtagcggtactagaatagctaactgcagcctccactttccagggtcaaaccatcctcccgcctcaacctccggagtagctggtactacaggcgtgcaccaacatgttctggctttatctttgtttgtatttatttttactagaaacgaggtttccctatgttacccaggctgttctcaaacttctgagctcaagcgatcctcccgcttaagcctttcaaagtgctaggattacaggcataagccaccgtgcctcgcctcactttaaataaagttctttgagtttgatttttcacatttgtaaaacagagatttatacctactcttaaggctgttgtgaggattgtatccaataatgtgtgtatagtattgagtataatgcttagagtaggtgctcaataaatattagttcccccaaatttcttagttgacttaaccaaaaaagaagaactagcaaaatatacttgtcttggtgacttgaagagtctaccagttatggctatttgaagatgttattatgactgatagaaagataaagctgtagtgaccatcgtttggaaaataaggcatttagatatttactagcccatatcaactagtcaatatttactcagttacgttatttacatttcaacttggataattcttctttcttgtaattgtcagtgtttttcaccttctatttcatctttattgattgtctttctaaagtacttctgaaaaaatatagctagtgttttattttcatatctgattatcatactactttagaaacttttattctgttttatgcagatgagtcataattgatattaaggatgggctgaaaaccatctttttggaatgaataaagaaacataatcattaattacacagagctgcactaaatgtcttttaatatttcttttagatccaattttgatatgaaaatgtacctgcatattggcattttacttagtgaaataggctacagaatacgttcaatacagaaggcactgacctagactactttcatatatctaaaaccacttttaatcagacttcatgaccacaagctatatgtggaatgtctcaatacagtatggtttctgttgtactcagacctcagaattttgcacgttacaacactcataatcaaagtacatttcagtacagaaatatcattaatgtcactatttgtgtttacttttagtgctcctcaatttttgtgtaaccaaataggctgctggataatgaatacttatttaataatacccatcaaagaagtcagtgcatatagcttcttctgcaatttaaaactgcaaactgaaatgatgactgtattaaagcacgtaagaaaatatcttcaaaatctactcttaattgctctaaatttaattctgcattatgttcatattcttcatagcattctcaaaatgtattttataatgctttttctcattgttcatagttagataaaattatttttaagcattaggctttctaaagagatctggaatataactcttcatttaaaatatgccactcaataacaaagatttcaattctgcgcttttatacttaaataatgccttgtgatggttacatttttcttaacttgataatagtttgtaatggggacaagtccatatttctttttaaataacatgtttggaaccttaggtgaggcagaaagaggtttttacagtagttaggcaaagagtctctcttttccagtatttacataagtcaacatgttatcaaattaaagagacttaatgtgtgatatagcatagaaagcagaactactctgtatgttttttattttatgtttttcctttatatttttgaatctttaaatagccccaaatgtgatgatggtatgttaagttttatagtggccctgacttttaaatcctagagtaaggacagataccatacatcttatgttgataatggctctagaacctattaggtgcgaaggaaaaacagaaattagaagttgaaattgagaaaagaaacattcattaaatatagcaccatacaaatcagttactaaaaatttaagaaagtctattcacaaaaaatataaaaataatttggccaagttttatggagcattttccgcatgtcaaacattatgctaagcaatatttattgaatattctctatgtcaggcatttgtgctaggtactgtggcttccattacataaaataatatctcccttgttcatatcagttccttgtggctggacaaaaaaaagtcatttaattccataacgtttaaaaggaattttctttatttggaacaaaatgcatgacttggccaacagagttatattttcagtcatatctaataatctgaattcgtatttttatttagagttgggtgaattcagtttttttttcagactaactttttctctggactgagctagaaaaataatagtagatgtaaattcagtcaagatgagtacgaaatgaaatctaccttactggttatttctaatcttgacttggtgaaagctgattgtggtattactcccatctctccttttccacctggccactggatgcacccatcacgctgtaagggttagtttaaatgccaacttctttctttgatgctttccttgtcacattcagataaaactcattcctttctcattgtagtcctccagcactttttacaaatctttattatgagacttactccagtattacaaagttggttgtatatgagttttcccttctgccagatttgaattccccaaagaccatccctcaggcctctcacagactctgaccagtggccactcaatgaacctttgctgaacgaatggattatggaatggaaatactccattttgaagtctgaatgtttcggtataattttatgttagagtagatgcttttttacttgccttttaaataatttaatctctcaaaaatagagattttggacacatatacctttattttactacaatgtttagcttattagtgacacaaatcttaagataaagtaattacactatcttggaatttataataaagaaggtaaatgatgtctggagaaaaatatatatgtaaatatgctgtagacttcaagaaaaatatacttcaaaaaattcagagaaaagtttttttcttttttatcccttgcctggataaaaaagatgaaagataaaaaagtctgaagataaaaatttaattttacaatcacaggatacagaaagaatggggaggatccatgggttcaggatgactgagtttgttcagcaaaaatgtactgaactttctgatgagttcagattttcaaagaataagcatttggaaaagtgatgaaatcctcatgcacaatttgagactggatggtagtaatttagctgatttaaatatggctgatgaactataattaatgaggccgacttaattgatcaatgttaagtttatcaaaaagtctctagtaaagtgccatagaattcagtacttttcccatcccaggagacatttttgtcattggtttagatgggtatataggaaggcaggcttatcagatctgcatgcaacgtaaatctgggtgcttgagcaaacccagtaggtgataagagtctatatccatagcgccttctacagcctttagaaagctgggtcacaatcaagatgaatcaaatgaaggtaattttaaagtccacattcatatttttaaaaaacaattacaaaagttcaggttggggataattaaggaattttgggaaaggatctaaagttttagcgttctatagtggtaattaattatcctactgatctttttgtttgtcagaaccatctttggtagcatattcagttctgagggtgacattttaagaaagcactgacaaaattagagcatctacaggatggtaaacagactgatgtagggtctgagaacaatctggcatgaggaaccattgaaagaatctggaatgtataactcagaaaaaaatagaattaaaagtgaaatgctaaacattttctaaggtctgaagcatatgtccatgcgaagaggcaaaattagtaagcattgttgaaaattagaaagagattcaaaacaagggaaaatctagtgatgagaacttcccaccaagcaggaagcagctcatttctgaatatgttcacatagagctgcatatcaaggaaggtgtagaaggggctcctgaattaagcaggaagttggactagagacctttaaaatatttattctaatttttagatgttcttaatctatgcctaagtatcatagggctttgagttaagagcaaatggcaatatggttcaccaagcatgcaccctacagaatctcctatgttttagttactcaatcccacccatacattatcgcctctaatttccatatttcaagaaataaaataactttttttgtagctagacgagacacaaaagactgtaaagaatttgagtagacaacattaaatgatgtactgaaaatgcacagaaaaataattatccagattgataaaacagcaaattcacattattaaagacattttaaagaaacaggatacatgcatcatgactggggcagtacaatgtagaaagaaaaacataaaaattgaaaaccaagtcccagctctgccttttatgagctgtgtgcccttgcgtaaaattgcttaacttaccggaaccccagtttcctcacctggaaagtggagataataacaggcatcatatagagttttgtgagaggtcaagtaagggatataataccagtgtaaataacttgttaactgtgaaacactttacaaagcaagtagtatcttctctgatgcaccaggcttagtcgctccttgaaacatactgtaaaagactggtctcctaggacctgtcagcttgtgttaccattatttacttaggtctagattagagtgtctctctcagctatatcctagtttttctcgagtacctgggccatcttttgctcattcttgtaacctgacaaccaataataatacttggctaaataaataaatgttgatagaatgaatagatatatggacagaggaattatagtgttttttgtaatccaaaatgaatagctgaaaataaatttctatggatgctcagactatgttaacaagaagtttgctactgagagagggaaatttcacatacttgttttattttatttttttgtcattttaacttacagtagaaacttacatttggtaaaattaatcaggagaaaaaactggacttggtcaaattttgtgtgtgggttggttggtgcaagtgaagcatatcagatttcttatattattttttagataacagtgttgcttatttgataattttttctaagaagttcaacgattttataattaattatctccctacattcgacagtatctctttgaacttattctttagcacagtttatcatccctatttttcagatgaataccgtaaacaaagacatgaatagccttatccaaggtccccagacttgttcctggatggactagaaaaccaaccctcttcacacaaagtgcatctttctttctgttagttagtgttccttccctcttttagataactatggattttaggggctgaagttcagctcaatatggacccagtcaactgtttattgagcagtatgcaggcactgtcatttgtaatgttacattaagaaccatcagaaattctgataagtgcaagcacagtaatgcataacattttaattaacgtaaggactgctttctaggttaaagtcaaaaaataatactaagaacactaaattgagagccagttggtttctaggttctgacagtaaatcaaagctacttttgtatagactctgcagccaactctgccctcagacgctccggccattcccactacagccactgagaaccacatgcatgcactagtgggcacaaactagttctatatttatggatgtttattttaatttcagaaaatgggaagaattttggttggtagtaaatacaggtctgcttacagctagaataaaaaaaggtggccctctgatttacacaggcaatgtaaataacaagttctaaaaacagagaaggagtcctgtatcatttcctacagggtagggaaattagtttgactactgtgaaatggaaagggcatttcataatctttctccactccacacgcctgccccctccctcaccctcccaggcccagccccattcataaagtcacctcagaagaactttcctgccattttaactgtggtaactgttcttgcaccttgcaggaaagagttctgaaagaaaaggacctttagaaacagcagctactcacatctataataataattgaggcccaactgcaaattgcctcagacatatcactaagggaagcaacaaaaatctgatctatgggtcccaaatacttctttccaccaaacacaatatttttagcctaatcttaattgaaccttacagtgctcaatgaatggataattttttatttttttattttcaccattctttaactcataaatagtagtttctttgttttaggatgtgtttgggattcgtatacccagctaattctattttcaaaggtttgaggtttgatcattttttttccctccaaataagagtcatgataaatataaccctcattatgtgaaaatatttcaggtcggctactccacctcatccccccacctagataatctctcagtttcctcccagttgaggaaacagaatgactaatgagtgacagatggacagttcacagatacaatacactctgtaatccaggagccacaggtcttcctatgtgtttaaagggttagggctggagtcaagagtctgcaacgacaatctttaattgggaaaaagggaaatgccctcctaaatgctctttctccacctcccttgttcctgacagtaagtaatggcacaaatgttctaaagtattcttcttcagttttattttgtttaattcagtctgtcattagaaaggctcgcgagctttaggcccgatgattactctcggtgggaggaagcagtgcctctgcagacttgtgttctagacaagcgttcctttatacaatgacggggcctgccatcgtaaatgaaaggctctttaaagagcagcgagggactcttttaagcagactgctaccacgtgcttgtaaccctccagcataacttgcgaggatgagacagcagtgtgttctgccgcaaaggggactattgtcctcgttagcctcaagcaaattgagcctccgtttcgctgaaatacagtagtatttccaaaggattttcaagcagtagttcctaaaattctgaacatgataaaaggattaaaataaggggcttagagtgtggaatttagaactctaccaacccctcaccctaagtcaacatcccaaatcccaaaataaaactccaaatcttatgcattggagggaaaataataaatcacagttagatctaaattaaataatcgaatgcacattaatgaaacgagtgtttattaacaaactcataaaagtttgagttttaaaatttgtgacagctgaattctgatgcatttgtctgcatgaggaaaaggaagaaggatgaccgaaaattgttaacttgatcaggatataagagattttactgtggcccattttaaggcctaggaatgttttgccttttgaaaagagaagactaacacagcaggcttcacattttttatatgggctgctcaagtctgcctggtttgttaaagggctaattttcattctaaatccaatctgtagatgcagtcataaaataaatacctttgtttctctgtatctcatctacataagagatataatttgaatctgagaagaatcaaataaaccagattaatattttgggggcaaaaacatgtttactagttcaacaaagccaaatgtacctaagggaaaggtcaaaggatacttcattccctgctgagcaaatgctcaggaagcacatttgtctacattttcctgtcataacaggaagagtgtaacttcttcctttccacaatagcctaggttttacctcctaactccaatattttctcccccagggccttccaaatcaatccttgcaagacagaaggctgtctcccttatagtttccaaacagttacatttgttgaaatgttatttaaatgttagtgatttctttagttaaactgttccaatttaaaattaaaagtcaaatttccaaacatttagactggttctctaattcttattaatggtccaacatatttcaaaagaaacacaaatacacattacatattatcaatttttaatttttttccttaatgatgtcatttacttaattttttaaaatttttgccaaagccattatcctcagaaaaaataagtttccaaactaccttcaacaagaatacattgggatgcaaactttaaaaataccctaataatttttgaagtagtttcattttgaactaaatgttaaagaagtgcagactgcagaggacatggcttttgaaacaattagcatcatgtcttttaatctacagtttggaagaaacttctcggtgtatgtagtctatttataatgttaatatttttagtgttggtttctcagtaatacaatgtcacacagtttgtgcatttgcaaagctaaaggtgacttgtagcagacagagtggtgtgtgcatgcattcccagaggtgaaaggggccattcagtatcaactttcttcacaaaatgagatacaataaataaaagcatcagattctttttaaattacagttttaagtagaaattatatgagatatacaaattagaactggaaacaataaaaacccttgaggccctcaagttcaaagaagagtgacagaattctagaagtgacaattattcttttccttatgaaaatgttggcctctctcagatttcctaccaaaggaaagtgaatgaatgagattgacgggagttggagcaatatctttctggcagtaaaggagtagatctagctgacataaatataaaatatcatgcaccgaacaggataaatagtaatatgtgtggcacactgttgctgtgatcctactacatggtggggagattatttgtgaattcttttcaaattgctaagggataaaatggaaatgaatggcctgaggccacagctgttaaacatacatctgagcattctgcctactgctttttttttttttttttttttttttaatttggaaactcttacaagtattatttaggtcattttcccttctggttttctttttcaactcttcaatcaccagcaattccaaatctttgaataaaaacttttcccttggtaattttaagattaataaaagaatgatttaacttatatgcatgaggagcttttaagaaggcatccccaatatgtggcaatagaccctataattcaattctgatgggtatgatgtcctaaaatattactatgacacacccttattttatttatatgaaataagtttagtataatttttaatacaagtgttggggaggcaggcatctgttaagaaatgatactaagaaaaaacaatcatcatcatcattattatgaggtatttgcaggcttattttggattaaaagataggaaaatcaataatttttcactgattgagctttttttcactaggtctgaaagagattccagatacttcttgattaacaagtataattcttctacagtatttaaagaaaaactcacaagtctggaaattctgtttgtggaggtggccaaaaaaagtgcatttagcagtggagactgcatcttccatctattctccaacttatggtttggaattcaccgaaaaattatttttttgaagcaattaatttgtatttctcaattatccagttactcacatttaaagagtgaatgtatctctctttcaacaaattttctattaggttattaagatgtaactcccaaatttagaactgtaattaacttgatgaaaaccaggaaaaagtaaggagtaaaattttttctttttaaagagtcacttgagggaatctatacatctctttttatttttcagtttagtgtcgaatagaccagatttagtttgaaaacacatcagtatgtagaaactgtcagaagctgcatctacactgaacacatttttccagcttttttcctagttcatcttatataatttataattcatatgaagagactgagatggggacataagaagagggaaagttagaaaatgtaacagctatgaactctgaattcttttagtcataaggggattctcctgttctattaacagaatgttgcaaattgtctttagtttgtgctccagttattgcactgataattacatgaagttttgtttgctggcaaaaactattagtgtgccagatctgatgaaagaaaagaaaacttaaggcatttaaatatatttctttcttaacttactattttaagccctaactgtgttatctgacaaatatttaaatgtctttttataacaagttgcacaaataaatttgggcttacctctcctatcctttcaaagtaggaaagctgaaattttcaaatacaaacatacaagtaaataggtttaggctaagcatgcctaatttttatatatctttcttcctaatataacagatttctaaatatattgtttgtagaaagagtcatataaggacaatattcatttaaaaactgttaaaggacccaaaattacagctaaataagacaaatgcattcaagtgttctatcccaccaaaggatgactacagttaatatatcttacagtttgaaatagctagaaggaggatattggaggtttccaagacaaagaaatgataaatgtttgagatgatggatatgctaactaccctgatttgatcactatacattatacatattaaaacatcactgtgcaccctatgaatacgtacaattatttgttaatttaaaaaattttaaacacaaaagaaatgaaacaagcacccccaaaaccatctgttcataaaaaccagtttgttgttgaactttttaaacctttgcatatatatgttactgtaaaatacaataaaagtgtcacagaaaaaaatctgtttcaggagcatgattaaaaattggtaccatgtgaaagagggtaagactgcctaactgatggaggtatttcaagggtaaaaaaaaaatgccgacggagagactgaaactgtagtgttagcataagctagaagctggtagtgataaaaatggtgaggagtagttaaaaataatttggtcagtaacatatatttgaaaacaggtcccacaagcataacatttaggaaacgacttctccccatccttgtcataaatcctctgcaaacgtcctgtgtgatctttccttcttgtccacaaactatcctctctgcatcagctcactcctgctctggtatcattctctagccccttgttggcttctgaaggctcctttgtgctcctgctctacctgttccacttttccatccatctcctcaatacccttttaaaataaaaccctcatgaaatgaaggtttaggtaacattctttattgtgctacacagtacaagagttgttttgatagaaatcacattaactataatagctaatggttcaaagagcctgagtcttaataggaatagctaataggtaaatttattgagcacttattatttggtgggtgctttacatttattgcttcatttaattgtcttaaagacctaatgagaaaggtactaactttttttcatcctcactctagtgatgagggtactgctgaagctcagagggtctaagtaacttgctagagggtcacatagctagtaagtggcagaactgggacaagaacgaagtttgtgtgtctctaaaaactatgcctcttagccatttgattatactggatgcagtataattgggaaaagtaatgacacaaaaccatgctcttagttattatattacactagatgcatcatgacataattttaaaaagcataatttgtttcgtgttgaatatgagagatccgggctcagatcttggtcacttcccagttttaactgtacaatcttgagccagttatttagaacttaacaggaccttcaaagctttgcgatatctgggtcctgtctaacatccaatcttttctctcatttctctacagtcatacaccaggcttaagtcccactgatcttccttcagctcctcagtcaagctctttcctctcttaaggaactttgcaaatactgcttctggaatgctgtcacctgcctaactctgaatcatcttttagctcatcttttagcacttcctcaggcctttctccaaccctgatgtaaataaagtacctcctattattctttcatagcacatataagtgaaatttttgttatatatttttatatttcatgtctgtttaactcaatcaggggtccataaactgtagcctacaagtgaaatccaaacgccctgtttttgtcagtaaagctttattggagcacagccacacaggttcatttacatactgcatacggctttcagactactagggcagagctgagtagttgagacaaaaactatatggctcacaaggctaaaaatatttgctatgtggtcctttacaggaaagctcgctgaacccctaaagcagaggataagctggatgagattcttgttcaccactgaatacttggtgttaggtacactgcagtctagtaatatttgttgatttcacagataaatgaattattcagccataaaatgggacttattaataaaaattatttgtaattatatatatatatatagttcttggcacataattggtaactacttttattaggttgtctgaaaatttctgtaagataaattaacaattcataatgttatttttacatacttgcttaagaaatccatgttgtctaagcttgaaactaagaaagaaatagtttttgtaaacttggaaatgccaaaaaatttttttaaataaaaaagctgtcaatttttattctcacctaaactattttacgtattgatgtttctgaatttgagctgtcaatttttattctcacctaaactatttcatgtattgatgtttctgaatttgagctgttccctacttccattatgaaagacagctaaagtaaaggtaaaattcaatttaaacagccattctatttcacaacagttttatttcttaatgatatacaacttataacatcagtgctgtaatatttcatttcacacttgaagtcagtatttctttttctggaaaaaacataacttattctgtgtatagctaaataaacaagtgcaatggcagagcagtctttgacaacttttaagaaaagatgacagtgagccattgcatgaggttctactggacagtctacagtggggcagcttcaaagagggcaaagcatttttctttgcaacatgtgaatacacagttgaaagaaagcccaggttacgggtgcctctacacagtatgatatgctgtttcggatttgctggttttgtttattagaagtgacctacataatttaggctctttcccaaatgactcttacaactgctctcatagtaggtgagaggtgcacaagacaagcatttatatgtaagatgtttgaaattgtcaacagcctctaaaataatcactgaaatatatattaaaacatggtggatttcaagtttactaattctgtttaaaagtattgaacttacaggcctactgtatctaaagactggagaaaagaataaatataccctaaattctaaagaataaaatcaagaaatctgtcttcagaatttaaaaaaatgataagtcaaactaagctgaatttaaataagttttcttcttctaaagttattatgacttctaacctggatgagggtaacagccactgtagctgcaactatatataaaaaaagaaaagatattcaattattagctcaaaagtgcgacattaagattctttgtttgtttgttttttgtttttttgagacagggtctcactctgttgcccaggttgaagtgtagtagtaacatgatcacggctcactgcagttttgacatctcgggtcctagtggtccccaagtggttgggaacacaggtgcatgccactaccacacccagttaatttttttttaactttttaaaataagagattgcatctccttatgttgcccaggctggtcttgaactcctgggctccagtgatctgcatctcaaagtgttgggattacaagcatgaactaccactcccggctttaaaattattgtatccctagaaatcctgtcatttgttacaacatgagtgaaactaactggaggacattatgttaagtgaaataagccaggcacagaaggacacattttgcatgttctcactcgtgtgggagctaaactttttttttttaaaaattgaactcactgagatagagagtagactgatggttactataggctgggaagggtagctgggcatggagtggggaggggataaagtggggatgtttaatggatacaaaaataggtaaaatgaataagatctagaatttggtagtacatagggtgactacagttaacaagaatttatcatatatttgaaagtaattaaaagagtagaattggaatgttcctaatacaaagaaatgataaatgcttgaggtaggtatacctcaattaccctgattttgatcactgcacattgtatacctgtatcaaaacatcacatgtattccatattatatacaactattatgtacccataattaaaaatagaaattaaaaaatcttgtatccctgttttttctaataaagcataataaaagctcatgaattcaacctgcaaaaattttcttctaactttgcaagcaaaagaagatataatgaatatcataaacctaaaaattatctggtattggtaataaagtgcaaatgctaattcatatgtttttgactatactcaaaataggttctggtccaaataacaaggtccaaacagtgttacatgacattcaatatttcagtcttaatttcaatttcaagctataggccaattaaaaaatagcggttttctattgacacaatgattgctctttggcttgatccacagcaagaaacgatgtgcatgaaaacactaaaggaatccaccataaatcttagtattattcaccctctagctaaacatgcagccaaaaatagttcaagttgtgtgtacctgaaaatatataataatttagaggagtataaacttgaaaacctaaaagtttctctactttttaatggcgtactgactttgatgcaagaaataattaattcctattcattatagtttacacatgaaacaacattacatttaaaaaaatgaatcaatcagttctagtcctatttgtatgtccaagaagacaaaacaggacaatagaggacatgagtgtctacatttgtggggaaattacagtctggtggttgtccccagggctactgtgtagccttcttcagtgtaaccgaaaagtaggcaaaacactcttctcttccacagtccagaaacgtcttctctgcaggttccatgatccatatgagatggttgggacccagcagtactataatttctcccaggaccattatttgatatttaacgttatacaaactacccagctgtccttacatagcctaactaaatccactctcccctagtgtgaagaaaaatagagtcaaattgcaggcattcatgatatacaagtctttaatgccaaactgagcatttgaatgtgtaaagtcttcacaacagattaattgtatcacacagacattatcattggcattctagaaaaaaattataacaccatctgcctctatgtttatcaaattcagatttaaaatggtatgaattaaccgatagtccttgcctatatgttttaagttattaatatcttgtgtgggtgttttctttgttgttgttgtcagcacaatgttaaaatgtttggatgtgtttcaaaatctcatttactatgaataaaatgaaagccattttcatacaggatatttatcctatattataaacctttaagtgaatgaccacaaaaggtctagttcccatgaatataagaatatctttgtttgatgatgcgtgcaatgtagcaatgttatgctgattaactcttaattatcaagctattcatgtcacacaactacacttcccatttcaaatttgtgttgaagtaaaaagtgaataatgacaaatgtgtaaactatgtttctgacagataaagtgatttttttctcctttatatataagagactatcagcactttaactggtcacatttaattaacccaaacttctcttaatagatatttacagattcaagatattttctgtacccttaacatatgtggagaaaatataattaataaataatgatacaaaaaaagtttactccactcacctgtctgttacgttcatccataatcctcgtaatctgaatcttttttctccccatagtccccgtttttcttctctctctcgtccctgaaattatgtattttttccttccttttctttctctttcctgtttcctccaaacaaatctccttcttcagcacttgcacagctcagttcccaaattcctgcattcgttcctgctgaacaaaaaagaaaaattaaataccactctaacagcaagtcagtttcataagaactatcatattctaattttatcaaggaaataaactatatggagctaaagcaataaaatgaataaaaataacttttttgttaaaaatatatggtatatcacagacaggagcagatcaagtagttttattttttaacaattaaaatgatctcataagtaatttaacaagtcatttaaatgatgcaaactatgcttttttaaagactaacacttgaaatgtatttttttttgtaaaaagtttcctaatctttttaatgaaattaggtgacaatttcacccgttatgaaaaattacctaaatcagagagttaatgaacctttatgtacctgtgtatgctaagtagggcagctaattcatttctgaagggaaaacaatctcctgttttgacagcagaggtgataacgtccctcgttatgcaaataggatggacgattatgaaagtgctatttgatatatgtaaatgtcaactaatttaaatctaaatcctttaatcttactttaaaaaaattattgctgtgagaacaccttaaaaataatatggaatatttaatcttagattacaagcatctatcagcagtgagatcttttctttttgaaagcccttaaactacatcttagataacaagaatcaaaaaagataagcattgacacaaaataaatggtgcaaaattaagattattcttcaatttataaccatattttttataacaagccatccttcctttaaatttaaatatttagaaacagacatatcatgtctttgtggagtaagatacaaaattgcagaagcttcacattacatactggagatctctgggtcaggaattaaaattagagaaatgatcatcaataacatgagataagcccaagaaacccagaatattaaaagtacatactttacttggttttaaattacatctgaaaatatttgaacacaacggaagttaattgctctgaaatgtgaaagttaacaagaaagcattccacaatgggtttttcaagcaacagctccaattattctacttcgttttaggtcaatgaatgcaacaactttacacactgctcagaatttccctgtttattttagctggtgtctgacaacggacctgataaattcccacatgtattatgtaatgctaagccaatgtcctggctatttaatagattgtttggctccaattcaaagttcttggaacaggaaggctgttacacattcggtctgaccattagctgtcttctgatttctttaatttaatttccaaattctttatcaccttgggtattttttttttttttagtttttggtgattatttaattgcagaagctattatgatataattacttctggtggattaagtgctgcttaaatactaagactatccattctcttttgcctcacgcctctctactaaactgcagctcagttctgcctctcataatatgtatgttgagtaacattatgaccacacagtgctcatcaaaaactattgctccagctgtaattttaaatgttggaggtggttcaaaattctaaagagttatagaaataacacacatttgacaaatacatataaaaatagttataacatattgaaatcacattaaaatatgaaaaacccacaaagcataattgcatcatatatttgatgttgctagacactgtccatctatttttagaaaacgtcttaaatgtcactcaatggggcaactttcctgtgtttcctatagtcttaccttagaagcaagcagtgtgttagaatggtatttcccatgcacgtttaagaccccaaagatacaaacaagctttctctatcacagaaagccaatccatgaatccacagcaaatgcatataggacaatttcctttcctttcatttagctgaggccggtggcactatcggcttacaggactatgcctgcctaagcgcttattcacttcaaggtggaaggtcagggtgagcagattagagtgtggtgataaggcagaagagacaagaacatctacagatcctgatttcaaaatacaaataaccaaacaagcagcaaaacatccttggagaaaagtctcagaaagacagagagagttcctgatgaaccaaacttaggagagttcctccatatcatcaccccatatttcacaactttgaatgagaccatttttaaaaagagcagagcaaggacttaaaaaaaaatttcttaaaacatgctggaaaaaaattttgccaaagagaatgtgtgtatgtatctatgtatatataagtggttgataaaaatgccattgaatatattttcttttttgaaatatgcaaagcaatgtagagagaagcaagtttaaatttcaatagaactaaacttttgttttctgtataaatatttcttgaggtattgccttcagaacatttctaaaatccaaaatttagtatgaagtacacgtgcagagtaatatgtggtgatgatgacactaagtaactggtcatgaagtaaagtctatcatgaaacgtggtttagaacatttgattatgggtcaccacatttcaaggctgtcactaaaaatttaaagaattaggaaggtcaacaatagctcacgcattgttttcttagcacaacattttctctaacctaatttttatgcaaaaactatattaaaaggtcagtttcaagtatcaatttgtaggaggcctagagaggcgaagaaagagattatttaactttagtaatctgtaaaactgttttgtgtgtatatgaaaaaggaatataacagctagcctacatgtagtaaaatttcaagttatgctgagaactttcattacgtacaatcaaccataagcttaaaataattccaacagccttgccactactttttttccacaggaaagaagcattcttagaaaatgacagagctacatataaataatcactaatttaaaaaaaaaaagatgaagaactgctctactatagttacactctatagaattacagtcttctgcattttttttttctaaagaaaaaatgccaacccagataaaagaaaactaaaatgaggctgcttactaaaaaggggaacttcattatggcaggcttctgctcattttgagtttggcataagcaggcagatgaaggcaaagtggtttgagacccaagtcgagaagaatttcttctggacagatgctaaagatcattctcccactgggctatctcatttacaaacaagttcccttgagtgacacatacctcccccctccatttccctcctccctccctcactctttcttgccctcttcctccctccttccctcctacaaatctctcccagtagcacagaagaattttgacagaatggcaggaaacacgcacacagactggtcagggaaggatatgatgtcagcaaccacgaacaataaaaggtgtaaaggtgcttccttccctaaactgttccagaagtgtaaaatgggaaccaaaactctccacttccttctctgagcagaaccgtctgagtgtgctgtgctgcacaccccacacacagaggccttggagaggttcagataagggacaatgaggacaattcagaccgggagcgtgatttttaatttccatctttaaaacacctgagaaaaattcatgtcagctctaggttagtgttttattatgattgctttaagaaatgaaaataagaaaacaaacacattgacttcattgaaatagcagatatatctcagttattgtttaccaggccttacaaaagtcatcgtacacagttaatgcagtcatataattggaatttaccctttgaggcaaatgaaaaatatgcaagcaaagaaccaaaatagatacattaaaacttttggttaaaaaaaagaattatgaaaaccggcaaaaaaaaaatcaatgcatgctggtaaaatatgctaatcatttgtttgctcccacattaaaaaaaaaaaaaagatatactgagggggaaaagattcttatggttattgagtttctcgaggttctttaaaaaaattcaaactaggaaccaaagtgaataacacaaactctgcatctatagtgaaactatttaatctcctcactattaggttctttctaacatggaaatggcattctacataaggtttctgtaggaagaaaaccacatatcaagcgtatctgagtcatcatcagatttcaatcatcttcccacaacactttgatttagaagttaaacataaccttcagttatgtgttttgatcttagagtgaaactgccatgccacattaaaagatgtgggaagaaattaattctcttctgctaaacttatctttgcaaagcatgtatttttctgcaataagtacaatgcagtcacttaaataaaaacagcctatgaataatggtaaaacattgaaatatgtgatgtcaattttcaaaaaaaaattccggttttctttgattcatattagcagatctttttgattgacttacattttcactaacactagtatcctcaaataatgttttgtaaaaactcaaagctgaaaactgagcacactctatcacacaacactaaataatactgttaaataaatacaagctggatacatcgtaaggggcaaaaatgatcataagcccagttgctgcaaacctagtattgctaaatcaaataattaaatgattcattatctttttaagtggaaaactttgctcaatatgttacatctagttacatttaggtttctattttgtgatttgtttgataaaatgtatgaagcatgcaattatattttggttaaaaggaacaggcagaacttttactttttttccattaggagctattctgaacttcaaaaggtataaccaaattactactcctattgatgctcgactgcgtgatgtcttgagttgaggaggatttctttggccttgaaagttgctccatttctctctaagcttaccatgtattttataaatataccattaccttagctatgagtgcattctgagtttatttccaaatcacatacccaagactcactcttctaagggtaataaaagaacagctattcttttccactagataaataccatcatgccatatgccaatttattttcctaatttattccaatttagtatcaatatgaatttcaaaccatcttcaagtctcagtaacatagtaccacatatacaaataatgttgaccatcttttccatttcctcacatctgccatgctccttcctgccactaggcctttgtgtactaggcaattctttctgcctggatgttcctcctttccttttgtacctccttgacttctcctcccttctgtctcagcttcagtttcacctcctcaggaagtactccacgccctcctgatgacatcgaatttccctctcataagatctaagcactgagtccttctcctttgcagcactcgcagcaattgaaactgtatgtttgcttgtcttcctcaacatctgttttatttgtttgtttcaccgttttatccacaatatataccctagtgtcaaacatatagaaagagctaatgactattcgttgactgacaatcagttaagatgtgtatctctcaactgacgtattttcttttcttcagcttctacttttactgactactactaaaaatattttactatttttgcttacacagaagcagattgataacctcacttaatacttcgccatatttacatagcatctcctatgtggaattagaataattgatactgagaattggaagttaaatggattttggggtcagaaaaaacagggttagaattctagcttggtacttggacgctgtgtgactccagactgattatttaatcccttggaactgttgtttccttgccctacccataactgggaaaaaaatcttcatttgtaggatggttatgatcataacatgtggtactatatgtgaatcctgggtacacagtagtactgggaacatggcctgctgctcgtatgattgcttccgtttgaaggcataaagtgaaagtcctatcatatagtaatgctatcaagtgaatagtgtagtccttacatttaccatgaagatctcactttccaaagctaatgattagcaattctgacagataatgcctcatttatcctgtaacaataatcaccaaatgaagaataaatttacagtgttaaaaaaattaagaagtttctcttacatatcagctacggaagagcttcaggctgcaaaagtggaaataactagggaaatacatcaattttccccatgaccacggctgctgaaaactctacattaatgcttctagtcctactttaatatctttccccaaggacaaaaagagatgaaatgtatgtcagaaatataataaggctaaaaaggaactcgttttcttaacccctgcaattaatttaataagtgggcctaacctgccattatccctgacatacatcattttatttacacagttccagaatttaggagacacatacctttatacaattgtattgcattataaacaatttaataactgtgagggaagcacagtctccctgtcatagttatccatggtctattttgtcttggacacttttttcacactgcagctaaaatagcattctctattcccatgccaaaataaactccaaatggtctaaatatgtgaagaaccttgtgctatccaaccctaccacagcttttagtctttccacatcatattaggtaattaattcagggttctatcatgtctttgtttttctaatttttcacaacagtgcagccaccatgttttctttcaaaggcctctgagtgatgtggtagggctcaccacaaaggtaaagcctgcactgtcttatgacaaagcaagagctacaatttaacatcagattgtgttctgttccccagctctaacctctcagtaagcacatgcagctggatttttgttgctgttattgaacaaagcaagttaagcactatacaacatcaacctcagtcaaacaaaatagtctgtaaagcaagctaggctagaagttggagatgttgctattatagattttcatgctattatgataaaaacatctaaattcccaggcatctcatgaccctgttagaaaaaaattatgttcgttatattcttcatctttaatatatcatatttcacgattaaaatggaaatactctaaaaatatttttctcatatgcctataagtgttgaacacatatttcagtcttactgatacatttgtgcatgtgtgcacatgtgtgcacagcacatggaaaaacacattttagtctgtcgaaatgtgtaaataaaacaataagagtacattttaagacacctgagttgtcttgagtattatcaccagtaaataatcacaatattattaagatcgtggtgtgaatgcctaaaaggacgttctcagtaaaagctttattttactctgcattcaaatattatgttaaatgattgaaaattatgtccttgaaaataatttgcttctttcattatttattttccaatttacttaacatttaaagatgaccttgaaatgggaagaaataccattgtccccctgccaatgtttttgttgtacattaaagagaaaatgctagataaatcatctgttatttaagtggaatgtcatttatttttatctctaaaccttcacatttagaaggtttacacagaaactttacatgctcaaatatgtgatgttcaaaatgctataatactatctctcaaaatatatatgatattgctattatatgtggctcaacatggaactcagtgattcatcaatttttctatttctcttcatctcttttacagcatcctaatcaacctaattaaggctttgttcatctgaaacctctgatgacaatttgtttaactctatcccactgtggtcttcttataaggagaattaaatctgatcttctgacagcaatcattaaatgatcccaactggccccaattaaaccacatggctcatgggcttccatacagtcaagtgccaagttctctgtttcattcacacattgttcttggtttattttcttaaagccagttaagcatgtgtcttatcaagtggaactaaatttccttatgtacattagctccagacacagtgtgtcaattgactgcacaccaaagtatcacataggacttctgaagccattctatacagctgcagaggtactagcgaaaaagaatctttacatttatttactcatcctgaaatggacccacatgtacattctcgaaataatacacgtgtttaaacagttctggctaacataaatcaataataacttttatttggcttgcttataatgatcttttaatagaaattctctgcatttagaagttgggcttaatattctattttttttttaacatttgaaattatctctttacctccctctaaaaaagcagtaccaaagtaagacttctgaagttaacctttcttacccttaatttctgctctaattttttcacatatgcccaattgtaagttctgtaatgatgttcccaggccttcctacaagcgcaggtagcctcaggatttagagctcattgattgtgtgctactccagggaaatgactgattaaaaacagcctcatgaggaggagtagctcctattcacatctggctcatctgattctaaagtctaatacctgtatgaagatttgatccatagatttagattttgaacaactgcagcagtttacctagaatattttgatgtcaaagcagaaacagttaaattaatcccactatgactggtgtctgacacaggttctgaaggctttaatcaattaccctactttcttgtgaatataaacaaatacactgtatttatatatatatgctaattatggctatcactgatcatctgctggtacttgatgcaggctgtcacagttctcagagcagatggattagaacatatctgttcatcctaatcatacattaaaaactgttagagaattgaaatacatgctatgcatcttataggacattagccttgatgggacatgtaattgttcttatgactcaaccaacagatgttaactgcaaagaaaaatgaaaatacaatggaatttttaacatagtgataaatttggtaatgccaggaaaaacattatgtgcattttctttatgataattaaatatatacctgatcatctattcacttaataactgtatccctctcaagaggaaaattcaaaatatttgttacaaaatgctgatgatatagaaaatacttaccagccttacaactgactgacttttaaaaatgtgtaataaatgtactaaaattttagcaaagcagtacagacactggatgttgaattatgaaatatttctcatgtattatagtaatctccaataagatttgatgttaattttagagcatgcttctgctaaaaagggcaaaccctgcaacagatttagtacaaagaagctgaaaatatcctgtggaaaaaaaaatctgtagagaaatcagccagcccaaatcctgccattactcagcactgtagtgacgtgcggatgtttgtagtggtttgaggagccagcaggggtggaaactctacgtactcgactccaacatgattgcaattgaacctcatcaaagtaagagctcataatttgtcacagaaaacagccaattaacatatgttagaaaaaggcttcataaagataatatatgattaaagacccagtgcagctgctgaaaatcaaaactatgcatttaaaaaagaaatctcagcctgagcttccgtatggttaaactgataatggctactacgattttttttaagtagaaaaatataattatagtgcttcttataagtttggggttatggcaagggagaactgggtactgtggcactatttactattccttacttagttctataaatagttgaagcccttgccaaaactctgtagttactttgttatagtgctattttaaaacacagaccttcattgtgagctaaatggccttcaggatgcactttgtagttatagcattcctctcaaaactatatcctccctttatctgtgcaaaactccagaacaagagacctctccatgactgccctggctcactgtaaaacatgctggggctgtgtaacacactgttcgaatacttcagaacttctctcagggtggtgggcaggcagggtgacagttaaatgtcagaaatgagattaaggcacacacatggagttcaggtcctctaacagaatgcagtccacgctacctgccacagctttggagcagaccaattacatgtaacatacttggtgtattctgattgtagatttcaggttggagtacatgggaatcaaaccctggctaagtcactgtaatggggtataccatgagccaaaatcatgatgcttaatatcacagatatcaatgacaaaattcaatcagtcacagagacatgaagttgtcaagcatgatgctacgtgccatggacaccactgaaaacaaaacagaaggtctcagtcttcatgaagcttacgttctaaggggaaaaagggcaacacacaagtgcaccaatatgatgattttaaatacagaagtgctatagagaaaatatcgcagtggaatggaccaaggggtgatgaagtggagaagggcagaggtggctatctattgggctgatttatagggaggggttatttgaggagatgacgtttgaggaaagccctaatccacaatggagtcagacattatttggaggatgaatactccgtcactgtgcctgtcactggtggtacaagcctggccaagtcatagttttctaaaccccagtctctttctctatagagtgggaatagtaacaacatacacattctattatgaggttgtgaggctcaaataaaagacaaaaccacactcatttgtaaaaattcagatggatacaactcaatttcatacactaattgtgtaaacttgcttccttcactgatattatataattttataaaaattgtaaatactttgaagctctaggaatatagcataatgcaaaatgtttctaaattgacatcaattgagtccaaaagcatccctcttcccttgaaatgtgagtatttcatgatggcaatggccactggttgaaacacctcttttcatttcacaatgctaactatggataacaccatgaagaatctgataaatacaatgcaaaatttctgcaagtgtaaaatatagaattatataaaaatcacactttttaaaatttgagaaaaaaacaatcttacaaccgtactaatgtaacttgtcagtgggctaggttgatttatttcatctctcaaaggacccaactcccaagtaatcagcagagctttgattaagatgtcagcagtatttgaaaatcccagtgtctcacagtattggaaatattcatgtatctttggacatccccacctatagattaagctgtgtagcctcaagcccaacagattaatttccaacttggaatgaatagacaaattgaattatctagtattttaaatgaaagcgtttttaagaaaaaaatacaggcctggcgcagtggctcatgcctgtaatcccagcactttgagaggccgaggcatgtggatcacctgagttcaggagttcgagaccagcctagcctacatggtgaaatcccgtctctactaaaaatacaaaaagttagccaggtgtggtggtgggtgcctgtaattccagctgctcgggaggctgagacaggagaatcactttaacctgggaagcagaggttgcaatgagctgaggttgcaccattgcactccagcctgggcaacaagagagaaactccatcttaaaaaaaaaaaaaaaaaaggaaggattataaattctaataaatagaaaattaaaggacaacaggctcccactttaatttttaaggttgtgaaacagaaatgcctaatgacaaatgatagtattttaaggaaaggtcaaaatttcctatgccttaaggaattaggggtatatattttcaattctccctcctcttttttggaggaagttataaatagatttgattctctattccaaaccatttcttctaatttcctgtttggtgaacataatttatcagttttaaaatagggtaagttatataatttaccatgaagcctaaatgaacacttatcgattttcatttacaatcaatcaaatgccctacaaaagaaacataaatctgaaagttttttaaaaataaaaactatatttttcttttctaaatgtatcatggtatagatattataacaaaaaattgcatttgattttcttctcagtgctaaccaatatttcacattgcattctcacctccctccctgtctatctagtaggatgacctctgggatacatttgcttcaccctccaaaacccagtcatgactgcatacaaaccagacatggaaatatgagtttctcctctctacttgtagcattccccactccagtttttcatttcatcacctttctttatctctttttccacatgtttggaactgaggggatatggaaagtgaaactgtcaaagagctaggaatagaggtgttctcagacgagcaaaatgtttcctccatacaatccaggcagggcaaggacaggcacgctgcagagggatgttgccctgggccagagtgagctgagacagtttctaggccgaaggcctagcaggaggctccttatctcagcatgtctacacattctgtcccaggctgttttcaaggatagcccaagtcatcctcggcagataacactaaacggaaagtattacagtgcttcccctgtaaaaaagatcaggtactatagatcagaagttactaaaatggatcctattttagcctgattctctcaaacctagactctaaaagaaagcactctcgggtggaggcaagctcacgactttcctttccttagagatcccaaagtgcctaaattagcattccccaaagtggattccagagattactggttcctaagattttaacaagctgtttctcaaaaaaaaaaaaaaaaaaaaaagtcaggaaatcaaatcaaatatatttggaaaactgatttatttgttataggacttttcatattcttctacatgctgaatgtcataatctggactatttcccaatatatttcagatatcccttggaaatgctagctttaaagaaaataacaagcttcttcccattgaccaatgaatacactgcagtgctgaaatacttcagaccaatacttggctcagtgcttggcacaaggaaaatacaatagtattgctgaagacatgataaaacaatggaaaacttttttttttcagttttataaaaaaagtgcaaacataagatcaggtgcagaaaattgctgttcacttgaagtaaaagtattaataaattattttgccattaaagagtgcaatttgtttccaaaccgcaaagcactaagcgcaaagcaatactgcacagtggaaagaaagctccatttggagtcagactctcagttgggttcgctagctgcatatctttgggccagtcaacttctttaagtctcattatcctcagacataaaaagggagccgggttcagtctctaagacccctttcaagttcctaaatggtatgcattcaataaaggaggaaaacaaaacaaaacaaaacaaaaatgagggttggaatgattctcacaaaagtatcatcctacagaaacaataaattgacaagttattgtttggataaatagaattgttttcttccatattttaaaatattgaaggatatgttcacctcagcctcaagcaatataaacagttaagactaaggtttcattatgcactttggaccactaatcacatttagaagtttaataaatacataatagctaggaaaatactaaggtattaaaagctttacatatattaactctaatcctcaaaacagcctatgaggaaggcactattacaatttccattttacagaaaagaaggctggaggacagagtggttaagtaacttacccaaggtcacacagctagtgttagagctataatcaatatcaatatatcaatataccaatattggatcaatatatcaatccagtctcacactcagagaatcgaatcacatactctgttacttctctatgctgctaagtaatattcaagggagtacttaaaacttaaaattctatgtagaaaatgtgatgttcaggagttggtggaatctacaaattatttttaaaatgagtgttcttcaactcatctcacattttcttattcttgatggcaaaaatgagtttacttccctgtgccagcaggggaatagaatgtaagttagatatttgtctttactattataatttactggatgatcatcagcagctgtttttggtttttttttttctactttctacaaatgaatgtgttcacaaggaaaaccaggtaaatgtatactgtataaatcagtatatattcttcacaattcccggaaaaagaaacccaaaagaattgtcttcctgataatgggtcaggagagtcattttcacttatgatgaagttaagaattacacagaattctcatctgagaattacagatgagaattacacagatatctcatccccaaagcttgaagcagtcattttgctttccttcaaagtaccttgagtaggtttctaaaacacacctaaccagctctggtatgaccctggccattatccttaccctcctccccttgccactcctctttttccttctcgttatgctctttctctttcttctccttatctcctcaaattatggtctactacaaatccttctatttacagggaagtttccacttcaaaattttatacagttacctacttcttcagaatactttgtgttttagagctctgagtttaattgtgcaattcaagctctttaggtacattattttagaaggaattttacggctttcaactttataagacacacgcctaataaaatatactaattgtataagaacagctgacataattggcgatatatttataattgttggaaaatactgcacattttggtgcattatagaagttaacatgacagttttttcacaatgtattgtgtagccttgctctatcagagcctacagcatgaggaagtaatcgtgtgtgtatatatatattcagcatttgtcagacttttttcctactttcataggcagaacaccatgtacctatgtttgtacatatatagtacatctatattcacttacataattatatatgttattgtagtagttgatgagaacaggtcagaaccattcaaaaactccataaggcaacaacgccacattatctctctctctctctctctctctctctctctctatctatctatctctacctacctacctatgtaagactgacttcaatttcagatgctaggcagttgatggtgcaaagcgaatgctcaaaatggctgcttctatatcccatgcactccaagaggacttctggtaaacaggaaatctctgagatttgtaattcagtaagaacgaatctgttggcaaatactgcctttcaaagtgaagacacctctaggataatttttatgtccgtgtccctcaggtatgtttgtgggtccagtaataagtgttctgaaaaggaaagagtgtgcatattactcttatatgctaaaaaagcggacatttccatcaagtaactagttcacataccaaattattatttggtcacaatcctgaggattctaactttcaaaattatataagagtatttgtcttttgtatcgtatgaaatagaaaaacaataagcataacaaaacctctaccaagtccctttgaaataaattagttaatatgaatattttgtgtttcactaaatttactatggagaattccagaatggacttggaaatttcaactgccttaaaatgaatctttatgaaaatgataaattttgccatgtcaaaaaagagaaaaaaatcttttcttttggttagaaatacatatttgtattttccattcatctaaggtaagagtagaaacaccggatattaatattggcaagagttatgcaaggtcatatcatttttccctccttcagataataccgtacccaaattatttcacaaagattccacctctcctatttttaaggccttccggaaaaggagcaacataaccttcctcagtatcctattttgatgtttcacaactctcactctcaggaaattcttacttatagctaatccctcacagaatactttatgtccactcctcttgttctgtcctttgtacagagaacaacatttggtgatcacgtcctcatgtcatacacttcaatattgtgtattgctttatgtctgttcttttaatctttccttacgctggtttttattttttcgccatctttgcagctcatcatttcacatcagatttgcctagatctctggagtccaaaaatatacatagtccttgaaaagtgcttttgttgtatattcttatcaaataaatatttttatttatccacactctgcatgaattttaaagtaaatgtttaccttttcacttatttcaattttgtaatttttcccttgccagatttgtttctagccaactcttccacattttgtatttagagagtttgtttttttttctccttggcttcaagacttctgaccacttctctagtttaccaaggttatgctgaattcctatctttcaagggccagacctcaagcactctttatacaggatttgttagcatttaaaatgtaatgactaaattatttaattcactattcctttagctaccattaaaatctgtgtgtggtttagatgatattttcccaatttatggatgaggatgtcatatggaagaaaatcaaaagccttagaaagttgaaattatacctatcctttttccttcacactttattaacaaagatgaaaatattctcatagcaccagttcttatatgatgctatgttgcttaatactcacgccctgaacttttaaagataaataacacatggatttcatggcaatatttccttgtacacttttaagtctgcaaataagagagttactaattgtggttcccagcgtcatccttcatttaagaaatgttatcagtgtgatagttaactcctagtctttactcaaaaattcttaagactaacagcctatggccccgtaatgccattatgttaaaatagttcctgctactgaaatgatcttagggccgggcactgtggctcacacctgcactccctgaactttgggaggctgaggcagatggatcacttgagcccagttcgagaccagtctgggcaacatggtgagaccctgcctctacaaaaaatttaaaaattaagtgggtgtggtggcgcatgcctggagtaccagctactcaggaagctgagatcagaggatcgtttgagcccaggagtttcaggctgcagtgagatgtggttgcacaactgcacctcagcctggatgatggaataaaactttgtctcaaaaaaaaaaaaaaaaagaagaaaaaaagaagcaaagaaaaaaaaatgatcttaggctttagtcaaacctttccaggaggagttccatgaaatttgttttgtttcttagtatcaatggattccataagtcacacatacttgtattacatttcatgtatgtggctacaagcatgtgttcatttcgctgcataataaaggtgaaaaataaagcaaagaagcatttcatttattccttcactcaacaatttttttctgagtcactactatgttcaaggcactattctatgtaatatgtcagggaataaaacagacaaaatttcatgccctggtggaacgtacacactcctgatagcacattaaaaatgggctacgttttattttatcttttgttgttgcttttggttaaacaaattcataaaaatcatcttttaattttgattctccttatccaactttaagccttatttcttagaacttttatttttatactatttgaaatttctcctattctcataatacattcagatttccattcctcatacagatctttctttagtcaaccagatacttctttttaaggcttgtgatttctgatgaagtgttctttgaccatttgtgcaatcctctatgctacatagtatattttataagaaatatcttgtaatatttacaagttctttgaaatctgatccattaaaattcatctttcctattgttggcttcttcagatctttaattcctacctgtatttgggtgctacaatattaagaatccggccaatcaccaggtttgatgaaaactaaactaattaattaataatattttcctagctttactgaaagaaaaaaaatctagtaaaacaagaaagctaactcactttcatgttttctgatattacatgtctgtggaatctgtgactgtaatatttagatatttctattatatgaggatgaaagcaagtaatcaatgactctctaacatataataaaagatagtggattagaaacagtgccattacaaacgtcaacaatatggaaaaaaaaaaagagaaattatacagtgaaaaaaaatttcctgagaattcattcaacagccacaaagttacagtaaataaagaaatgggaaatactgtgatagtttccttgtcataattttaactttcattaagtatgttgaaaaaattcgcagtaggaaaaaggtgagataaaggagaaaacccctcttatgtgtagctagatgtctgccagtatgtcaacttcctagatacatttttcatgtgcttatgagaatctaaataataataatcttctttaaaaatatgacattctgggttaggatctcaataatttgtgaagaaaaacaactttttcttttccagaatccttgaaattaagcgtgggttctattctggaacagtgaaatgtctggactggagagggcacgtgatgatgctgaccacaaccatctccccagagaaacacactgcccctccttcagtcctgctctagaaggagaaggagggtatgacagacagagatcatcagtggctactgattgggagctacaaaagacggagttattttggaacatcctgatatttagggggtggtatcttgtcaaccctaacgtttttcctatctcatttttgggagggatgaagggctttataaaaatctctctagttatatgtgtattttgcttgcttttttttttttttaattctatggtaaaaaaaaaagcatttctatttctatttgggtatcttactccattatccatgtgagatggatagacatgttacatcacgtaaaatattgtttgtgtgttatttaaatttggttccccccaaaaaaaaccctcaaaggtgaaccaacaaattgttgaaattaagctaaaaaaatcaatctatctttggaattctattgagacattgcaaaaatgaggcagaccaattattaggcagacaatttatgttacacaattacatttaaactacatttttcatgtgtctgaaattcaagttttataccttattcattttttctaagactcaatttctccacaacaaagtgagaggtgttaactatgtaatatatatgtttcttctatttctaattaaaatttttattagctatgatctattgaaacaaatatctatgactttctctaatccagaaaattatcatgttaacagattctatttcaagttggaaacacagaagaaaaaaatctgaagaaataaatttgaaaattggcaacaacgtcttaatttgtgtttgattgtttgttcctgtgaaactttttttttttttttttttgagacggagtcttgctgctctgtcacccaggctggagtgcagtggtgcaatctcggctcaccgcaacctctgcctcctgggttcaagcgattctcctgcctcagcctcctgagtaactgggactacaggtgcgcaccaccacgcctggataatttttttgtatttttagtagagacggggtttcaccatgttggccatgatgatcttgatctcctgacctcgtgatccaccagcctgggcttcccaaagtgctgggattacaggcatgagccatcgcacccctgcgaaacaattttaaatcatcctagtaaaagtggtaaaatttaatgagcatgccccaggcatgttatttctatatttcaattggaccttaatctcaggcaaattcgtaatctcatgattatacttcatattatatttctgttgaggaaatcaaggcattgaaaaaatgcacaacttgtccaactctatactgcaagtaagcaacaaaattgggttttgagataagggaggctgactccagagtccaagttctcaaaaaggcctaaggaaatatttttatcatgttgttttaaaatattatatgtcaaagtccgaaatcagttgacagtgacatacatatatcaaattcaagtacaaccacgatcagagcttttatctaaaaatacacctcgaagtttatttcttattagattagagaagggtttttgttttgtttctgcttggttttttgttaccactctttgaaaactgggaaaatatactgctatttgtagttttaacacagtacaccaaaaatactaagtaaatctaactttttctctgattcaaattatatttcttaatgcacttctatttaaagtcattccaaaaacaactcttttcctcatggttaaaattttaaatagtgttatagtataccagcaagtatttacttacaacttataactagggataagatatctctaattttccatttggtgtatgtcagtaatgtaaacataattaggaactctgactatatagattaacttgacaatgaattggaaaaatgtgctgctaaaggttaaatttatagaggaattggtgagaaatgccgtgttctgcaatttattgaacatgtcttatctaataaatgtctatgcctttcttatcaaatgattcttaagagttctgtgtatgaaaatagttcaccttgtgcatttaaaattacccattgattgtaagcaactttttaatactttacaatagataggatactaaaaaacgtcaaggaccagtgaacctgttttaattccatgttaattaatttgaactgcatgtaaaagttgaagccagaatgaacattacaaataacgaacgcttaactgcaactgtcatatcctcccgtgtcaatggtgcctataattgctgttgtcaacagctgcttcaaattgccaaaagaccccagaaacaattcaggaaggaaaagtttttaaatggatccacattatggaaaaaactcttcctttatagtcactgttcatttcctgcattgaaatatgacgtagaagcaactgtaagtaagaaattacgacctacttaagtgctttttaataagccaaactttcattatgtgaaatttcttttttgtagtcatttcagtatcgacataccactaaatctgagattacaacagcagtagaagttttgaggaagagtacactttcactatttgtcatgatcttttccattcatttacctgaatcttacgcatcacagttcccttcctgtgtgataagcttatctaaagtaggaaacaagcaataatgcatatgagtcttctatggtgaacatctcagaagttggtgataaaaatacacatttttatcttacataatctaaataaattttaaatggtaataacactaacttatggtgcagaaaacttttgttttttgagatggagtctcgctctgtcgccaggctggagtacagctcactgcaacctccacctcctgggttcaagtgattctcctgcctcagcctcccaagtagctgagactacaggtgcacgccacaacacccagctaattttggtgctgataatttttataaaatacataataaaagatttttcttaacattgaattttcagcctatatcttcttgatatgtactttcagcttattagaactttgttaaaagtggtataacattcaattacatatttactcctataataaaaataatatatacttcaagtctttttttttttttttgagatgcattctagctctgttgcccaggctggagtgcggtggcgcaatctcagcccactgcaacctccacctcccgggttcatgcgattctccttgccttagcctcctggtagctgggactacgggtgcccgccaccacgccaggctaatttttgtatttttggtagagatagggtttcaccatgttgatcaggctggtcttgaagtcctgacctcagatgatccacccacctctgcctcccaaagtgatggaattacaggcgtgagccaccatgcctggcctacttcaacactttacgaaagtgctacaaatatatggcatttccctataatgacagaaaaatgacagcagcaataccatgtagtaaactgtcatttcagagagcaaaaggaaaaagaaaatcattacaaaaatcactctgtaatgtctttgttagcataaaagaaaattaagcagtaaagttccaaggagaaatctctttgtgctcaacatggtagaaatatcattcaaacacagtttatccctgcagggagattacctgtaatgccgccaaggtcactgtcaagttgtattaatggccatattcagtatgtcagtcacatgagttggagctgccttcttcttttttctactgcataatgaccagcctctaaatgtacactgacaaactgaggtgagtgaatatgtttttccaaaatatagatggaagagtttcattccaccaactcttctattttaattgtaccaaacacgtggaatggatatagtctggcaggaaagaggttttaaatattctactttgaaaattgaaccatttttgaaatggcaccttgaatcttaaagggaattatttgtggctgcattgtgaattttctttcaaatgtacatttgcttatattgctgcaaaagcacaaaatattttttaaatgcaggaatgacgtctttttatatcaaaaatgtcactggaacatggagttagcaacagaatgatttagtattcaatagttaagctctattgcggatttgtaattttcatttatcaacattattcatcatttacagaagaaatgtgagagtgtagacatattggcttttgaatacatctactgactagagagtagcagtcatatttatgtagagtaaaaacagattaacacatcttctttacaggacttatatttaaatagaataaatcacaccctgaaagaataaatgatattctagtatgttataataagacttgctcgtaggagacatctctattaaaaatttatcactttagccctagaataccaatgtagtcctagttttgagattagcaatctattataatatctggaaatttagcaatttcaattttcaatttgctatcagaactcagcactgatttctttgtttcacttacatactttaattcaccaaaacattattgaaatgactgggaaagaaagaagacatgaagaagcacttccctgcttacatcagctgacctggacaatattttaagactatatttagaaaaagataaaaagagctgagtacagcgacaattctctgtgccaacttcctctattaccacttttcttttcttttttttcacttagtaacttgactataaaacacatgttaaaaaaaagggagagagaataatcccaggacctctagatagaattttaacatgtgaatctggtacataaaattaggatacaacatcagacaccaatctatacctttcatatgagaccaccatttctattttgtttatctcatttatatttacacaatttttggtaatgacttggatcacaaatgcattcaaagttcctcacatttgaatttgaacacaaacaatgattatctaaattacaaaagttagagtcaaataaattccacttataaagtacataactaaaaagtgggaatacacaaagtgcaaataaacttcattcagcacgcttacaactatgcttacaactagcgattgggcataaaatgtaactaaaaatccatatataatattttagctgagattttaaatctttaattgtcataacttttaaaaagatgatatagaataatttgccatttaaaaaaactcctcaaaggtaaagagcagaaagacattgtggagagaatctgctggatttaaaaacttaataatgatctgtatttgaaagaccaaagttatagtggccaaaaccattttagtagaggataataaagctagttccagaaaaatggttgaatggctacaactttctagttatgtaacatctcttattttatagaatattgggtaatcttacacggatgaaaaattacatccttaaggtaaaaactcccattttcacacatttctatctctctacatagtaatgataataggcaatatgctaagtgctttatgcatattatttaattcttataattattctagtcataataaggtagataagctgaggcacattttgaaatcttcagtagtataacttctcactccacactgttaactagtgatttgcaactggggtaagcacattataaaaatgggcacactgatgaaaattaagtttggattttggtaaaaaaattgacactcctggggatacaaattccatttgcctatgtcattcttctctgtgaaagagttaaaagattttctatactaatgaataaggtatttagagttcttaacgggtgatgtagaagtaagtagtatgtgttcttggatgacacaaagattcttcaatattggaaaatacttcttaaaataatattattgtgagccaggcgtggtggctaacgcatgtaatcccagcactttgggatgccgaggcaggtggatcacaaggtcaggagttcgagaccagcctgaccaacatggtgaaaccccgtctctactaaaaatacaaaaattcgccgggcatggtggcgcctgcctgtaatcccagctactcaggaggctgacgcaggagaatcgcttgaacccgggaggcagaggttgcagtgagccgagatcgcgccagtgcactccagattgggcaacagagtgagactttgtctcaaaaaaaaaaaaaaaaaaaaattcttgtgccaaatactttaaaatattttaaagtatttttaatttacttgtttctaaataatttaatttgaaaataaaaagcattcataaatccacatgctccaactgcttaacccttaaaattcacatatctaagagccagcacacatgattttggctaatctgttgaattctatgggaaatatctcttctttgtcctgcaaagattgcaaaacttatttgttaaaaataaataaataataaggtcatatgcacataatatatatacagagaatgagtgtgatatttgactaacatgcaatgttatctaagactcaatttaaaaatctacaataaaagtttgaacatatttattctatttaatctgtgtcttaagtgtttaactttgtatcaatcacattcatgattggccattattaaagttttgttttctctgtttcaggcaaatgaatctgcaagctgccttaagaaattatctatcgttaatcaatatttcgaaatgcagaaacttccagaaattagcaaatccagtatactctagatccatttttaatttaataatttgaattgaaaccattaacatttcactccaatacttttttaaaaaaacactgaagagataaatgacaaaagtaaagtcatatttaatgactttagggtagcttgtaggataatgtaggattatgtggtaattataaaatctatttcctagaccttcctctcaaaaggcaaaaaccaaaaatccttcaaagcaaaatttattttttttgtttgtttattatactttaagttttagggtacatgtgcacaacttgcaggttagttacatatgtatacatgtgccatgttggtgtgctgcacccattaactcgtcatttaacattaggtatatctcctaaggctatccctccccgccccccaaccccataacaggccccggtgtgtgatgatccccttcctgtgtgcatgtgcttttattgttcaacttccccctatgagtgagaacatgcagtgtttggttttttgtcctcaaagcaaaatttcttgactgtaaaagcttaaaaaggataatgattgttaattcttgttttgtgtcatgcactattctattcattttacatatattagttcatctaatctccagaaatatgctttgtagtattatgcccattttacagatgaaatggaggcaaagaggacttcttttgcccatggtaagaggtagatctagggtttgaagttacaggatctgactccagcatctgctttttaactattacactaaaaagagtccaacattttaatgaaaaataatggctattttgattgccataagaatgcagcatctgagtgggaactgccaaagtagatgagggtatggaggattcagagttgaagaggaccttcagggccactatgatgcccagaatgcccttcacttcaacatggagcagtaattgtaacctccagatttgtgtacacactctgattttggtgatctctatgacacacacacacgcacacacatatacacatacacacacacacatatatatgcacacacacacatacatataattatttaagaaagaatatatatgtacagttgacccttgaacaacacccacaggttagaactgagagagtccacttacacatgaattttcttccatctctaccacccgagacagcaagaccaacccctctcttcgtcgtcttcatcagcctactcaatgtaaagatgaggatgaagaccttaatgatgatccactttaacttaatattttctcttttctatgattttcttaagaacatttataacattttcttttccctagcctactttcttgtaagaatgcagtatattcctgtccaacgtggtgaaaccccatctctactaaaaatagaaaaattagctgggcgtggtggcgtgcacctgtggtcccagctactcaggaagctgaggcagaagaatcacttgaacccgggaggtggaggttgcagtgagccgagatcgcgcaactgcactccagcctggtgacagagtgccactccatctcacaaaaaaaaaaaaaaaaaaagaatgcagtatataatacatataacacacaaagtatgtgttaattgactgtttgtgttattggtagggcttccagtcaacagtaggctactagtagttaagcttttggagagccaaaagttatatacaaatcttcaactgcatggggggtcagtaaccctaacctccacattgttcaagggtcaattgtattttagtagaaaacttggctactttgcttcatttttgaataatgccatgacttcactttgtcttccattttgatgtcaatcaacctgtacaagtattggatgcagacttactaaacccactcaatataaacagcctatctgctaggatctggctaatttttctactagcttttagcttctgcttgctaaggttctatacgctactattcgtaataatttcacattctcgatgataagtcggctaacttaattaaggtttaaaaattcagtatttggtcatgtacgactccttattttatattttaaaattaaaatagtttcatgcatttatatttgtgtgaataggttgtaatatttattgcaagtactggaaattataaaatgtattttcagcatctcaaagagattaaagtattctaattgtactaaaatgtaccaagatgattattacttgaacctttataatgcaatcaatacaatcagactcaatcaataagtactttatatatctggaatataagcaatttatcaaactatttgtatttttgtttgcaacatttccataatgacaagtgaaaactcgaatgaccaaaagtaattgtacttggcagtcatatacattcctaagcactatagtgacaaaaaataacttactgctatcattatagacatcataacacgattaaaagaattttagaactgtatgttgaactgtatgttcaacattggttagtaacagaaaagatttataatattaaaaaacacatcctttaactaaatactttaaatcttttctatataattaaaaagttaattttaaagctatttcttctaaaaaatgttagaaaagcacacacctaaaagtaccagtggtggggtaaaagttgagatgaagaaaattcataaaacatgatgagaaaaggtagtcagaattgcactctaaacttagtgcccaaaaaagaccattcagagtagtggtctctctatttatttgaacactggattctggttgtattaaccatcacttgaaataagtatactgtacaacaataaaactttccttaacaaagatttttattttaattattttatttttccaagcgataattaaaatggtgcatgtgctgctcttaagaatgtagttctagctgggcacggtggctcacgcctgtaatcccaacactttggcaggccaaggttggcagataacctgaggtcaggagtttgagaccagcctggccaacatggtgaaaccccgtttcaccgtttttgtatttttaggagaaactaaaaacacaaatactaaaatacaaaatacaaaaatgagctgggcacgatggtgcacacttgtaatcccagctacttgggaggctgaggcaggagaatcactggaacctgagaggtggcgcttgcagtgagctgaaatagcgccactgcgctccagcctgggggacagggcaagactctgtctcaaaaaaaaaaaaaaagaatgtagttctagccagacacagaggctcatgttggtaatcccagctctttgggagaccagggttagaggattgcttgaatccacaatttcaagacaagcctgggaaacatagcaagacactgtctctgtaaaactgaaaaaaattaattgggcatggtggcctgtgcttgtagtcccagctactcaggacgctgaggtgcgaggatcacttgagcctagaagttcaaggctgcagtgagctaggatagcaccattgtactccagcctgagcgatggtgagactccatctgttttggatttttttgttcatttgtttttaaaaaaaagtaaagaaaaagaatgtagttctagctgagtgtgcaatgagtagtgagatcttctaggctggacttgtatacgtttaaacaagagttgattaccaaacagctgtgtacacagggtagccagggagcttccattaggaccattaagaagaaacgttctgttagctccataatgcctagacatttagtaagttgaaacagtataaagtcactataattaaatgggcacagataattgtaaactgcctgcaaaagtgaaatctatgcaaaataaaaatgacaatcattttaggcaacaatattattaaaacaaatatatcataaagactgctggtgaaaagtaaaacttagtgatttgaatatcattttgattttcttattcccatcatcatctgatattaaacagcaatggaaaatataaaggcatgatttagcttttattagatgtccacgtaatgaatttataaaagatataaaccctttccaatgtacttgaatcttcagatatttacaggaataagcgatccacatggtcagatgctcatcacaaaacaaataaaacaatttacatgaatgctttggataaagcttaaacttcaaacaaggataataagatgtactatgtctcctaataaatcataaatgtgtctttcaacattgttttatcagtgacaacattattgttatttcatgacctcacttgtgacacaaacaagaaccacaatcattcctaatttttacatgggggcaaaatctgaggaagaactgtaaaattataatttaggaaagaggtggaagcattctttatctattacctgcatgtaaaatgaattaaagaccattgagagcagctttttgcagctatataagaaccatatttttggtgagaccaaagctttaatctatgagacttctaaatctcagttttcttctctgtgaaatatgtattaggatacaataaatagatactattgccatgggtttatagagtagttatgatcaacatccttcagccagtcaggtagtatagcagatgtggtgcaaaaaataatttgttagttgagagattagaaatcaatcaggaagtatatcctgaatagaaaggtgaataaaacttaacctctgcacaccaaagagcctacattttatcaaacttggaaagatactttaaaaattaactttagtacaatgtagaaattagtaaacaccataaaagagacactcaaaaagttctctgaaagtcagatgtgggaaagataacaccattgggaaaagcctcatggtggaaatacttcatcaactacttttcctagatctctctcacctgaattaggataattattacccttcattcacttgcttcaaattaattcaacaaagatggaacatctattatgtgtaacagactcatacagaccatagagaaaacaaagatgagtaaggtgcagtctccaagctcaaggagtttacaatctaacttgggttgagaataatgtacatttgtacattatttccattttacagtgctatgtgcacatatcatttcacacagaccttgagaatcatgtttactgaagtcacaaaagttgatatttttctactgtgatatgaaaaaaggactgcaatgaatcacaactacctcagtagagcctttagggtcttgtgcttccgagaactgagattcattctaattttagtatttatgtgaatggcttgacccattctagaatagcttatgtgtggtttactacccaaagtggttctatgcacaataaaggagacaagcatggcaggaggtacacagaaagggtgctggaccccgtgctgtccttgctgaagaatcctgaagaagagacacaaatttaaaaagaagctttggaacttttcctcagctttatagttcatttttaaacagctgtttttaaatgttgggatttgaaagagttttgctaagtgctatatagaatatataggaagcatttaaatatatatccatattcaagtttattttcttaaataatttgaaaatatttttatctataaaacaaattacttccatttttagaaaagcatcattacatttttttgaatagcacaacatacagtaataagatgatatacttcttttaacgattttggatattttttccttaactgttcacagattatttttctgatacaaaagaataaactagttagttggataatttaaaagccagtgaataaaataatgcttttcatgttgcatgatttttattccctttctgatacagtttggctgtgtccccacccaaatctcatcttgaattgttcccataatctccacgtgtcatgggagggaccaggtggagataactgaatcataggggaggtttctcccatactgttctcctgatagtaagtgagttctcatgagatctgatggttttataagtggcttccccattcacttggcactcattctctttcctgctgccctgtgaagaggtgccttctgccatgattgtaagtttcctgatacttctacagccttgtggaactgtgagtcaattaaacttcttttctttataaattacccagtctcaggtatttcttcatagcggtgtgagaacagactaataaagtaaattggtactgcagagagtgggacactgctgtaaagatgcctgaaaatgtgaaagcaactttggaactgggtaacaggcagaggttggaacagtttggagggctctgaagaagacagatttgggaaaatctgaaacttcctagagacttgttgaatgcctttgaccaaaatactgatagtgatatggacaatgaaatccaggctgaggtggtctcagatggagatgagaaacttgttgggaactggtgtaaaggtaactcctgccatgttttagcaaagagactggaggcattttgctcctgacctagagatctgtggaactttgaacttgagagagatgatttaggttatttggtggaataagtttctaagcagcaaagtgttcaagaggtgacttgggtgctcttaaaatcattgagctttatgcattcacaaaaatgtggtttgaaatcggaacttatgtttaaaagggaaacacagcataaaagttcagaaaatttgcagtctgacaatgagatggaaaagaaaaacccattttttgatgagaaattcaagccagctgcagaaatttgcatcagtaacaagaagccaaatgttaatcaccaagacaatgggaaaaatgtctccagggcatgtcagagaccttcatggcagcccttcctatcacaggcccagaggcctaggaggaaaaaaaggttttgtgggccaggcccaagaccttgctgctctgtgcagtcttgggacttggtgccctgtgtcccagctgtggctaaaacagcctgagggaacagctcaggctgttgcttcagagggttcaagctccaagcctggcggcttacacgtggtgttgggcctatgggtacacagaagtcaggacgtgaggtttgggaatctctacccagatttcagaggatgtgtagaaatgcctggatgtctaggcagaagtttgtttcaggggtggaaccctcatggagctgctagggcaatgcagaagggaaatatgtggtcagagccctgacatctgtgtttccactggggcactgcctagcaaagctgtgagaagagagccatcatcctccagatcccagaatggtagatccactgacagcttgcaccatgcacctggaaaagccacagacactcaatgccagcctgagaaagcagccaggattggggggctggggggctataccctgcaaagccacaggggcagagctgtccaaggccatgggagcccaccttttgcatcagcatgaccttgatgtgagacatagagtcaaaggtgatcattttggaaatttaaagcttaatgactgtcctactggattttgggcttgcttggggcctgtagcccctttgttttggctaatttctcccagtttgaatgggtgtattttcccaatgcctatactcccattgtatctaggaagtaactaacatgcttttgattttgataggtggaactaactaacatgcttttgataggtggaagggacttgccgtgtctcagatgagactttggatttcgacttttgggttaatattagaatgagctaagactttgggggactgttggaaaggcataattgcattttgaaatgtgagaatatgagatttgggaggggccaggggagaaatgatatggtttggctgtgtccccacccaagtcttatctcgaattataggtcccataatccccacttgtaatgggagagaccaagtggagataattaaatcatgggggtagttcccccgtactgttctcctgatagtgagttctcatgagatctgatgtttttataaggggcttactccttcgctcaaaacttattccctctcctgccaccctgtgaaggggtgccttctgccacaattctaagtttcctgaggcctccccagccatgtgaaactgtgagttaattaaatctcttttctttataaattatccagtcttggctatttcttcatagcagcgtaagaacaaactaatacacttcctttcttcagatttcctgtaaagtagctgaatgtgtgcttaaattatggtccaagtctagaggacgcagagaaaaatctcaaagcatgattttaaaaacaatgaaatttataaaacagcaacaacaaaaactctgtgaattaaatacatgcagtattgtttttagactcataagaatatccagcaaagtattttcttcctattaatttaattttgacaaattgaggcatttcttgataatgaaatccaacttgtgaatatgtacttcaaatcaactcaatgcatacatctttcctccttgcaaaaacaggatctcctcaatcttccctccacgctcctacatatgcctatcacctcaagaccaacctctacattcaagcctcaccaatcttttttcctgtctctcatataggaattcatgtgtaatattcacctacaatatattcaaggtacttttccagtcatttcaggggacccttaaagaagcaagactccatagagattggaataaagggggtgacagaattcatttgctcattaatttagcaagttaatcatgggccttggctgcatttatagttggtgaccataggcaacaaaacttaaagcccacctgggatgtcaggaggaggcagcccagtaagagttaactagaagacaaagaagggagcaaagtgcatttgataagggtatggattctgggacccacccacctatgtccttatcctcattgtgtgcagaccttctctggccctcacttacatgcacacatccttgtcagtttcctaatcctggatcagttagttactccttggagaaatctctttctcatgtgttctgcatgtcagctaaagacaactaataaacatttagagtgatgcttattatacatctgcattaaggaataaaaaacgctatttttaaaaaaaacataaactaagaatacttgaatctttaagcagtaatcctcaaacttcacattctaattatttaaatatcatgttcaaagttctccccaggaaggtagtagtgagacgtgtattttgaaggagcactgcaaaccattctgaggcctatgtatggtggattacattttgcacatctcgacattgttttcattgtttccacaaaaattctgcctgtctcgtcagagtgctttgattaagcattactggttatggcaaacttgaactatataattgttatttgtattacaacatccatatggcttcttactatttttaaaattgttattaagagtgtacactaggtatttgtgggttcatgtgagaaaataacaagcatttaaaaaactctttccatgaaaaaataaattctggattttccaacataactttaaaacagaattttgggatgcaaattattcataagctgcagtgtgacggtattcctgggaacataatggtatgttagagtctttactcaaaagcaagacacccagtgacaaggcacattcaagctcttctgttaagatcccgctcaagtgttttctcctttgtgaagtatttccagaatcctcatgtagcacagattaggctttttatttcctgtgttatcaaaaatgtagaaccagcatgcaaggaaaatcaaggagaatgccgtttcacatatgaaagttcctgtattaattaactgaagatgacagtgttctatagcaagaggaaagcattaatgttttcagtatcctattttagttcatacctgacagaatgttatataactgctacaacctcatcctaaaagaagccaataatttgaaaattagattgatctaattaattgtacacattgggaagttgcgctcaacgagcaaaaactctttgcagacatgacagatgtaaagctaatggctacaagtctgcaaaaatatttgctcatttatgaacaagtcaacaaatttgaggttttattttcttgtgggagtcaattcagaagtgttcaacaaaaatatattttagtttattttctttttaaacagaacaaacacattggatactgtagcagatactaatattttctttaaacagcttcataaagttcgatagggcaattcatgataaagtttcttaaaccatacaggtctaatcattttattaaatgctttctctaagtaggaaagagtataaatttcctttaggtaatggaaatatgttacatttttatggccaattcagccttctaataatgactggaaatgcctgtgaaaccctatgtttcacaggtaggaaaggacaacagtttcttttacataatggcaatatgttccatttttacagtaggttccacattctaataattatggaaagtgccaaagaaatgaatgaagtaccttctaattttcttccacttctgtaaggctggtaagggggcaatcctgctacttctaatgtggacaggtgaataaatgcatgaaactatttgtatgcttttttttttttttatggtaaggtaggtttttggcaaccttgtctcaattgccaggaagctgtgcctgctggtcataatggtggatttgtccattctctatttcccttgacatttcccccctctaaaatcataaaacaaaatgaaatattttgtttttagaaattgtaatttttttttcactttaaaaaatgccatattccagggcttacctttcagacagtcttaggttatgtctgtgtgccaaatgcagcccaatggggtggtcagattcacccagcagagctgccccgctcagcagagcctagcagctatgatctggaagtgttggccccaccacatgcatgacattaagatgatacatagcaatcctgcaagactacagtttaagtagagcttccaatttgctgtggttggcatgacctaattctggcttgaaaggtacatttttccccctctgggtttcactgactacacattggagaaaaaaaaaatgttcttcaagggattctctttcctttcttaaggaaatttagagaatttaacaactgttggcctctggctaatacccaaactaaagtctttttccagcttcgcctacatcttgacccctcatgccaaatattttagggagtctatttataaagttcatcacttcccctgttacttcatctttagaaatgccgataatttagaaactggaatgatgcggctggtctcacagatgaaaaaaagcaggattctatagaaaattttcctgtcataacttaagaaattaatttattttcttctcaattctacagctagaatggaagtaacaccaatgttctgcatttgcttcaccctagtgttcaaagatgtttcaaagttgtagagattttgaatgttccactaacagtagttcttaatgctgactatacatttcaatcacttcaaacactttttaaaaacactgatacccagacccatcccagactgatgaaatcaggattgttggaccaggttccctggcattgttacttgttaaaaactctccaggagattccaatgtgaagccagatctgaaatgaatcatattaaaactcttagaaacataaccactgcaacacaggtatgttgttgcattatctcccttggatgtggtatgttcttgaaatttaccggtctatccagttctgagctaattcacctgagagagtttctcagctactgcacgaagtgagagaaaaaaaaattcatatggacaacctgacacttaatagatttataagttaaaatcacagaaagctttgcctttctgagacaacagtcctgataaatatgccccttttctgcagaaccagtattaggaactttcaagggcttgcaaagtaatcatttttatctggatcatattgactctttggagggttttcagttgtatttaaaaatataaatttcaccttgtgatatttactgacttgcaaatctctaatagtatgctaattaaattcaatgctgtatacttaatttactcaaggtgataattttctaattgcatgtatgatgttaatgtattatctatttgagatcaaattcactacattttgtgacttccaaaaaagtcaatccattagaccaaagttctcagtctttcacaactaatttatttctctacctcagtcactgggaaatggtattagtaagcagtgcaacccagttcttccacctccctccacatgaaacaggtcttttttcattaagtacctggtttgtgaaggtaacgttatctagcagctgcgaccaaaaggtttacagacttggaattttgttccattatataactgagatcattatctaatccctgctctttacataaaactttatgtggttcattttatggtaaggcttcctacgaaataataaaacaatctttttctatagaatttgtggaactagtatttttattttcctgtcatgtcttgccttttctgacttctgtcatacacacaaacacacacacacacagagatacatgtgtatgtttgtttggcaacataggagggacaagcttagtttctcgtattctacgtgtcttataagatcatggtttgctatgtttacagatttatccccttctattagagtacccgaagttcttttaaaatatacaagatgttttcctactggtatgacatccctgaagtacttgtctttctttagttttattcttttagaacaagaaggaaaaaaaaaacccgagaaataacctttaaagttttttaaaaattactttgtaagagatgtaagttgaatctcctctatataaagtattcttgggtagctccctgtttggcccttttctcttattcataacttgtcccatatcccttgtcaaaacagtgggttgcaggggaggacccggatcaggccatccttcctttcagctgtgtctaggaaatagggcaggagtgggcgctgaggaggagtatgtcctcccagttaccttgagatctgccacagtgaggtttctatggcataccagagaatggaaagaagattaggttggcacttcctacttctgataccatcttcacggcttcattaggtgcccccaatttccacagaatctgaagttctgggcaaggcctgcacagcttttctaaatgagaaagcaaagttgagaatatggcaggccatacgaaaaacatatgaaagtctgctatgcttccagagggcagactagcccccaaaacttttttctggagtactgccaggatttgactcatcatttaagactcaccttaggcatccttgactgaagattgacctaaccagtcatctcccaaaagagctgaacattctatcaattaagcgtttacctcattttcaacatgcctgcagtatagtgtttatcacattacatttataattgcactttgcatattcaactccctcatcagactgaattcctcaacaacagagtttccatctctcacttttgtatccctaatgaaacactcccatgaaacacttagtgaaaagttgactgatgtgttaataaatttatacagttgacgtccaagaagtgttgggcaatagcagtagacattttattggcagagccaaaggtagttttcaatttataggtttatttgtttctgaaactgtaagaatgcatggatttgtatgcccaagttcaagattcactattttgaaatatacaatacattattattaactatagtcaacacactgtgcaacagaataccagaacttattcctcctcctgtctcacagaaattttgtacctgttgacctatgtcttgtctcccctttccccatccactcccgcctccatttctggaaactgcctttctactctctacttctgtaaattcagcttttaacactacacgtacaaatgagatcacacagtatttgtctctctgtgcctgacttatttcacttaacgtaatgtcttttaggttcattcatgttgcaaatgacagaatttctttttctttttttttttttttgagagagagcctcgctctgtctctcaggttggagtgcaatagcaccatctcggctcactgcaacctctgcctcccaggttcaagtgattctcctgcctcagcctcctgagtggcagggattacagggatgtgccaccacgcttggctctattttgtatttttagtagagacgaggtttcaccatgttggccaggctggtttcaaactcctgacctcaggtgatcttccagccttggcctcccgaagtgctgggattatgggattacaggcctgagccaccatgcccagccatgttttctgtttttttttttgtttttttttttaaggctgaatggtatttcactgtgtattcaatgttctccacacaaagaaatgataaatatttgaggtgatagttatgttaattagccttatttgatcatgctataatgtatacatgtgtggaaatatcacatgtaccctatcaatatatacagttattatatgttatttaaaaataaaaattcacatttatcttcttttaactagtggttctcaacccaagctttacattaagagctcccaggcagctcggagaaactgcaatacctggatggcaggccaatttaatctgaatctgggagtggaacttgggcattggtgtatgtgtgtatatatttgtatatttgtaatatgtgtatttacatatttataaatacacataaatataaatatgcatattataaatatacataaatacacaaattatatatatgtatatttatatatttagagaccaggccttactctgtcaccagattggagtgcagtggcactactatagctcagcacagccttgaagtcctggctcaagagatcctccagcctcagtttcccaagtagttaggacaacaggcatatgccacaccatcacgcttgttttttcaaatttttttttttttttttgagatggagtttcgctctgtcgcctaggccggagtgcaatggcgcaatctcggctcactcaccgcaacctccgcctcccgggttcaagcgattctgcctcagcctcctgagtagttgggattacaggtgcccagcagcacacacagcaaatttttgtatttttagtacagacggggtttctccaggttggccaggctggcctcgaactcctgacctcagatgatccacctgcctccgaaagtgctggggttacaggcatgagccaccatgcctggccatttaaaaaaaaaaatttggagactggatctcactatgttgcccaggctggtctcaaactcctgacctcaagtgattctgtagcctcagtgtcccgagtagttaggattacaggcaagagccactgtgcccacctaacatcagtattttaaaataattctccttacagccaaggattcagaaccacttatctaagctaactgttcaaaggaaatccaatgttttatacctatgaccttgtcacttggcatataccaaagatcagttacagcccatagttttctaacgaattctgcttgtgagaaacttagttgattttagtctttggatgattaaattttttaaaaaggcttttgaagtgcagtattagctacatcgcaatcttcttcaaggaatattactaataagtttatgcaattatcttttatagaattagccaacagctataacttcctcctcagtcttagggtaatccaggcctttacagtgaataattatttcctgcatatttacaactcaaatggatattaatataaatatggtgttttatggagtcttagagcgtgctttacagttagaagattccaaagagacagaattcaaacaactttagtcaaaatcacattaggaagtagatataactggcctcagtggttttgctggaaagagaagaatgaacactgagtgttaccaatgggacttaatattgcataaagcacacaaaacttccccgccagtgggcatcgtaagtgacaggaaggctgtttatcactgaaatcaattaattccaaataacacattgaatccccaaatctttaagtcacatttcttttcttttttttttttttcttttgagatggagtcttggtctgtagcccaggctggagtgcagtgactctatctcggctcactgcaagctccgcctcctgggttcacgccattctcctgcctcagcctcccgagtagctggggctacaggcgcccgcaaccacgcccggctaattttttgtattttttagtagagacggggtttcaccgtgttagccagaatggtctcaatctcctaacctcgtgatccgccggccttggcctcccaaagtgctgggattacaggagtgagccaccgcgcccggcccaagtcacatttcaaatagacgaatttttaaatacagagagcatagattatttgcatgcttgcatggtaatccaaacaagcatttcattctcttcaacagtgaaacaaagcggaagcaaatgtagttactaatatgaactgtggaaatttggcaaggaatccatgacattaaagatatggtagctattaattttgaagtccaaagcttgtatatctggtaattcagaaatatctgagtcccatttgacctctggccagcctctctgtcctcacttctagtcagcagtacggcaatacttttatgaaaaaacaaggaaactgtttattagaataaagaaagttcatattgtttctcatggtaaaaattctaaaaatgatccttttcctttttcaaaaggtcttttactgaacccagaaaaattcagttaaaagctaaaagctatgcacttgatgaataaacttgatataatatttcttattttcaaatataatatgaccttgttctaactcatcagtagttatttcacatctaactttggttttaaagttttgttgttttccttttttaactacaaagaaaaagtttaaaggtgttcttgaagttgaattctctagaatatccatctgcactaattaaatttactgaataactcctgaaatccatttaatattcatttataggctctgttatacatctcacatttttgaattaaaaccatataaattactatgattcttgcaaatgaaggttaaaaattaaaacagctcaagaaatgaatagcaaagtggtcactagacagtgatgacataaaacgagattttcccatttcaattaacgctaatatcgtagctggaaaaatatattttcgcaaatagtaagacattgcttgtgaaaagatttatcaagcagttgataatatatgtttttctcacttcacatcaacaatgtggaagtatatatcacaggccaagaattaatacacttctttttaaaaacaatacaaacatgtttacacaaacttagttatattgtcattccaaggttactaaatatttttccctaagatgccaggcaaaattaagactcaataattgactctttccttcttcttatctaacagataagatcatgtatgtgagattttggcttaataagaagagagtggacttgagactatctggggttgagattctaggtctgccattaagtgggtaactttggacaagttactttgtaaatttttacctcagtttcctcatctatataatcgggatagtaactgcacctacctcattaagttttgaggaataaatgaattaatgcatataaaacttcaggcctatagaatagtgctcaagtatacggtatgctctcaaaaaaatgttagctgtggtttttattgtcttattataattagtaattctttcaaattaataatataagcttttacacacatatcataaaagttattaaaattattagagatattttgagtagtgacgctgaagaaagtaaaagtggaattcctaagtcatacttgaaagtatcaattatatttatagaagatcagtcctactttcaaccaccaagccagcaagaattgaaaaccaactggtcaacatatgtcgatgcagatggaaaaaggatacaactgtctttaaattccctaaagaaagctgagtggagagccttctggtcactgcagtccaacctatcattacgcgtgcagcgagactctttgatggatttcttagtctgtgaataatatatattttggggacagtgtcacaaaaataatctgtctttgctccaaaaagacctatgactaagcaaacgcaaagaaagaattacctcccaaccacaaaggagggtggtaccccctgtgttggaaatcaagacaactggcaaaactttaaaaagtatttttgagataaaaatggccccacggtgcatatcctggagaaccaggaaaatttcacgtttcggaactactcttcctttaactttaaaaaataaagctgggggaaaaatatctgattacttctttatgaagcattactaaataaaaaagcctacctttttagaagatctggtatttacaagcatttcacaaggcaaaacacaactgcaaatattcagtttcggtgaatactgctaagaggcgtaagcttttcccccagtgaaatttgggatgatatttacactttgagtgatagaagattttaaggattagtaaatcaggataagtataactaagtttgcctctggagttttgtcttgaaaggatgtcatgtatattcaaattgcagcaaaataaatgattctgcttgttctccaagtccgtgtgacaccccccacccaatactggcatagttagttagtgaggctgtctactttcttgtaacacactacaattctcccccacctctaccaccggtactttaaggagaagagagagaggctatgacaacccacatgattcaactagaacattcttatcagttcaccacctatgattcttggccttttatgccaagagcaaatattccgaattacccaaaacaaagcaatgaaattacttacaggttagataaaaagtcgagttatctgatgtgtaagattacagataaattaaaatgttggcagtaaaaagtgaactccagaattgttctttatgattcatcttaaatctatgtgctatgttcacatcgtcaaaaaacattataaaatcaacttacaataggcacgtatacattataatatttgatataaaacaaggattcctttttctttacgaattaagaaaacttactacaacaagcacatgatagaactctagaaagataatttagcaattaatctatatgatgtgacaacagtgccagtgagttctaactgtaaattattatcttgctataatggcaaagttgtttcacaaaggtcttaatttatattgctggatttgtctatgtgacaatatatcagtttcacaatcacgttatgtcttaaatgtattttgtaattttttcctaggcagaaatctaaaactagttttcatatatatatatatatatatatatacatatatatatatatatacacatatatatatatatatacacatatagcttcatttgtacaaattgtcattccttaaaatattttcttaatctgcatttttagtgcatgtgaactataacttatttaaaaaagtttaattttcctgaacgttgtattgttctccaagtcaaaaattattttaaaatgctaaaactagcacttaagtacctttttaaagccttcaattctgggagatatttaaataccatgaactgtacacaacatgtaaatatgtccattatctatctgcatatgcagtccctacttactacacatacttgacatttcaaattctgttaacttactacacttattaattcagaaacgaatgcaacttccattgctcaaatttttttaattcacatagtaccagaaaaattattttttatgaagacaacaaaaactgattttttattaagaacagtcaatagaaatagagaaatcttaacgaacaaaaattaatttcataactaattatctagtatgcttttaaaacatgcatgcttacaaaaataaaatgtcacattattttgtgaaaggatggtgtatcacgcgtctctatatgggctaagaaagttttggtagtttaactactttgggtttaacttagtggtgtcaaacacttagggaaatcagtactatatatcagatcaaataactggtacttacggccatatcctaagtattctattacaatacattttttaaacaatgctttgacttgagtaggaaggtaggtttgcttttagtatgagggaagatatgtattgaaggattatgcagtaaatttcataattggaaatttaataattttatctaaaaatctttggtttattttaaacaatcctataaaaatttactcaaattttaatataatacatttcataattaaagatgtttgtgaacttttaaaattttatttttaatggaaagtaaatatttggtcaaaaatatgtttggaagaaagcttttggtttatgaatataaaagtttcttagaaatctcttaagggctgagcacaataaaactagggcaatgcatatattctcagttactctttaaaaaaacctgtaaaagtgactatagtggcatgttctgacacattcttttcataaaccgaaccctgttagtgacagcagaacagattgtgtgcatctgctgggaatgagccagatgacagtggaaaaacgcacatggataccttggcacagcaaataaaaaatggagaaaaaaagacctggaagagaaagtgttcaactttaattgaaacattctttccaacatgatgaacatcatccaaccacctcttttagcctgtcaattttacatataaaaatgtgttttaaaggagttctttgtaaattagagctgttttgtcctctctcagcactaaatattgactccggttttgggttatttcttcaaattatggcaatgtaataagcattagggtagaaaaagaggccaaaccactctaccacagcctggtacaaaaacactaaacttataaaaaccctttcgggttcaagtcaaattttaaatatctggggtaagtttttgaattatgtgggtattgtattgacaagtgccaaagatgccacaattcaaatattctgcaaatgtgactattgtaaatgttgcttgtgctcaagagtgctacaatattttattttatgctgatcaaccacagtattgtttaaacagttggctcaatagcggtagagaggtccatacataaaaacaaatgtgcttctataaatcatatcaagaagttttctcggatgctctgattacaatgaaaatttattctatacagttacaatgcaaattttaaactgaagatgaagttgtttaatagattagtagtctgactgaagcagctgcagtcaaaaaaaattctggtgattaacagccattttccagtaatcataaccctggaaagggctactaagtagggggagggggttgcagatgggaataattctctaagcccatgtgccttagagggctccatcatcttcatgcagacttattattattattattatttttaaattaaagcttttagaggcgtccttgattgcagtgttgggagctgtccatgctgttttaccatagggaagtccactctgcaagtattccttgtgctgagcactctttatccaggcattaaaacagagttagaaaagaaagctgaaatgcaaggtgcacactaaaggggcattattcaaaagcatgataacaatttcaagtggttgcaactagccaggttgtataaactgggcatgtctcatcaatattacctgacatccaaaatatgattttttttgagaaaccatgtgaacagaaaagctgaacaaaaggggttccctgacaccagtaatactcacatttttaaatctacattttacctaaatttgtttgcgttatcagaaggtataatcctcaggtacaattctgcattttctatactttatgtttttttcttacataaataaaaatacccaaattaagacaagttcacttattcatcatctcaaagttgataagctgtggtcataatgaataagccctcaaatctagagaaaaataggataataagggtagcatttgctggttatattttcttttcaaataaaaaatgcatttcatctttatgggaaaatacaattcattcatttattcaacaaatatctatagagtacctattatatgcaagagttcttgtgaagaaatataaagactaaaagaacacacattcatcataaattaattccatttctacatataatcaaagttgtctaataagaaaaataaaaaaaaggttattaatgtatacaaaagtggataatactaagaaaaacacctagaactcttggcgaggctggtttcaccattaaaatcatctaataactgtacatgaaacatttcctccaaactgaactttcattaagactaaggaataatctacctgcaattcagaactttgagtaaatgacttttaaaattcatggatggtatcattttgtttctttggttccatttctggttctaaaaataatatatttatttaataacatcaaatctgtgaaaggttttgatttttttggagaaagaagtatattgaacttagcaatcattagaattgacccacgactgtgtaagaattagatacttgctctgaatgtgacccaaatttaatggactgaaagtattattgaaaaataattttaataaccatcccaccaaaaatttctaaatcaccattagcagaaacttaaaatgactaaaatatagtacaatgctatgataataatttaatatttactgatcatttactatgtatctgcattacggttttatatgtattatcctagtaaatccttaaaaaactttaagaggtgggtgattttataattcccattttacagatcctggtactggggctttctggtcattaaaacacctgcctaaaaccactaatcagtaaatgggaggctggcttttgaacccagttttggtcgttgttcttaatcattattctttattgtttatggacatgtttgtctaatagcataatatgtagaatcaaagaaatgatattaagtgtggaaatggagtctccaaactctttatgcttgtttaaacgatcttctctctcgagagtgtatcttcatcctttcatgctttttctctctctctgctctcccacaccgatgctccccacaccgtacacacatacacacacacacactcacaccgttggagttctggtctaacacttacttcatagagcaacctaaaaggcataatgtggttgaccttgtccaataactgtaccacttcctgggagttcatgaagctgttcatgtttgcaacgaatataccatccagtgactctaaagctgctgttgttctttacaaagacatgatcctatagccctggctatttcaagatcagtgtccgcagttgtttcaagacatggcattgggctgtgatgaaccacatcagtttctcaagtgtaaggaggtaagttagcatctaaaacaattctgtcgcccatgtgtagtcaaaacaagttaaaagtgcacttgctttcacgataccaaatactttgaagcaagaaggaagctcagacaggagagaatccaaaaacaatgaaaacggaaggaaaaaacactgaagtcaagaattctctgatttttttgaagctataaaatgagagaagcggagggaaaaaatcacataacgctcactctaaatcaagcaagatcaaacagtcttggaagggatattgccgattcatttcaacccaagagtcatagggaaacaattaatgggtactgagtatcttactcagccttctgcaaatctatcaatgtcgtcacggattttttttttttttttttttttttttttttggtttatgtaaagggggaaatattcaaacatgaaatgaaagaaaaaaatagtcaaaattatttactttaacttctaacctatatagagtctaagtgaacttccaataaatactagaaataaaaaaaagattcacttaaaaatagacaaatttgttagatttcatttagttaagaaaaatcatccagaataaattaggtctggatttatatagtaccttttaaagatattaatgttaactgtaatagaagggtgaaaagatctacttttttaaccacataaacctttacaaaaagaccacccaacaacttaataaggctcctcaaatatggatgaaaatccggtaccttaaagaagtaattgttttaatggttaacagagtttaaaatttcccaaattcttgaccagagaattacttactaggcgaacctctaatagagtcaacgttttaatcgggtatagttttatcatacttaaatggcaagatagcgaattttctattttaaaatttctattccatacatatgttcaatagttgaaactttacaatgtatctgacaataccaacgggtatgattcaaatgaccctactgttccagagaatttccaagaaaataaagaaatctcttacaatagcctaaatagaagcatagttttaatttgaatttttaaatgtgtgtaattttctaacaaataaatgtcagaaagtattgactcatatatatattagcatttacaaaacaaagtttaacatctttttcctcccttgctaatgggtcttgaaaaagtgccaggtgtaggaatatgccattgttatcatattcttataagctgccttatacattttttaagatctatgttgtattaatttcttaacaatttatcgggaacatttgcattcacagaaaaataaatgcttgatatttaaacataattaaaattatcattcttatctatttaagtttcaagagaaataaaattaaattacacttaactgttggtctaatttggtaaatttcatataggcaattaataattagtgtagtgggttaacaactaagctaacatttatacactattcatatactgttaaatcaataatttagtttaaaaataaaattagaacaaatatttattaagtggtaacactttctcctgaaggctcccatttaatacatttctaaagaagaaggctagttttagaaaggtgtgctggcaataatctgattgcacctcatacaaatgagaattctactgattgaaaggagccatggcagctagaaattattttttaataggattttttaaaaatcacatgggtaacagttgaaaatgtaactggtaattaaagcctgcttcttaacaaagttttactttattttttaaggagaagtacaagcttttagactatagtttcagatacaaggaatattagtgcagatatttagaagtcaatttattttgcatggtattatacacagaacttacactgtacctttcaaatgaaaagcataaaacaaatctgaaaactaaaagctcacattttctccccctgtactctctattttgacctaataatcatttaaagtgtgggtgtttatcaataaaaatttttgcagcaccacacattgtggtggaacgttgctatttcccgagataagtacaaaaaacctcaatgctaatttgcatcacaaaatgatctaacatatctggaatataatgcacaagcttcattgaaaagaaaccattatatttttcttttcgaaacaaaaagtacagatatctgattgggtctgggtgtgctggaggtagggggtggggaagaggtctcattttctatctcacacctattgttttatgtattctaaactgctatatgggaataaaaaggaaacatactgaatccactttgcagttaatgtcttagtaatttaagaggcagaattttcaagttaaagaagggaaacattatacttttcctttcccaaaggtatttcccctatttcccaggaagaaggccctctgttccttaccctatgtagggggaaataaaggacattagttagggctgaaatcactccgagacagaagaggggaagtttatgatgtggcactgtgcacagtatctggtctgcagccaggaagttttcattttgtagctctgctgccagtacctgccctgcatattcaggaataaaaatataccagaactctacctgaaaaactgtggatgttacaaagaattaaaagagtttatttttctttctttatcctgagtgtaattactgttttttaaaaagaaagagctgaaactgtagtaactggagttttttttttttttttttttcctttttaaactcctcaaactaccttcccacaaagccatttaagttaaatggtacatttacagactcacctacatgaaggatataacttaaaacatctgcttagacacatacgttctgttcagatataaaaaatgtggcaaaaatttttaaaaatataggaccactatattcttaaaatgtgtgttcttctgtgtgtgtgtgttcattcattcaagagatctttgactgcaattaggtagtcggtcctataaaggcttccttgtgtgacgataatttctaaaagtaaaatgctccagtgaatatttctgctaaataatcatatcttaaaattactttaaagaaattccaatccctcatgttacattaagcaataatgccagttttccataatatgccttagttgtaccaccttattcagggtcgacaattaattagaagacaaaaagtataaatcgcgtgtttattaagtagcagacaaatttctttgtctgtctcaacatatttacattaatgtgtttattttctaattttgaaaataaataagcatatttaagccaaagctgcctgtcttcggggtttggggaaggatgcacattctcttgctatccttctaacttgctgaaagaatcacaggtgtgaaaaaaagacaggcatagttcttggctgatttttaaaaaaacacttcacattctatcgaaggaccatatccacttcttttttaatccaatatgctaggaatccatagtatctgagagcaatttatatgaattcttcatgtgcatcttatctatgacaacaagatagaagaggaaaaccagaccaccacgctcatgatgctatttggaaaaagcaggttctcaaaagggactgattcaaagatcagttagttcctccagcctctaaaaacaagttttgggtacttaatttaaatcactgcttgaggacttgcactgtcattctacatgaatcccaaccacttgcaggaggaacaacattgctccattcatttcaaatttacagcattaagaattaataaagtctttataatgtctgcattatttaagagtaatgattcctgaagaaatctgcctgtaatatgtttactgtttttattgcttgtaatgtcgtcaatttccttttcaatgccctcaaaagattctcttcatgtactttgaactttgtttacattggctgtattttaaaaatatataccaagatttaacttgtacaataaaatgacaatgtacagcaaatgaattatggcgatgacaaataaatgttactcatatcacctaaaactaaaccataaatttgtataacatgtatcacctaatttccatatttaataggaatatgattttttgcagtaaacattaaaatagtatcaaggagatgtgagataatagtatattaaataaccttttctataatcttatttttacaatggtattctttgtcatagaacattctttaattatttttctttcacagacaaaaataacaaaagaacatcaatgccatcttcgtattcttaaaagagaggggtaaggaatgaatgcttccagcaccctttattttgttatgcctcaatattgtctgtaaaataacatggttactaaaaaattcttgatttgagcaagaccaaaattattacagtgtactttacagttatttcacgcatgaatgttaaaacatactgaaattataaaactttcatagactttttttcagtattcagtttaagataggttgtcaataagagctactttaaaaaaaactgacaattttctttgctcactaactataggagatcattgcaaattattttctttctcatgctgctattcacttacgtactgcatatttgcttcaattctccaagggaagaaatgtggctcttgtgggaaaggtccacccctttctacatgtttgcttccttgaacgaaaggaacacacccccttacattctttgaaatgtgtccaacaattgtaatagcactgtattattgactaaattagaaaatcttaagtgatagtcaaatattgttaatacactgtgtattttgagtcaggagaactaaatgacacatatacagaatgaagttcaatctagtgtctacacttggatgctatagaatgtttgtgttagtagaagaaactcatgaatgtttttgtgtacaggtatgttgtatgacacctcaggaagaggcccatgaatgttacaagtttttgatggcctcctttcaatttaagacccattacaggaatgacccctttctttcataagtatattggataaaaaacatttagaaacttaggaagtagaatcagagagctgtttgaaatcacaaacatgcaaaaatatcacaggtctacgcttaccatcctaatggcagaaaactcacaccaaagttggcacccactaacttctacctcattaaggcaagctgctggtcattggatattgtgttctaacacgacttccctttatgtagaataatatgtttccttccaaggaaagtttttcttttgttgttattttctaataaatatactccatatttatagaaaattttgcatttatctttgattttatcttttctaaatagtctttctttattccacttttacaaagaaattttcaagtgtaaagacacagcaggaaaaaaaattatatctcttttaagatattttagtgtgtaaatgaaatggatagtccttgtgcaatttatcaggcatttcagaatgaacccaactgtataattcccaggcctacaaaatgaaagctttgttatttacctatgtttctcacttgaaataagagtgaatataaagagtgaatatataactgcaactgaaggtaataaacttgttaaaacttagtaagatattgtgatggtcaaagaaaacctgcaagtgcgtgccacaaatccactcagatgaaacatctcattcactaaaattttctatcttattataatagtgcacagaaaattaaacacataaatattaattttatgtatcacagatgatgtaggcaatgaaaatgcaatgtttacatttatgggtgactcattagtgttttattgtgtgaaacactaggaggcatcagttgggtaaaaaaggacttcaattttagaagaagcaaaaaattactgtaaagttgggtgtgtaagaagttaagattttcaaaatgttattatgtaaaccaaaactttattctctgaaataaactctcaaaacatcatattctgttgtaaagaatgatctttatataacattcatgaaatatatatattatatatatatataaaatttgaccaatgaacttttatgaagatatgtttcacatatatggattcataactatgtaattacacatttttatgtagaatatatttggtaacagaataacataatggatattgactattatgcattttctgctgaattactcaataacatgagtgtatgttttatttctggcaaattctgttttgtgctctttataacgcctctgaaaatgtctaatgcatttaagccttacaatacctgcttcatgtaagcagacaatttaatgtttgttcataaagaaatgatggaacttaaaatttacacaatgaagacatacataaaaaaggacatgttttctcttacttcactactgaaagcctgtcatttgaaaactgaattttccattgtttgaatggatcataatgatgaagcaacagggtcaaagtatgcttatctaagcaatcatttgaaattgagtgtcttgccattcctcaacaatcagcttttatctttgacctatcaaaataacatgtgaactatgtaatctgccttttgtaacgtgcatagactctgttgttcctggttttgtgaatcacctctgtaatctggtttgatttcctaaaggtgacagatctcggtgaacagtcaagctttactgagtgcaagacagtccacgcgcctataagattaaggtacagtgctaaggacggggatcttaattacctgtctttccacatgcagcatactgatggaacaacagtgattaaatcatttcatcgtgtctaggcaatcaccacattagtatagaatgaatacgtgtattttgataagttttagatattaatttgtgtggtattttctcagaggatgtgcttttgaaaaaaaagtgtaactttattaataatctcttaacagttcatcttgtgaccattaattgcatattaaattcttctatgttgcttcgaatcatgtccccaaagccagaattctgtttaataactatgtctttgttgttatgtagcacaagtattgctgcacagctatttccccatttttgtcactttctgagatttcatagactcaaattataccacactttagagttgagaaataaaaccacaaaatatactacaataaacagaagaaagttttaaaagataatgttaagatatgctaaggagttattcagtgctgttctttataaaagaagtttaaataaagtatttattagaaagatacgtttgcagtgttatggaatttattgattccgttaagttagggccaaggaaaaaatttcaggtatcttttcccccaaatttttcaaaatgaacatgtttacaaagaagaaaagaggcaaagtgcctcttgttatctaagtttcatggagttatctagtattaatgtgcttctctcttgaaaagttaatatctgtgattgcacacttttaaaatatgaatagctcagaaaaggtggaaaactgtttttattataaattgctcatttgttattgaaataaaaaacaaattaacatttaataaaacttacactttaatattatctttcaatatattccacatgcacagcaatcaggacgtaaatggtgcaattaatgaatgaagtaaaatgctgcctttcctaagaagtctgaaaaaaagtcaaacattcgaatgctgtgtgaattatattaataaaaatagtaggtttttataaaatttagtaaaatttgaagtaaaggtaacagccacctactgtctctttgacgggagaaccaaattttaagcaaatgttatgtttaaagactgttttgatgaaaacttttagaattgagttagtagcagaatacatagctaaatgtacttttctacaaatagaatgagatatttgatttaaaatatttctttcctcttgaaataggatgttagatagggacatctcattttacctatcaagttctgagtcttgctttagaactacttcttttaacttaatttcatgcatacactggaagacaataatatggctttttaactgcattatctttagttgaaactgatggagaaacaaaaatactgcttataccatattggtacatgctgaatgtttttaaagactagccaaaactgacattttttaaaattaaataagatgttttagtttcaaattagagattgttgatctatttaaagctaaaattggtatgcaatacgaggttaaacggggttcacaggtggtcacatttccatgtcctaccaagtctctagggattggagttattatactccacataaacatctttactctgcaaccacaattccattgcaaggtgccagtgaaagtaggctagtcgctttttttttttttggactggtataatgaggtggctggagtttcctttatagcacttagaaattatatgcagtccccaagcatttcataagacagttactattagagttagtttcagattcacaatagtaaaacgcactttgtgtcaaagcaattctccactgaggaccggttaaggaactggcagagagcccaattctacttagtctactgtcagcatttacatataaagtattttatacaaaagacacgcattcctaaaatgtgacaaaaaaaggctctccccaaagaatgataactactggacttagaatagtcagaagtgattcagatataaaatttcctttaaaaagcaatagccatgttcagggaaggaaggtaacattagcattaaatttaaatacttccacaatatttaataataaaataaacaatgtgccacatctatatatacttcctttgtgacaaactttatcatcgagtttggtaactttcattccaagtccaaagagaaggcaatttaagtgacttaaccttgcttgcttttaaacagctatgtatttgacttgacctgaacagcaatccatatgctgaaatcgaacgtgaattgtgaaatgtgtagactactatggcagggatattactttttgtccacaccaattaagaagccctctgtcaagccggcactttggtgagggaaggaaatgcacaaaggtatactctgacagacagccatgctttaggtcaaactaatcccaagaattagtggctcagaagcataacccagggcaaatcagtgtctttggggggactcatgggagcatctttccacagtgaactaactgctaaatcttaaggcgtctacttcaaggtcacagaacatgctgtgaaatattaaaatccaccaggctccacacgctccaccatatcaaacatgctaatgacgtgaactaacttcatgaaactttaaatacactggtgtgacaggaacgagtcaggagtgatttcaatagctgatggcaaacggatacgactatctaaaaagttacttttagcaacaaacaaggaaatcatggaatctaacgaaaaagaatgcacaacgagcctcaacttcagccttcaaaaaaggcacagggatagatagacacagtgccgtggaatatattgatgcagattttagagacaatacccgggttttctatttcctcgagaaatatcaggggtacttacatgaaggaagacccgatcagattagtccttgggatattttcctttcttaagagagagagagagagaaaaaaaaaataacaacaataatctttacttcgtccagcgttgaagtgcttctccacctgattcaaacatgcagccacggcgacccacacagaaccttcaaagtcaatccaatagcagcccgaagatgtctgggtgtacgcgtgtgctcaagtgtctgtgactgcgagcagagcgagcagagagctggagacgatgtgtgcgtgtgtgcgcgcgcgcgaggggagcgcgcgcgagggggggggcgcggggccgcgcattcgcgcgcgccgaggccgctcggaagaggaggaggaggaggaagaaggaggaggaagagaaggaggaggaggaggaggaggagaaagtggctctcagcggccggtcggattaaaagtaaccagactcgtccagaaaactgcgtccaggaaggaagtgacagaagacgaatgggaaaaggagaacagctc

SEQ ID NO: 2579 - DNA, 165226 bp, Homo sapiens; identical to SEQ ID NO: 2578
  source 1..165226: mol_type = genomic DNA

SEQ ID NO: 2580 - DNA, 14600 bp, Homo sapiens
  source 1..14600: mol_type = genomic DNA
agattttctaatttttttattcatgaggcccagtcaattctcttaagaatcatggcccggcatggtggctcatgcctgtaatccctgcactttgggaggctgaggtgggtgcatcacctgaggtcaggagtttgagaccggcctggccaacatgatgaaacctcatgtctactaaaaatgcaaaaaattagccgggcatggtggcgggcgcctgtaatcccagctacttcggaggctgaggcaggagaatctcttgaacctgggaggcggaggttgcgagccaagattgcaccactgcactccagcctgggtgacaagagcaaaactttgtctcaaaaaaaaaaaaaaaaaagaatcataggccgggcacagtggctcatgcctgtaatcccagcactttgggaggctgaggcgggtggatcacctgaggtcaggagttcgagaccagcctggctaacatggtgaaacccccgtctctactaaaaatacaagaaaaccagcctggtgtggtggcacgcacctgtaatcccagctgctcaggaggctgaggcaggagaatcgcttgaacctgggaggtggaggttgcagtgagctgagatcgtgccactgcactccagcctgggccacagagcaagatttggtctcaaaaaaaaaaaaaaaaaatcatagttcattaatccaggtacacaaatacttctatcccaatccagtctgcttgcgtttctctaggcttcccatatcctcaagacagaagcagagagaacaaggggacatatatccttgccgtggggttctgagggaaaatgagggccaaatcttctgttcaggagcacctgagagtgccacccaccaggggcggattatgcaacgactccgtacttcctcctctgaaatccatggtgtgtcatcagtacatgtcttcacccggattgactaacatgttcgttcctaacttacctctgctataatcgggtaggctccgtgggcacagtaactattttgttatttttgcatttcccatagcagctagcacctagtcggcattccgtgactattgagtgtgaatgcaagatacaaggccagaagcaggaagagagatgcagtgttgggcattcagtcaggcccctgaccacccactggacagatagtcagaggagctgtgttcttccctccatcacgtgtcccagggctgaagataggttgaaggggcccagagaaagagcagctggcgaatgtatagatgtgggatctggctgtcacattgtaaaaggagatgcttccaactctgtagtccacgaagatgcccacacgcttgggaggctcctttattagcaggcgggtcgggggaacgctggacgcctggtactcattttccttcatcattatcaccacccagtagccattctctggcgacagagtcatgttccctttcctgcttatggatgtcttgcaggctcccaggatccatgctgtcttgtctccaacctccacctcccagtaacggcggccagagaggaaactcggagagcccagaacaatgatacagctgtcaaatctttgcgggccatcaggcagcctctcccacttgtttccaagtctaacactcttcagatcatcagagaagatgaggttggggtaagcggtttctgcatccagaatcacattaactgcaaagaaaatttgaatacctaggtaggggtccatgggcaacatccctacagggttctccccacctgcaggaaacagggacagggtagttcttctggaacgtggtaggggagagcacagggatccagcaggccagggccacttgccttgatctgggcacttaccagcatgtgcctgagcgccaatcagctccggaactacggagaaaaatcagatagggaaaaaaatcctgagcattagcattaagaggggctaaattacactgtcctgacaacaaggaaagacaaggaaccccctgcttagggccctgcatgctatgttgggtataatcccgttcctcccaggaacccaggccatgttggggactgtggtctaatgagtcaactcagtcaatgagtcacgcacagagcctggggggcctgccatgacctttctcctacctttgctccaggtgtttggtttttttttttgtcttctaaatagggcccctcaagtcaacagcacaagggaacactgcaacaaccccaggccagcacacaccattaccgctggactcaccattgaacatttccatttctgaacgcagggtttctaaaatgtgggaaagggagcagagagaagctggagttaggtccctcagccagggacagatggaggagaggttgaaggcaggtcagcaagaccaggggaagaggagggaagtgaggggctctgggctatgtggatcttagggaggaagtgagcatgcacctccaatcttctcccaagcccatctacctgagaagtactttgtgctcttctccacaaactctgacttctggtggaggagttggatcttttgttttatctcttgaggagtggtccacttttcagggacaggcactgtcttagccctagagacaaaagactgttgaccagagaaggccggagcgagggggtggcccaagtacccgtgagctggaaatgaactacattctccacagggcacacctagcccagcctgagctacacaaagaaaagtcttccctggattcagaggtctaaatgctggtcctcaactttggccacagactgtcatgtactggggtgctttaaagacatggatatcaaaaccacaaggagttttcagaatggacttaaaatgacattgatattatctactagaattatctatgtcaaattgattatacacccctttctttctattgaaataaaaagataataaatgaaaaaaaaacacacacaacaaaatatcccttcacatccattagaatggctattataaaaacagcaacaacagaaaaaaatagaccaggtatggtggctcatgcctgtaatcctagcacttcaggaggccggggcagtgggatcgcttgagcccaggagttcaagtccagcttgggcaacatggcgaaaccctgtctctattaaaaatacaaaaaagtagccggaagtggtagcacatgcctgtagtcccagctactcaggatgccagctactcagaatcacccgagcccaggaagctgagcctgcagtgagctgtgactgtgccactgctctccagccttagtgatgggagtgagaccttgtctcaagaagaaaagaaaggaaggaaggaagaaaggaaggaagggagggagggagggaaggaaggaaagagaaatggctgggcacggtggctcacgcctgcaatcccagcgctttgggaggccaaggtgggtggatcacttgaggtcaggagtttgagaccagcctggctaatatggtgaaaccctgtctaccaaaaaaattagctgggcatggtggcacgctcctgtagtcccagctactagggaggctgaggtgggagaatcccttgaacctgggaggcagaggttgtagtgagccaagatcgcgccactgcactccagcctggatgacagagcaagacgctgtcttcaaaaaaaaagagagagagagagagtgaaacagaagaaaataagtgatggcaaagatgtggagaaactggagcccctgtgtgctgctggtgggaatgtgaagcgatgcagcccctgtgagaattaggatggtggttcctcaaaaaaaattaaacacaggataaccacatggtcccgcagttccacttctgggtaggtacccaaaataacaaagcagggtctcaagcagatatttgtacacccttgttcatagcaacattattcacaaaccaaaagttagaagaagtcccgatatccatgaatggataagcaaaatgtatgaacacacactggactatgattcagccataaaaagaaaataaattctgatacacgttacaacacggatgaagcccgaagacattatgctaagtgaagaagccagacacaaaaggacaccgggattttgtaaagctcccaggtgattttaaggcttagcctcttcctgtcccttccctcccctccccttcctgctgggcttagcccagctccactccaaacaagcttcccaaggccaccagtaggcctgaaggggcagctttcatcagatgaactgcacgggacacaatgcactcggaaggtttcttagggagcctccatcttgtttcagcaggatgggctgaattcacccttcccagtctgcagctccatacccggccagcctccctgctgaccagatgcccttctccctatcaaatccagagaggctttgggaagctgcagaaaaaaggaggagtctggaatcacagaccccggggttgggaacatctccctcccaggtcccttctgggactgtctcccccatatgctttctgcaagacaccccagggtacaccacaggacctcgctgtacctgtgcaagatgtctccaatgtcctaggagaaaaaagaaggaaactgtcggttaccaggctcctagtggctgggctgactcctggcctctacttctgggctcctggacttttagctccccgctgcacttaccagggctccctgccctagggtgtcagtggaagtggagcacctttcttcaagtctaattctaaccacgggaattcaggcatcccaggtggcgaggcctgcaatggaacggccctcaagccctgctgatcccttctgggaaatggcagagatcccctggataccaggccaccctgggctcctgagagacctcatcaaaggggtctgggcacaagaggcactgtgggtcaccaagaccaagtcctatcctaggccttaggggcttcacccacttgttccagcacggctgatggcagagctgggagcctgaggcatcctgataggcacaggggacccaagaaagccgggcccaggcacacccacctgcagaagttcccattctgactggcactccttggcctccagttccccaatcagcgcatcgagcagggcgatgtcctgggatacgcgggtgtcatatgccttcctgatctgcccaaccatctggcccacgtcctccagtgaggccacaaagaaatgctcttgctgctccaggaagtagtacacctgctccagcttcctctgcacccgctgcttcagcgcttcagtttgtttctggggagcagaggacagggaggtatgggggtctgtgctgtgggtggacgtggatgtccaggaacccccagaagcccacctcctggaggtggataagaggtgggcttatgctgcctcttcaaggcctagattccagagcaggaggcgatattgtctggaaccttccagaaaagactgagcatggctggggctagctctgggaaaatgtccttaaacctggtgttaaggtttaactgtgtcccttccaaaatttacacgttgaagccctaacccccagtactcagcatgtgatcttatttggagataagagttcttgcagatgtaattagttaagatgtggtcctactgggattgggtgggtccctaatccaatataaatgttgtcttataaaatggggaaatttgggctgggtgcattggctcatgtctgtaatcccagcactttgggaggctgagttgggcagatcacttgagatcaggagttcgagaccagcctggccaacatggggaaactctgtctttactaaaaatacaaaaattagccaggagtggtggcatgtgcctacagtcccagcaactcgggaggctgaggcaggagaattgcttcaactggggaggcgaaggtttgcagtgagccgagattgcaccactgcaccccagcctggacgacggagtgagattccatctcaaaaaaaaaaaaaaaaaaaaaccctaaaaaacaaaaaaaccagcccaggcacgatggctcacacctgtaatcccagcactttgggaggccgaggcaggtggatcacctgaggtcaggagtttgagaccagcctggccaacacggtgaaatcccgtctctactaaaaatacaaaaattagccaggcgcggtggcaggcgcctgtaattccagccactaaggaggctgaggcaggagaattgcttgaacctcggaggtggaggttggagcaagccaagatcgtgccactgtactccagcctgggtgacagagcgagactccatcttggaaacaaaacaaaaaaacagagagtaaattatgaagttaaaagtgttcttggccgggcgcagtggctcacatctgtaatcccagtactttgggaggccaaggcgggcggatcacgagttcaggagttcgagaacagcctgaccaacatggtgaaaccccatctctactaaaactacaaaaattagccaggcatggtggcactcacctataatcccagctactcaggaggctgaggcaggagaatcgcttgaacccgggaggcagaggttgcagtgagccaagatcacaccactgcactacaacctgggtgacagagcgagactccgtcacaaaaaaagaaagtggcgttctcctcccttttcctcaatcccatctttctgcagtagtcaccggcataggttgctctctaccatcttctggtgagtatgagaaagcatgacaggatcctcagaggtgacccctgcctgctgggggtggtctccctctacagggatgagcttacccttggctgctggttaccctctgtcccctgagaggaggtggccatccctgctgccctgtgaaccacagcagaatctcggggacccctgctcactcttcccaccttcctcccagggacggatgggccatcagccacctctgaccttaccagaaagctcactgccttctcctccccataggatcgctgctcctcccctgattttctcagcttcttcagatgctccagctgcttctgaattttcttctggaaaaacagcacttgttgaaaagcttgaatttggctcctgccatctttagctggtgccaactctggaggggaacatctccttctggtagcaaggctgagggtgctgctgccagcggcatggggaggggtgctcaggaaagaggagggaggaatggctgaattgccaaaggcagcagagctgagaggcacttcctctgagcctctggattcagccatacctgaagccagctccccctggatctctgagcaacataaacctgtagctcccctctttgctggactggtttatattgtgttcttgccatttccagcccaagaatgctggttaatgcaccaacaacccagagttgttgggaaaatgaagtaaggcccagtgtgtccaagtgcctggcagagaagagcccacaggcagggagtgcctaccttgtgttccagggcgacctcctcaatggggcgcacccggtggccttggtgctcctgactcagactgcagatgaggcagatgggctcatcgtgatcctcacagaagagcagctggacctgcttcaggtggcgcttacactgtggcaggggctgggggcttaggcttcccgggctcttcctttcatgggagtcctggcaccgggggcagccaggtgagcggctgcctgaggcctgggggtgcccagaaactgcctcggggaagctgcaggaatcacgcacacaggtaccgtcaactgggtctccttcctgggcgtggcagcggggactcgcagccgtgtctggtggccttcctggggacatgcagtggaaaaaccccctgaatggcaaacccaagttgcttacacagaggtatcacaaagcacagcggacacagcccttgcctgagatgtgcgagttctcagttagactctgcccacttcctagcttgtcctcccccgacttccatccagtgaggaagcaaacaggccactgggcctgagagctaagggccagacctcagacattcctgagccttggaattcttgggcatttatcctaaagaaagacccatggccttgtgctgttcctcctgcacagacatagatctagcaggtgatgccaaggaaagagacattctgaccagtgttcctttgccacttgaacccatccctggctgcccataacgtgagtggaggcttccaggggatggtgacttgtgtacctcgctcctagctggatcccagcccctagcagagtacctggcaaatgcaagcatttggaaaatgagtattgaatgaaggaataaatagaccactgctcacatatgagttcaataaccattaaatgaaagcaaagaaggggctgggtggtggctcatgcctataatcccagtgctttgggaggccaaggtgggaggactgcttaagctcaggagtttgagaccagcctgggcaacatggcaagagcccacctctacaaaaaattaaaaaattagccaggtgtggtggtgcacacctctaatcccagctacttgggaggctgagacaggaggattgcttgaacctaggaggttgatgctgcaccactgcactccagcctgggcaacagagtaagatgccatcttaaaagaaaaagcaaagaaggggggcattatagggctaaagactggaactcatcatgaagacctaacagttatgaatagctctactccaagactctaattgcaacttcataagcagacatgccacgagatacaagaagaaatagaaacacaaggccgagcgcagtggctcacgcctgtaatcccagcactttgggaggccgaggcgggtgggtcatgaggtcaggagttcaagaccagcctggccaagatggtgaaaccctgtctctactaaaaatacaaaaattagccggacgtggtggtgggcacctgtaatcccagctactcgggaggctgaggcaggagaattgcttgaacccgggaggcggagtttgcagtgagctgaagttgcgccactgcactccagtctgggtgaccaagagagactccatctcaaaaaaaaaaaaaaaaaaaaaaagaaatagaaacacactcaatcctttagcccctgctacctcctcccacctcacagtgtcccagaaattcacagcacatctgtaaatgagactgctagtagtcaccagaaattattctccctccttctctcgtgatagaattaattgtccacgtttccctgtttccctgcctcccattgccccccaaatgccctgcatttctcagcctcctttgcagttaggtgtggctatttgacaataatatgaccaaagggatgtaaatggaggtgtcacaagcagcttctagaaacttctagagctttcccgagggatactattcccctctgttcctccatcttgctgcctggcatgaggacgtcaccttctgagagcagaagcttgaggacaaacttggtgggacagagcaacagcaggaccccagggtcctggcccacggatctgcctgggaccgcctgtgtatcatttatgtgaaggaggcacaaacttcttttctgttgaggttactgttatttgggtgtttctattattcacaaccaaacataattttaatgactacctcagcagtagatagttaggactttagccaataggcttttctttctgctgagagaaaggcaaatggtagaatctcaaccccatgatgatgcattgctgtgaggttattgtgagagggagtatttttaaccagtcttccccagattttctacctggtgtccataaaccccttggattctaaagatggtcttcagagtgtccaagaactacctgaaatttgatgtgacatttgtgaagctgtgcatatatgcatttttcagggtctaagcctgcatcagattaacgaagcggccctagaagacacccaggaatcccaatgatataaatacagtggggacctggtgcagtggtgcacacctgtaatcccagcagtttcggaggcaaagatgggaggattgtttgagatcaggagttcgagaccaacctgggcaacatagcaagaccccatatctaaaaaaaaaaaaaaattaaaaaaaatacagtagggataaaagaaaattaggggggaaatacttcagtacttttcaggtcactattcctaaggatgctaggttttccagatcccagggtcctttctcactggaagacccagggacttctggatttgaagactcatgcagcataccacatcctttcccctcccaggtctcaggggtccctggactcccaattcttttttttttttttttttgagacagagttttgctcttgtcgcccaggctagagtgcagtggcatgatcttggctcactgcaacctctgcctcctcggttcaagcaattctcctgcctcgaagccttctgagtagctgggattatggacacccgccaccacgcccagcaaatttagtatttttagtagagatggcgtttcaccatgttggcaggctggtctcgaactcctcacctcaggtgatccgcccccattggcctcccaaagtgctgggattacaggtatgagccaccgcacccggcctggacccccaattctatttctcctccttgagtgctgtgatttctcctctccagccaacaatgcattggaaagtgtgttccataggctgggtgtagtgactcacacctgaaatcctagcacttttagaggctaaggcgggggatcgcttgagcccaagagttcaaaaccagcctgggcaacatagacagtcctcgtaactacaaaaaatacaaaaaaaaaaaaaaaaattaaccaggtgtggtggtgagcacctatagtctcagctacttggaaggctgaggtgggaggatcgcttgagcctaggaggttgaggctgcagtaaactgtgctcacactactgcactccagcatgggagacagactgagactctgtctcaaaaaaaaaaaaaaaaaaaaaaaaggaaagtgtgtttctgaatgctgcccccaccacgagcatggaattgtcacctggatagcctcggtaccctctaaactggtggcatttttcttttacagtttttttttagtctctttacctatagggacagctgcttaaaaaaatccagatggcctggagcctcctgatcccttgccaaaaaccagaggaagttaagatcagagcaaaaccagtgcaaactggaagaggtgacttccagttaccttaagatcatttacacattgttataaggctaaaggtccctcccctaaaagaagatggccagggttttgtgtccatgcgatgtaggaagaagcatgctggggacagcgcctgcacatatggaaccctgccctgggcctgcttacctatctcccttcccctccctggactctaaaatcgccctgcctcccatccctggcaagcagacgcctgcagaggtgagctccccttctccattctttggccactgataacacctgattgcctttttcaatcggacattctttctttctttttttttccccccaaaatgtttaagagacagggtcttgctctgttgcccaggccggagtgcagtggcacatcctcagctcactgcagcctggaactccctggctcaagcaatcctcctgcctcagcttcctgagtggctagaattacaggcgtgtgccaccatacccagctaattttttttttagttttgtagaagtggagtctggctacgttgctcaggctggtgtgcagtggcatgatctcagctcactgtagcctggaactccgtctgctcaagtgaacccgagcagctgggactacaggcgcgtgccactattgtattttgtagagatggggtctcactgtgttgcctaggctagtatggaactcctggggtcaagagatcctcccgtgcaggcctctcaaagctctgggattacaggcgagagctaccacgccctgcccaacctttgggtttttatttttttaatttcgtttatagagatggcgggggtctcactacattcaccaggctggtctcaaagtcttggcctccagcaatcctcccgccctggcctcccaaagcgctgggattacaggcatgagctatcgtgcccggccagccattctttctctgcagccgatataaagtaggaaagaacacaatttaccggtgaccgaatgttctggatttccagggccttccttcaggtccgcagatgcccctccatccggagtgggccttgcccggggttctgttgccgagtccagattcgcagctgtcttttcctctagagtcaggagaatttctggatttgcgggcgccttctcccctgtagaaatggtgacctcaaggcttctaggtcgcatctttcccgagggcaggtacacttcgaagggcctgcactccttctgccccggggcgccccccgccagcccctgcagcctccccgcggagctggcgtttctgcgcagccggacctcggcctggcccccctctagcgccctgcaggggccggggcttctcccgcccggcagggccgggctccgggtccgaggcttgccctgcgcgtccaggccctccgaggccttctctctgcgtttgctcaggggcttcctcgacagccccctcccggcctcgggctggctgcaccgcaggctggcagctccgcccccgtacggccgagggccgttcccctcgttcccctcggggtggtctggagtcttcaggctcctgggcttgttctcccccagggagctggacgctgcggaatcatctgtgccgttttcttgtgtggaatattctggaaggacaaccagatgcaaaatgatgaagctgtcccacgtttagggcccaagattcagggcagaggagagagaatccccttggatattaaagtttagaaattgaggaaaacaacgggccgggcgcggtggctcatgcctgtattcccggcactctgggaggccgaggcgggaggatcacctgagatcaggagttcaagaccaacagggtgaaaccccgtctctactaaaaatacaaaaataagctgagcgtggtggcgcatgcctgtaatcccagcttctccagaggccaaggtgggaggatcatttgaggtcaggagttcgagaccagcctggccaacatggcaaaaccccgttcctactaaaaataagaaactcagccagacgcggtggtgcgcacctgtagtcccagctactcgggaggctgaggcatgagaatcgcttgagcccgggatgtggaggttgcagtgagctgagatcgggccactgcactccagcctgagtgacagagcaagactccatctcaaaaacaaaagttcaggacttcctagactagacaatggcagtcaattaccattcagtaagaacatgcttgatgttgctatgtatttctctctctcttattttattttttgagacaggatcttgctctgttgccctgatgtgatctcagctcactgcaacctctgcctcccaggctcaagcaatcctctcacctcagcctgttttctgttttttcaatagctgaaaatacaggtgtgtgctaccacgcctggctcatttttttgtatttttggtagagacagggtttcaccatgttgcccaagctggtctcaaactcctgagctctagcaatccacccaccttagcctcccaaagtgctgagattatttataagtgtgagccaccatgcctagcctatatttctcaaatagtacttttcaaacgttttaagcaggacaactgtttcaaataagatcttacacaggtcagcaaaacccagattatacgctttaaaaataaaaataagccgggcacggtggcctatgtctgaaatcccagcactttgggaggctgaggcgggaggatcacttgaggtcaggagttcgagaccagcctggccaacatggtgaacagcactgagaagattctataccaaccccgttcatatgattgcatagcaatccctttttgctaacctagagatgtttgtctgacatgagtattaatcataaatgtagtgaagaagtctcaaagaacaggtgttccagctcctgcctttcgtgaccctgacctgcttcttaaaaaacccattaggagcctgaaggaagtttactaacccagttccaaaggccagagtgaagaaagggacgttcctgaactaaagtcatctggattttggtagacctgagactcccaatccccaggtcagagtgagctgctctgagctcctggtcccctttcccacaaagcagccagcactcagcactggatgaggaggaggcctgggcccgcttaccctgaatggctgccctgtggagctcctcggccagcaggcgctggttgatggcccgcaggacctgcagggtgagctgcacggcgtactcttccccatagtaggtgaccagcagagtggccatcttcaccggcctggctctctggatctggctccgggggatcctggagtgctccttctgcacactggtgttctgcagcttgaacttgaacttctcgaagtcatagggcaccagctcctccagggtggacagcagatggtcactaggggtcttagccatggtgctgagcaggagaggctcgagccagctgtctggcttc

SEQ ID NO: 2581 - DNA, 14600 bp, Homo sapiens; identical to SEQ ID NO: 2580
  source 1..14600: mol_type = genomic DNA

SEQ ID NO: 2582 - DNA, 45529 bp, Homo sapiens
  source 1..45529: mol_type = genomic DNA
agtgaccgccctttgccactccccctgcctcctctccgcctttaacttctcgggaagatgaggcagtttggcatctgtggccgagttgctgttgccgggtgatagttggagcggagactgtgagtgccggctgcctcgacagcacgtttgcgacgctcggagtgaccttcgagcgactggggaccgggggcgggagtcgtgcatgcagcgttgtgtgacgaggcgccgcccgccgcggtcctgtgggaaaggagagagccagctgtcgggcgaacggggctggcggccgagtcgagcccacggagcccacgaggccgtgctcgggggtgggattgggggatccggacctagacggtcgtgcgcggggcgggggtgggctctggccctgactcctgcgcccggtgtgggaaggtgggaggccttttctaaggcaggtgttcacaccggccggaccggggcgttacccccacccggcttttcccacgcagctccttcgcgcggtcatttcttgactctctggaagaatccgccttctttatggccactgttcctttccatgtacacaccaggattagaccgtgattgtttgtctttggtgtctttttcttgagaaaccacctatgctttcttaaacttatagtccttgaagtttctggtactttggctggaagcgttaatgccctcttgaagccttacctttctaaatgtcagcctcacattgtgatcttagaattttatttcctcactctgcatatccactcctactcacctagagcttcaggttgagaaacttagtaacttccttattgtgtgtgaatttggcttcgcctcactaaccctgttccctgatgtactttagagtcacatgcagtgacaaacttagtcacaattagtttcgtcttcaccaaagggaaattgagtagaaattgcaaccaagattttggctaatagatttcacttattttagtgaaatatcattcaaaagtcgtctctaactgtctgactagaacactcccaaaaaagaattacctaaaaacattttgccagcataatttatttcattggggagttgatgaatgtcactggtgtgtcatcagtttgcatgtctatcatccactttagttggtgcttttctaactttatctccctctagtagcataatggcagaacctgtttctccactgaagcactttgtgctggctaagaaggcgattactgcaatctttgaccagttactggagtttgttactgaaggatcacattttgttgaaggttagttcttcttaagtttttaaagtaattactgttgaaaatatataaaagtgcttattctttcaacgttagttattgaacacatgtatagggcattatactgtatactatgagaagtaccataatgaataaaacccctttctaacctccagaaggggaaaattaaatggtattaataacaactaagaactttagtatattaatagctcatttaattttcatcaccactaggtgatgagaaatagctatgttaatagttcatttaattttcatcaccaccatctgtcattttaaagatgaagagacgaagtcaaagaaaagttaaacagtttgcccaagatcacacagctaataagtgcccagacaaaaaatcaggcagtccacatttaaccattatacttgtctcctccccaatttagcagttaagccaagacctcagacatatctcattctctcaaatgaggctgaattgcagtggaaagggggaaaaaggagtttcataactgttaaaggtgatgaggaatgtcatgtcttactagggaatacttcttttttttttttttgagacagagtcttgtcttgttgcccaggctggagtgcagtggcatgttcttggctcactgcagcctccacttcctgggttcaagcgattcttctgcctcagcctcccaagtaaatgggactacagtgcacgtgccaccatgcctgactaatttttgtgtttttagtagagacagggtttcaccatattggccaggctggtctcgaactcctgaccccatgatcacctctcttggcctcccaaagtgctgggattacaggtgtgagccaccacacccggccaggaatccttctttggagataactgttgaaattttttctggttcttaagattatgtacctctcggccaggcgccctgactcacacctgtaatcccagcactttgggagtccaagatcggcagattacctgaggttaggagttcaagaccagcctgatcaacatggtgaaaccctgtctgtactaaaaatacaaaaattagctgggcctggtggcagacgcctgtaatcctagctactcaggaggctcgaggagggagaatcgcttgaacctgggaggcagaggttgcagtgaaccgaagtcgcccactgcactccagcctgggtgacagagtgagactccatttcaaaaaaaaaaaaagattatgcacctctcaactatacaatggaaagggagggattctgtaaatttttccagcgacagtggggaaacctttggtagattgggaatcaaactttttttttcatgtctctcccaaccctctcttaccatattttgagctcctttagggcaggagcctgggattcattgtattcctagcaccagacttgacacaattcaatgctgaatgagaaaaaaaaaatagtagtatagaatctttgtttccaattaggaaataatttgagctggcacagttgactttttaaaaatatttttttttctaaaaataataggaagtgaaaatgaagttaaatgtgtattgtacgtgttatagatcatgcatcatgctaggcactagtgaaatgacagctttagaatctgaattcagttgtacaggttttagaacctcagtaaaaatgttgcaaaaaggagacaaagcaaataaatcaagaaaaacatacaagagcaaaaataaaatgaaaagcaaaaataaatgtaatgatacttaaaccagtctgtccgttattcaccaaattgcacatattttattaatgcgttagaaaagtatggtgagatatgagaagcttaattggatgtgcactggagaagttttaagtggcagtgtttgtctctaattagggtcattcagatagccagatgaatctttttgtttttgtttttgtttttttgagacgatgtctcactctgtcacccaggttggagtgcagtggcaccatctcggctcactgcaaactctgcctccggattcaagtgatttccagctaatttttgtacttttagtagagatggtgttttaccatattgttcaggctggtcatgaactcctgacctcaagggatctgcccacttcggcctcccaaagtgctaggattataggcgtgagcccccacgcccacatgaatcttcatgtctttaccttcaaaaagaggtgataagaatgtaaacatcaggttatctcctattcctgagttataaaaaaaactgaaagatttttctatttttcaaacccaggctttttcaactacctccagccatggaggagaggtgagggctgggatgtgcggttaaaccctaaacctgataagagtgaaagtgggatacaatctgatgagatcgagtgcattcagggtggtatggctgtagataggatacaacctgtaattctctttcttctctgtctttgtgttaagtgagctgtttcacctcatccctgggggaagcagatagaacgtggtaaagtagcaaggtctttcctagcttggagaccttgcactgtatcttaatttctgaggggctcctattcaaacctcacttttttctctcagtatgtggctcccccttctgagctcaagatctgaagatccattcagtcaggttggaacaataataggtcagtgttaggttctagtttctctctttagaaatgtattcttgtctcaagggtagcttgtatgtttgagacctagaagtccacttttgactgtgcccttgcaacttttaatattcttgaaattcttttgggcgggattcttgtgacccattgccacggagtatgcaccttttaccaaacattgagatgctgtgggtggcatgttaacataaagcaaaaatacatacaatcttaggtattccattatataactaacttaatattcatttatatcacttttctaatgccatttcaattttgcagcaacatataagaatccggaacttgatcgaatagccactgaagatgatctggtagaaatgcaaggatataaagacaagctttccatcattggtgaggtgctatctcggagacacatgaaggtggcattttttggcaggtaattatttattattacttctaagattagtttccaggaatcagctttgtgtctgatgtttcaacaagtaatatttctcccatcctcccccagccccgcaagtttctgcctgtgttgaatgttaaagctgttagcatgtgaaagaatttgtgcattttacctcctggtataaaatgaagctttatgaaagtcaatcatatttttaccttttaatgattctcatctctaagaattggcttgtagacagttttaagaatggaaatatagataaatgataagcatactttgtgttttactcttttaagtttacttgattatgtgaaagtttcagaagctaggatgaaatcacttttgtcatacctagacaggcctagaaggaaagaggctcttgtctgagataactatttccaaggactttctagaaattctttcaaatctcctgctttgataagacttatcaataaacatactttaggactgccttaattcagataaaatgttttcaggagagttcttgcccagtaatggcatctccgccaatgaactgacaataactggcgttgaacctctggaaccaaataactcttgtttctaggcagcttatgtaaatctctttttgctaatagaaacccctcttaccctcactgaatgcactggtatgccattccatgcattccagattataatctttatttttgattcccaagtaaactcagcattttttttttccccctgagagggagtctcactctgtctcccacgctggagtgcagtggcacaatctcggctcgctgcaacctccacatcccgggttcaagcgattctcctgcctcagcctccctagtagctggaattataggcgtgtgccaccatacctggctaatttttgtatttttagtagaggtggggtttcaccatattggccaggctagtcttgaactcctgacctcaggtgatccacccgccttggcctcccaaagtgttggaattacaggcgtgagccaccgcatccagcctaaatttttttttttttttttgagacagagtctcagtccgttgccaggttggagtgcagtggcaccatctcggctcactgcaacctccgcctcccgggttcaagcaattctcctgcctcagcctccctagtagctgggactacaggcgtgtgctgccacacctggctaattttttttttttttttttgtattttagtagagatggggtttcaccatgttgcccaggctggtctcgaactactgagcccaggcaatccgcccacctcgacctcccaaagtgctgggattacaggcgtgagccaccgcgcctggccccagcataatttttatatttttattagagatagggtttcaccatgttggccaggctggtctcaaactcctgacctcaagtgaaccactcacctcggcctcccaaagtgctgggattacaggcgtgagccactgtacctggctaatttagaggtgattttctttagtgtctttcttaagtttgacaattatctggattatggcggggagaaaaaggcagtgatcaggtacgtcttccaaaattttcaactccatcattcctagagggagagtaggaggcgtacattggtgtaacagtccagagtgatagggtgatctctgccacagcttatatgcaaagacaaatgactagctccataactggttattcagctatctgtgctgtgtaccaacagaggcatttatttactaaataacttcataggccttctaagctattttcccatcgtagggcttttgcccttgcaattccctttgcctacaactcacctttccttgttgtagctacgtctagtgccttctcattcttcatatttcatcctaaatgttactaccttggacaccttctctgaccaccctatctaaattattccttctcagttattttctgttaaagcatcctcttaatgtctttcaacacttttcacaaagctcttattttatgtttttattttctgcttctcccatttgaccatattctcagggccttacacagagtctggcatgagacagctccatttaaaaagatcctacttcagattagggtggagtaggaaggaagagcctcctgggaaggtgatgactcaactgtcctactgagaatgagaaataggtatagctttggatgtgaaaaaggtccaaaagctcatttcttgcagaaagccataaatagaaaggggtagggagaccacagtgtgtttggagaactcaagtagttgaatttaaggtgttacgaaacaatagcaaaagaagagactttgtaagcaaaagtcagattgtaaaagaccttgtattaatatatcatggtaaggcgttctgcattcttttattttggaaaatagtcctgagaggattggatgttacaattataaccttagatataatggggagaatgaattgaatgagaacaggggtaggaggcagttgtgataatgttaccagaaaggggccccactcctaaccccaagagagggttcttggaccttgcgcaagaaggaattccggatgggtccataaagtgaaagcaagtttattaagaaaataaaggaataaagaatggctgctgcataggcagatcagtcccgagaactgctgctttggtatttttatggttatttcttgattgtatgccaaacaaagggtggattattcatgagttttccaggtaacgggtaggcaattcccagaactgagggttggtacctgtcccccactttttctttttttgggagacagaatttcactcttgtcacccaggctggagcgcagtggcgtgatcttggctcactgcaacctctgcctcccggcttcaagcgattctcctgcctcagcctccctatagtagctgggattacaggagtgcaccaccacacccagctaatttttgtattatttgtagagatgggatttcaccatgttggccagcctggtctcgaactcctgacctcaggccatccacccacctcggcctcccaaagtgctgggattacaggtgtgagcccccgtgcccagctggtacctcccctttttagcccatatatgcatccattctggatgttgccatggcatctaaactgtatgtattatatacatataatatatatattacaatgagcagtgaggacgaccagaggtcactttcatcgccatcttggttttggtgggatttggccacttcttttatcagcaaggtctttgtgacctgtatattgtgccaacctcctatctcattctgtgacttaaaatgcctcatctcctgggaatgcagcccagtaggtctcatcctcattttaaccagcccctgttcaagatggagttgctctgcttcaaacacctctgacagtagtataggcaggaaattgtgtgtgtttaatacaactatatatattcaagtatagttaccaaaaaggcagttggaaatatgagacttggactagggagaattctaggaaatttaggaattattggcttatgttggtgattgagatcacaggagttgatgagatgatccagggagagtgtgtaatgaaaaacaatgacagcactggggagaggaagagggactatccatggaaatgccagccaggggccaggcgtggtggctcacacctataatcccagcactttgggaggccgaggcaggtggatcacctgaggtcaggagtttgagaccaggctggccaacatggtgaatccctgtctctaccaaaaatagaaaaattaactgggtgtggtggtgcactcctgtaatcccagctacttgggaggccttggcaggagaatcacttgaactcaggaggtgcaggttgcagtgagcttacatcgcaccactgcactccagcctgggccacagaaggagactccatctcaaacaagaaaaaaaaatgccagccaggtaaaaggaaaattagaaagcattggtatggtataaaaagaaatatatttgatctttgtcccattcttgtcacagagcttctaaaaccataggaattccctgagtgattggagtatcttgttttcataatgagccctttttaatgacaactgaatttatgctaatgagtggtttagggtggggtgcctagataacctcagagggtgaccagtcacctgaaaggttaagtgatcaggggattagaggactggaactttccttcccacccacccatttccaggaagggtgggggaggacaggctgaaaattaggctttatgaaaactcttgaacatgattggacttccaggtaactaaactcatggttacgctgggagagtggcatgctgagagggcatgaatgctcaggcatctcatctgtgtcacttacaatatcctttataatgaaccagtaaatgtaagtatagtgcttccctgagttctgtgagctattctgacattgaaccaagatgggaagaggtagaaatgaatgataggacacccagttggtgtttgctggagaaccacttcatgcatgtggaaaaatccccatatatctagttatgaagtgttctgtgttgattttgatagtagaggagaaaaagtttctatttccacagttgttttttttgttcgttttgggaaggcagggtgacagtgtgtctcactttagtatgcataagaatcatcccaagagcatccccagagtcttgattctttaggttcacagttcacttgaggaatctgcatcattaatgggctccccagatgattcttatatggggtggagggacccaaactgtaactataggaggtccatcacccaatgtatgcagcaagttgatatgctgagacaccaggttgcagcagagaagaggtttaatcgtagggtcaccaaatgaggagatgggggggaaccttaatccatctccccaaggaatttgaggttagggtttttaaggtttttggagtacccaaagtgtagaggtcgttgattggttgcaacttgcagagtgaagtcatgggacagggagataataaggctaggctgtattcgcatgctgatccatatcattcctctgtggggggtcttcaaactggttgctggatctgggggcccaaaaaacatcttaagctatccttaaaagtgttacgattctaatgtcagagctcctgtctatagaaagaatgggggtgcaaatggtcagtatctggtgttacatgacatttagcaacaaggaagtgggccaaagtgcagcctgattattaatgagctacagccatatttctgtccagaccccggcatgtaattcttgttaaccctatggggatggtttcagaactactcttgaggatcactgcaaggcttcatgaaatgtccagaaagataaatcttaagagagatcctaggcatccttgcaggatgtggtatattggcaatagaagccaatgttgagctaatgaaggcaagaaggttccctgggaagggagttgggaatgatatccataacataaagaaaagttctttccctcttatgctaaaggaaagaggtaaaacatatgccgaaaagataggatgcttttgcagtgaaccaaaaggctcccagtgatatctgggacttgggttgacttaatggaaagcaagtccctgaagtgagtgtgagttctttgcatttcagagccatcaaaagtgtcctttttcctatgactgcataacagattacccaaaacttagcaacttaacagccattttattatgttcactgattctgtgagtcaagaatacagatagggcacagcggggatgtcttgtctttgctccatggactctggagccttaactgagaagatgtgaagattggggtggctcaacaactgatggttgaaatgatcttaaatcttcactcacatgtctgggacctgggctggaatgattcaaagactaggactgttgagtagagcactactcagagctctccatttagcttgacttccttgcagcacagcagactcggggtaagtggactttttacatggcaaggctccaagtgcatatattccagggaacaagatagaagaacctgcattgtcttttatgacctagtcttggaagtcacccagtgtcactcattttgttttttttttttttttttgagactcagtctggctctgtcgcccaggctggagtgcagtggcgcgatcttggctcactgcaacctccacctcctgggtgcaagcgattcttctgcctcagtctcctgagtagctgggattacaggggcccccccaccacacctggctaattttttgtatttttagtagagatggggtttcaccatgttggtcaggctggtcccgaactcctgacctcaagtgatccacccaccttggcttcccaaagtgctgggattacaggcgtgagccactgcgcctggccacccactgtcacttctgatgtgcattatttgttgaagcagtcacaaaccagcccagatttaaggagatgggatattagaccccatcttgtgataggagtagtgttgcagaattttgacctgtgatttcgaattgccacaaaaagcaagaaagaaaagttgaggatactactgtgagaaaggtgggatttgtcttcttgcactttattttttctgaaatgtacattgctagtatttgtgtaagccaagtggttaatcttttcataaaaatgcagtcttaagaaatcttaacaaaatttggattttaaaaaagttgatattagacccagtgaaagaactactttttttactgttatgttttgtttttcatgattttgtatattcttcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaaggtatgatctttaacctttagcagaataatatacctgaaacaatgtcctgaacttattctttaataacatttttataagatgtctgcatcgctgacatcttataaaaagaactgttaatatttttctttttttttttagacggaatttcgctcttgtcgcccaggctggagtgcaatggcacaatctcggctcaccgcaacctctgcctcccgggttcaagcgattctcctgcctcagcctcccaagtagctgggactacaggcgtgcgccaccacacccggctaatttttgtatttttagtagagatgggggtttcaccatcttggccaggctggtctcaaactcctgacctcatgatccacccacctcggcctcccaaagtgctgggattataggcgtgagccactgcacccggcctttttttttttttttttttgacactgagtctcactctgtcacccgggctagagtacagtggcgtgatcttggctcgctgcaacctctgcctcttgggttcaaatgattctcctgcctcagcctcctgagtagctgggattacaggtgcgcaccatcatgcccagctaattttcgtactttttttttttttttttttttttattagagacagggtttcaccatgttggccaggctggtcttgaactcttgacctcaggtgatccatccgcctcagcctcccaaagtgctaggattataggcatgcgccaccacacccggccaaaaagcactgttaatatttctaactttgaaagccatcactaagtattttgagtactctaaatttttttttcacttcataactaaattagtgaaaaaataaaacttgtccttaatttaaaggtatattagaattaacaagttttttaaatctacccttccagtgagactaacattattttagttatttatttgtttttagatggaatcttgctctgttgcccaggctggagtgcaatggcacgatattggctagcaacctccacctcctgggctcaagtgattctcctccctcagcctcccgagtagctgggattacaggcatgcaccaccacacctgcctaatttttgtaattttagtagagactgggtttcaccatattgcccaggctggtcttgaactcctgacctcaggtgatccacctgccttggcctcccaaagtgctgagattacaggcgtgaaccaccacgcccggctgagactaacattattgaagtgtatcattgctgtttaatcgtgtatcattgctgtttaatctcaaatttgtcccaccttggcctcccaaagtgttgtggttacagacttgtgccaccatgcctggcctccgatttgtctttttgaaacagaattgcttaagaaattgggccctggcatctgtttttgatatgtatctgtgtttttagaaactgtcttacctcaggattatgtagtaagtatatttatgaataaatattttaactttatcagatgagggccaatggcaattccctacctttcataaatttctcaattcagtgccactccttcagccaaaaaaaaaaaaaaataaaaggaaaaacaaattaggatgcaaaatgttgactctggactgaaagcagttagttaaggcactgtttctcattgtggttactttctcttgagtctaaagatctcttccacaaacacaaaagttcagtgcttgatgatccatgctattttatttcttggtaaagtcatgggtggttcttctttgtgaatttgctctttgatgtaaatcaggtaactcaatctgtaagttttagaataagcatacccttcagattagttattagaaaaatgagatgatgtttatgaaaatactattcaaggccgggcacagtggctcacgcttgcaatcctagcacttgagctggtcggattgcttgagaccagcctgagcaatatagtgagaccccatctctacaaaaaatacaaaaattagccaagcatagtggcgcatacctgtagtcccagctacccgagtggctgaggtgggaggattggttgaatctgggaggttgaggcttcagtgagccgtgatcactcagcctgggaaatggagcaagacactgtctcgaaaagaaaagaaaatactaatcaagcttttaattcatataaatgaaggaatcactgttgttttgtgattaagatttttagcaaatcaaaattcaaacttctcgtgacttcagagtctcaaagtatgctgttattttaaagaaatcatctctcattttcctgatccatgctcttccagtcctcttcacactcttttcctcctccttattttagattcaggggttggttacatgtacaggtttatcacatggatgcattgtgtgatggataggtctgggcttcaactgagcccgtcacccaaatagtgaatgtagcattcagtagtttttcagctcttgtcaccttccacctttacccctgtagtagctcccagtgtttattgttcccatctttatttctgtgtgtacccaaatgtttatctctcactttttttttttttttggagacagagtcttgctctgttgcccaggctggggtgcagtggcgtgatcttggctcactgcaaccttcacctcctgggttcaagcaattctcctgtctccgcctcccgagtagctgaaattagaggcacgtgccaccatgcccagctaatttttgtattttttgtagagacagggtttcatgatgttgtccaggctggtctcaaaactcctgacctcagttgatccacctgcctcggcctcccaaagtgctggaattactggcatgagccaccgcccccggcctagctctcacttttaagcaagaagatgcagtatttggttttctgtttctgcattaattgacttaggataatggcctccagctccatccatgttcctgcaaaagacttgatttcattcctttctatggggtgttaaaagctatgtaattttaacctgttttaataatgacatttcttctaatgacatttcttccatatgactaagtgatacacatttatttcagtagaatcagaaaatacaaataggcaaaaagaacagagactccagaacttatatacttcacaaaatcagtatcaggagttgcttagaattctgttgctggagttctttttgagggaaccattttttttctacttggaaatttaaaaattcaggttctcaagattgctcagaaggttttatttcagagttttaccttttatatacctgttttgctaaaataaatgtaccacaatgtttttaatttttattgaattttattacaagtggagtttatttttttcttttcctcctgctttagacagttaatcaactggcccatgcccttcacatggacaaagatttgaaagctggctgtcttgtacgtgtgttttggccaaaagcaaaatgtgccctcttgagagatgacctggtgttagtagacaggtaaaattacatgtggattgcattttctctggaagtttatttaatagtataatactgcttactttagcatatggtataaaaaattacaacattcagttgccattttgttctcattagctagattaaggaagagatatggtattggttttattttataagttacataaaagcaccaattcatcactctgattccatttcaagaaattttaaggatggccactttttttggccagagtgcagtgccgcagtgccacgatcttggctcactgcaaccttcgcctgccgggtacaagtgattctcccacctcagtctcctgggtagctgggattacagacacacaccagccacctcacctggctccattttgtttttgataatggattttccttttaaatggaaatgagtgtttcaagtaatccatagaaacagaggagagagaagatgttcatgacaccaagatatttggtttaaatacaatgttaactagtttagctttatttcatagccagattgtatctatgacccagtcagtcaagattgacagttggatagatacaagaaaatatgaatgagatctagtatttggtaccaaaatgggtaacggtagtgaaaaataattgatttttatttatttttttgagacagagtctcactctgtcacctaggctggagtacagtggcgcagtgtcagcttgctgcaacctccccctccggggttcaagccattcttgtgcctcagcctcctgagtagccaccacgcctggctaatctttgtattttttggtagagacggggattcaccatgttggccaggctggtctcaaactcctggcttcaagtaatccccccatctcagcctcccaaagtgctgaaatgacaggtgtgagctgccgtacctggctgaataacaatttaattgtacatttaaaaataactaaaagaatataattgtattgtttgtaatacaaagaataaatgcttgaggtgatagatacctcgtttaccacgtgatttttttttttttcggaggcagggtcttgctgtgttgcccagtctggagtgcagtggtgggatcatggcttattgcaaactccgcttcccagtcttaagcaacccttccacctcagccaccagagtagctggggctacaggggcatgccaccaagcctagctaattttttttttgtgtatgtggagtcagggttttgtcatgttgctcaggctggtctcaaagtcctggactcaaactcccgccttggcatcccaaaatgctaggattataggaatatgccactgcactcagcccctgatgtgattattacacattgtatgcttgtatcaaaatacttcatatacctcataaatatgtatacttaattaatatatacccataaaaattttaaatgaataaattttttaactttttacaaatatttattgttggcaaattcttcactgcagctcctagtacagttggtatattaaatttatatttttttatttgtgtttataagtgcttaaatcatctctgagccatactggatatagctgcttgaaccctcattgtttagtatctattagcctagttttatatttcagccatctaaagcataaacattaaaaagattgaaatattgagcatgttatttgctttgtcaaagatcactaagttaaaatttcctagacttcttacagatgacagctggaaatcctggtttttaaacttcaaattatatataaaagctgaaaaaattctgtaacccaaattttctttttaagaaatataatacaatttttatttcactctcattagtccaggcacagatgtcactacagagctggatagctggattgataagttttgcctagatgctgatgtctttgttttggtcgcaaactctgaatcaacactaatgaatacggtaggatttaatcatattattgtgtttcgatggtaggaaatgaaatggtatctgttttaattctgaaaagcaagggaaatccatatcgtggattagaaaaaacttctaaaaacaggcatgaatgaaggggtttgtgttttcatagaaccagaagggctgtttctagtctttctatagtgtgtagttccctggatttctctagcagtatagggcttgatggttctagcttctggttatttgtcagtctcagggaaaatgagtgccagaaattttaggatgcttatttaagtctcttgaataaagtataaaccactccttccttctgccatctatcaggcaaggctttttatattttcagtattgtcagctatttccagcttcaccagaatatactccaggtttcagcttaactgtgtacactttaagctgctgtcagacttagaagattatttagccagatgtctggagccagactcatctgaaataaactttccagagtttaggtaatctaatattcaaaattataacatgattttttaaagttatcagtttttttcatctttgaaagtttaatgctcatagagtgctttgggatcctttgtcagtggtgttaattactgtttaaatggttcagactttctcattaaaataaaatttcaattataaatgtaaattatagtgaatgtactgtggggttttttttgtttttcaggaaaaacacttttttcacaaggtgaatgagcggctttccaagcctaatattttcattctcaataatcgttgggatgcctctgcatcagagccagaatatatggaagacgtaagttgttatttttttttttgtaggttttgaaatacagtcacatacattgttatttgagaaaacaatattgcttatagaatagaaaattataagagctattccatgaaaagaagatagttagagaaaacctgaagtaggtatgtgataaagaccaaagtctgaagttactttgagggaaaattgtgttatactatctagttatttcaaagcttgaaagttcttttttgtttaagttgttattgaaatgtacataacagaaaagtacataaatcgtaagtgatccttccagtttggcttcctaaagtgctgggatgacaggcctgagccaccatgcctggccaaattttacaaatttaacacacctgtttcaaaatccagatcaaaaagcagaccattctgaacaccccagaaccttcctcttacctacctccttctaacttcccttctgtcctacttcccaaggagaaattatccatttatcatgacttctgaccccctaaattaatctttctggttgttcaactttatataacagaattatataatacctgctcttgcatctgtttttgtttttatttaacgtgtttgtcatatgtgtccatattattgtgcgtagcatagttgtattgcattcccattgctgtatagtattccatctgtgactatactacaattgatttattcacagtgatgggcatttgggttaatttactgtattcagttatgaatgctactgtgcatatgcttgtatatgtccttctggtatgcatatgtatgcatttttgttaggtagttctcagtgtggaggatggacagttttgacctcaatgggatatttggcagcatctgaagatactttttttttgttacaattggggttttgtgctactggcatctaatgagtagaggttagagatgctgttacacatgctctgacacagaacaggcccccaagcaaacactggccaatccaaaacgtcagtaatgcagacgtcagtaaaccatgggtatatgtacttagaggtaaaactgctagattacaagttaagaatatgttcgattttagtaaatatatagcaccagagttctccaaagtgcttggtgtcgatttatactcctgccagcagattgagtttcataagatttgcatcctcaacttttttttttttttggcattttagtcacaccaattgtagaaacttaaaaagaagtatctggaatttgaactataaataatatttatttaatttgcttgagactatttctgattttaatagtagtacgagattattatatgtagaggacaagataaaaataacttaaactatcccatcactgttcacatgataaaattatttgctttcatttttccccaattggaattttgcataacatcatgttttatatcctcctgtcattaactgttgtcttacagtcttgctctttcaaattggggtctcagaattaggaagcatcactcataaattatttttccttaaatatttcagcattcctatttagatttatttttgcaagtcttaatatagagatctctcatcatagccataatactaaagactagtactaaatcctaacttctaacccttaatcttcacttcagtgcccaagtggtaatcttgaacccaacattgcaattctaatgcctggttaatgcattctacccaaccttaactccccaaccttaactttgttttttgagacggagtcttgctctgtcacccaggctggagtacaggggcacgatcttggctcactgcagcctccacctcctgggctcaagcgactctcctgcctcagcctgcccagtagctgggattaccggcacctgccaccacacccagctaatttttgtgtttttaataaagacgaggtttcaccatgttgtccaggctgttctcaaactcctgacctcgtgatctgcccgccttggcctcccaaagtgctgggattgcaggcgtgagccactgtgcccagcagaattttaaatagatgttcaaaagacagaatcgttaagagaaagatttcctgtcatcaagtatcaaacttcatttattagaatttcttaaattcattagttatatggtaacttttattatatcactgtgaataaagtaagtattggtctatagtcgttggttattatatttgtttaaattattagaattcttttaataccgttttctctgtaggtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtatgcattacctatagatttcctgtttaaatataaaaatatttaaaattggctgggtgcggtggctcacgcctgtaatcccagcactttggaaggctgaggcgggcggatcatgaggtcaggagtttgagaccagcctggccaacatggtgaaaccccatctctactaaaaatacaaaaattagctgggcatggtggtgcacacctgtaatcccagcttcttggggggctgaggccagaaaattgcttgaacccaggaggcggaggttgcagcgagccaagattgcgccattgcactccagctctgggcaacagagcaagactctgtctcgggggaaaaagtatatatatatatatatatttaaaattataaaatcagtagcctaccagaaaacatatcttgctacatactaggtttttaaatctttgcctgtacgttacaggtgtggcacttgctgaaggatttcatgcaagattacaggaatttcagaattttgaacaaatctttgaggtaggaattttgtgattgtattgcctaatacaaaactctttctttggttggagaaagcataatcttctatttttatcctttgtctttgtcaataacttttgctgttatttagtttagttactgacacagccagtaaaatgtggaaagtgaagaaaaggagcccctgcaaaatgatttgtaagaattgagaattaaagattgtaatttattccttattcttatttttatgtattttatataaataagaaactgtgtttcaatattgctgtgttgtgcaatgaatgaaattccctgtattcaataatttggaacaagagtaaacaagcgtaattgctgttggaatggataatagagcaaagtaagcattatccttttttactttgtgccgcatgactaatagaagtatacaaaacatgattaatgccatttgacaaaattttattatatttatatactgtgttaccacatgtccattctccatattttgtgccaaacattctaaatgaataattgagtagaaaagagcttcagcgttttcagaaacttctaggaaactattgaagtgcctgagtggtagatggggagggaggctagtttcttatgttgcattgtaagtgtttttattcagagacattaaaactcaccctacatttgactgaatagttctttagatattaaccttctgaacccctattttgccctgtataattcatatcaccttcccacttaggaatgaacacagtgacttcagcattgaagaaacctcagtctgtaattattcttataagtagtaactgctttaatgtaaaggggacatgaatgttgagtatacttggcaggatttttaaaataaaaaatgtgcttactatctctcatctttaatttggtgagagaaaaaaggttattagacagatgaagacaaactggaagaaagcaaatccactgccagctatctcgataagatctaattgttcagaggctactggattatcagtagatgtcctctcaagccaagctataggatacgtgaagtccccgttactcaaagactattgtttgttttttttcttttccttttgctttcaccaaagggttgatgctctcctcacctcttttttctcttaaagaaatgggatctccctctgttatccaggctggagtgcagttgggcaatcatagcgcattgcagcctcgaactcctgggctcaaatgatcctcccacctcagcctcctctcctcactgttatcagttatttcatccatggggaaaatatgtagggagaggatctattctacttccttgtctttatttactgaccttagtatatatgtgttttatgtatgtttatcattgatttcttctaaattatacatttatataatgtataattgtgtaatgttctgttacacatttatactgcttccatattggttcatggtatagcttgtgcttcccaagaatatctcgttgaggaggtgggaatgagaagaataagatatgctgtagggaattggttcataagcctagctgatcatcagaatcacatgacgtgctttagagaaccacaggctcctgacctatcctatccccaaccccagatccagggggttggggttggtctaggaatctatatacatatatattcaaagttccccaagtgattgcaataatcagacagacttaggaactattctttttaaatgtttttagaggaaacttggcagtttatgttttattctaatggtccatttgggattctaaaatttatgtatggaaaaaattgcttatgagcagtagctttttgtttttacttaaagtcatggaatgtccagctttagagtttgaaaattttaagtctgaaatatctaaaatgagaatcagttaaaaattatttgaatttttccaaacaatcagctgggcaaaaaatattatgtctgaatgtattaaaaagagacaaaacattttttgttaattaattacattgaaagttttagtcagctttattccaaaactggtatttgttacttcttaagtcagttttggtaatttctgatttcttagaaattggtgtatttctgaacatttataatttagtagcataaaattgtttgttttgaatctcttgtttctcacttctatatttaaatataaatatatatctacatatacatacacacacagacccttaatgggtttgccaatgatttatcatccaaagacacagccccagctcttatgtaatttatcacttaataaatatcatttttggggtttcattcactaagttctttttttttttttttttttttttgagacagagtctcgctctgtcgccgccaggctggaatgagggagtgagtgcagcggcgcgatgtcagctcactacaacctccggctcctgggttcaagggactcttctgcctcagcttccctagtagctgggactacaggggcacaccactacatccggctaatttttgtatttttagtagagacggggttacacagtgttggccaggatggtctcgatctcctgacctcatgatccacccgccttggcctcccaaagtgctgggactacaggcgtgagccaccgtgcctggcctgtgttcgtctttaacattgtttacgttgaagatgcattggtttttgcttattcttaaagaaaagattcaggattgtgaatttgtgactgcagctttaggcgtatcccaaggttttcagtactagtttagtttttgttgtttttgtttctaattatccttttggcatttccttatcaatataagactttttaaaattcaagtgttttgattcattttatccaatttttggttactaatttcttggtttctttgtgttgtggtcacatcatgtggcttttacacacattttctctgttttggggatttgcttacttttttttgtagtcgtgcaagattttttgtgaaaagaaaaactgtatcaagttcatcacctttatcaatttgacctgtgccgtgaacttctttagattcatttgattcaaatggatctaagtattttaaacatttagaatactaatttaagcaaggcttgaaaattaaatggagtaaaagcaataaaaaaaatcaatattagcctgggcattggtggctcatgccagtaatgccagtactttgggatgccaaagcaggaagatctcttgagcttaggagattgagatcaggttgggcaaaaacatgaaaagactaaatcacatctctagcaggaaaaaaaaaaatccagatatgatagctcatgactatagtcacagctaccccagaggctgaggtagaaggccaagaagtttgaggctgtggtgatggtgagctatggaggtaccactgtgctccaacctgtgtgacagagtgagactctcttttctttcaaaaaaaaggaagaaaggaaaatcaatgttagtctgtcaatacattttcttattgttttaaaactgtatttggaaagtttcaaaatgcatttggactgcattgttctaaaggcaagttagaaatccaaatatcttttgcacagttatttcaccattaattcttactagttttggttgtatgatgggagatagacgtataaaaataacttatttaaaatgtcagtggatttttttgtaatggacattcctggatgataggtgaaatttgaacatgaactgtttgttagataatagtattgtctcaatggtaaatattctgaatacaattgttttgtgattgtgcaaatgttttctttcttagaagacaagtattgatgtgttaggtaacaagcttgtgatgtagtaatgacctgtcaaaatgttcaggaaggaaaataatacataagtatatataaaaatatatgcctctctttatatatatgggggtcatacattttatatattcattgcaagacatgtattatatatattatatatatttattatatattatatattatataatacatatataaatattatatataatgttatatataaatattatatatatatgccctcacacaggagagagagtatcgagcgcgagtatggagggaggggagaagtaaacaaaaggggctgaatgttaatatttgatatatctagatgaaaggtctatttcttgcactttctattgaaagtatatcaaaataagttggcagtgatgagtagcatgttaggtgtttgtagggtctgttttcaagggaaattgacaagtttgttggttttatgttttaattacatatataaatttatattattaatgtatgattagagttcctgataaaataaatctgggaactgctgcatattatatatgttccccatagagattaattagcatattagtgtagtaaggatgctgagaaataacttagaaggggaactttatttaaattaacacttcccatacttatttggagtaaaatgttcttttttcaaggtacctcttaaatatcctacagatcagtgggaacaccaatgtgggattactttttaattgattattttcttctctatacttactcatcattatatatttttgaatcagacagtaacttatattgcctaataacttttggagatcttttctgtctcgtctagctctaacactgtgctgttatctacaaatttggatcttcattgctgatatctagatctgcttcatcgaggaatatagactttattttaatctttttccttttaaaaatatttttgtttttataattttgcagaagttaatttgacacatttatgaggcatttatttaaaataaagtcaatgcattattttagttattaaaaaataagtagtttacaaatgttcactattatgtaattattggtgattttaaagaagaaaacatccgggtatgttttatctttaggtgtgtacagaacaggaatgctataacttcctacattaattttttcaaaatcagtgaaaataagtgatgcataaatgagcttcaccatgggaaaaaatgaagctaggcaatgcaagaaagtaatggcttcagagttaaatattgactaaattaattaccctcatgtgctctatagctaaataatctgttttgttttctctacctcaaacgaaatgctgaagaggggagctaaaatggcagtagagattatagtctttctgagtgctcaaataatttcagagacatgaaggctaagcataggtcgtaaataggacattgaatgcacgtgtagcatcctgatgatttcaggataagaaatgtagcactagagtattaagtaaatgccttttgaagcctaaaagccatttattaaaggaaggatagtaatgaacttcaggaagcaattaccacaatttgtattagctaaatatatagaggttcgagaagatgaattcattggagtatcagagaattaatatatccctaatttttaaaaaatttatcatagaaaataaacatgtctcttataaaacatctatagtacttactgtgctatatttcagtgcagaatttgactttctgtgaagtaaaaatgaaataagacaaattgtaatataaaaattttataaatttttatttatttattttttgagacagagtctcgctctgtcgcccaggctggagtgcagtggcgctatctcagctcactgcaagctccaccttccgggttctcgccattctcctgcctcagcctcccgagtagctgggactacaagcgcgtgccaccatacccagctaattttttgtatttttagtagagatggggtttcaccatgttagcctggatggtctcaatctcctgacctcgtgatctgcccgcctcggcctcacaaagtgctgggattacaggagtgagccaccacgcccggcccaattttataaattttaaatgataaatcatagtaaatatatatttataggatgggcgtggtggctcactcttgtaatcctagcactttgtgagactgagacaggcagatgacttgaggtcaggagttgaagaccggcctggccaacactgcaaaaccctaactctactaaaaatgtaaaaattagccaggcatagtggtgcatgcctgtaattacagctacttgggaggctaaagtaggagaatcacttgaacctaggcggtggaggttgcagtgagtcgagatcatgccattgcactccagccttggtgacagtgcaagactgtcaaaaatatatatataacatatataacatatatatgtaatatatatataacatatataacatatatatgtaatatatatataacatatataacatatatatgtaatatatatatataagataacaagtattctatatattgaaaattgaaacaaatgtgaaatgtatccattgataaatgtgatgcattgtgacgtattttttatttaaataaacactggttataaaacactgatttataacaactattttaaatgggttgttagcttgaagataaatgagatagggcatgattcaggtttctgtgtacacactatattctaatgaaagtaattacaattatcttctaaacagctgcagatattttttctataaacaattttagatgttacattgttaaatgttagctttcaaattcttcacattttaactcaatgaagtcctttttagcaaacttacaggaatcattgtatcattcagctattaaataaggaattgttctaattcacatcttaattaagaactttactaggttatatcttttgcaagtatgagaataatctagatagaaggactagaattggattaaaggtgatccagataaaaatagtaattctaatgaggaaattttttaacattgaaaatagtaccctgtttattttttttaatgttagagtcaaaccattgcacattactgtgtaaaaatacacaaagatggtaacttgctgctaaagccctttttacttttgaatctttgtatttttttcacctttgtaattttaagttgtgcttttatcactcatttgttttctatctttatttctgtttgggttaaagttacaaacagcaagtttttgtgtttaaattcctgaaaatgttgcgatggaattacagtaatgtgttacggcttgggcccctcgcaggagtgtatctcgcagtcagcagtgaaaacaaagttcgaacagcacactatcagagctaaacagatactagctactgtgaaaaacataatggattcagtaaacctggcagctgaagataaaaggtatgagttcattttgttgcaacataaaaatgttagtttttttgtcagacttttgttaagatgaggttttaaattgttgtactataaatactttttacactgaaatcaaccttgtgggtttaactgatgcctacttctatatttttaagtgcgtatttgaaagtgtcgatatttattctgcaaccttgcacacatcatttatatcccctggacctcactattcctgtgtatgaattgtgatttttaaaatgttttgtggctttaaaatatctttgaagcagtggaagaaccatttcttcaagcagatttttatgaagaagtccaaaacaggtgatcctctttctgcattcaacccacgacccattttttaatatggtcatacattggtattttgaaatcactattttatactagttgtgtttgtttattgcctggtgaacaaacaaggcgatgctacctgccaaccagaaagttgatttggtaagcagtaccctttatgttatactgtacggcattattttatactatttgttaccttgtaaaggtggcaatgaatacatgaaaataccagcattatcgatacaaagtataattttcacaaacttggtatgcttgaaacacagatcgggatgttattagatgtgacaaaagtaatgatgttaagcctcgataggaccttcagtggacttaagccagttgaaggaaacataaacgcatcaaagcttaagtccaagatgacataacattggaattttaaatgtatttgctctttcagggaacaaagaccccttcatgtccctgtctgttgctttataatggtactttcttaggaatgaattaagttcaaatgcagagaattgccagcatataaaacgcaaggatcagaaccctgagtttgaactcagcccctgtgtacagcctccgtgtggcctctgtttaattagatcgtgctgctatagcagttccttctagctcagttgctttgatgtagtacccaaattttggcctaaaagtgatttaattagtaataatttttaaagatataggatgttgaacaaagtatagcacaaagaagatgtgatttgaggattgtataatcataatgtcctgggaacttcttaagtaaaagatcttcttaaatggatctcaggtctttattttcctgtatcagccagagttgaacaaacttttgtttaaaaaaagagccagatagtaaatattctaggctttatgggccataaagtctcttggagctactcatttctacagttttagagcaaaagcagccatagatagataataggtaaatgaatgggtgtggctgtgtttcaagaaaactttaacaaaagctggcagctggctagatttggcttgtaaggtgctatatgctgacccctgcttattaactaaagtcagtattgcattctgttttgcctgttcatatctatgaagacttagaattcttattcatcctttctgggattcaggtgccacatgggcagagaaacgtggtttctatcaaatcatctatataaaatactttataagtgaaatattacttgaatcctttgagatgttacaagttttttttttccttgagtcatgctaatagatggttcaatacatgaatgagtcccttgctgaaatgctttaggacttcagactaccctgaacgttgattactctttatactgaaataggcattattcagtggaagagagggaagaccaaattgatagactggactttattcgaaaccagatgaaccttttaacactggatgttaagaaaaaaatcaaggaggttaccgaggaggtggcaaacaaagtgggtaacagtagcttcatgattaaaataacctggatggaaattatttttgataatgctaaaaatgttattcctgttactttaaaagaatgttttcagatttttcaatttaatttttttgaataattgataatcttgtttaattattttaactccaaaattttcatattttcaggtttcatgtgcaatgacagatgaaatttgtcgactgtctgttttggttgatgaattttgttcagagtttcatcctaatccagatgtattaaaaatatataaaagtgtaagttaaagtatagataaaattattcagagacagtttcttattattctataccctcatttatttcatggtttggcatttcagtgtatcagtacaaaatgaaactgttagatctcttgtgccctcttgtaataaatgtaaactgtcttgtataaaaagtaaatagaaaatttatacttagaatgagataaagatcattttaggacgaggcacagtggctcatgcctgtaatctcaacactttgggaggccgaggtgggaggatcagttgggccccagagttcgagaccagcctgggcaacacagtgagaactctaatctacaaaaaacagttaggctggttgcggtggctcccgcctttaatcccagcactttgggaggctgaggcggacggatcacgaggtcaggagttcgagaccagcctgaccaacatggtgaaaccctgtctactaaaaatacaaaaaaaaaattagccggtggcaggcgcctgtaataccagctactctggaggctgaggcgggagaatcgcttgaaaccggaaggcagaagtggcagtgagccaagatcacaccactgcactccaacctgggcaacaagagcaaaactctatctcaaaaaaaataaaaaatagccaagcatggcgacacgcttctatagtcccagttactcaggagtctgaggcaggaggatcgcgtgagcctaggaggtcaaggctacagtgagtcaagatcaaagcactccagcctaggcaacaaagcaagaccctgtctcaaaaaaaaaaaaaaagtcaaattaaaaagaccattttggcatttactgaatattttatgtctttataaaaactacatactttctggagaaaaaataatatggatatttaccattgttaacaggaattaaataagcacatagaggatggtatgggaagaaatttggctgatcgatgcaccgatgaagtaaacgccttagtgcttcagacccagcaagaaattattggtaatatttatgtctacaaggtcatgtctggtttgttttttcattcatgactggtgaagagcttattttcctttaggcattccattgaaggtaaaacatttaccattcttatcttaagtgttgtaattttgttctttctagaaaatttgaagccattacttccagctggtatacaggataaactacatacactgatcccttgcaagaaatttgatctcagttataatctaaattaccacaagttatgttcagattttcaagaggatattgtatttcctttttccctgggctggtcttcccttgtacatcgatttttgggccctagaaatgctcaaagggtgctcctaggattatcagagcctatctttcaggtatgtatctttgaatctaccaattaagactctcctttattattttgtttatgtggtttttctataataaaactagctttacaaaatctgcacatttaaaagctagtatctatctcttagagccatttctgaggtagatatttagtttgagcatctccaatctgaaaatccttaaaggtccaaaatgaaaaactttttgagtacggtgacaccacaggtggaaaattccacaccagacctcaatgaggtcatagtaaaaacgcaggcacacaacacacagtttattcagtgtcctcaagggaaaaaagactcagcctcttctagctgcaatatatcttttccacgtatgcccaaattcccccacacaagcacacctatgaagggtactaaaatggcacatgtgcaggtccagtgcaccaacagcattttccccatgatgccccacaaggggccaagacctttgtgcattacccagtatgggcttctttacttcctgtcttttctctggtgtaaagatactgtttaaaaaaaatttttttttgagtggggatgcgtttgagacagagacctgcgctgtggctcaggctggagtgcagtggtgcaatcttggctcactgcaacctccacctcccgggttcatgcgattctcctgcctcagcctcctgagcagctgggattatacgcacccaccaccacacccagctaatttttgtatttttagtagacatggggtttcaccgtgttggccagactggtctcgaactcctgacctcaagtgatccacctgcctcagcctcccaaagtgttgggattacaggcgtgagccacagcacccaggctgtttaaaatgtttaaaaggcctacagatacccttgtgggtgacattgataagaaaaagaagaggcatttatttttatttataacacataaatttaagctgttggaaaaactggacaataatgtaagtgagaaacttcttacagaagaatgatgttggaatgaacaccatatatgacctaaaagaaagaacaactttcctaaagttgttctttaggactaaactgttgaagttccatgctaaaaatgatgacagaagttaatgaaaaaaacaaaaacactgcagaaagttaaaaacgaagatcttgatcatgcattgaaagagtggatccatcagcattgcagtgaacacgtgccacttaaggacatgctgatcatgaaataaacatctattaaaatgaactgaaaatcgaagggaactgtgagtattcaataggctggttagagaaatttaaggtaagatagcattaacttttctaaaggtttgtggtgttaaagcatcttgatcacaaaacagcagagaaattcattgatgaatttgccaagattgtctctgatgaaaatctgactccagaacaagtctataatgctgatgaaacatcactgttttgccattattgacccagaaagacactgactacagctgaggagacagcccctacaagaataaaggatgcaaagaacagaataactgtgctgggatgtgctaatgcagcaggcataaatgtgaacttactgtgataggcaaaagcttgcatcctcactgttttcaaggaatgcattttttttactagtccattattgtactaacaaaaaggcatggatccctagggacatcttttctgattggtttcacaaacattttataccagcttgtgtgcacttgcagggaagctaggccggatgatgactgcaagattttgttattccttgacaactattctgctcatcgtctagctgaaattcttattaaaaaaagtgtttcattatttcaaccttgtgaccagggtattctacgatcaatgaagagtaaatacaaaaaccttttttgggcagcatgctagcagcagtgaactgaggcctgggtgtggaaggttttcagaaggagtttagaatgaaagatgccatagatgcttttgccagcacaaggagtttaggatgaaggatgccatatatgccagcacttggaagacagtgactcagttgtgtatgcctgcagcctctgcctgtcactacatttattgatgatgaggagcaaattggtgactttgaagtatgtcaagtgagctccttatgcaaaaaataatatcttcagagtccatccgtaagctggaagaaggatatatcaaagaagtgtttgacattgataatgaggtttcagttgttcattcattaactgatggcaaaatagctaaaatgcttctaaatcaaggtgattatgataatggtgataatgaagatgatttcattgacctcgcagaacaactgcctataggcagcatggtgatgggcttattgaagcactagagcagcatgtattcataacagaacaagaaataggtttataaaatcaaggagagacttcaacaaaaaccattgttaaagaggcaagtaggtggtactgcaggaaacattttaaaaggccattcagcacaatgtcttattatgccgagaggacccacttcttggtccctcaactgcttctgatgtttcttctcacctaacaaagtactgtgtaccggaactttttaatcaaaacataacattgtaggtagagactgaaagcctgccattgttgctgtttaacagctgatacaggtgttctggtgatgccactgtgctgcttagtttgaatacgttatttttcactgttattaatggtgtgtcttatatttttactattaagttcctttgtgtgaatccgtgtaagaaaatgattgcttgtcagtagtatgtaaattcaatcaagaatgatggtgatgccaaacaaccatagagtgttcacatgggtggctgacatagcaacacctgtgttttctgataagtcagtgtacacaacctttgtttcatgcacaaaattatttaaatattggataaaattaccttcaggctatgcatataaggtatatgaagcataaatgaattttgtgtttggacttgggtcccatcctcaagatagctcattatatctatgaaatattcaaaaatcctaaaaaatctgaaatctgaaacacttctggtcccaagcattttggataagggacactcaacctgtagtatgcttaagggaaagcttatcctaaagctttcgtccaatactgttgcaggtggtgctacattcatttttgaaacatttctgttttcttaaaagatttggttttcacatttcaaataaactagcataaatacaagcatttttttaatttttttttattatacttttaagttctagggtacatgtacacaacgtgcaggtttgttacatatgtatacatgtgccatgttagtgtgctgcacccattaactcatcatttacattaggtatatctcctaatgctatccctcctccttcctcccatcccacaacaggccccggggtgtgatgttccccttcctgtgtccaagtgttctcattgttcaattcccacctatgagtgagaacatgcagtgtttggttttttgtccttgcaatagtttgctgagaatgatggtttccagcttcatcgatgtccctacaaaggacatgaactcatcattttttatggctgcatagtattccatggtgtatatgtgccacattttcttaatccagtctatcattgttggacatttgggttggttccaagtctttgctattatgagtagtgctgcagtaaacatatgtgtgcatgtgtctttatagcaccatgatttatattcctttgggtatatacccagtaatgggatggctgggtcagatagtatttctagttctagatccctgaggaatcaccacactgtcttccacaatggttgaactagtttacagtcccaccaacagtgtaaaagtgttcctatttctccacatcctctccagcacctgttgtttcctgactttgtaatgattgccattctaactggtgtgagatgatatctcattgtggttttgatttgcatttctctgatggccagtgatgatgaacattttttcacgtgtctattggctgcataaatgtcttcttttgagaagtgtctgttcatatccttcgcccactttttgatggggttgtttttttcttgtaaatttgtttgagttctctgtagattctcgatattacccctttgtcagatgagtagattgcaaaaattttctcccattctgtaggttgcctgttcactctgatggtagtttcttttgctgtgcagaagctctttagtttaatgagatcccatttgtcaattttggcttttgttgccattgcctttggtgttttagacatgaagtccttgcccatgcctgtgtcctgaatgatattgcctaggttttcttctagggtttttatggttttaggtctaacatttaagtctttaatgcatcttgaattaatttttgtataaggtgtaaggaagggatccagtttcagctttgtacatatagctagccagttttcccagcaccatttgttaaatagggaatcctttccccatttcttgtttttgtcaggtttgtcaaagatcagatagttgtagatgtgtggtattatttctgagggctctgttctgttccattggtctatatctctgttttggtaccagtaccatgctgttttggttagtgtttggtagtgtagtatagtttgaagtcaggtagcgtgatgcctccagctttgttcttttggcttaggattgacttggcaatgcgggctcttttttggttccatatgaactttaaagtagtttttttccaattctgtgaagaaagtcattggtagcttgatggggatggcattgaatctataaattaccttgggcagtatggccattttcatgatattgattcctcctatccatgagcatggaatgttcttccatttcacccattcacaattgcttcgaagagagtaaaatacctaggaatccaacttacaaaggatgtgaaggacctcttcaaggagaactacaaaccactgctcatcgaaataaaagagaatacaagcattttaaaagaaaaactttaaaaaatttatcaattcagtaattttttaggaaatttgtgaaattgtaaaaccatcaccacaatttagttttagtttttgtcacctcaaagctgttttactcatttgtagtcaattatgatttccacctccagcctcaccactaatctgccttctgtttatggatttgccctttctggaggtttcctataaatgcaatcatatagaatgtggccttatatgactggtttctttcacttagtataatgttttcaaggtttatcatcatggtatcagtgttgtaggatgtatcagtacttcatttcttattacggctgaggaatattccattatagatacaacactatccattcaccagttgatggacattagggtagtttgtagtttttggccattatgaatactgctataaatattcatgtacatgttttttatgtggacgtgcgttttcatttctcttgagtatatacgtaggttctaatgggtatagagtagtattcgttgtaggtttgatttgcatttccctaatgaccaatgattttaaacatcttttttgtgtgctcactagccatttgtgtatcttcttttgtgaaatgtctattcaaagcttttacctatttttaaattatttgggtcctatagagttgcaggatttctttgcatattctggatcaaatcctttctcacatatatgatttccaaatatgtttctttattttttgagacaaggacttgctatgcccaagctggagtatggtggtgtgatcacagttcactgccacctctgcttccaaggagctgggaccacaggcatgtgccaccacacctagctaatttaaaagaaatttttgtagacacaaggtctcactgtgctgtgctggctggtttcaaactcctggtctcaagctatcctcctgccatggcctcccagagtgctgggactacaggcataagtcactgcacccagccccaaatatatttctcttgcctgtggctgtgtgttttgaagtttaagaggtttttattttgaagtcctttttttttttttttttttttttgagactgagtttcactctgttgtccagactggagtgcagtggtgcaatctcggctcactgcaagctctgcctcctgggttcacgccattctcctgcctcagcctcccaagtagttgggactacaggcatccaccacctcgctgggctaattttttttttttatgtatttttattagagacagggtttcactgtgttagccaggatggtctcgatctcctgacctcgagatccatccacctcggcctcccaaagtgctgggattacaggcgtgagccaccgcgcccggccgaagtccttttttttttttttagtttatcattttttgttgttgtttgtttcaaggattgtgcttttgttgttagtttttttaaaaacacactttgttcctcttgagagttgagggcctactgttacatttagaccccattgtatattatgaaaatttattgttcatgatatcattggtccatattgtagataagaatttccaaattatttttattttctacatatatttgtggtgtactcatcatttagggtaatttttccctcatagatgtgctactataattttagagttttataaagataactttatagttgtttaagtgtaatcttttttcctttctctttttttttggcagctccctagatctttagcttctactcccactgctcctaccactccagcaacgccagataatgcatcacaggaagaactcatgattacattagtaacaggattggcgtccgttacatctagaacttctatgggcatcattattgttggaggagtggtaagaaacattacttttagtataattaaaatcgaaatgtttgcaaggctgcctgttagctcacaaaagaaaaggtatacagtatttacttctatttataggatctgtaaaatagtatgaaaatttgcaggttaaaagtagtgaattaaatatcacaagtttcatcttaaatttttaaaaaacatacatctttaggaatgaactatcaccacctagctggtctttaatacttcctaagcattttcacatcacagcacacaaagaaatatttgtacgttgaggtaataagaaaaccccaggtgccctatctagccttctctgaatatcaaggggatctgtcttaagtattaaatgttatttttagtagtagttcttatttgtttctttaaaaaatgtatatcattaacagcatggatatgcttgttttggtttttgaaaggtctgacctacaatatttaacattgttttatttttgagatacattgaatcaggataagtctggcagcttataaagctctccctcatttgtgtgctgatcccttttaagcctgattgatttctggtaacttcaggttttctcatggagaaggaatatacatttttagaaaatgtatctaactcaaagatccatagggaactaaaatgcttttaaatgtactctccaaagtggtgtttttccttctcagactaagctatgactttatcttacagatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacagtaagttggaaggtgcatctttcctttaaaaaaaagttactgaaatatgacatacatgcagaaaaagcacaaaataagtgtattgctcaaagaattatcacaaaatgaacatgtttcgtgatggccataaatgagaaaaaatagaacaatactaaacctcactgctgccctttctccctcctaatcactattcttctttccattctcctgatagattaggtttgaacattagaaaattggtagataggaactctcaagaactctggaggggtttaaaaagatagttcttaattttttttcttttttttcagagatagggtctctgtcgcccaggctggagggcagtggcacaatctggctcactgcagcctcgaatcttgggctcaagtgatcttactgcctcagcctcccacgtagctgggaccacaggtgtgtgccaccacaccaggataattttttaattttttttttttctttgagacagggactcaatatgttgcccgggttggtcttgaccacctgggctcaagtaatcctccctcctcaagcctcctgagtagctgagattataggcatgagccaccatgcccaactcaaaagatcttcagcagacctattctaaatttatgtacctggctgggcaaggtggctcacgcctataatcccagcacattgggaggctgaggcaggcggatcacttgaggtcgggagttcgagaacagcctggccaacatggtgaaaccccatctctactaaaaacacaaaaattagccgggcatggtagcacatgcctgtaatctcagctagttgggaggctgaggcacaagaatcgcttgaccctggaaggcagaggttgtagtgagccgagatcacatcactgaactccagcctgggcgacagagtgagagactatgtctcaaaaataaataattgcccttaagatatttgtggtttctttttttttttttttttttttttttttttctgagatggagtctcagttgcccaggctggagtgcaatggcacaatctcggctcactgcaacctccaccttcctcattcaagtgagtagctggcgtgtgccaccgcacccagctaatttttttttttttttttgagatggagtctcactctgtcacccaggctggagtgcagtagcacgatctcggctcaccacaacctccgcctcccaggttcaagcaattctcctgcttcagcctcccaagtagctgggactacaggtgcatgccactacacctggctaattttgttttgtatttttagtagagatggggttttcaccatgttggccaggatggtctcaatctcctgacctcatgatccactcgcctcggcctcccaaagtgctgggattacaggtgtgagcctccatgcccagccccttgcccagctaattttttttgtattttttttttttagtagagccaaggtttcaccatgttggccaggctgatcttgaactcctgacctcaagtgatccacctgccttggcctcccaaagtgttgggatcacaggcgtgagccaccgcgcccagccagatctttgtggtttcttaataaagaaaactgaatgaatagaggtagcctggccaagcagtctaagaaagctgaatgaattcttagcatttaacaaatgaacttaatggtaggtagactcctgatttcatggtgaatgtaatgtatatttgctctcgcagttcaaatgtatacgttaaatgctattttatttttagatctcaggagaattttattataacatatacctaagtccacccggtttctgcttttatacaacttaaatatttgtttcattcatgtggtaaaaatatatagaactccagtcaagtcagggtacaatattctgtatttggatgcctctgagagcagaatttaaaaattctttgagttcaagataacttcagtttaatggaagaaactaacatttacataattataatacaaagtgagagtgataagaaatataagagaaagagaaaccattatcataaggcaaggctgtacaagttacttaaatcatgaaggatagtagatcaataaaggtttcctaggggagatgtgtagcatatgagatttgaacatgctgtatcggaagatcagatggagacaacaacccaaatcaaaaacaagaaggtaaggggaaaagactgcattcaaagacatgaagagaaatattcaatgtggcacatgtgtatctaagctgtgtacatacattcaggtgtagacttcatagcaggatgtggccttgtctgtatgtgtagattggggtttggataattaggaattccgagagtgatgtcaacacttagttctagaacagataactttgcagtagtatttgaaattgtttagactcaagagacaggaattgcaggaacggtaaactgttgcagatacaaaatcaaagtctgaactaacagttaataattgtagagaatggttaccaggagactgcaaatttgaggaatttgttcatttattcattcattcattgaccaagttttttgagcctctattttatctgatagttttaatttatattaaggatgagttttcatctagttaagatacttggacatccaaagaatcagctgaaattcatataaataaaaacaaagttaatgtagctttccctgcattgattatcaaacatttattaattgcctcccacgcagcagttcatgctaggggttatgggaaataaaaactcgacttgatcctctttcttagaagactttgcacattaatggaggcaacctcaaataatttctcagttaaaataaactaagtaaatatttaatatttaacaaaatattaaaagaatgacacatgcttcatctgtctgagatttggtggaatgggaagaggtatgctcccatttaaaaatataatgtttgccaaagttaatatatgaattagccctcaaatataaccctttgattctagaaatattgttaaattttgctataaagtatttttgcctatgtcacaaaagtgcatggaattttttttctgttcttgataatttcttactttgcgcagggccccaagcatgagtaaagtttattgtgcttctgaagaaacacacccatcttttgtctttatgtagcttattcatgttcacagccatatagcagaggtaatatcgtctcttgagccaggataaaatgcagcccactagtgccatatcttccctcttatcattcttagtgttctgattccctatagtttagaagttttttaaaacttgtgttcttctttttatgtgagctttaaattaaagcttattcatttttgaagacatttatgactgcttctaaatttttattttaagacaaatagctaccacttttgctcgcctgtgccaacaagttgatattactcaaaaacagctggaagaagaaattgctagattacccaaagaaatagatcagttggagaaaatacaaaacaattcaaagctcttaaggtatttaaacctttcttctcaataatttgaacatttactggtctcattacaaaatatgtaaaattattaatgaatttgtattcattcctaatagctttttgtgttggtttaaatgaaaatcttccatatttaattccatgtggtttgcagtttcaccgaaggtttaaatgaaaatcttccatatttaattccatgtggtttgcagtttcactgaaggctaattgcaacaagaaaacaaatctgaattgaaagggactttatagatcgaaatttactcttcattaggctatattattcccttttcagaacagaagttgtataattaaaagtgaatttttagttgtgtatgtccaagacccataacttctgttttcatgggggactattgattatgtatacttaaatcataaaagtaagatgtcctgataaaatgtggatttctggtttgatatgattcattatatattatttagggtctaataaaatttgcttttggggacaagactgaaagtgtcaccattcggtctgtagttggaaattcttactcagtgcttaagaacttaactttcagctttcttacttttgcttacccattagctggcttgtcagaatgtcttggaagaaccattaaacctcatttagtccctgctgttacttctaggacacatgctacacaaaattgcctgtgtaagaacagcttagtagtcaatgtttacaaattggagggactgtctttgtgacctggattttggggcatgtacttaaaacatccatagtagtgattatccatccatagtgtcttcatctgaccaacaacacgtgttcattgtaccttagtttcaaaatctctggaaaagatgactgcctatcacttagatatttccaacctcacccacccatgtgaattgtatgtattagattgctcctattttaagtcagctcatcccatatatacctttcaaatgtggtgaaactgtgcagtagaaattggttttttgtcttaacctaggtaagtttttatggttttttggttttgatttattcagcttttgaaagaggaatactaggtaagtttttaaatagtatttcattttgttataataaatgataaaatagattattggcattagtcatgtagctttctgatttgggcaagactggcttgaataagtatgaatatttttggtctgctaatcatttttctaatagaaaaaagttaaaaaaaacaaataccataatatttggaatttccattttttactagattaggctcagccatttggatagaatttaatgtgctaacgctgcaggagagctacctcaagaaatatatacagtagagttcagagctgatgtatacttgtatgacctgaagcatatgcacacaggaataaagtaaaacaagaccctccccgtccataatggagagagagagcccactcaatgaatatgtgccctggcatagtgtgagagtgggaaacaaatctgtttttctgtcagttttagttccagttttcctctcttgtgggcatttggctgcatcaaggatgaatctagtgtttaaaggaaatatttttggtatgccattgccgctgtaacatctgctactttccttgtatgtccataagaaacactgtgtactttgtgcattatttaaagggaatttgcaagcataatcatgactctaggtaacttaggatatcccgtgtaaggtatgattccactgtctgttatgctcttcattgtttattattaaagtttttgtcttttaataatggatggaatgcatttttctccttgacctttatagtaattagattggtgttttatttttttaattagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccaccaaggagtgtggaatgtccttgagtgtattatttatgcaagtcacagtcacgttgccatcatggcagctatgtgaaacactaataaatgtgtttttactttttattcccgttaaaactgatgtaaaacaggataaaggcttgttatagtcacttataagtatctgggtctaagtaatttccttagatgtttctaaagaaacattttcagctttgctcccattatgattccaataaggaacgctttcctagtgcaattttaggagtaaagtttgaagagataaaaatagccaaagataggagacgtctgaattttgaatgataaacagtgatgttttaaaaaagctgttgttcttcaggaggcatttgcctaggatattgctggattataccccattggaggcttttaattttatttgtatgaattttccaggatttcattaaaaattattattgtattttttaccttaatgaaagattttgggttcaaatatctttctatattaaaagctgattgagtctgtacatatgtaaattatgcctagtggaggttctgttgactttcttccccactgtggaagaggccagttttgcctccatttgcacattcatttcagttatttctgatccataaatataacatttacaaaattcttccttgagctggtggaaatgcctcaccagtttcctctttaatgaatcaaataaaatctttaactgatgttaa

SEQ ID NO: 2583 - DNA, 33335 bp, Homo sapiens
  source 1..33335: mol_type = genomic DNA
atgatgcagtgggagtccgagcctctgcgtcgtccgcttgggacgcgccggcggaggagtggcgcgcggaggagtggcgcgctgagacgccgctcgaagcgccgagtcgcggggcagcagaggcgtaaggagtaggcggggcgagccggctgggctcagggtccaccagctcacccgggtcgaggggcaatctgaggcgactggtgacgcgcttatccacttccctcctcccgcctccccctggggtggcgctcgctggtgacgtagtgagtgtgatggccgccgcgaggccgggaaggtgaaggtgagagggcgagcaagccggggtggcggggactggcccggcccggcccggcgagtcctgagcagctcggcgtgggccgacgggattctggggccacgggggtctgggatgcagtcaagcggggtccccactctccggcctcgccgccgggccctccccggccctgagaggagggggcgggccacgggacctgggactggtcggtggggtcccctgtagcttctcatcgcccccgcctttccacccttcacggccatgttctacccctgccccttctctatttttcatcctgtcttcattttgccagcatttactcagcacctgataggtgtccacgttcaccgcgggagcgccctgccatccccactttgggcagttactgccttctcgttcagccctgtttacttatatgacttctcaccggactgtaaggccctggagggcaggactgtttcttatccatttctaacgtggcgcctgacacacacagagaaggcacacagaaaatgttgaataaatagctgttaagacgcacgaaggcagaactgcccgttaccccctctcgtaatccttcattgccctctttaaattctcaatcatctctctctcttctacccagaaaagggctctggttatctcttttctacccagaaaagggctctggttatccgcctctggtgtcccaaggtttggggcttgggggaggaaggcagctcaatgtagttaaaaaaggaaggaggccggtcgcagtggatcacacctgtaatcccagcactttgggaggctgaggcgggcggatcacctgaggtcaggagttggagaccagcctggccaacatggtgaaaccccgtctgtgctaaaaccaaaaactagccgggcttgctggcacacgcctgtaatcccatctactcaggaggctgaggcaggagaatcgcttgaacccgggaggcggaggttgagccgagatcgcgctgctgcactccaggagctttggagtcaaagggagctaatatttcagatcccagcttagacaaatcttcaagtattccagccctctgtcccacagaatagagaattaagtgagatactttacagtagctgaacacattggctttcagtcagttcttctgttcctcaatagtcagctgttccacagtcctcaagcccagttttgttcctagttttgctctgtcctcttctcccctctctggatgtacctttcccagggctcctgcagggacctccgtggtgcctcaaacccgcacatggcggaatacgtgtgcacagtcaggattggtcccacacctctgcgtttttttccccagggcacttcctcacatgccagcgcaactccccaatacctcaatgagtaagcttccctcagggatgagtttgtttggcttgaaacctgattagacatgttttgtacaccagtgttttttttttttggacaccggatccatctcccttttcttttctaataagtcaggactggtggagtcaacacagtcaatcaatagccaacctcaacctgagacaggacagaagagaactcagaatctttttgtcttttggacttcagccatgtccatgatgcctaccctgtgaagatctctcaccatccaaaaaagtaagtagtagctgtgacttctggcaccctggatttgagctgagtggacaggggtgtgctctcctggacctctggtggcaagtctcttgaatggcatcctctttgtatagagccacagctttctaacttgtgttgaaaaactaccgtatcttttacttccgtgaaggatttcgctggttgcttagagagcctgtttaaaagttgacagttcagaagtggctgggatctcttgggctccctgaagagttagtctctgtctccctcatttggtctctgctgtgctggctcttccccatctcggcccagcacaggttggctccttgtcactgctcttttaagactctgctctgtcccctttaccctgtatactctttttgtttcgatttctcagcttctcctcttttccagttgtgccagcagacgatccgtggatccattttattttccctgctaggagttgctgtacataacactgggtaaggaggtggtgtggattcagggactgtgcttgggatccaaacacaccttgcagtgaattttgctactgctgtctctacacccaagatacctaatactcctcaacgaatagcctaggttgaggcaaagctgttgaccaccttggagggctaatagcagtttccatttagaactgggttcatttctggtcttaggttaatatttattaatactgtgccctggcactttttaggggtaggggcaggagagtaccagaaagagtgggcttttccctaaagtgtgatcctcgggattttaaaagctattacacagaagggttttttcattgattatatttgtgaaatgctgaattcaacacagttaaactagtgtctttacaacaaggcttccttcccaaactcttttgctgtgctcacgtgctccactgaggaaaatggtagcatatggtgttttttgtttgtttgtttgttttttgttttttttgagacagagtcttgctctgtcacccaggctggagtgcagtggcgcgatcttgcagtggcgtgatcttggctcactgcaagctctgcctcccaggttcacactatcctcctgcctcagcctcccgagtagctgtactacaggtgcatgctgccatgcctggctaattttttgtagttttagtagagatggggtttcaccgtgttagccaggatggtctcgaactcctgaccttgtgatctacccacctcggcctcccagagtgctgggattacaggcgtgagccaccgcgcctggcctagcatatggtgttttacaaactgattctactattgaaccttctttacatgggatattgggtgcaagtcgagttctgtggaccacgctttgggaagtgctgccagaaactatccaaaacagtaatctccagagcacttatgaggcagtcacagcttgaagtgtgacgcttagtgtgtcactgatgttggagctgggctctcaggctatgcttgcaggatggtccccacgtgcctgtggcaaggtctgtggtgaagcagagattatcaaggctttccagaggcagaggaggaacccagctgccctgcatcaccctggaggagtagggagtcagcagtcaaagccttgagataattggggaacacaggatgtgataaaaaccagaagtctgtgatgttgtttgttctctatgaggcatcagaggaggcttcatggagcgggtgacacttgagttgggtctagaaggacagtaggagtatgccaaatgggtggaaaaggaaggaggattccaggcagaaagcagctcatgcaacacagatgtggaatctcagcttgcaagttagcagagccagataaatcaggcagagtttggaggggttgacagtaggttttacgccaggggtttggatgcagctgcaggctgggtattagtgagagcagggaggctcctggaccggctgaactcccagcagaccttgtaacctggagctcccaagcttctactggtgtacacgctgtcgagtcttgcagttagtgagcactaatgcttttggttttatatctcctgggcttgcaaacattgaccagaacttaaaagcacctgcttctgatggcagggaacttgcttcctgcagcaagtcacttctggagtggggtatcgctgatccttccccagctgacctgtttatttgatctccgtgatagcgggtaagggagtggtgtgtgtggtgtgagttggcggagttgcctctgccctccctgaaggctgggtgttcatggagagagtcttgtgatcttgctggtagagtttgttgttattgttttataacatgtaaagctgcctttagctcttactgtagtgaagcatgttgcttgcgtcatcaactttagtcttctcacagtttagatggtattgtggtattaggatattggttttcatccacggatccaggctcataactcctatccacagcccttgttatggttttttgatataatgttagatgtgttaggcctcaggggcaggcctctgaccttctgctctccttccaccctaatctttccccacctgattgtgggccttaaaaccctcccctgagaggggtggaccctgtatcctgggggaaggaatgctgatgtcatgaagcttccataaaaatccaagaggacagagttcagggagcttgtggatagctgaacacacggaggttcctagagagaggcctgctcagggagggcacagaaactacacgcctcttcccccatacctcgccctaagcgtctccttatctgtatcctttgcgatatccctcataataacctggtaaacgtaagtaagtgtttccctgggctaggtaggctgctccatcaaattaattgaactcaaagagggggtcatgggaaccccagcctgaagccagtcggtgagaaattctggaggcccagacttgcaactggtatgtttgaggggtggtggtggagaggcggggcagtcctggggactgagccctcaacctgtgggatctgacactctctccaggtagacagcatgggaactgaatgagaggatacccagctgctgtccgctggttggtgtgtggggaagaaaccccctcacatttggtcacagaagtctcttgtgttgatgattatggtgtgagagtagagaaaaaagataatttgagacagtttctctctccagtaggtgtcttgtttgttgtacacatgaagaaaccaaggttctgtgatgaaataacttgcttaagtttaagcagcccagaaataatgtagtcacaatttgaacccagctctgcctgattacaaaacctgtcataggtagtgctatatcatgccccatccttgatccctttttttttttttttttttttttttttaaagagagagacttcgctctgtcacccaggctggagtacagtggcgagatcttggctcactgcaaattctacctcccaggttcaagtgattctcctgccttggcctctggagtagctgggactacaggcatgcgccaccacacccagctaattttttgtatttttcatagagacggggtttcaccatgttggctagactggtcttgaactcctgacctcaggtgagctgcctgcctcggcctcccaaagtgctgggattacaggcatgagccaccgtgcctgacccctgatcccttttctattccttttggatggctttcctcttgtgcctgccacatcccctctttctcgaacagtctgatctgccaggccatggcaagcctcatttcagcgcactctcctttgctgctttggaagagtgagagtagcattttctttgcagtttcctttctcagagctgtactgtctttaagccctggacatatggcttccatgctgagaaaacatctctcatagctgtggcgtcatgctgaggaggaatgtagaaacggaagtggggtcacttccttcccttgtctccagaggaatcattaacattgcacaagaacttgttggtttgggcacacatgtgggtccctatcccgctttgggtcggtctgtcttctgcccactctttgggatggttagttactaaaagtccgttttggcatttggtcttcatgtacctcttccgggtgttctttctgcttttcaggaccttgtgcaacatactttggccccatttggaagtttttcacgtgtgcttgctggggagcaacacctcatttccaatctagagagagtgagcttactgctgggtggagaactgagcagtaagattagggtggctggggaggcagtgacagacccaggcacagtcagctgtgcacacaccccctcatccaggagggcctttgccctttgacttcctgggattggtgggctctgctcaagaagtagctttcgccgtggtgggaactctgagggacctggcaggggtccacttttggggtcggaattcccagtcttaccctgggcactccttctggtgtgtacgcctctttttgatctttttttttttttttttgagatggagtcttgctctattgctcaggctggagtgcaatggcgcgatcttagctcactgcaacttccagctcccaggttcaagcaattctcgtgcctcagcctcccgagtagctgggattacaggtgcctgccaccatgcctggctaatttttgtatttttagcagagaaggggtttcaccatgttggccaggctggtctcaagtgatccacccgcctgggcctcccaaagtgcagggattataggtgtgagccaccatgcccagcctcttttgacctttgaccaaagacctctaggactttggagtcaagtctcatgacctctaaaatgttgttatatgaaaagataagctacaaagatatgtaggattgagtgagagcaagagagacagtcacacaaaaatagactgtgataatatggctgggtacggtggctcacgcctgtattcccagcacttcgggaggccgaagcagatggatcacttgaggtcaggagtttgagaccagcctggccaacatggtgaagccctgtctacgaaaaataaaaaaattagctgggtgtggtggtacatgcccgtactccaagctactcaggaggctgagtgaggcaggaggatcgcttgaacctgggaggtggaggttgtagtgagctgagattgcaccactgcacccagcctgggtgacaaaagtgagactctgtctcaaaaaaaaaaaaaaaattataataaacaaaatgttgggccgggcgtggtggctcatgcctgtaatcccagcactttcggaggacaaggtgggtggatcatttgaggtcaggagttcaagacctacctggccaacatggtgaaaccccacctctactgaaaatacaaaaattagccgggcatggtggcgagtgcctgtagtcccagttgcttgggaggctgaggcaggagaatagcttgaactcgggaggtggtggttgcagtgagccgagatcatgccacagcactccagcctgagcgatagagcaagactctgtctcagaaaaaaaaaaaaaaaatgttggctgggcatggtggctcacgcctttaatcccagcactttaatcccaacactttgggaatccaaagtgagaggatcattggagcccaagagtttgggagcagcctgggcaacataagaagaccctgtctctacaaaaaattttaaaaaaattagtggggcgtggtggtgcatgcctgtggtctcatgtactcaggaggctgaggtgggaggattgcttggacccaagaggttgaggctgcagtgagctgtgattgcgccactgcactccagcccaggtaacagcgagatcttgtctcaaaataaaaaataaataagtaaataaaatgttaacattgcttatcacaaaatgatggggttatgggtttttttccccttcagtttccaaattttctgtagcacacctgtgctatactaaaatagaccaatagtttttgtgtgtgtgtgtgtgtgtgtgtgtttttctttgttgagacttggtctggctctgtcacccaggctggagtacagtggtgcgatctcggctcactgcaacctccgcctcccaggttcaagcaattctctgcctcagcctcccaagtagctgggattataggcggccaccaccacacccggctatatttttttgtatttttagtagagacggggtttcatcatgttggccaggctggtcttgaactcctgaccttgtgatccacttgcctcagcctcccagagtgctgggattacaggcataacccaccatgcctggctgtttttttttttttttttaaatagagacggggtcctacattgcctaggcttgtctcgaactccaaagttcaagtgatctgcctgccttggcctctcaaagtgctgggattataggtatgagccactgaacctggcccctaaccaatagtgtttttatgtggtcttgctctgtctcccaggctagagtgcagtggactgatcataggtcactgcagccgaaactcctgggctcaagtgaccctcccacctcagactcccaagtagctaggactgcagatgcatgccactgtgtcatgctaattttgttttattttttgagacaaaatctcgccctgtcacccaggctggagtacaatggcatgatcttggttcattgcagcctccatctcccaggttcaagtgattctcctgtctcagcctcccaagtagctgggattacaggtgtgtgccattgggtctggctaattactgtatttttagtagagacgggggtttcaccatgttggccaggctggtcttgaactcctgacctcaggtgatccacctgcctcaacctcccaaagttctgagattacaggggtgagccaccgcgcccagcctgagacactgttcttatctcaccgtcctttgttctagtcctggaggttgcagtgacctgagatccccatattcttgattctccccaaagcattccgccatctccctagcaggatgtcccgaggtaggtgttgctgggttcgctcacgttagcttctcttgcagcgcaatgtccctgctcttctctcgatgcaactctatcgtcacagtcaagaaaaataagagacacatggctgaggtgaatgcatccccacttaagcactttgtcactgccaagaagaagatcaatggcatttttgagcagctgggggcctacatccaggagagcgccaccttccttgaaggtaagggggcaccggctcagccaggcccgctcttacctgtttagatatttagctagtgggatttgcgggtggggaggtatatctctgctcccagggaagtcataaccagatagccttagaaatgctctgctcttgaaatcatgtggaattggagtctggggagatgaggccaggaagacaagggaactgccatttagtaattactttaagaagtccacatgttttgtttcatttaatcatgaaagataggtgaatcttatccccatctacaaggcaagcaaattgaggtttgagagttgtccgataccttgtaagtaatagatcagggttttacccaggtgtctccaactccggagcccacgtgttttcctttgcctagttctggctgccattaataccaggcactgtttgggtgtcagtgatccctgaccagggcgccctttctttgatatttttagattggtgacagaactataggaaactcacgtcacctatgccttttctactagttactaatttgagcccaacctctagttccttgtctatcagcagagaaggactggttcccagggccccgctcgtctgagtgtcaactccagcactggcttcctcaggctccctctttagaaggacactttggcgccaggtcctgagattgtctgtggagacccagtaactgagtcttatctgcccttggtttcctcacttgtgaaagtggggctcaggtgtgaacagtggtttcagattctagtctgcagaaccctagaagttcagtggtggtgcttcgggggttggcccctggctcaggggggccaccttctttccattctgctttcaaatagagcagcttggcttctcgttgttttacatgccaggctgctacacgaggctccctttgaagaaagagactgtccaacttcatgccctcatctgtgccctgccctttgcgtggcgcttgatgccacagaaggtgtttcctaaatacttgttgaactaaaacaaatctgaattttaaagtagtatgattggtagttgaaataatcccaactcattgcctgtttatcagtggctatggtgtgccagccgtgtgccaggtgctgggcatgcagagatggggtagatcaggccgctcccctctgggagcccagactaaccctcttggaagctctgagtcacctactcagatgatgtggtggacaaacacatgcgtaatgcaggtgtttatgtgatgcatgctttgatttctctgtgtgtgaaaatatgaggcctcccctgttgtttaaatggaagggaaagagctggagtgatcctgagctgtgctgggtcagggaaagaatggttcctgcctgggcactgtttctaacgggcaggtaacaagagcttgttggcctgctggctctcgcttttaagtgtagtcacatgcttgagagccagcttcctccgagggacattccaaaggccatgcccaggtgcccatataagggaggaatattgatgcatctggggcagaggtgaccggtggacatagcgggaggggagatgggggtgttgttgacttggtcatttcctttcatggcgctggctgtgggggaaattcactgggcaggcccttgtcatgcttcagatgctttcggagtgttctcagggctggggcctgtcagcctcatagttcccaggagtgtgcagaggggctaaacacccgtctgtgttccagccagctgaagcacctgtctggtgcgagttctagacaggacagtggtgggatctcactcagttgctcctgtatggagtaatttgttggccatctgcctgttaagggcactgggaaaaagcagtgcagtgatccaaaggtctgctcacgtagcaaacatttgtgcacctgctgggtgctggggtcagatagtgtggccctcatgaggcagatgacacagacaggtgagctgtacagttaccttatggtgaggtgagagctgagatgggagaagtgcagggtgctggggcacacagagaaggggtccggggtcctgactcaggttagaggggtggtcagagaaggcttcctgggggcagtgctgtctaagctagaccggaggccaagtgagaatgagccacgctgccccaaggcagtgtagtgtgtcagttcttcagagagtggggagggggtttgggcagcagggaatggagccagagggccgaggaagctggtgagtttggggatatggtgagggagaccgtgaggcagcgggtggcaagaggccaacagggccagggcagggagggcctcaagaagtgacatagaggccgggcgcggtggctcacgcctgtgatcccagcactttgggaggccgaggcgggcggatcacgaggtcaggagatcgagaccatcccggctaaaacggtgaaaccctgtctctactaaaaatacaaaaaattagccgggcgtagtggcgggcgcctgtagtcccagctacttgggaggctgaggcaggagaatggcgtgaacccgggaggcggagcttgcagtgagcccagatcccgccactgcactccagcctgggcgacagagcgagactccgtctcaaaaaaaaaaaaaaaaaaaaaaaaaaaaagaagtgacatagagtggttaagagcctggactccagagccaggctgcctaattcaaatcatagctctgccttttactaactccggagccatgttaataaagaggaccaaaggagagaatgaatttgaaaagtgaaaggaacagtgcctggcatgtggtaagaacttcgtaaatatttgttaagaaaaaataaacaaggaaggcagttaacatttaagtattcatcttctaccagccgccattcacagcatttgtgtttcaattcgtttgatcctcacgatgttctcatgaagtagataatgtagttatctccgttttgtgcttaaggaaactaagacccagaaaggttcttttgcttgaggccacagagctagaaagtggtaagaaccagcttcagaaccaggcagtgttgctcctgagccatcttcttaaccaccacaccgtggggccaccatagaggatctggagctcagcctgtcggctgcagggtgccagaggtggactcgtttagggtaagcagggccggcgctctggcccttccagacttgggactgtggaactcctctgaccacgtggtgacccattttcaatccccacctccagacacgtacaggaatgcagaactggaccccgttaccacagaagaacaggttctggacgtcaaaggttacctatccaaagtgagaggcatcagtgaggtgctggctcggaggcacatgaaagtggctttttttggccggtaagtccttgaggcacccaccctttctttcttcctggctaggagggagggaggcactttgtgcaaggtcacagaacgttccaggcagggacatgcttcagaattcattgctttcctcttaatttatattttatttatttatttgatttttgagacagggttctctgtcacccaggctggaagctcattacagcctcgacctccctgggctcaggtgatcctcccacctgagcctcctgagcagctgggactgcaggtgcatgccatcaagcctgacttttttttttttattttctaattaaggttaaaggcatataatataaaatttaccaccttaaccattttaagcatacaattcactagtaggtatatttgcaaccagtctcaagagctttttcatcttgcagaactgaagcttgtattatagccattaaacaataactccctgtcccacatgtcccttgccctggccaccaccattctactttctgtccctatgaatttgactattctagatgtctcacgtaagtggaatcatacagtatttgtttttttttctccattcataaaacttttattccacttacatgaatttaatacacgtgttcttaacaattgtgcttgtattgttcatgaaaatttcgtaagacattaaacaaagctagccatcatctcaagttatttccctgttaactatttttacagtgcatgcatgttaggcaagcatcaaaaaaaaatcacaaaagcaaagaatctaaaaatatgccgggcatggtggctcacacctgtaatcccagcactttgggaggccgaggcaggtggatcacgaggtcaggagatcgagaccatcctgtctaacacagtgaaaccccatctctactaaaaatacaaaaaattagccgggtgaggtggcgggcgcctgtagtcccagctacttgggaggctagggcaggagaatggtgtgaaccccagggggcggagcctgcagtgagccgagatcgggccactgcactccagcctgggcgacagtgagactccatctcaaaaaaaaaaaaaaaaatctaaaaataagttaaatacgtgttttttttgttttgttttactgctagcttgatatacatgaagtattcatttttcctgcatctttacttttacatttgttcttaggttgcctgaaacattttaaatacaaataaaatgagtgtagcaaaaataatgaaagctaacagcagataactttacaaataatggagtgtgaaccatttctgcccttatccagattgaaatgggtcacaactttgtttaaaggaacacttccacagctgtagtcaaaggtgtgcacattgagattgagtattccacagacacacatggtttaacatgtgataaccatggggtatctgtttctaccacagccttgtaagtgctccaaaccttaaagtacccacatttactatacctgtgactggaaccaatgatcctttttattccccaccaggacaaaccaatatgtaggcagttttctttgctttgacatggaagcagttttaacactggcccttgtgaagccacaatgtacctaaagtactaggccaaacatttataacttgtataatgaccaggcacggtggctcacgcctgtaatcccagcactttgggaggccaaggcaggcagatcacaaggtcaggagattgagaccatcctggctaacacggtgaaaccccatctctactaaaaatacaaaaaaaattagctgggtgtggtggcgggcgcctgtagtcccagctacttgggaggctgaggcaggagaatggcatgaacccaggaggtggaggttgcagtgagtcaagatcgcgccactgcactccagcctaggtgacggagtgagactccgtctcaaaaaaaaaaaatctaatacaagaaaaaaggcatctagacagattgtatgctaggcacacagtggtagcctggggaataggcactgtgcctagagtcttgaccctgatgaactgtaacctcaggtgtggtcctctactcctctgaactatcatttcttcatcctcacctgggaggtatgaccccctacttaggtgagctagtgggcttcctgtctcactgggtgcaggtaaggtcattgtagttctgctctagtgatatggctgagaaacttcaactcagaatgagaaacactgtgtttagcacaggttgaaagctctgagactcagagcagatgagtctgctgagcagagctattctcaagaagcagaaatggtggggtgcagtggttcacacctgtaatctcagcactgggaggctgaggcaggagaattgcttgagcccaggagtttgagaccagcctgagcaacatggcaagaccccatctctaccaaaaatttaaaaattagctgggcgtggtcgcagctatagtctatatataggtggtacctatagtctaagctacttgggaggctgaggtgggaggatcattgagccctgatggtcgaggctgcagtgagctatattcatgccacacgctactgcactccagcttgggcgagaaagcaaaatcccatatcaaaaaaaacaaacaacaacaacaacaacaaaaaaccccaccagaatacatgaaaggggtgtgataggtaagaatgagaaagtaggctgggcatggtggctcatgcctgtaatcccagcactttgggaggttgaagcaggcaaatcacctgaggtcaggagttcgcgaccagtctggccaacatggtgaaaccctgtctctactcaaaatacaaaaattagccgggcatggtggcacatgcctgtagtcccagctacttgggaggctgaggcaggagaattgcttgaactcaggaggcagaggttgcgatgagctgagatcgtgccactgcactccagcctgggcgacagagtgagactctgtctcaaataacaataaaaaaaaaaagaatgagaaagtaaccttccctttagcctggcagttgtcagctgggactcacaaggtggagcttcatgtgtaaggaggagcgtgatgggagaaaagcagcgaaacatgccctgtgtaggaaacactggggtcatttagactgaggaagacactctgggggttagtcggtgtttcaggtaggcctgaattaaactttggagacagacagacagtctctataagtgttgctgagggtggctgtgtgattcaaggggcagacagcacgcagtgagcctcttgtagattgatctgaaatgatgaaccaggggcatgtcagaggtttgggcctgggggtgtttattcattttaataaacagtgcctactctttgtctctcagcactgtctgggcactggcaacattgcactgaatagggctttggccttccaggctggtatctgcgttgtgaaagtaattcaggtcagatactggtggctttgctgacagctgttacttccttctaggacgagcaatgggaagagcaccgtgatcaatgccatgctctgggacaaagttctgccctctgggattggccacaccaccaattgcttcctgcgggtagagggcacagatggccatgaggcctttctccttaccgagggctcagaggaaaagaggagtgccaaggtgagggtgccaggctggctgtcagccctgtgcctgctgggggagcaagtcctccgttgtgacacggctgacctcacctctagggagggggcagcaccaccctgtggaggtgaatgggagaccctattttagatgaactttttgaaggatgtaagagcttttgggggctggcggaggtggttttcagaaacgtggatcaccaagaatgaggaccctgctgttcctcatacagctctgagtggccactgacctctcttcactaattaaggaagacagtatgtgctgtgttcttccttgggatattgccagagaggaattcctgcatttgctgtgtgtctctgacctatcagtcagggaccgacactctgagttttctgagaggcagctgcattcttgtttggggccagatgctcaatttgcttcataaagaatcaattggtcgggcacggtggctcacgcctgtaatcccagcactttgggaggccgaggtggatggatcatttgaggtcaggagttcaagaccagcctggccaacatggtgaaaccccatctctactaaaaatacaaaaattagctgggcgtggtggtaggcacctgtaatcccagctagtcgcgaggctgaggcaggaggactgcttgaacccaggaggtggaggttgtggtgagctgagatcacgccactgtactccaaacctgggtgacagagcgagactccgtctcaaaaaaaaaaaaaaaaaaagaatcaatcagtgcagaacagatgactttagggtgatatccgggaaagaagctcaaaagagcagtgaagaaagtgggttcttattgacaactcccagctgttaactttttatatgtggaagaagaaagggtagcagatgggcagcattcccagccactgtgctgtgatgcagcggcacaggaaatctcctggcctggtggttcctcctcagcctctttctttccttcctctgccatcagactgtgaaccagctggcccatgccctccaccaggacaagcagctccatgccggcagcctagtgagtgtgatgtggcccaactctaagtgcccacttctgaaggatgacctcgttttgatggacaggtaagagggaggtgccctcctaggaggtccaaactggaaggcaccaggtttccatttctggataatctaggccagggtccctgggccccatccttgctctgcttaagtattactacctttcagatgggctcaaccaaatcctctggcctcttggctttcctctggagtctggttactatacctatttatcagtaccctgcagatgtcccagggatggtctgtaaaagataggagggatgctcaaaagttggtgggggaggttctcaatctcagcccagtgccagcatgtgtactgggggtggggagttgtggcggagtcagaggtgtattttatttcccttgaagaaacactttgccttggcttggtggactggttataactataccaacatgtacagtattgtagtgtttatctggactcacatcaagtcacaacttcaccttaattgtatatcatcttttttttttttttttttttttgagacagagtcttgctctgtcacccaggctggagtgcagtggtgcagtctcggctcactgcaacctccgcctcccgggttcaagtgattctcctgcctcagcctctggagtagctgggattacaggtgcccgccaccatgcctggctaaattttgtatttttagtagagacggggtttcaccatgttggccaggctggtcttgaactgctgacctcatgatccgcccaccttagcctcccaaagtgctgggattacgggcatgagccactgtgccccgcctggtatatcatctttaaagtagaattacaagtaattctgtttttataaaagcaatagatatatgtgtttaaaaacactcatttctgccaggcacggtggctcatgcctgtaatcctagcactttgggaagctgaggcgggcagatcaggaggtcaagagatcgagaccagcctgaccaacatggtgaaaccctgtctctactaaaaatacaaaaaaattagctgggcatggtggtgcgtgcctgtagtgccagctacttgggaggctgaggcaggaggatcgcttgaacctgggaggcggaggttgcagtgagccgagatcgtgccattgcactccagcccgggcgacagagcaagactctatatccaaaaacaaaacaaaacaaaacaaaacactcatttccaggcaatctggaaggataggaaatgggaagtaaaatccgttaatgagggccaggcctgatttctctcccgtccctggctttctcctccatgacctgcctgcctcacaagtcccaggtctgttctcagcaggaagaatagggctcctgctctgcctgatgatttggtttacccctgtcacctttagccctggtattgatgtcaccacagagctggacagctggattgacaagttttgtctggatgctgatgtgtttgtgctggtggccaactcagagtccaccctgatgcagacggtaactcctcctctgccttctcccaagctcccagcaccccctgggcaggcagctgatggggccttggctgtcaagctcctgctccaccgaggtcttaccctttatctaggaaaagcacttcttccacaaggtgagtgagcgtctctcccggccaaacatcttcatcctgaacaaccgctgggatgcatctgcctcagagcccgagtacatggaggaggttcgtgcttctgtttggcagtttggggaatgcaaccccgagggagcactgcctgccactggggccacttcctgcacccctggatctagtgacttccctgaattaattttattgccaaagaattctccaaatactcttctgtggtatcttctggtggtctttcccctctcccatccactttgctggatgcaccccctcttcaagccactctcccctaggcctaaaaaggatccctgctgcattagtgcatcttcagtgccggtgctcagtttggtttctgaggaattaatacagaacaggctcagctctagggaggcctctgggaaagaggctggaaagaggaatggagaataactggttcttactggtgacttacaactcttagctatttacttatttatttagagactgggttatgaggctggctaatttttgtatttttggtagagacggggttttgtcatgttgcccacgctggttttgaactcctgggctcaggtgatccacctgcctcagcctcccaaagtgctgggattacaggcatgagccaccacgcctggcctcacaactctttaaatatgtgaaatgaaagacaaaagggtaacaaacggcatggtggtgcacacctataggctgagagaggatcccttgagagtaggaatttgaaaccaccttgggcgacgtagcaaaacgccatctccaaaaaaataaagggtaggccgggcgcggtggctcacgcctgtaatcccagcactttgggaggccgatgtgggcggatcacgaggtcaggagatcgagaccatcctggctaacgtggtgaaaccccgtgtctactaaaaatacaaaaaattagccgggtgtgatggtggcaggcgcctgtagtcccagctacgcgggaggctaaggcaggagaacggcgtgaacccgggaggtggagcttgcagtgagctgagattgtgccactgtactccagcctgggcaagagagtgagattccgtctcacaaaaaataattaaacaaataaagggtaataagattgataatatggcaatatgggatgataaaacatgcagttgcagtcagtaggccagagtccaaattatttatttttttcgagatggagttttgctcttgtcacccaggctggagtgcagtggcacaatctcggctcactgcaacctccacctccagggttcaagcaattctgcctcagcctcccgagtagctgggattacaggcacccgccaccacacctggctaatttttgtatttttaatagagatggggtttcaccatgttggccaggctggtcttgaactcctgaccttaagtgatccgcccgcctcggcctcccaaagtgctgggattacgggcgtgagccactgtgcccgcttgtgactgacactaggcagtgtgactttgttagcttccttgacccttctggtaatccaatttcctggccagtgtgatggtgtgataaatagacttgttgagaggatgaaatctgtcaaaaacacctgacacgtggtaggtgtctacaagaagctattgtcacattttatcggtagaaccccaggatgtcagagccaggagggatgttctagtgatgcccactccttttataaacaatgccccaggaggacacagcttgtcagagtataggtcccagatttaggtttcttgacctcagggttcctttcctgccagggcaccaaaatgaggcactatataggcttaacaagaggcagtctagggcacgtttaagcatttctgcttgtatatgcataaaatatctttggcacgctcactgccaagtaacccccacacgttggtctgggaaacttggtggtgagagagcagaatagtgggggacattacactgtgtatgtgtttgtgcctttggctgttgagccatgtgaatatattgcctattcttttttttccctcactctgtcgcccaggctggagtgcagtggtgctatcttggctcactgcaacctccgcctccaggttcaagtgattctcctgcctcagcctcctgagtagctgggattacaggcgcctgccaccatgcctggctaatttttttgtatttttagtagagacagggtttcaccatggtggccaggctggtcttgaactcccgacctcaagtgatccacctgccttggcttcccaaagtgctgggattacaggcgtcagccaccatgcccagcctcttatgacctattcttttaataaaagaggcaggtgggggctgtggggccacctacactcactctggacacatttgtttgggctccaggtgcggcggcagcacatggagcgttgtaccagcttcctggtggatgagctgggcgtggtggatcgatcccaggccggggaccgcatcttctttgtgtctgctaaggaggtgctcaacgccaggattcagaaagcccagggcatgcctgaaggaggtaatgatgagaacagatgtcctccttttctctgatgtttgagacattttgtctcgtgctgaggagtctgtcagtagaaaatccttctgagaaggggatgctgagaagagcagagaggctcttgctctttagccagtggcttggtttctggggatttcatcgttttcctctgctgccaagttgtttctggactaatgcagtacaatcctcctagggggcgctctcgcagaaggctttcaagtgaggatgtttgagtttcagaattttgagaggagatttgaggtgagtcctctgattctggtatctggcgattctgtgcctccccagctcccattggctgtgtccctggcagtgaaaaccagagtctggcccttggttgtaggcccctggtggcccccacctccctccgtgcctctgtgtgttccaggagtgcatctcccagtctgcagtgaagaccaagtttgagcagcacacggtccgggccaagcagattgcagaggcggttcgactcatcatggactccctgcacatggcggctcgggagcagcagtaagagtccaagactgcagataggtggagagagctgccgagacaagggtgctccacccctgccttgggcagttaggacacgccttgatggcagggctgagtctctgggctcccatccagagccctttccctggccaccagaccatgttagaaccacatagacagcctggtgaggagggcggctgggtgcttcatcaccccacctggtctgtgcagcacgattccctgtgttggaggtcttggcccatgccctgctgagctctgcagccattctcagagcctgaacacatttttcaaaacaacattccagccaggagcagtgactcacacctgtgatctcaacactttgggagaccaaggcaggaggactgcttgaggccaggagtccagcccagataacatagtgagatcccatctctacaagaattttaaaaatcagctgggtgtggtggcacacacctgtagttccagctacttgggaggctgaggcaggaggatcactggagcccaggagttcagggttccagtgagctgtgatcgcaccactgcactccagcctgggcaacagagtgagaccctgtcactaaagaataatatgaaaacaccttgcttctatcacacagaattgactttctcagttgtttatgttaagttaaaattttaaaaagttcagttcccttttgattcttttgcacttgtcccagtgtcactctgccctgaggcaccataatcatgaatttacattgttctatcacccaaacagtactttttacataaatgctgaggaatatgtcaggtttttacatgcttcagatgtacagatgtggcatcacactgtctgtcactgtacctggctttgctttctcaacatcgtttttccctctatccttgttagtatgtgtagtttgtttatgaatcggaactgctgtagtatattccattgtgaatatgcctcattttcctatggatggaattttagattttttttttgctattggaaaccctactgcagtggacatttgttcatgtgtccccttgtgcacctttttaagagtcttcctggggtgagttcctaggggtgtggcaattctgttttagggtacacgcgtttccagttttagtcagttttcttgatgctcttcagaacagccgtacccattcattgcatgaccagtactgtccataggccttccatttcatcagccctcaccagaacttcagacctggtcatttttgccaggccttggtagaaaatagtgcctttaaaaatttcatttacaactgggcatggtggctcacgcctgtaatcccaacactttgggaggccaaggcggatggatcacctgaggtcaggagttcaagaccagcctgaccaacacggagaaaccctgtctctgctaaaaatacaaaattagctgggtgtggtggcgcatgcctgtaatcccagctactcgggaggctgaagcaggagaatcgcttgaacccaggaagtggaggttgcagtgagtggagatcgtgccattgcactccagcctgggcaacaagagtgaaactccatctcaaaaaaaaaaaaaaaatcatttctgtgattactagtgaggttgagcttttttccctatattaattggcagaatttgtttaaacccccttaaagcgccctccctgttttgtgcccaccacctgacccacatcgaagactgaagagtgcatggttggctgcagggtcctcttcttacctgggaaggggaaggccatgcccctgggtgcgtgtgtgcagccctgccaggcaagatagcgggcagggcggcgtgggatttctggcatcccctcttgctcctctgcttagtcagacaggaacatggatttctcaccagtactctgctttcagggtttactgcgaggaaatgcgtgaagagcggcaagaccgactgaaatttattgacaaacagctggagctcttggctcaagactataagctgcgaattaagcagattacggaggaagtggagaggcaggtgagaaatgaggaggaggcattctgggaagatttggactccgagtagagtccagaagaaagcagacctcctcctcttagggacttctcagcctttcagaagaaagttgtggccctgtttcaagaatacagagctgccgtttgggttccattgtcgggttgtgtgatgctgggcatgttccctttcctctggacctccacagatcatgtgggcgtttgatcagccagtttcccagaccctctcacttcagaggctttaattccatagaggagctgaggaggctgctggtttgagaggaaggatgtgccatctgctaggatctctcctggtgctgcaggagtgaactttggtcttccttgatacttaacagtgtgcttccttttgctgtaggtgtcgactgcaatggccgaggagatcaggcgcctctctgtactggtggacgattaccagatggacttccacccttctccagtagtcctcaaggtttataagaatgtgagtcatggagcaacaggtcctcttggcaggaggcccccaaaagtgattcaacccctgttggtctgggtcagggccccccagcagtgacagtagaagccacagagacaaggcccaggcttccgtcagccttctggggtcacctggtggatgtggcctgaagggaattttgatggacatgcttctcttaacttccctcttctggtggcaggagctgcaccgccacatagaggaaggactgggtcgaaacatgtctgaccgctgctccacggccatcaccaactccctgcagaccatgcagcaggacatgataggttagtgcccatggggaactgggcagctgtggccctgggctgcccaaagatcagatgcggaggccaagctaaagaaatcaggactttccttatctgtcacttttcatgatgattcaactcgataccttcaggttctgggtacatgttctgaactcattcttgtttgctttttgagacagagtcgcactccgtaacccaggctggagtgcagtggcatgatcttggctcactgcaacctctgccaccgaggttcaagcgattcttctgctccagcgtcccgagtagctgcgactacaggcgtgaccaccacacctggctaatttttttgtatttttagtagagatggggttttgccacgttggccaggctggtctctaactcctgacctcaagtgatctatctgccttggccttccaaagtgctaggattacaggcatgagccaccggccctggccttgtgaactcattctgtacacagggttggggagcccatcttgttctactacatgggtctaccctaggctgagaattgggcctgctcctttaagtccacgtgaggcataagtgttagcagtatggcatctgagtccacacttgcctgggagagctggcctcaagtgaggcatgctcagtctcacgggccaacttgactggggtgtggttcccaggcaaagctgttcagcatccctggcagtagctggtagagccctgtctccaaggcttggtgccgctgtggtgcagggctgagctgataagcttttcctccatttctcttcctgacagatggcttgaaacccctccttcctgtgtctgtgcggagtcagatagacatgctggtcccacgccagtgcttctccctcaactatgacctaaactgtgacaagctgtgtgctgacttccaggaagacattgagttccatttctctctcggatggaccatgctggtgaataggttcctgggccccaagaacagccgtcgggccttgatgggctacaatgaccaggcaagcaaagttcctcacctcaagggcattgtggggggtcagtctgtaccctgcctccagacacgggaaccattctaaaacgggggttccctaaggtcagcagctgtggtggtgtgccccaccacacagtacaccacagacagaatttttgctactgattgacctggatttgttctaagcagtgatatttgtgaaatgacagatgctagtatttttctctaatacacattaaagtaagtatgtaactattaaaaatagacgactttaaaaataaccacctacatacgactattttaaagttcagattttaaaaacattcatctctaaaccacttgagttgtcacatgtactgccctctgtacacatcccacactcggggaagctgccaggcgggtcaggatggctcctgctcacattttgcacgtcccgtggtgctcacctgagggtctcctctgctacatctgaagctagttgtcccctttttgccttttggaaattgaagagccactctgtgtccctgttccccagactagggcaacactgagggttcacgtgaatgagagactcaatacgtccccctcacccctctcatgtttctctcctcaggtccagcgtcccatccctctgacgccagccaaccccagcatgcccccactgccacagggctcgctcacccaggaggagttcatggtttccatggttaccggcctggcctccttgacatccaggacctccatgggcattcttgttgttggaggagtggtcagtgaccagttctgctcgggaaggtgggggcggagggcaggtgggcggggcctgagggctaggttcctgctgtggcccctgcattgggccacactccacagtccactgcatactttctcctctgtgattgcatggggagcgcttactccctcaccaagtttccctcacttcctgctggacatggtcccagaccttctggcctcggtgggatcaaaggagacattgaaagaggaactcagagtagaaacatgaaggctccttggctggggcccttcagatggccctggtagtgatgggccccagaggagggtgggccacagagaggctgcactccaggctgaccatgtgctctgcaggtgtggaaggcagtgggctggcggctcattgccctctcctttgggctctatggcctcctctacgtctatgagcgtctgacctggaccaccaaggccaaggagagggccttcaagcgccagtttgtggagcatgccagcgagaagctgcagcttgtcatcagctacactggctccaactgcagccaccaagtccagcagtgagtggccctgtcggaccccagcaggggacttcctttaggcagggtcagccccatctcccttccccatctctcttcccacgtggcctggaagccactgggtcctaagcatcgtagaccctgggccttcaggtgtgcagggccagctttgaggccagtcatggggagaggggtctcccagggacactttgcgtcttgggctgggacggggtaggcctctgggccccttggtgaggaagaaatgggaaggcaagagatattcctagtaggagttttagaggttgccttgaagagcttgggctgtggatgtagttttgaagtttttgaacccagcctgatcttcgtgcacatcttaggtcaggtgggaatctattgcctaatctggggtggtggggatgaatatcctcgcttccttttttttattgtgtgtggcagaccctttgctctagacattttgcacctaattatttctctgactcttggaggtagatgttgtcttatagccatctcctttttctttctttcttttttttttaattgatcattcttgggtgttttggcagggtcataggacaatagtggagggaaggtcagcagataaacaagtgaacaaaggtctctggttttcctaggcagaggaccctggggccttccgcagtgtttgtgtccctgggtacttgagattagggagtggtgatgactcttgacaagcatgctgccttcaagcatctgtttaacaaagcacaccttgcaccgcccttaatccatttaaccctgagtggacacagcacatgtttcagagagcaccaggttgggggtaaggtcatagatcaacagcatcccaaggcagaagaatttttcttagtacagaacaaaatggagtctcctatgtctacttctttctacacagacacagcaacaatctgatttctctatcttttccccacatttcccccttttctattcgacaaaaccgccatcgtcaccatggcccgttctcaatgagctgttgggtacacctcccagacggggtggtggccgggcagaggggctcctcacttcccagaaggggtggttgggcagaggcgccccccacctcccggatggggcggcggccgggcggaggcgcccccacctccctcccggacggggtggctggccgggcgggggctgaccccccccacctccctcccggacggggcggctggccgggcggggactgaccccccacctcccggacggggcggctgctaggcggagacgcttacttcccagacgggggcggctgcctggcggaggggctcctcacttctcagacggggcggctgccgggcagagacgctcctcacctcctagacggggttgtggctgggcagaggcgctcctcacatcccagacggggtggtggggcagaggcgctccccacttcctagatgggatggcggccgggaagaggtgctcctcacttcccagagtgggcagccgggcagaggggctcctcacatcccagacgatgggcggccaggcagagacgctcctcacttctcagacggggtggcggccgggcagaggctgcaatctcggcactttgggaggccaaggcaggcggctgggaggtggaggttgtagcgagctgagatcatgccactgcctgggcaacattgagcactgagtgaacgagactccatctgcaatcccggcacctcgggaggccgaggctggcagatcactgccggttaggagctggagaccagcgcggccaacacagcgaaaccccatctccaccaaaaaaatacgaaaaccagtcaggcgtggcggcgcgcgcctgcagtcgcaggcactgggcaggttgaggcaggagaatcaggcagggaggttgcagtgagcagagatggcggcagtacagtccagcttcggctcggcatcagagggagaccgtggaaagagagggagagggagaccgtggggagagggagagggagcgggagagggagagggccatctcctttttcaaaatcaagaaactgagatttgaaaaatagtgacgtgtcctctgctactcggctgatgagcagcagagtcaggatctcttgtgcccaaaccagggtgcacagctctgtgctgttgcttctcaggccgtggtgatgctgagtgtgtttggttgttatgattattcagtctcagcagggtgtaggagattctgccaaaccaggcctggctcagggcagagctgctggcagggatatagacaggcccagctgctccctactgtgggtgggctaagccaccagtggcatcttgctccacacaccccaactgggtcccttctctctcctccccagggaactgtctgggacctttgctcatctgtgtcagcaagttgacgtcacccgggagaacctggagcaggaaattgccgccatgaacaagaaaattgaggttcttgactcacttcagagcaaagcaaagctgctcaggtgaggctggcccgtgtggccaaaggttagggctccagggtgcagcccaggcacactggggctcagctgctgggcttgcgtcttgggtgtggacacaaatttttctggtggggatttagctcattcgtgttagatgtgtaccatgggctgggcacggtggctgacgcctataatcccagcactttgggaggctgaggcaggtagatcacctgaggtcaggagtttgagactagcctgaccaacatggtgaaaccccgtctctactaaaaatacaaagattagctggtcgtggtggtgtgtgcttgtaatcccagccactcgacaggctgaggcaggagaatggcttgaacccagaaggcggaggttgcagtgagccgagattatgccattgcactccagcctgggcgacaagagcaaaactctgtctcaaaaagaaaaaaaaaatggatgtgtaccacgtacctcatggatgccagatggtgctggaggctcaacaagacacagcgtcgctgccttcaaggcacttgcagttgaaggcatgatggcatcacagtactgcgagactgcagttcacagcgccctgtgctgaaccgcagggcctacagcgcttaacatgtgctatttcactcagtcttccctatttctccattttctacatagaaatgttggggaacttgtctggcatctcaaaaaatggccaggctaggaggggagcccaggtgtacttggctccagcagcccccgcactctgattctccttacctgccactctttggacccatgaagagggcatagccccccatttacccacagagaagctggttacttggctggggactggcagagctgggattggaactcagatctccatggggtctctgtggagctttcattaataatttgctggaaagaacatcagtctgaggagtctggagtcctgggttctctccagccactcatgtttggcccaagctcttaactctcctgtgtctcattattttcatctgtaaaatgggagtaagatttcatgacacagctgcatgactgaatgtaaaagtgccctgcaaaagtcctcggcctgcccagctcatgataacatcagcacacggggaccctgcagaagtcctcggcctgcctagcccatgatagcatcagcacacggggaccctgcacttcctgccctcgcccctgacgtcagagtctgcagggtggcagagccagaggggagatggatcagagggtgtcagctccaaccctcaccggatcactgggctttccctgccctcgactgcggatgtgccccccccgcacccccacctggggacagctgcttcctagggacacactgcttgccctctggggactctcagaaagggggaatggggggaactgctgcttgtcagccacagtgacacagctgaacctggaaagggtctcctgtcagcacctcaaccccttgcttggcaagcagggaaactgagttcccgacagctcagggacttgcacatggtcctgggtgaaggaaacacagggcttgagaatcagaaaagcctaacttgtagctccctggcttattagccgtgtggccttgggaagttatttaacccctctgggcctccttttccccatctgtgagacagggataaacacgattgttggaggatgatgtaagggtgtgtgtcaagcgtccttaggatggtgcctggcgggtagtcctaatactgcctatcatcagctatcatggttacaaaagaaccatttctttgcaggaataaagccggttggttggacagtgagctcaacatgttcacacaccagtacctgcagcccagcagatagtgggcacctgaggcggagtctgcgtggagaggggcggtgctgccagccctaagtgccatgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgcttcctagaaataagcaacacctctcccaaaaagcagcccacaaggcaggggcccagcagcccagccatcactcatctttgaggaaatgagttggtagcctctgtgcactgtttggtggccacatcacaggtgatgtcctgttcacatacctgcttgtatttaaagccctcagtctgtcctgttgtgtggggcgaagtgatggactctgccaggtggacatgctgtgggtggatgttcccggcgtgtgccgggcctgaatggacaggggccacttcacagcatgtcagggaaaatcactgtcacacaattccaatggattttgtgctctttttgaaaaaaaaaaattctttagcgtaaacatgaattttttttcaatgtagcccctggggaatgaatgaaattttgagcttcttcaatacgtaaaattaaatttataccactgagggagagaccctttctgaaagaagtatggccaaaagcactttaatgctgctgacattgttgtttttatgttcatttgctggagcgcaagacgtgctgacacagtgagttttctctgatgtatttaaggtgatgtatttgcttgagttactcctgtatcattgctcataatattggaaactaaaataaaacctagttggaaatcctttgtga

SEQ ID NO: 2584 - DNA, 33335 bp, Homo sapiens; identical to SEQ ID NO: 2583
  source 1..33335: mol_type = genomic DNA

SEQ ID NO: 2585 - DNA, 57497 bp, Homo sapiens
  source 1..57497: mol_type = genomic DNA
gaagagacccagcaacccacagagttgagaaatttgactggcattcaagctgtccaatcaatagctgccgctgaagggtggggctggatggcgtaagctacagctgaaggaagaacgtgagcacgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactggtacggagggagtcgagccgggctcacttaagggctacgacttaacgggccgcgtcactcaatggcgcggacacgcctctttgcccgggcagaggcatgtacagcgcatgcccacaacggcggaggccgccgggttccctgacgtgccagtcaggccttctccttttccgcagaccgtgtgtttctttaccgctctcccccgagaccttttaagggttgtttggagtgtaagtggaggaatatacgtagtgttgtcttaatggtaccgttaactaagtaaggaagccacttaatttaaaattatgtatgcagaacatgcgaagttaaaagatgtataaaagcttaagatggggagaaaaaccttttttcagagggtactgtgttactgttttcttgcttttcattcattccagaaatcatctgttcacatccaaaggcacaattcattttgagtttctttcaaaacaaatcgtttgtagttttaggacaggctgatgcactttgggcttgacttctgattaccctattgttaaattagtgacccctcttagtgttttcctgtcctttatttcggaggacgcacttcgaagataccagattttatgggtcatccttggattttgaagcttataactgtgacaaaaaatgtgaagggaagagatttgaaacatgtggaaggaaaagtgagtgcagactataaacttccaaaaagacaagcccaaaatacacctaaacgttatgtcagattattttgttaaaatcagttgttagtgacgtccgtacgttaatagaaaaaagaatgcttcagtttggagtggtaggtttctagagggatttattgtgaaagtataaactattcagggcaatgggactgagagaacagtgggtagaaaggaccactgaaggaaaggaagagaattggaaggtagatgaaagaaggagcaagaacctggggatgttttttccttttcacttgtaatagtagtaacagaagcaatggcagactggcttttgtttctactgtgttagaatgaattgacaggacaactgggcctattattgtactgtgccagaatactgtaaaacaaaactaaacatactagcttggtggcttgtaattaattacttaagtggagatttttattttttttttattttttttttagacggagtctcactttgtcacccaggctggagtgcagtggcgcgatctcagctgactgcaacctcctcctcacaggttcaagggagattctcctgcctcagcctcccgagtagctaggactataggcatgtgccaccacacctggctaattttgtatttttagtagagatgggatttctccatgttggtcaggctggtgtcaaaactctcgatctcaggtgaaccgcctgcctcagccttccaaagtgctgggattacaggcgtgagccaccgcgccctgcagttttttgtatttttaatagagacagggtttcaccatgttagccaggatggtctcgatttcctgacctcaggtgatctgcccgctttggcctcccaaagtgctgggattacaagcatgagccaccgcgcccggctcaagtggagatttttatatggagtccagttatactctttttaatatataagttgagatgactaatacaacttcaatacaggggctcatgagaaatgtctgtaatatttaagtaacttattgtcttctttcttttttttttaagatgaagtcttactctgttgcccaggcggaagtgcagtggcgtgatcttggctcagggcaacctctgcctcctggtttcaagcgatcttcctgcctcagcctcccgagtagctgggagtacaggcgtgcatgaccacacccggctaatttttttatttttagtagagacggggtttctccatgttggccgggctggtcttgaactcctgacctcaggtgatccgcccacctcagcctccccaagtgttgggattacaggtgtgagcccccgtgcccagcctattatcttatttctgaataaagaattgtctgtgtggggaatagataactctttctcatgcagcccctgctagaaaatttgttttctctagcagttggtctgtgcttataggctactctttgaaagcacaaaaaatttattgacttcttttttttgggtttttttttttttttgagacagagttttgcccttgttgcccaggttggagtgcaatggcgcgatctcagctcaccgcaacctccacctcctgggttcaagtgattctcctgccttagcctcctgagtagctgggattacaggcatgcgtcaccatgcctggctaattttgtatttttagtacaaatggggtttctccatgttggtcaggctggtctcaaactcctgacctcaggtgatccacccgccttggcctcccaaagtgctgggattatgggtgtgagccattgcgcctggccagaaaattcattgacttcctaaagatttattaactttctgcattacttttttttttcccctccatcgtaaatataaaagggaatagtagagaaaatcattcagaattttattttttagtgacattatttagtgacattttattagagtcacttaggaacctgaggctgaataaagttcaggtaaaagtaaaattagttgagaagagacatctgccaaaagaaatctatttttaacttcacttgctgtctttcctagaggaacagaaatagtgctgaatgtcctattagaaatgatggttgctctgcccgtctcttccctctctctcacacaatatgtaaactcatacagtgtatgagcctgtaagacaaaggaaaaacacgttaatgaggcactattgtttgtatttggagtttgttatcattgcttggctcatattaaaatatgtacattagagtagttgcagactgataaattattttctgtttgatttgccagtttagatgcaaaatccacaagtattcaagtgattgttaaagagggaggcctgaagttgattcagatccaagacaatggcaccgggatcagggtaagtaaaacctcaaagtagcaggatgtttgtgcgcttcatggaagagtcaggacctttctctgttctggaaactaggcttttgcagatgggattttttcactgaaaaattcaacaccaacaataaatatttattgagtacctattatttgctgggcactgttcaggggatgtgtcagtgaataaaatagattaaaatctattctcttctgatgcttacattatagtggtgggagacaaaatgggtataataaatattatattagatagcattaagtgctgtggagaaaactaaagcagggaggaagataggagtgtgcaagccagaaaggttgcaattaaattgagtagttcaggaaggcttcaatatggatgtgatatttgagagaccggtggaagtcaaggagcaagttgtgaggctatttaaaggtattcttggcttacagaacaatatacgcaaagactattaaatggaagcatacctgacatgttaaaggactatcaaggaggccagtttgtctagaggctgaaaaggaaagagtaataggagatgaggtctgagtgaaaacacgtaaatccttgtgggccaaggtaaaatctttagctttttttctgaatatggtgggatactgttagagggttttaagcagaggttacgtggtgtggtgagttttttttttttaatcctttgtctttctgtgtggaaaatagcaggacagggcagaagcagtctgtcctgcagactgcttggtcgcagtagagatgtaagaagcagtgagattctgggttaattatggaggcaaagttctcagaatttgctgatatagggtatgagagaaagaggaatcaggaatgatttcaaggttttggtctgctaaatggaaggagttgccatttactaagatgggaaagactatgaaagaagcagattttcagagagatcagaagttcattttggggcatgttcaatttaagatgcctgttagttggatgtttatgtgagtttggaatgcagggtagagatttagggatgaatatttggtagttgtctgcattttaatggtattaaaagccacgagaaggatgggcatggtggctcacacctgtaatcccagcactttgggaggccaaggcgggcagatcacctgaggtcgggagttcgagaccagcctgaccaacatggagaaaccccatctctactaaaaatatataattagccgggcgtggtggcacatgcctgtaatcccagctactcgggaggctgaggcaggagaatcgcttgaacctgggaggtggaggttgcgatgagccgagatcgcaccgttgcactccagcttgggcaacaagagcaaaactccatcaaaaaaaaaaaaaaaaaaaaaaaaaagccttgagactcacctgaaaagatgctcaacattattggtcattaggaaaatgaatgaaaaccacaatgagataccacttcacacctattaggatggctattatcaaaaacaaaaacaagtgtttgcaaggatgtagagattggaattcttgtgtattgctagagggaatgtaaaatagtgcagggtgctgtggaaaatgctgtggtgattcctcaaaaaattaaacataattatataatccagtaattccacttctgagttattcccaaaagaagggatgcaagcagatatttgtacactcatattcatggcagcattatttacagtagccaaaaggtgaaagcaacctaagtgtccgtcagtggatgaatggataaacaaaatggaataatttcagccttaaatagaaataaaatgttgacacatgttgcaacatatacgaaccttgaagacatcatgttaagttaaataagttggtcactaaaggacaaatattgtatgattccccttatgaggttcctagagtagtcacattcatagagacagtagagtggtggttgcccagggccggggggagcgaggagaatggaaattattgtttattgggtacagagtttctgtttggggaagatgaaaaaattctggagatggatcatgatgatagttaacacagcagtgtgaatatagttaatggcacagaactgtacatttaaaaatggttaagatggaaaattttctgttacatatattttactgcaatttttttaaattttattattatactttaagttttagggtacatgtgcacaacatgcaggtttgttacatatgtatacatgtgccatgttggtgtgctgcacccattaagtcatcatttagcattaggtatatctcctaatgctatccctcccccctcccccaccccacaacagtccccagtgtgtgatgttcccctttctgtgtccatgtgttctcattgttcaattcccacctatgagtgagcacatgcagtgtttggttttttgtccttgtgatagtttgctgagaatgatggtttccagcttcatccatgtccctgcaaaggacatgaactcatcattttttgtggctgcatagtattccatggtgtatatgtgccaccttttcttaatccagtctatcattgttggacatttgggttggttccaagtctttgctgttgcgaatagtgctgcagtaaacatacgtgtgcatgtgtctttatagcagcatgatttataatcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaagatcgccattctaactggtgtgagatggtatctcattgtggttttgatttgcatttctctgatggccagtgatgatgagcatttcttcatgtgttttttggctgcataaatgtcttctttcgagaagtgtctgttcatatccttcactcactttttgatggggttgtttgtttttttcttgtaaatttgagttcattgaaaaattagaatttttttttttttcccttttttagaggcaaggtctcactctgtcgcccacactggagtgcagtagtgtaagcatagctcactgtaaccttgaactcctgggctcaagcaattctgtcatctcagccagctgaagtagtaactgtaggttcacaccaccatgcctatttttgtttttgtagaaatagggccttgctttgttgccaaggctggtcttgaactcctgacctcaagcagtcctcctgtctcagcctcccaaagtgctgggattataggtgtgagccactgcacccagccttggagatttttaataaagaagcttgtcaattaaacaaacaacaaaaagccctgagactgaatgagataatcaagagagtatgtgtagatagagaagaggtccaaggaaggagtcttgggtgactctgatgtcaagtgaggacatgaggcagaaacagcagtgactgagaaggagccacctagtaagaaaggaggaacaccaggacagtgtggtattctggattccaaacaaggaagttactgctaattttaaagctcttctcaggctgggcatggtggctcacacctgtagtcccagcacttcgggaggctgaggtaggtaaatcacttgagctcatgtgtttgagaccagcttgggcaacatggtgaaacctcatctctactaaaaatataagaaattaaggccaggtgtggtagttcatgcctgtaatcccagtgctttgggaggtcaaggcagccagatcatttgagatcaggagttcgagaccagcatggccagcatagtgaagccccatctctactaaaaatacaagaaaaaattaaccaagcatggtggcgcatacctgtaatcccagccactctggaggctgagacatgaaaattgcttgaacccgggaggcggaggttgcagtgagctgagatctcgccactgcacttcagcctgggtgacagagcaagactctgtctcaaaggaggttgcagtgagctgagatctcgccactgcacttcagcctgggtgacagagcaagactctgtctcaaaaaaaaaaaaaacaaaaaccaagaaaagaaaaaaaaactcttctaagaggatttttttttcctggattaaatcaagaaaatgggaattcaaagagatttggaaaaatgagtaacatgattatttactcatctttttggtatctaacagaaagaagatctggatattgtatgtgaaaggttcactactagtaaactgcagtcctttgaggatttagccagtatttctacctatggctttcgaggtgaggtaagctaaagattcaagaaatgtgtaaaatatcctcctgtgatgacattgtctgtcatttgttagtatgtatttctcaacatagataaataaggtttggtaccttttacttgttaaatgtatgcaaatctgagcaaacttaatgaactttaactttcaaagactgagaattgttcataaataaactattttacctgcagagacctctgatatatgtttcttgatggaagtacccagtaccacctatgaagttttcttgtcaaaaaatcaaatgtgaatctgatcattacttagatctaagtaccaatatatgaaaaatataggagacaaggaagcatggtaaatgatactgagattgggagactacatggaaaaagacttgttcccttcaacagatagacagcagggaaaaaagaatagagaaaggagtaaagaacctgtagattaaaagacatttaagggacatatgaaccaggtccagtgtatagatcttacctaaatcctgatggagcaaactataaaaaaatttttttgagacaaatgtttgaatacaggttgactatttgatggcattaaggagaaattatgaattatcttggtataagaatattgtcatgggtttttttttttgagtccttacctgttaagatacatactaaaatatttgtgggtaaaattatatgacgtataggagtatatgatttagaaaacggattaaaatataaaaggataaaataggatcttatattttgtgactcacttcctgttggatatctttctacccagtaaatatagtcctatctaggttttaatggctacatgtatgtactgtagtttgtttaaatggtttcctattgaacatttatgctctttgccattttttcctgtttaacgttctgtttttttttttgtttttttttttttttgagacagtcttgctctgttatccagactggagtgcagtgacatgatctcagctcactgcaacctctgccttctgggttcaagctattctcctgcctcagcctcctgaatagctgtgattacaggcgtgcaccactatgcccagctaatttttgtattttgggtagagacagggtttggccatgttggccaggctggtcttgaactcctgaccttgaatgatctgcccgccttggccttgcaaagtgctggggttacaggcatgagccaccacgtctggccttgtttaaggtcctgatgagtattcttataggtacactgtgtttcgtttaattatttccttaggataaatttatagaaataacattccttggtaaaagaatacatattttaaaaactgtattagtttcctgttgctgtcaaaaaatttccagaaacttagtggcattaaacaatacaaattaattattctacagttctggagatcagaagatacgggtcttactaggcctcactaggctaaaatcaaggttttggcagggctgtgttcctctatggaggttccaagggaccagagaaactactttacagtagttattttaagggaatgaaagtgaagatggggttgggcagtcaaagaggctgttacttttcatttttggcctttcagtagtttgaatttttttatcatatacatgtattactttaatttttaaaaagtaaaaagcagctgtgattcagtctctgtaatttagatcaatttacatcaaactagggtggtctcatgtgttgtcttgctcacagtgaccactagattattccaagaagggacaatttccaagacttggtttacactgagacggctcctgattttaaggataccttagatcaaactctaggaaggcagtttcattttggccttgcagttccctgggtcattttccaagcccatggcctcctggagtcttcgcctagctgtaggttatctttgtggctattatttcactgtaattatacaggaagatttattgagggatttctgtgtaccagccgtggttctcagcactttgtatactttgtattaactctgactcctgacagtaactctacagaggttctgctgttacccagttttacatagaaacatggccagcggacgcagttagaaaatggcaaagtggggattagaaactaggcagtttgactccagagtctgtgcccctgtccacttggctccactgctggggaagaggcctctgaagcagcaggaccatctgctgtgccgtgtgtagtggtactctatcttcctggtgtgatgttgtgttctactttgcattttcatgtctttccttatacaggtctcaaaatcatttacttttttttttttttttttgagacggagtctcactctgttgcccaggctagagtgtagtggcatagtctcactcactgcaacctccgcctccgaggttcaagtaattctcctgcctcagcctcccaagtagctcggattacaggcacatgccaccacagctagcaaatttttgtatttttagtagagattggtgtttcaccatgttggccaggctgttcttgaactcctgacctcaggtgatccacccacctaggcctcccaaagtgctgggattacaggcgtgagccaccccacccagccttatattttttaatgatgcacattagctcaattacataaaccagggaaatccagctaggacctggtgatttctgagcctgacccatgtgactttcaatgaactgaacttgccacagctgtatttactgtctactgagatgctgtcacacagaccccgtcatagcacagttcctgagttacatctttacatactgtagtatccttcttgtgaaaaaagatacagattccaaaggtctgagaaaccaatcttggttataaaggggaaaaatggtcatgggtttttaaaatttgttttgtcttaattgcatttcaaatttacatttctaaatgaataattgcttatataaagcagttttgattaacaatataaaacactatctatttggagtgattcctttacccatttctgaaggcaagttttaaaaattactagaagacacttcattgagaatattattaaacatgcctatagttctaccacctcaacacaattgcttattaacacattaatgttttggtgtgttttggactttttaatatgtatttttcacttgttctagtaattatgctacagattgatcatttctttttcaacatgtcatcaaagcaagtgagcaaagtgctcatcgttgccacatattaatacaaaatggaagcagcagttcagataacctttccctttggtgaggtgacagtgggtgacccagcagtgagtttttctttcagtctattttcttttcttccttaggctttggccagcataagccatgtggctcatgttactattacaacgaaaacagctgatggaaagtgtgcatacaggtatagtgctgacttcttttactcatatatattcattctgaaatgtattttttgcctaggtctcagagtaatcctgtctcaacaccagtgttatcttttttggcagagatcttgagtacgttttcttttctccttattgataaattgataatcctcaaggatgattattaggtgatactcttacttcatggattcttaaaagatatgatttaacatattacaagtgcctagcaaggtgtctgttacacgtaggtattttaagtaaatggtagctgctgatgtaatttctgcccctttgcccttcagttggggtattgctttggaccgattagagggctgtggctgggatgctaaaggttcatgtttccttagctggctcctgagccaccagctcccaccacctgtgtatacctgtgctagtttgccttcccacaagtagctgctggctatctgttatgctggtacagttttcagaaactgatgaatggcctttgaacagaacaaaaatgagattcagaataacaaaattgcacctttgtttttataagcactggccattcactagttgaagactggtaggaatacctaattcatgccaaaagaaagataatttttaaaaatcacacaggttgtttgtagattaaaagggaaaataggctaggtatagtggctttgcctgtgagtttgggaggctgaagtgggaggattgcttgaagtcaggagtttgagaccagcctgggaaacagagcaagaccccgtctctacagaaaatttttaaaaaattagctgggcatggtgatgcatatctgtagtcttagctactccggaggtgggaagattgcttgagcccagcagtttgaggctgcagtgagctgtgattacaccactgtactccaaccttaaaataaataaataaataagggaaaatatcttcaacaaaggatagttctgtctgtttctcagtcttcctcaacagataaatgtgtgaagtaatggaaggtggagatttcagattacacaacattaatgctaagggcgtttgactctgtgtgaattctaattgccctagatctagacgggctgatactattagaatcccctgtcactaactgaagacagagttgtaagttaatgccttcctagatagcctagattgtggtatgctgctgcatgctaaaatggctccccttccatagcaggatgaaatagagtcattatcttggcaaccagcccctgccaatgtgctctcagtctgcctttccagccccttctctctacctattcccagctgccatgtattctaaagcctctatgctttcatttttgtttttgccttcctggatggtctttcctgctgtctccacctgaaactattcctctctaaagaacagatgaattgccatctctctgggatgcttttacccaccctcactcccacctcaggctgaatggacccttctctagatcgcttagcatattgttctacagttaggtaaaaagtctacctatcactagatcaagagctttgtttttttttattaatttaattttcttttttttttttcttttttttttgagacagagtctcgctctgtcgcccaggctggagtgcagtgcacaatcttggctcactgcaagctccgcctcccaggttcacaccattctcctgcctcagcctcccgagtagccgggactacaggcgcccaccaccacgcccagctaattttttgtatttttagtagagacggggtttcaccatgttagttagccaggatggtctcgatctcctgacctcgtgatccacccacctcggcctcccaaagcactgggattacaggcatgagccaccgcgccgagccccaagacctttctttattaccagggcttccacagacctgacacatggtagttcctcaataaataattgcagaattactgaaaaattttactgttaacttaggcagtggtaaaaccattgtttggtagctcagaactcagcaagtaaatagcaacatttgctggaagaacagatagtttttcaaatccaattcaaggactgggtatggtggctcatgcctgtaatcccagcactttgggaggccgaggcaggcgtatccaggagttcgagactagcctgaccaacatggtgaaactccgtctctactaaaaatacaaaattagccaggtgtggtggtgggcacctgtaatctcagctacttgggaggctgaggcaggagaatcgcttgaacctggtaggcggaggttgtagtgagctgagattgtgccattgctctccagcctgggaaacaagagcaaaactccgtctcaaaaaaaaaaaaaatccaattcaaatgattatggaagtagtggagaaataaacaggaaaatgataaataattaagataatatataatatggctatattttaatctattgttgatatgattttctcttttccccttgggattagtatctatctctctactggatattaatttgttatattttctcattagagcaagttactcagatggaaaactgaaagcccctcctaaaccatgtgctggcaatcaagggacccagatcacggtaagaatggtacatgggagagtaaattgttgaagctttgtttgtataaatattggaataaaaaataaaattgcttctaagttttcagggtaataataaaatgaatttgcactagttaatggaggtcccaagatatcctctaagcaagataaatgactattggcttttgtggcatggcagcctgccacgtccttgtcttttttaagggctaggagattctttattgggatggcaaaagtcaatggcagggtagttgtcattgaaagaagattaagcttgaccccagaaggcatgggttagagcccagccttgtcactcaatggttgtatgtccagaggcaagtcacttaacatcccttaaccccagttttctcatctgtcaaatgaagcaaagaatacttgccctcttgacttaaagggtgtctgatgagacatatgactgtatcattagctgggagaaagtccatcgtgctgcctatgtatagtgcctcaagttggtctctttcccttctatgattacacaaagcactccgctgtcatgttatccatcccgcccctccattccaagtcccatctagagcacatcttcttgaagtccactgtaacctgcctaatcctggatgtgacgagccaggcaggaggcagaaaagaatgtgtgttttgcaatacatgttaagagacatcttgggctgggcacggtggctcacacctgtaatctcagcactttgggaggctgaggagggcggatcatctgaggttgggagttcgagaccagcctgaccaacatggagaaaccccatctctactaaaaatacaaaattagccaggcgtgatggcgcatgcctgtaatcccagctactcaggaaggctgaggcaggagaattgcttgaacccgggaggcagaggttgtggtgagttgagatcatgccactgcactccagcctgggcaacaagagtgaaacagggtctcaaaaacaaaaacaaacaaacaaaaaaaatcttttaccacggtgaccaccatgtgatttccaagaacttcaaatgatctaagaaattttgtgattattactagtttgaaaaatactttttttttttttgagacaaagtctcactctgttgcccaggctgaagtgcagtggtgtgatctcagctcactgcaatcactacctcttgagttcaagcagttgtcctgcctcagcctcttgagtacctgggattacaggcatgcgtcaccatgcccggctaatttttgtatttttagtagagacagggtttcaccatgttggccaggctggtctcgaactcctgacctcaggtgacccacccaccttggcctcccaaagttctgggattacagacgtgagccactgcacccagcctgaaaaatatctttgaatgccatgtgatactatacttgtcagtttacatgtgtgtcccactaaatcatgtactctcctgagcaggatcatgctttgtcttcatattttctgtacaaagcaaagactctgacacaaagctagcccccagtgcatagttgagaaatcagtgaatgaatgtgggaggcaggaaaaatgtcctttaattcttctgttaatgctgtcttatccctggccccagtcagtgcttagaactgtgctgttggtaaatataattggattcactatcttaagacctcgcttttgccaggacatcttgggttttattttcaagtacttctatgaatttacaagaaaaatcaatcttctgttcaggtggaggaccttttttacaacatagccacgaggagaaaagctttaaaaaatccaagtgaagaatatgggaaaattttggaagttgttggcaggtacagtccaaaatctgggagtgggtctctgagatttgtcatcaaagtaatgtgttctagtgctcatacattgaacagttgctgagctagatggtgaaaagtaaaactagcttacagatagtttctggtcaaggtttagccaccaattttgcagtttctctcatctccccaggaaagagcagttggtctttagatcaatgagagctcttttatggcagacaaaacaaagtgactctagccaacttgagctaaaaagaaatttagtggaaggctaggagttaccacatgaagtgtgtgcagctgccccttggagagaataagaaccagggtgcctctgggacttaacatcattactgtactccagttgttttcattcttttcctgactttgctctagagtcagtttcctaacagagtacattcgatgatcatgtgcccatatctgtggggagaagatttcttgattggcagtcttactaagggtgcatatcaagtagaatggaatagaggtagtttcctaaaggaagatgagaggctgttaccaggaggaggagaagggattcaggacagatgaaaacaacgttatatccatgatagacttacgctgctggtacagatggtacaggtggcttcagtataggctctccgaacccacatatcattgattatgatagggatatgttaactatttttcagtgtatatatgtatatgtgtgtgtgtatatatatgtatatgtatatatatatgtatgtgtatatatgtatatgtatatatttatatatgtatatgtatatatttatatatgtatatgtatatatttatatatgtatatgtatatatatttatatatgtatatgtgtgtatatatatatttatatatatgtatatgtgtgtatatatatatatttttttttgaaacggaatttcgctcttgttgcccaggctggagtgcaatggtgcgatctcagctcactgcaacctctgcctcctgggttcaagcgattctcctgtctcagcctcccgagtagctgggattacaggcacttgccaccatgcccggcaattttttttttgtttttttttagtagagagggggtttaatcattttggccaggctggtcttgaactcctgacctcaggtgatctgcctgccttggcctcctaaagtgctgggattacaggcgtgagccaccatgcctggccatttttcagtatttcttttttttttttttttttttttttttttgagacagagtttcactcttgttgcacaggctggagtacaatggtgtgatctcggctcaccgcaacctctacttcccaggttcaagcaattcgcctgcctcagccttctcaagtagctgggattacaggcatatgccaccatgcccggctaattttgtgtttttagtagagatggggtttctccatgttggtcaggctagtctcaaactcccgacctcagatgatcctcccgccttggcctcccagagtgctgggattactggcatgagccagcgctcctggcccatttttcagtatttctaaaaaaaatctaaagtgggtcaaacatttcaccttaatagaatgacaggtttgtacatcaagtttctttgctttttcttggaattttatactttttttttttttttggagacagagtcttgctgtgttacccaggctggagtgcagtggtgcgatctcagctcaccacaacctccacctccaggttgaagcaattctcctacctcagcctcctgagtagctgggattacaggcacatgccaccacacccggctaattttttttttttttttgtatttttagtagagacagggtttcaccatgttgtccaggctggtctcgaactcctgacctcaggtgatccgcccatctcggcccaccaaagtgctgggattacaggcgtgagccactgcacccggcctttttcttggaattttatcaatcagtgtcagaatattcattacctcctaaaaataaaggagttctagttggctgttttgattctaggtgtggtaaagtgaaatattgttacttaataaatgcattttgctagacacaatccttcggttcacgagctctgtagagaaaagagaaataaccgccaaccaagaaaagattgggagatactagaataagacccaggggcaggaagaagccagtgagaaggagggcatgttgagagctctgagagagaataaaagcaggggttgttggagctagcttctcaagatgtccttgaggcaaaccagacctttgggacactctgaaaataaaactgaaagtgaagagattgtgggccgaatgtggtggctcacgcctgtaatcccagcactttgggaggtcgaggcgggtggatcacctgagatcaggagttcgataccagcctggccaacatggcgaaacgccatctctactaaaaatacaaaaaaaattagctgggcctggtggcaggcgcctataatcccagctactcgggaggctgaggcgggagaatcgcttgagtccaggaggcggaggttgcagtgagctgagatcgtgccattgcactccagcctgggcaacaagagcaaaactctgtctcaaaaataaataaaaataaataaaaaagagatagtggcgtgatatccttgattctatcagcaacctataaaagtagagaggagtctgtgttttgattcagtcacctttagcatttttatttccatgaagtttctgctggtttatttttctgtgggtaaaatattaataggctgtatggagatatttttctttatatgtacctttgtttagattactcaactccactaatttatttaactaaaagggggctctgacatctagtgtgtgtttttggcaactcttttcttactcttttgtttttcttttccaggtattcagtacacaatgcaggcattagtttctcagttaaaaaagtaagttcttggtttatgggggatggttttgttttatgaaaagaaaaaaggggatttttaatagtttgctggtggagataaggttatgatgtttcagtctcagccatgagacaataaatccttgtgtcttctgctgtttgtttatcagcaaggagagacagtagctgatgttaggacactacccaatgcctcaaccgtggacaatattcgctccatctttggaaatgctgttagtcggtatgtcgataacctatataaaaaaatcttttacatttattatcttggtttatcattccatcacattattttggaacctttcaagatattatgtgtgttaagagtttgctttagtcaaatacacaggcttgttttatgcttcagatttgttaatggagttcttatttcacgtaatcaacactttctaggtgtatgtaatctcctagattctgtggcgtgaatcatgtgttctttcaaggtcttagtcttgaaaatatttatagtgtagtagaactattttatcctccaatgctccttcttttccttgtatttccattatcatcactttaggatttcacttatttatcattcaacatttattaattgcctctcatattccaggctttgtgctagaagttagggatataaagacaaataagatatttcctgcccttaaagactagattcgtgttgctaagtcttcattatcaagaaaagcataagtggggaaaagtgcttgcattatggattcctcatagttgctcccctctgcatgtaaaaatcaccatttccatcatagattcctagcggtctcaggactttataaagcccaaagtgcctatgtcataatatgaggaaaaatactgagacccttccatatatgggaggtatatggatgagacagctcctgacttcacttttcccagaaatctgaaaagcagcagcagtcattccagagcccagtttctactttgaagggcagattatttattctttgagctaacctgactgaggaacaattagtttgcttttaatttactattttctttttcttttcttttcttttttgagacagagtctcactctgttgcctaggctggagtgcagtggctcaaacttggctcactgcaagctccgcctcccgggttcacgccattctcctgcctcagcctcccgagtagctgggactacaggcgcctgtcaccacacccagctaattttttgtattttttagtagagacggggtttcatcgtgttagccaggatgatctcgatctccagacctcgtgatccacccacctcggcctcccaaagtgctgggattacaggcgtgagccaccgtgcccagccactattttctttctaattgttaatgaattaattttttaaaactgtgctcctagagcgaagggagagctctgtttacagtgtaacttttcagagcttctttaactagattttaagatcagaattagttgttgtgaaatcttagggactgtacaagattagaaatcctctatagcagcatttcccaaagcaggcttccagaacactagcctcatgaggcattttgggaaaaaagagtttgctggttcagtgtgtatgggcagtgccacaagccgtaccctccgttgaagacactcattccacacattactgcataaaaagcttccaccagccattcggcaaacttattgagtgtctgctatttcctgggtattgtgctatatggtagggttatagtagtgaacaaagaagaaatgatgcctgctctcagctgactttgcagttggaaagacacatgaaataattacgccattcattagcagattgtgctagatgcctcactggaaaaataaaggacatgatggaaaactctgtagggtcagagaaagggatcattagagaaggttctttgaagaaatattttttgaaatatgaaggataaataggaattaactaggtaccaataggttaggagtagagctttccagacagagggactagttcttgggaaggtctccagacagaaataagtgtggcttgtctgaggacctcttattcgcctattaaccttccctccccagtaaacactcctgggaacaacacacattgtagaaccacgttgtggtgctgttcagtatagcaagtaattcagcagagataagttcttggaatctcatctttgggatttagttactaagatacattcaagtttgagcaaaataaggtctcagagcttggattcattgttctgttccagcaattagagcagtacctggcacatagcacaagtgcttgaaaacactgactgagtagggtaggtgggtgagtgggtgggtgggtgggtgggtggatggatggatgggaggatgggtgggtgaatgggtgaacagacaaatggatggatgaatggacaggcacaggaggacctcaaatggaccaagtcttcggggccctcatttcacaaagttagtttatgggaaggaaccttgtgtttttaaattctgattcttttgtaatgtttgagttttgagtattttcaaaagcttcagaatctcttttctaatagagaactgatagaaattggatgtgaggataaaaccctagccttcaaaatgaatggttacatatccaatgcaaactactcagtgaagaagtgcatcttcttactcttcatcaaccgtaagttaaaaagaaccacatgggaaatccactcacaggaaacacccacagggaattttatgggaccatggaaaaatttctgatccataggtttgattaaacatggagaaacctcatggcaaagtttggttttattgggaagcatgtataatttttgtcctaagtctgtgctcagccctcccacatgtgctcattgctggttgactgttggagtctggttcttacctctaagaggaagcccaggagagggcataaagccagcacactgtcctcacctgatggtgtcagagtccttacgagtaagccctagccagaacattgctggaagagatcaagggccactgtttgaaattgcacagcaggatacggaaaaggggtaccttaggtataggcattgtcattaaagaaattgctaagatacttgagattttcctgtttaaggaatgagctttatgatacaaagagcagttctaaaaattagggagggaattaactaaattaattaggatatttctcaaattcctttacagtttttgtctctctgctgatatagtgtttacatgattgttatttactaaacaaatgctattttgtattgtgctccttataacttaattgtttattacaaggttttgatggtgacctaccaacaacaagtaatcccaaacacagtctgaattttttgttttccatccagaaataagatgaatctttccatttccgtgttttcagttttcatcatttttatcctataggttacttatctttattttaaagcatttcataataattttatagtttttgttttgtttgcttgtttgctgttggaaatggaatattccctccttccatttagactgctaaccagctgtaaatgtttcaaaatatgcatgttttacagcagttgttcaaagcaatacaggaacagtaaggacagagccagtcattttacaaccacattctgttaaactgatgtctattagcagggtttttcctattttattaggaaggacttacacctgatatataacaaagcttgttttaatcaaggctcagaaaatgtttttcattagtttttttcctaaccatgaagaataactgctttgtaacacacatgctggctataaagcagacaaaaaattcactgtaggtgctgcctgactggcctctgtccgtgtttctgttggggctgcttaccacagcctctgcattatcattagctagtgtgttcacaataccaagttcccagtagcaaagaaaggtcaagctcttacgcatgccattcatttatctacactgtgcaggcgcactcaggtggcagggacaaagaccactcctttggcgcatctcaagttcagaattctcagtagaggggctccagctgtccttttgtcaggtgcccatgcctgctccaggcctgtgtggtcaggacacgtgttacagagtacagtgacattaatgatggggccatggatatggtcagcactcagaggatgttagtctcttcattgataaagtcacaaccacttttcctgttggaaataaaaagatttgacgtatccttgtctacagcaacacaggacaacagataatcagcaggtcatctaaatctgttcagagagaaaggagagctgtttcctgaaaatacatcttcccctgattttagtcttatttttttctgcctttattgctttctaccctcttcaaaccagcctcatttcctaaattaccttgaatatgcattgacacttgtactgcctgaaattctggaaaactcagtatggctactccaccgtcagaacttcctgagcaaagttagttgctctctcggctcactgttttgttttgttttgttttcctgcctcaggtttatttgtacaaatagcacaggaggaccagccccatgcagatggtagcccaggggcgggggtagggggtcacaccagtccttctgtcctcatgttggcagagatatctactctgaagcctttgtaggggcctgggcacctttgggagcctgagctggaactgaaggtggagctgcagcctgggccttggtttgatccttggccttggcctttggccggcacagcctgagccccttggcaatacgggcacgagcacgcttcccaagcttgggatgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggcccttcttgttgtgcttcttggcaaagtgcatgttcctcaggaacttggggtccacccccttaagagattcgtatctttgtgatcggggtttcttgataccatttctgtgccattttcgggactggttgtgtgtggtgtggttcttggacttcgccatgtctacaccttaagccgcggctcccgaagcacctagaaccggaagagttggctcactatttagcacacacacacgtctataatagtgctggccacttggggttggaattagtttatttatcagcatgttgtctcccagcacttggtgtgtgtgatatgcagtatgtatttgcagaatgaaaagtctgagggctgacatcatatttcccactgtgcccagaaagagcacagttagtccacatgagctaatgggggcaaagggaagtgaggagggagaatgtactgccttatcatgttttctattacttggctgaagtaaaacagtcccaagccgatagtaagatagtgggctggaaagtggcgacaggtaaaggtgcacctttcttcctggggatgtgatgtgcatatcactacagaaatgtctttcctgaggtgatttcatgactttgtgtgaatgtacacctgtgacctcacccctcaggacagttttgaactggttgctttctttttattgtttagatcgtctggtagaatcaacttccttgagaaaagccatagaaacagtgtatgcagcctatttgcccaaaaacacacacccattcctgtacctcaggtaatgtagcaccaaactcctcaaccaagactcacaaggaacagatgttctatcaggctctcctctttgaaagagatgagcatgctaatagtacaatcagagtgaatcccatacaccactggcaaaaggatgttctgtcccttcttacaggtacaaggcacagttttccttcatttattcactaatttagcagaacctcactaagagcctcctatatgccaggctctgcgttagcaataaaaggaatgccatgcctcaccccatcaggaggtgctgatagcttgtaggcggagtggaaacagatgtgctctagaggctctaaatattacttctgctggggtcagttgggaagccacaacagctactgttcatcttccataaaagacaatcagccgggcacagtggctcacacctgtaaatcccagcactttgggaggctgaggtgggtggatcacaaggtcaggtgtttgagaccagcctggccaacgtggcgaaaccctgtctctactaaaaatacaaaaattagccaggcatggtggcgggcgcctgtagtcccagctactcgggaggctgaggcaggagaatcgcttgaacctaggaggtggaggttgcagtgagctgagactgtaccactgcactccagcctgggcgacagagcgagactccatctcaaaaaaaaaaaaaaaaagactgggttctgttctgtggaggttcttgtcttaacatatccactgttgattgcccagatgttgatgtaattaatttagcagtcgtaaatagtttagcacttgcattaaatagaccaaaccccatagtaggtatttgaaatacagaataaatgtgaggtacccctgctctaaaggagtttatagtccagagctgacttatggaggatttctttctattatttctgggtctgctactaatttgtctatttcatatcctaattatccttgttttcattttgattgaaagggggagagcatagaaattgtggtaaaaggtagttttattttttatttgagatggagtcttgctctgtcacccaggctggagtgcagtggcacaatctcatctcattgcaacctccacctcccgcgttcaagcaattctcctgcctcagcctcccgagtagctgggattacaggtgtgcaccaccacgcccagctaatttttgtatttttagtagagatggattttaccatgttggccagtctggtcttgaactcccgacctcaggtgatcctctcactttggcctcccaaagtgttaggattacaggcctcagccactgcacccagcctaaagttagttttagattaagtgttttcatgttttcccttgcaaagtaataaactggtcaagttatcaccttgttccatctccatattaatcagggtccaaacaggagatagaaaccatgcaacaatttgagtagttgaataaagaattataaacaggagattagagtaataggggattagatagtaagaggtgaagagataggaacagcagatataaagaacaaccatttcctcctatggctgagataccatcccctcaccacactcccccacctactcactgagatgcagaccttattgaagagaatgtaactggcttgctgcgaggtaaagtcaatgaggcgctccccagtaccactctgaggggatgctggggaaaactgcccatgagaagagggcacatgctgctggccacttgtgctaaagaacttgaagtctgataggagtgcaccctaacctggcatagaaaccctttcttcctgctgagtccctctagcaccttatactggcaaagctttacattgcaaacctccattatcacagagcaagcaatgaaagatggactcagagctgaggcgataaattgatagctagcatagcctctaaactgacttttatgactacattttatggatagaaagtgttcttatatatattgtttctttacataataggggacttattcatggctgcagatgagaaaacagatcctaagaagttaagtgacttgcccaaggtcacacaaagaattccactagttctaaaatgacagtaattacagttaacatacattgtatgtggcagatacatataaagcacatggcattaatttttttttttgagatggagtcttgctctgtcgccaagctggagtgcagtggcacgatctcggcttactgcaacctctgactccctggttgaagggattctcctccctcagcctcccgagtacctgggattacaggcatgcgccaccacgcccagctaatttttgtatttttagtagagacgtggtttcatcatgttggccaggatggtctcgatctcctgaccttgtgatccacccgcctcggcctccccaaatgctgggattacaggcgtgagccaccacgcccggccacttggcatgaatttaattcccgccataaacctgtgagataggtaattctgttatatccactttacaaatgaagagactgaggcaaagaaagatgatgtaacttacgcaaagctacacagctcttaagtagcagtgccaatatttgaacacactcagactcgatcctgaggttttgaccactgtgtcatctggcctcaaatcttctggccaccacatacaccatatgtgggctttttctccccctcccactatctaaggtaattgttctctcttattttcctgacagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccaggtcagggcgcttctcatccagctacttctctggggcctttgaaatgtgcccggccagacgtgagagcccagatttttgcctgttatttaggaactttctttgcaagtattacctggatagttttaacattttcttctttgaacctagttataaaggtattgtgctgttgttcctaggcttagagtcataaggcctgagctcacttcctcactttgcctccatctggaaccttagaccaacttcctaggaaaacgagctgtctgaaaacagaatagggtgcctcttcaatgtgctcttcactggagatgttcaggaggaggctactcccacctacacagggtgcagtggagggtctgggccccagggaggcagcaggaagagtggaaagagcggaggctctactgttggacagacctgggttaccagccgtgtgactagccttccctggcctccatatccccctcagtaatgaaggaatgtgtcatccccaaatccagggacagttacaagcagtcagtgaacagaaagtgtctggtacaggttctaagtgcttattattctaagtcacttcacttacctgagttctcagttttcctatctataagataagcaggttggataaaatgttctccaatatactcctggtcctgagatgatgtgattgtgggcagccctttaatcatggtgaagatgttcatcataagcacactgaaactacaaaataggaatataaatattttctccattaaattatgctggatcctagaagcaaaaactggaactgtgaaaccctacttcacagaaaacttaaaattcccaagcagatgaatgcttctcggaaggacactgacagttacctacctggaaagaatctagatggaggtggcatgggcactaagcggtgagattaaacccagttagggcagccccaccagccttggaacccacacatctggagattgttgatgcagagagaaaggttcctactggtgagacctgaaagggatatgtggcaggtgggaggaagaagttctgtctggaaaccaacccttgttcctccgttattgattgactcctggtaccaacatgagccctaggtcttatagaggccataagtccctatgccttatagtgcccatggatgagatgaggccacacatgcccccagtgggttaacatgtctagcgtgggtaaggctcttggagcactatgatacacaggaaatgcccagtaactcttagttggtttgatatctgttcccattgctcacttaagctcagtgcccctttactgatccttttattctgcctccctctgcacatgtgcattgagactcctatctgagacacacactgtgttgggtgcccagggatgcagcatagatgttgctgccttccacagaagcgctcatggtctgctagagaatatatcccatgggagagaaaaacagactcgggagaatatagcaggggcccttgtcctggactttggcagttaggaaagggagggaagagacatggaggctgggacccaaaggctaaataggaatttgctgggccaaaggggagggggaatgaaaagagtgtttctggcagaggaaatggcaaggataaaggcctggaggcgcaagagaatatgtgtttgaggatctgaaagttgagtgcagtgggtccagtgttctctaccctggctgccattagaattacctgggaaacttttagaaaattccagtgtctgggccctccctaaaacaataaatcattcttgggtggtggggtctgggcatcaggattgtttaaaaccctccccaggtactgtcatgtgcagctggggttaagctgtgctggggtctgagtatggatctgttagggcaagtggcggtgatggagttgaggctgcagaattcaggccaaatagagaggttttcatcaggatattaaagagtttagatttcaatttggtgggaatggatgggatcttatttgcattttatgaagagctccctggttgcaatatcagaatggattggagaggagcaagatggaagcctacagtgatttgggagaagtggtgagggacttgagacacaggaagtagccccattcactaatagttgagtatgtagatttgctaggacctggaaatggtttggctggtggggagtgggaagaaaggcccaaagtgtgaaatgaagatggagagcacattgcctagcccagagtgattgccatttgctctgtcccagttgaggtccaaggggttggccagagatcatggagtctgtggctccatggggagaagaacctctcagcatgcctccttgtcttatcctgggttagtcagattcattttgttagattacattttttttccagtggaactctgcttaagtcctgaccagtatgttttcagaaggatcagagggcctgcccttgtccattggtgcatgacaccagcttggtgggttccttgctgctccctgttttcatagggttatcagaataccttctctccctgccaccagcaggtcacactggctcctgactttttggcccatggaaccaccatctttctgcttcttagattgtgccttgtactccactgatcatggccagtacatcagaagccctggtttgcagtgaatgcatttgatatggaaatcaggaaccctggggataccactcatcatatttggttgctgtgtttttcctccaatctttcaccataacaacaatcaactcaaaagatttctataaccacttgtgtgggggtttctccccacacactaaacaagcagtcagttccagagtggacagcagctggtctcctccaatttaattccaacactgtctacttggagatagcattagatcccacaggttgagggtgcagtcccctagactgcccccagtctcctgcttcagacaccagtcacaagtccaggactctagaagttctgaccagtttcaagttggggttcccacaaccccccactttatttttgattaatttgctggagtggctcatagaactcagggaaacacttagttttctggacttattacaaagatttaaaaagataccaataaatagccaaataaagagatatacagggctagatctggaagggtctggagcgcaggagcttctgtccccatctacttggctcccagcagatggatgagttcttattcattttcttgtcagcttcgacatgttcagctctctggaagcccgcaaactcttgtcttcttgggccttttatggagacgtcgttaggcaggcatgattgaaacatggacaactgtgtcgaaatatgattggacataaaggggtctaaactcagtgaggcctgtttgttcagattcttcttggcctctctgtggccattctttcctccaggatatggggcaggacccctatggaatgagggtcttatgacccacaatcaaattagagtcctgccttgggcaagtgaaaggaaagcaggagaaggtaagagaaattctgttgcctaagaccttctgaggcctaaagcaccccaacattataacagaagacgataacaggactatgggagttatgagctgggaaccttggacaaaaatatatacatattaaataaatattaagtgtatatatatacttacgtatattaagtgtatgtgtgtgtgtgtatatatatatttttttaatttactggttggttttgggaagcagaaattaccataactactcttaaaaatcttttaagtctctttgaagttagaaaagtcactgtacctttttgtttccattggccctgtacttcttattataccccagcaggaggagcataatgtgttgttatatcattctggtgataagattcataagtgggttcagctggtgacagcctgattccctcattgtaaacttatccatcaacatgtagcttaatcgtttcaccttttgtgatgaccattacctgaatcagttatttcattagattgcaagattatgcttttctgattttatcatttcttctgtattgactgtaattctttggtatagaagaactttcccttgttaatagctatttggttgtcctgaagtacagttcttactagaaagtaagaccaaatgctgaattatatccctctagctatcaattttcgaaggaatgaatggtgtcctagtaatttccagtggtgtttaattacgttttcccttctctttctccttctcttattccctccctctccatctcctccctcctcactttcagttttttgctctttcagtattttgtcatagctgttaacagagcaacatattttaatcaattgtagtcatttttctttttggtgctcaaattatcccgtcttagtcccatggaagcaagcccttggagctagggccctctaccttttgatggatttccatttgtcttgataatttccttgtttctgacaagacaagatgttgcaggcacattttatactttcccagcccaaaccctggaataggccttttctccgaggagctctagttcattttagtgggaaatggtatttagagactataatctgggatctgggagtcctcattgctactgagtagtcattacttttaggcttttccagtggtcagagctaggaaatatgtatatttaaaaatggacagttgaatggttgttgccaggagctgggaggaaggggaagtgagaaattgtttaatgggcacagagtttcagtttggggaagatgaaaaagttctagagatagctggtggtgatggttgcgcaacaatgtaaatgccactgagctctcatttaaaaatggttaaaatggtaaattttatatatattttaccacaataaaaaaaagtcttcttctgggagcacccccccaagacaaaaatatgaaaattttacactgatacttccatttcaagataattttaagattataaggattttgcttaattcttgaattttatacctgtaaaccttttatacttcaaatttcgggcagaattgcttctataacaatgataattatacctcatactagcttctttcttagtactgctccatttggggacctgtatatctatacttcttattctgagtctctccactatatatatatatatatatatatatttttttttttttttttttttaatacagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccaggtatggccttttgggaaaagtacagcctacctcctttattctgtaataaaactgccttctaactttggcttttcatgaatcacttgcatcttctctctgcctgacttgccctctggaatggtgctggaatggtcctgtggccttgtccactgtctgcctttgaccataacttgaaagtcacccaccatagtgtcctttgaaataacttaaatgtccacagttccaagcatgagttaaaaacacttcagaatgtagagtagttgttcaattgaataaacacacacaccagaaaaaaaagcaagtttatcttttatttttagtaaagaattttgatagagcctcaacaccagaaatggctagagagagaagcctaacatatctggaggattatttttcatcctacttaaagctgctttcacttttttcaggaaaaaacacacgttctgaatctaatttataaaactccctggccgggtgctgtggctcacacctataatcccagcactttgggaggctgaggcaggtggatcacctgaaatcaagagttcaagaccagcctgaccaacatggtgaaaccccatctctactaaaaatacaaaattagccagacgtggtggcgcatgcctgtaatccccgctactcgggaggctgagacaggagaatgacttgaacccgggaggcggaggttgcagtgagccgagatcgcgccattgcactccagcctgggcaacaagagcgaaactccgtctcaaaacaaacgaacaaacaaaaaccccaaaaatccctgaagtacgtgagctagtggtgaaagaaagctggagaaaaggagcaggaataataataataataataataataataaagattgtcatttaattttgagtacttccagtgtacactttgcaggtactctaagacattacctcactgaaatctctaaggtagatattctttatttaaagtgtacttgtatgaaacctggagctcaaggtgaaggaatttgcccaaggctgcacttgcactatcgtggcactaattagccgtgtgaactgggacacgttacttcagtttgctcatttctgagtcagcctagcaagatgacttctaagaattttttccagccgggtacattggcctgtaatcccagcacttcgagaggccaaggtggaagggtcacttgagtctaggagttacacacaacacacacacacacacacacacacacactagccaggcatggtggcaaatgcctgtagtctcagctactccggaggctcaggtggaaggatcacttgagcccaggaggttggggctgcagtgagccatgatcacgccactgcactccagcctggctgacagagtgagatcctctgtctcaaaaaaagaaaaaaaaaaagatttttttccagggaataataaaggaagctaatatttatggagcatctacggtgtgccaaatactttgcatacgttatctcatttaatgctcttatccctgcagggaaagtattaacatttgtttatcacttgcagaactaagtgatatttaccacagagtagacaaatattttcaagcccaaaatcaagtggtatcacttttctgctgagaatgtttcagtggtttcctttgctcttgggataaaacttaaatccctcaccctacccttgctccaaccctccactttccttctcccatgtggtgatttggccatacagctcttgtggctgatctgaactgactgagctttttacccttttgctcttgctgttcttacagcctgggaaccccctggttacctcttggcttggtgtggtggcttacatctgtaatcccagcactctgggaggccaaggcggacggatcacctgaggttgggagtatgagaccagcaagtcacctcttgccagtggcctttgtccattgagtctgaagttctttctcctctcatttccccatcattctattatgctaccttgttttattttcttcattgtgtttattgatacttaaaatgatctcttttctgttgctgtttgactctcccactagaaagtaagcattgtagatcgggcactgtggctcacacctgtaatcccagcactttgtggggcagaggcgggtggatcacctgaggtcaggagttcgagaccagcctggccaacacggtgaaaccccatctctactaaaaatacaaaaaatagctgggtatggtggctcgtacctgtaatcccagctactcaggaggctgagacatgagactcacttgaacctgggaggcagaggctgcagtgagctgagatcacaccacagcactccagcctggaagacatagtgagactctctctcaaaaaaaaaaaaaaaaaaaaaggaagtaagcattgtgagggcaggtaccttctctgttttgttcattgctggatgtagttagtatacagcagtatctgatggatggatagatggaggaatgaatgaatgagacttcacaaattcagctcacttgctcaaggccctgcagctctacgggatgaagctatactccagagtcctgctacattggctgtgtggccagctgctgggatctgagggttgtcagataagcagtctaccagagaacagactgatcttgttggccttctgccagcacaggggttcattcacagctctgtagaaccagcacagagaagttgcttgctcctccaaaatgcaacccacaaaatttggctaagtttaaaaacaagaataataatgatctgcacttccttttcttcattgcagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgagggtacgtaaacgctgtggcctgcctgggatgcatagggcctcaactgccaaggttttggaaatggagaaagcagtcatgttgtcagagtggccactacagttttgctgggcaagctcctcttcctttactaacccacaatagcatcagcttaaagacaatttttgattgggagaaaagggagaaaaataatctctgtttattttaattagcattaattggtattcttgttaaaccataggagtcagagtaaatcagccatttcaccaattttcagtttgtttctgtcttagctaacagcagtgtaatggtcagcaaaattcttatcttgtgtactgaatggcatgtcctgttgctgaaagtgcacaggcttgggaggtagccatgagctcaaatcctggcactaccacctctcttgtgtgaccttagactcctgacctttctatgcctcagttctttcttacctataaaatgaaattaattttacccttaaagatcatcgtgctgattagagataaaatataaataataacacttgttacagagcaaggagttgacacttttatattctgaagacaaagtggtaaatcattatcatctatgtcagaaatagcttttgagaatacctgagtatagaactatcttgatccctgttacttcaaaactaaaataatggttttaggaattaaaaggtgaggctagtcacctccaagggatgaactgactcagggattgaggtatataacagtgaactggtccaaacaacagtcctgaccccactttatgagtgagactatgagtaatggtctaagtgtagacatcattgtccagggctccagtaggcagctctgtacttgagaatttagcagtgacccttctatttttcatctattatacctttttttttttttttttttgacacagggtctcactttgtcacccagctggagtgtggtggtgcaatcatggcccactgcagcctcaacctccctgggcttaggtgatcctcccacctcagcttcctgagtagctgtaattacaggcatgtgccatcatgcccagctaatttttcttttcttagaggtggggttttgccatgtttcccaggctggtcttgaactcctaggctctcacctctgtcttccaaagtgctgggattacaggtgtgagccaccacacctggcctattacacatttcttaattaaagtagtcaaatttgaaaactgttacaaagtgtatcttaaaatacgacgatctggtttaatttttaaaagatatgagtagccaaggagcaattctgtgcctttcccactagtccctaaccttttaaagcagctgcttcttggctgggctcagtggttcacccctgtaatcccagcactttgggaggccaaggcgggtggatcatgagtcgagatcatcctggctaacacagtgaaaccctgtctctactaaaaatagaaaaaaatagctgggcggggtggcggatgcctatagtcccagctactcgggaggctgaggcaggagaatggcatgaacacgggaggcagaggttgcagtgagtcgagattgtggcactgcactccagcctgggcgacagagcgagactccatctcaaaaggaaaaaaaaaaaaaaaacccatctgcttttgattcagtggcttctttaattttgtcggtctcagtcaccatttgtctaagcaaattcaggcaggcttcaccttgcctttctacatttgttcccttttcttagcattttgggcctttgtttacacgtgggaaaagacccacaggtcgtctctccctttgggcaggatacaggcttcctgtgactgaggttttgctagctgtagaagtggctgccaattggcttctggtttttatttccatgatttgctccagtggctcttcccttccatcattgttagctttcaagctaggaacttttaaaatgcttttaaataaaagtgagctgttacttgatgcatttagcagtcttcctcacagtggttttgatagacagactccctcagtttggaatttatgagttttctttaagggtttgtctccctcatgtatagcaggctgttgaaagttacaatgtcaataactttctgaatagtatcaaactgttttcagtgcagtgtattaacaaaactaacctgcctcaagtttggtcagctttggagtcttactgaggctaaaatgataaatctaaatgatttaaaattgtgtattcctacacagtatctcacttaattatgtaatagtcttgtgagtgaggcagagcagatgccgttttctctattttaaagatgaggaaaatggaatggaaaatggaaaggacagactaattgcaacatcctcgcaatcaaaaacaggcccaggttcatgccttgttggcagtgggttgctactggctgtggccttcatgcaggaaggctagatgcataaccaggtcaacagcccgtgcaggacaagcacgccatgtaattctgattccatcgactgaggctggtgttttcaaacgtgctggtgtagggtcttacagacagagtcatctgtgctatggggaatggaatgtgctcttgctttggagccagaactcctctgaagctcccaccacctacaccattcagaggccagacagaaatttgttcaccattttgggcatgattttcgtgcttttgtaaaatgtgcttcactgcagcccttactgggctgtggtgatgaacacttaagatactgtgtgtgtgctttataatctgtaaggcactgttcaaggggagggacctctgccatgagcccctacccactggtatctggttgacatccaaagccccagcctgggagaagctgattctctagttgaatgctgtatagggatttgactgaggctcagatttggtgaggaagaccactaaccttaacagaccaacaggctggctactccctgatgaagttccccaggccatgaaagaagtaagagatacattccttgtaacagctttcttagttgcacctgtatgattatttgatcagtgtgttgtctgtgcagggatcatgtctgtggagctcaccacctcgtcctcggtgctgagcagagtgcctggcatgtgtactcagtagatatttgctaagggagcgagtcagtgattgagaggagcagcctgggaggtaaagccctagaatctttattttaaagggatatcaaagttgaacattcagttagacagttctcttgagtccagggatttacccatccatggtggacacactttcagttaaaaagtaaggttaattttgacaggttgcagtatccaggcaagcattctatggaataaggctcatctcagggattagtaatgactgaattaacttactgctagtcccataattttgacgttaattaatggggttaagaaatgtcataagctatttggtaccatttaaagtgaaaatacccttaacgttttttgcctccagatatccacacttaatttcattttcttgctctttggtgaacagtcctgggtctgaatgtatatatccatggtttgtcactaggtgacaggtttttttggaacaagaaatcagttcagtgaacatttgtcaagtatcttctctgtaaaaagtgtaatgtgccaagctcagaagtaggaagtgaaatggataaactatgacccctgccttaaagaacaccatggtgttgtatgggaattgtttaggtagaatgaaagaaatcctctaatagagatatgaggccagttcagcagaaagccagggtgagatctcctgagagggatggaagggtgtcttgatcatctctggtagcagcaaaggcactggcatacagtggccactggaagacaaccagcaggggatgggggcgtttacccttgcaagtgagcattaggaactagaggactgattgccctttcttcagctttggtttcccttgctgcagaaaaagatgctgagactcatggcctcggttatgaactcagatatgtggtttggctttgaagcacagatggattttgtccgattttggcagggaaatgcctacagacagcactatgggcatatttaggttagggacgaaatgcaagttgattaagtcctgataagaggctgtgaagaggtccaagaagcctcacaatgcccaatgaagaaaagccctgtgcttggtgctgccgcctcccttccccgtcctgctggcagggctgcgcttcagtagctctggatgcgtcagagcagtccatgaacattctgtgtggaaaatctctgactgttttagtggattacactgctctccctttcctccagtgcctcgttattcagtattatttgatgttctccagcttttaaaataatcattttccgcctacgcagaacatcctgtagagacgttgaggttccagtgggaacagagaggaatacttattctaaaaatgaagaaaataaacctttttttatggagtgggtgatagtattgcagaacttctataatagtatgagaattcacttgtggtgccaaagcttaaaaaaaaagtatagtaaaaacataatgtataggcttattgctgtgctatgacccatgccccgttttctccaacctctcttgtcctcactcttcctttttgctggtgatatttttacttatttcatgaaaaaaaagataacatatacacacacatagatatatgcacaagtatatgtatatatgtgtgcataacacacataaacatatacattggtaaatttaaaaacatatttatgaaatatatgtagcatctacagaaaaacatgaacacttgtgagaatagcatctgcctaaaaaataggacatcaccatcacctttgaggctcttatgtgctgctcccctgtgccattcccttcccttcttccttagaggtgattactattctaaattttgggattattatttcctttttttattatagtgttttaattacagttttattacctgtatttgtattcctaaaaatttgtttacttttgcaagctttagattttataaaagtagaattacactgtaagtttaatttttctgtaatttatatatagctacacatatattcctaagattcatccatcttgttacatatagctctggtttaccttttctgtataatatagattctgcttcgtgaatttacagttcattcattcttctgttaaaggacagttggaggactcatatggcctcagtctctgtgtccccacatgccaccctgcttcccagcctcatatgagttgattggtggcctggcatactggatgagaagctctaggtcatatatttaagagagttattgctgggtcataaaatgacagattgttttccagaggggtcatattgatttaaattatcaccaacaattatattgtcagatttttaccagtttggtgattgtgaaacagtgtctgatggtagtttttatttgcattttcttggttgaaataaagttgtgtatttcagccaggtgcgttggctcatgcctataatcccagcactttaggaggccaaggtgggcagatcacttgaggccaggagttcaagaccagcccagccaacgtggcaaaaccccatctctactaaaaatacaaaaattagatgggtatggtgtcacatgcctgtaatcccagctactcaggaggctgaggcacaagacttacttgaacccgggagatagatgttgcagtgagccgagattgtaccactgcactccagcctgggcaacagagcaataactaaataaataagtaatcaattaataaataagtatatttcctcagctgttaagtacctgttcaagttttttacccaatatttgatgggctctttttttgtcttttctaattaatttttggagtttttgatatattctagatagtaatgagttacatgaaaatatccctagtttagggatcctctagtaactttttaaaatgaatacttgttttaggaacagaaattcttagatttaatgtaggcagattttatcaattgttctttacagattggctttgtagcttaagaaatccttcctaactttgcaataattaaagatatgctcttagattgtttcctaaaagactgatacttaagcctctagcccacctggaattgattttcacagatactacattttttactagttatagattggccccttcgtagagcaagtccgatagctgccatttttatggcagcatgtgctcacttagtgtctctgtcaaattttggtaattctcacaatatttccaactttttcattattactatatctgttatggtgatctgtgatcactgatctttggcattactattgtaattgtttggggcaccattaagctcactgtcttatgtgggcataaaccatgcccacataagacagtgagcttaattaataaatgtgtgtgctcagacccctccactgactgggtgttcacatgtcttccttactctcctcaggcctccttattccttgagacgcaataatatggaaactaggcaaattaataaccccacagcgtccacaagtgtttaagtgaaaggaagaggctgggcgcaatggctcacatttgagctcacaaatgagcccatgctcatttgccattccaaaaatcccagggcccttaagaattatgctaactctactctgcctctgctctataaatggaacaacaaagcctagatgacagcacatctttttagaacatgatttactgaatattttaagcccattgtggagacctactgctcagaaaaaaagattcctttcaaaagcctgtaatcccagcactttgggaggccaatgcaggtcgatcacctgaggtcaagagttcgagaccagcctggccaacatggtgaaacacgtctttattaaaaatacaaaaattagccaggcctggtggtagatgcctgtagtcctggctattcaggaggctgaggcatgagaatcacctgaacccaggaggtggaggttgcagtgagccgatatcatgccattgcactccagcctgggcaccagagtgagactacgtctcaaaaacaaaacaaaaaaaaaaaactgaaaggaagagcttaatgagaaaggcatattaaaagccagtataggttgaaagctaggcctcttgtgcaagttagccaagttatacatgaatggtaaagcaaaacagctttattgctgtaataaagaaagttttagtggtctggatagaagatcaaatcagtcacagcattcccttaagccaaagcctaatccagggtaaagccctaacttgcttcaattctttgaagactgagaggggtgaggaagctacagaagaaaacttggaagccagcagagattgatgaggtttaagggaagaagccacaagtgctgatgtagaagctgtagcaagttatccaaaagatctaattgatgaaggtggcttacactaaacaacagattttcaatgtagacaaaacaatcttctattagaaggtgtcatctatgacttacatagttaaagaggaaaagtcactgcctggcttcaaagcttcaaaagacaggttgactctaataggtactaatgcatctggtgactttaagttgaagccagtgctcatttgctattccaaaaatcccagggcccttaagaattatgctaactctactctgcctgtgctctataaatggaacaacaaagcctagatgacagcatctttttagaacatgatttactgaatattttaagcccattgttgagacctactgttcagaaaaaaagattcctttcaaaatattactgctcattaacaatgtacctggccaccctagatctgtaatggagatatataaggacatgaacactaacacagcatccattctgcaacccatggatcaaggagtgatactgactttcaagtcttatttaagaaatacatttcatagggctctagctgccatagatagtgattcttctgatggatctgagccaagtaaattgaaaacctctggaaagaattcatcattttagatgtcctgagaaacattcgagattcctgggaagaagtcaaaatatcaacattaacaggagtttggaagaaattgcatccagccctcatggataactttgaggggttcaagacttcagtggaggaagtagctgcagatgtggtggaaatcacaagaaaattagaattagaagtggagcctgaggatatgactgaattgctgcaatcccatgataaaatttgaacagatgaggagttgcttcttatggatgagcatagaaagtagtttcttgagaaagaacttaattctggtgaagatgctgttaatattgttgaaatggcaacaaaggatttagaatattatataaacttggtaaagcagcagcagggtttgagtggattgacactagttttggaagaatttctactgtgagtaaaatgctatcaaacaacatgacaagctacagagaaatctttcatgaaaggaaaaatcaattgatgcagcaaacttcactgttgtcttatttcaagaaattgcaacagcttcctcagccttcagcaatcaccaccctgatcagtcaacagccatcatcagggctagatcctccaccagcaaaaagataacaattcgccgacagctcagatgactgttaccattttttagcaaaaacctttttaattttatttatttatttattggagacagagattcactctgtcgcccaggctggagtgcagtggcacaatctcagctcactgcaaccaccacctcccaggttcaagtgactcttgtgcctcagcctcccaagtagctgggattataagcatgtgccaccacgcctggccaatttttgtatttttagtagaggcaggattttactatgttggccaggcttgtctcgaactcatgatctctggtgatctgcccacctcgggttcccaaagtgctggtattattggcatgagccactgcgcccggccagcaaaaaagtgtttttaaattaagctacctacgttgattttagacataatgctatttgcacacttaatagattacagtgtggtgtaaacataagttttatatgcactgaaaaacaaaaaatttcacatgacttgctttattgtgatattgactttattcctgtagtctggaactgaacctgcaatatctcagaggtatgcctgtatctacttgttctgtgatacttgttattgtcagtttgtttggatttaccacatattatttgatcataattctttcctgtagatgttttatggtctgcctaaacctttagtggggcctttgatggcttagtcctttcaggcttaagacaatagaagtttatttctcagagttctaaaagctgggaagtccaagatcaaggcaccgacagatttagtgtctagtgaaggcccgcttcctcatacatggcaccttctagctgtatccttacatagtggaagggaatagctagctctctggagtttctttcataagggctaatcccactaatcccaattatgagggaagacctaatcacctcccaaaggccccacctcctaatagtatcaccttgggggttaggatttaacatatgaattttgtggggacacagacattcaaacaatagccatggcaaacttttttgctttgtctaattcactcttattttgaaaagtatttgtgttgggtttaaaactccagattggtaattattttttcttagtgcattgaaggtaatagtgtatcattttctgatttctactcttgctcttgaaaattcagctatcaatcttaaaatttattacctgttgaaaatccagctaccagtcttatattttatttacttagtgggtaatctctcttctgagtacctttaagatctcctttcagaaataccatgtagtaaccctgtgtgtcacgtgtggattttgttgggcttgctagctgagacttgacagttttcatcacttctgggatattctcaggtattttgtcttcaaagtcttcagatattgtcctcttcctgccctctctccgactccttctggaacatgagttatgtatttattatctcccatgtgcataagttatctttacatattttcaatttctttatctttctgtgctacattctggataattttgttgatctaccttccagttaattagcttgttaactttgtcaaatctctttttaagtctatcttgatttttcttttcaattattgtatttttcatttttaaaaactttatgtgctcttttggaaatcttgatcccaggagatagtggatagtgtcctgctgcttactcatggttttaatagttcttgagcatgctgaacatacttattttatgttatttgctaatctttccaattcctgaaacctttacagatctcattctgtggattcttctggattctaattcatggggcattttttttgttttttgttaattcctcatactttatctgtggggaattacttgaagcctgggttgacaatgaaattctgcagagagaatttgcatttgattctactggaggaacagtcagccccgatatcagtttaaattaaaatctctgcttaaggttttcaggcaacctgcttagcatgaatcctggctggaaaagcatgtgaggaccagtttatgattacacattcacagggtgtcatgttttcttccaacaccaatgctagaggtggcagttttgcttactgcccttggagggacaggggagtgggcatgggcatagtagtatggttttccttttcactgggggtgcagcccttggagtctcagcttaatgtgttggggaagtggtctcctattagactctccatttcaaaccattccatgattttgtcctccttttgccaccttccgagcctgtaaaaactaatgtttgtgattcctgaggtttctctaatgtcttttaataaagttgacctcagagatctcgttacctctctgagttcctgctttgtcttagattttgatccttgagtgttctttaatcttttagcaattccttgttgcatgttaaaagattagttatattttattcctcatttgtgttcgttttcaccaggaggctcaattcaggcttctttgcttacttggtgtctctagttctggtgcctggtgctttggtcaatgaagtggggttggtaggattctattacttacctgttttttggttttattttttgttttgcagttctccgggagatgttgcataaccactccttcgtgggctgtgtgaatcctcagtgggccttggcacagcatcaaaccaagttataccttctcaacaccaccaagcttaggtaaatcagctgagtgtgtgaacaagcagagctactacaacaatggtccagggagcacaggcacaaaagctaaggagagcagcatgaggtagttgggagggcacaggctttggagtcagacacatgtggtttcaaatccaagttcgaccatttcccatttatttgactgtagacaagttacattcctaaactatgtctcagatttctcatctgtaagttgtggtattactagttaacatgcaggggttttgtttgtttgtttgtttgtttgtttgtgagggtaagaaataacccaagaagcctagtccttggtagttgctcagtgccctataaatgttgtgaaccaggtggtgagggtttggtgctgctagagaattctggtatctgctctgtgcaacagagtactgtaggtgatgcaagagaaagaagacctgatgccttctttcctcccagctttgagaatggagcaaaggcctaccccagccaccaagtgagccagtgggcttgatcagcacaggaaaggtgaccccggcagtttcatttgactattgcatggctggcaacatttctattgattgtttccagggaccttggcggatgagctcctgttgagtctagcatctctgttaaatctgttctcaaataggtaatgcatatgggaggatgctgccaccttgcatctactagacatcacctatctactgtgagactctccctctaagccctgctgtggcctcagagtgcttattggccctgtgagtggggcagccactatacattgcatggagttggtacatgagatagaaacctattcgccatcccttgaaactgccccagtccagaagcttcctgttagcacatgtacctccttgtatgtattcagaactcattccatttaggcttggaaacccgtttggtgcaactctgttcaagttccattgtctgctttgagaatgcttgggcttgtatagtgagctgtcactttttaatttgttaggaattctactcgccttgctttttcttttccagcatgtttaagggaatgacctccaaggccccaaatcacagttgtattcatgttctttcatttcacagatacaatccaggccagtcccagatttgcagctgttaataaatgtgaatggttttccagtaagggggtagaaaaacatagggagagaaccgggttcagagttcaatatctggattcaagtccttcctttagcactttactaactgatgtagaataagtcagctactcaataggtgcctcagtttccccaccaaaatgcagacatagaaggtgctttgtctgctttgatgagaagtctttaagcaagtctatggggttcaatgtgttttaagaactataaagtaccatataaatgtggcctttattcccattgtgttcttggaagtaattcaatatagtgtgtacttcatagctgcttttggactattgccagccagtgtatcatcctaaactacatgtcagcatagtataatcctgccttaggtctacttttgattatttaggaagactccctgcccttcctatacatttcacataatttttaataagttgtaaaaaagtgatttataggattctttgtaagtgggggaagttaagcagacaaaaagtttttaaatcttactgcagagtgtcaggaaccttttatagcaccagacaggtagggacagaacatgagtggcagcaagccagacttggtcttagtgctctaacctgtctgttagaggctggccagtcagacccctggttgaagacgttgggaatcccagctctttggaggggtaagagattttgttagactgttaaccagattccacagccaggcagaactatttctgtctcatccatgtttcagggattacttctcccattttgtcccaactggttgtatctcaagcatgaattcagcttttccttaaagtcacttcatttttattttcagtgaagaactgttctaccagatactcatttatgattttgccaattttggtgttctcaggttatcggtaagtttagatccttttcacttctgaaatttcaactgatcgtttctgaaaatagtagctctccactaatatcttatttgtagtatgttaaatttttctaaaacttctaaggatagttgctgtattgtatgatttgcatatggaggtatctataagaagttttatactttttagcaaaatagtcatttggtagccaacttaaacaaatgtttattaatatagaagttaataatatctactgatactcggccgggtgcggtggctcatgcctgtaatcccaccactttgggaggctgaggcgggcagatcatttgaggtcaggagttcaagaccagcctgaccaatatgatgaaaccctgtctctactaaattacaaatattagcagggtatggtggtgggcgcctgtaatcccagctactcaggaggctaaggcaggagaatcatttgaacccaggaggcagaggttgcaatgagctgagatcacgccactgcactccagcctgggcaacagagcaagattccctcaaaaaaataaatatctactgacacttaatacttggaaagggataaaaataaacattgtctaaagccgtggtccaaacacaacccctgccaacaattttagtccatttcttccaagacttttttttttctatgccttttgtgaaaactgtcaaaaactttttcaatgctgaattttagttctgagttaaaaatcatactacctgtttatatggtttcatatccacttttttcatgtgatatactctacaaaaagcctgctgagattttgattgggattatgttgaatctagatcaatttagggtgaaaaacttttgttagataaatcccttagtatttcacatttttaaatgctaaatggcatttttcaaaaattttcttttttcttttcttttttgagacagagtcttgctctgttgcccaggctggagtgcaatggcaaaatcttggttcactgcaacctccgcctcctgggttcaagcgattctcaaactgcctcagcctcccaagtagctgggattacaggcatgtgccaccatgcccggctaattttttaaactatttatagtagagagggggtttcaccatgttggccaggctggtcttgaactcctgacctcaggtgatctgcccaccttggcttcccaaagtgctgggattacaggtgtgagccactgcacctggcctcaaattttttttttttttttttttaagagacaggggtctcactcttgcctaggctggagtgcagtggcgtgatcataggtcactgaagctttgaactcctaggctcaagtagctaggaatacaagtgtgtaccactacacctggctaatttttttaaaaaaatttttttcgtagaaacgggagtcttgtgttaccaaggctaatctcaaactcatggcctcaagtgatactcttgcctcagcctcccagagtgctaggattgtaggcatgagttacttcacccagccaaaaaacttcaatttcctattgtttatttgctagtatatagaaatacatatagttttgtaccttgatgctgtatcttgcaaccttgttaaactcacttactagttctagtatattttttgtagattctatcagattttctatatatgtatcatgtcttctgagaataaagaaacttttacttcttgctgtgcaaactgaacaccttttctttctttctttctttttttaagacggagttttgctcttgtcacccaggctggagtgcagtggctggatctcggcttactgcaacctccacctcctgggttcaggcaattctcctgcctcagcctcctgagtagctgggattacaggcgctcgccaccacgcccggctaatttttttgtatttttagtagagatggggtttcaccatgtggccgagctggtcttgaactcctgacctcaggtaatctgcttgtctcggcctcccaaagtgctgggattacaggcgtgaattactgcgcccggctgccttttatttctttctcttgactgactgcactggctagagcctccaatacaatgttgaatagaagtggtaagaatgggccaggcatggtggctcatgcctctaatcctagcactttgggagagtatggtgggcaggttacttgaggccaggagtttgagatcagcctggcgaacatggtgaaactctgtctctattaaaaatacaaaatatagttgggtgtggcagttcacgtctgtaatcccagctacttgggtggctgaggcatgagaatcacttgaacccaggaggcggaggttgcagtgagccaagaatgcaccactgcactccagcctgggcaacacacacacacacgaaaaacgaagtggtaaggatggaaatccttctcttcttcctgatctaagggggaaaggggaaagttacaaaacattcagtatgctgttagccatataggtttttttgtagatgcccattatgaggttgaggaagttccctctgttccttatttgctacagattttatttaggattggatgttgaatttttttcaaatgctttttttgcatctactgagataatcatatgatttttcttttatagtttgttaatatagtgaattacattgattttcttatgttaaaccaatctttgcattcctgggatgaactctgcttggttataatatataatcctttttatttattatgggatttgatttgctaaaatttttattataattattttatctgtgctcatgattgttactagtttatagttttcttttagtctttggtttttgtatcagggtaatgctggcctcatagaatgagttggtaagtatcccctccttttccattttctgaaagagttttgtgtagaattgatgttaaaattattgcttaatgtttggcagaactcaacagtgaagccatctgggcttggagattttcttcatgggaaggtttttaactgcaaattctatttctttaatagtatagagctattcaggttatctgtttcttcttaggtaagctttggtattttgtttctttgaagaaatttgtcgcatttaatctaaatttttaaatttactgacataaagttatttataatatttcttattcttttattatctatggatctcttggtgacataacctctctcattcctaatattggtaatttcaggcttttctttttaacttggtcagtctggctagaggtttatcaattttattgatcttctcaaagaactaacttttggtttcatagatttttctattttctatttcattgatatctgctctgacttttaatctttcttatacctattttggtttaatttgtcttctgtttcacatttctttttttttttttttttttttttttgagacagagtcttgctctgtcgcccaggctggagtgcagtacagtggtgcgatcttggctcactgtaacctcagccttccaggttcaagcgattcctgtttctaagcctcccaagtagctgagattacaggcatgcaccaccagctaatttttgtatttttagtagagatggggtttcactgtgttggccaggctggtctcaaactcctgacctcaggtgatccacctgccttggcctcccagagtgctgggattacaggtgtgagccactgtggctggcctgtttcacatttcttaaggtagaagctgaggtcacggatttgagacctttcttcttttctaatacaggtgttaagtgctacaaatatcccttaagcactgcttcaacagcatcccacaaattttgatagtttgttttcattttcattcagttcaaaataccttctaatttcccttttgatttcgtctttgacctacaggttttttagaactgtgttatttagtttccaatctcttgaggatttttaaaacaatatgttattgatttctaatttatttccatctcagtcaaagaacatacttgcctttttttatacatttattgaaactttttttatggcccagaatatggtctgtgttggtaaatgttccatgtgtacttgaaaataatttgtattctgatctcattgagttgaatgttctaggtatatcaagttgatagtgatgcccaagtctcctgtatctttactgattttctgcctgttctgttattgagaaaggggtattgaaacttccaactataattatgatttgtctgttctctttgcagttctcttagtttttgccttcatatatatatacatatatatgtatatatatatatatttttttttttttgagatggagtcttgctctgttgcccaggctggagtgcagtggtgtgatcttggctcactgcaagctccgcctcccaggttcacgccattctcctgcctcagcctcccgaatagctgggactacaggcgcccaccaccacgcccagctaattttttgtatttttagtagagacagggtttcaccatgttagcaaggatggtctcgatctgacctcgtgatccgcccagcttagcctcccaaagtgctgggattacaggcatgagccactgcacccagcccatatattttaaagctctgttattgggtacataaacatttaggattgttatatccttttgataatggactcttctattatgaaaagataatatactgtgggtttataacatatgtaaaagtatgagtaacatattatcagaaggggagaaatggaagataacttaggcatcttatttttaagcatagttttccctttgtttctgcattagatgatttacctgaaatgtcattcaatttaacttactctccatcctcacccgcccagctttggttatgaggcagtagaaagaaatgatctgcctgtggttttctagaaatacgaaagttgagtccttaaggctacacagaaagaaagtacctccccagggcttcacccttcccatcctttcagcaggctttttgtctgtcgtatcttctctgttgaaatggccattgacaagaggaggaaaggggttttgttgtggattgttcaggcacttcctttggggtatatgggggatgagtgttacatttatggtttctcacctgccattctgatagtggattcttgggaattcaggcttcatttggatgctccgttaaagcttgctccttcatgttcttgcttcttcctaggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggtgtgacagccattcttatacttctgttgtattcttcaaataaaatttccagccgggtgcggtggctcatggctgtaatcccagcactttgggaggctgaggtgggcagataacttggggtcaggagttcaaaaccagctggccaacatgatgaaaccccgtctctactaaaaaaatagaaaaattagccaggcgtggtggcgggtacctgtaatccaagctgctcaggaggctgaggcagaagaatcacttaaacccaagaggtagaagttgcagtgagccgagattgcaccactgcactctagcctaggcgacagcgagactgcgtctcaaaaaaaaaaaaaaagaacgttccaaggtcaggactaggcctcccctcagaagcagcaagtgacatatgtgacatcctctccactccctatttgcatttctaggttatataactgtactactatccatgcatgcctactcttgttcccagggtgaaggacccagacatggagagccgaatccctgcaggccattataaatgagattatgccatttgctcccatttcttcttattctttcatttttggggctctccatcttgatgtgttctttggatcgtgaacagatccaaagaaaaggttgttctgccgtgctgtttgtcaggatgaaaaactcttttttaagtgtttaggtctgcccccagtgcccagcccaatcaagtaacgtggtcacccagagtggcagataggagcacaaggcctgggaaagcactggagaaatgggatttgtttaaactatgacagcattatttcttgttcccttgtcctttttcctgcaagcaggaagggaacctgattggattaccccttctgattgacaactatgtgccccctttggagggactgcctatcttcattcttcgactagccactgaggtcagtgatcaagcagatactaagcatttcggtacatgcatgtgtgctggagggaaagggcaaatgaccaccctttgatctggaatgataaagatgataagggtgggatagctgaaggcctgctctcatccccactaatattcattcccagcaatattcagcagtcccatttacagttttaacgcctaaagtatcacatttcgttttttagctttaagtagtctgtgatctccgtttagaatgagaatgtttaaattcgtacctattttgaggtattgaatttctttggaccaggtgaattgggacgaagaaaaggaatgttttgaaagcctcagtaaagaatgcgctatgttctattccatccggaagcagtacatatctgaggagtcgaccctctcaggccagcaggtacagtggtgatgcacactggcaccccaggactaggacaggacctcatacaatctttaggagatgaaacttgcccatctctaaaatttcgggatttctttgtacccaacaaggttcaaacacaacagtcagcttttattcatgatttttacttccatctgctgatgtagaacatacctccagagtgacctcagaaattgtcaaatgtgaaaacacaagccatcacagtgagaaatgggaggttgagttagattgtctaaggctggagagtccatatactcccactgttagctctgaagtgtgtagccagtcttcagattctgggtcagttgcctcagtctctcttagcttttgccttactctttatccgaccactgccctgccaggaaaacaaggctctataactcctcttacaggtcagcttgacacaaaaagggtgcctggattcctaatgtttcattgtcacttttcccagtcagatgataatgcttttcaaatcaacatatattttgggggaggttggaagggagagttgaaatattctaagaatcaaagagtagcccactttaatcagagtatgacccctgattgctcacagtcatctcctgagcagtgtgagcgagtttcagatgaggaggctgaaggccagtcaggcatgctcgaggattccaagtctgtaggtgggagggcagagatttagtcctgttggccaaagcctctagggaatttctcactccagtggagaaggcaacacacttaccaaactgtgtggaaactatctcatttgattagaaattttacctcaagaagaggaaggacagttgagaaagaacattttcttacacatgagacagctaaggcttacaagaaggagaggaataatgaggcaaaataatcctcattaatattttcattcctcccctggggattagaactactttcagacccgattttaatggtaagttaggtacttcctacagttgccatccaaatatcagtcaggatcagacatgatgttagctcctgctacaataaaaccattttctccctgaatgaaaacaaaggttccacaggagacagtcccacagagcagtggcttcttttcctccctttaaaacctcatgttggctggacacagtggctcacacctgtaatcccagcattttaggaggctgaggtgggaagatggcttaagcccaggagtttgaggctgtagagctatgatcacaccactgcccttcagcctgggtgacagagcaagaccttgtctctaaataaacaaacaaacaaaaaatcctcttgtgttcaggcctgtgggatcccctgagaggctagcccacaagatccacttcaaaagccctagataacaccaagtctttccagacccagtgcacatcccatcagccaggacaccagtgtatgttgggatgcaaacagggaggcttatgacatctaatgtgttttccagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 2586 - DNA, 57070 bp, Homo sapiens
  source 1..57070: mol_type = genomic DNA
acaacggcggaggccgccgggttccctgacgtgccagtcaggccttctccttttccgcagaccgtgtgtttctttaccgctctcccccgagaccttttaagggttgtttggagtgtaagtggaggaatatacgtagtgttgtcttaatggtaccgttaactaagtaaggaagccacttaatttaaaattatgtatgcagaacatgcgaagttaaaagatgtataaaagcttaagatggggagaaaaaccttttttcagagggtactgtgttactgttttcttgcttttcattcattccagaaatcatctgttcacatccaaaggcacaattcattttgagtttctttcaaaacaaatcgtttgtagttttaggacaggctgatgcactttgggcttgacttctgattaccctattgttaaattagtgacccctcttagtgttttcctgtcctttatttcggaggacgcacttcgaagataccagattttatgggtcatccttggattttgaagcttataactgtgacaaaaaatgtgaagggaagagatttgaaacatgtggaaggaaaagtgagtgcagactataaacttccaaaaagacaagcccaaaatacacctaaacgttatgtcagattattttgttaaaatcagttgttagtgacgtccgtacgttaatagaaaaaagaatgcttcagtttggagtggtaggtttctagagggatttattgtgaaagtataaactattcagggcaatgggactgagagaacagtgggtagaaaggaccactgaaggaaaggaagagaattggaaggtagatgaaagaaggagcaagaacctggggatgttttttccttttcacttgtaatagtagtaacagaagcaatggcagactggcttttgtttctactgtgttagaatgaattgacaggacaactgggcctattattgtactgtgccagaatactgtaaaacaaaactaaacatactagcttggtggcttgtaattaattacttaagtggagatttttattttttttttattttttttttagacggagtctcactttgtcacccaggctggagtgcagtggcgcgatctcagctgactgcaacctcctcctcacaggttcaagggagattctcctgcctcagcctcccgagtagctaggactataggcatgtgccaccacacctggctaattttgtatttttagtagagatgggatttctccatgttggtcaggctggtgtcaaaactctcgatctcaggtgaaccgcctgcctcagccttccaaagtgctgggattacaggcgtgagccaccgcgccctgcagttttttgtatttttaatagagacagggtttcaccatgttagccaggatggtctcgatttcctgacctcaggtgatctgcccgctttggcctcccaaagtgctgggattacaagcatgagccaccgcgcccggctcaagtggagatttttatatggagtccagttatactctttttaatatataagttgagatgactaatacaacttcaatacaggggctcatgagaaatgtctgtaatatttaagtaacttattgtcttctttcttttttttttaagatgaagtcttactctgttgcccaggcggaagtgcagtggcgtgatcttggctcagggcaacctctgcctcctggtttcaagcgatcttcctgcctcagcctcccgagtagctgggagtacaggcgtgcatgaccacacccggctaatttttttatttttagtagagacggggtttctccatgttggccgggctggtcttgaactcctgacctcaggtgatccgcccacctcagcctccccaagtgttgggattacaggtgtgagcccccgtgcccagcctattatcttatttctgaataaagaattgtctgtgtggggaatagataactctttctcatgcagcccctgctagaaaatttgttttctctagcagttggtctgtgcttataggctactctttgaaagcacaaaaaatttattgacttcttttttttgggtttttttttttttttgagacagagttttgcccttgttgcccaggttggagtgcaatggcgcgatctcagctcaccgcaacctccacctcctgggttcaagtgattctcctgccttagcctcctgagtagctgggattacaggcatgcgtcaccatgcctggctaattttgtatttttagtacaaatggggtttctccatgttggtcaggctggtctcaaactcctgacctcaggtgatccacccgccttggcctcccaaagtgctgggattatgggtgtgagccattgcgcctggccagaaaattcattgacttcctaaagatttattaactttctgcattacttttttttttcccctccatcgtaaatataaaagggaatagtagagaaaatcattcagaattttattttttagtgacattatttagtgacattttattagagtcacttaggaacctgaggctgaataaagttcaggtaaaagtaaaattagttgagaagagacatctgccaaaagaaatctatttttaacttcacttgctgtctttcctagaggaacagaaatagtgctgaatgtcctattagaaatgatggttgctctgcccgtctcttccctctctctcacacaatatgtaaactcatacagtgtatgagcctgtaagacaaaggaaaaacacgttaatgaggcactattgtttgtatttggagtttgttatcattgcttggctcatattaaaatatgtacattagagtagttgcagactgataaattattttctgtttgatttgccagtttagatgcaaaatccacaagtattcaagtgattgttaaagagggaggcctgaagttgattcagatccaagacaatggcaccgggatcagggtaagtaaaacctcaaagtagcaggatgtttgtgcgcttcatggaagagtcaggacctttctctgttctggaaactaggcttttgcagatgggattttttcactgaaaaattcaacaccaacaataaatatttattgagtacctattatttgctgggcactgttcaggggatgtgtcagtgaataaaatagattaaaatctattctcttctgatgcttacattatagtggtgggagacaaaatgggtataataaatattatattagatagcattaagtgctgtggagaaaactaaagcagggaggaagataggagtgtgcaagccagaaaggttgcaattaaattgagtagttcaggaaggcttcaatatggatgtgatatttgagagaccggtggaagtcaaggagcaagttgtgaggctatttaaaggtattcttggcttacagaacaatatacgcaaagactattaaatggaagcatacctgacatgttaaaggactatcaaggaggccagtttgtctagaggctgaaaaggaaagagtaataggagatgaggtctgagtgaaaacacgtaaatccttgtgggccaaggtaaaatctttagctttttttctgaatatggtgggatactgttagagggttttaagcagaggttacgtggtgtggtgagttttttttttttaatcctttgtctttctgtgtggaaaatagcaggacagggcagaagcagtctgtcctgcagactgcttggtcgcagtagagatgtaagaagcagtgagattctgggttaattatggaggcaaagttctcagaatttgctgatatagggtatgagagaaagaggaatcaggaatgatttcaaggttttggtctgctaaatggaaggagttgccatttactaagatgggaaagactatgaaagaagcagattttcagagagatcagaagttcattttggggcatgttcaatttaagatgcctgttagttggatgtttatgtgagtttggaatgcagggtagagatttagggatgaatatttggtagttgtctgcattttaatggtattaaaagccacgagaaggatgggcatggtggctcacacctgtaatcccagcactttgggaggccaaggcgggcagatcacctgaggtcgggagttcgagaccagcctgaccaacatggagaaaccccatctctactaaaaatatataattagccgggcgtggtggcacatgcctgtaatcccagctactcgggaggctgaggcaggagaatcgcttgaacctgggaggtggaggttgcgatgagccgagatcgcaccgttgcactccagcttgggcaacaagagcaaaactccatcaaaaaaaaaaaaaaaaaaaaaaaaaagccttgagactcacctgaaaagatgctcaacattattggtcattaggaaaatgaatgaaaaccacaatgagataccacttcacacctattaggatggctattatcaaaaacaaaaacaagtgtttgcaaggatgtagagattggaattcttgtgtattgctagagggaatgtaaaatagtgcagggtgctgtggaaaatgctgtggtgattcctcaaaaaattaaacataattatataatccagtaattccacttctgagttattcccaaaagaagggatgcaagcagatatttgtacactcatattcatggcagcattatttacagtagccaaaaggtgaaagcaacctaagtgtccgtcagtggatgaatggataaacaaaatggaataatttcagccttaaatagaaataaaatgttgacacatgttgcaacatatacgaaccttgaagacatcatgttaagttaaataagttggtcactaaaggacaaatattgtatgattccccttatgaggttcctagagtagtcacattcatagagacagtagagtggtggttgcccagggccggggggagcgaggagaatggaaattattgtttattgggtacagagtttctgtttggggaagatgaaaaaattctggagatggatcatgatgatagttaacacagcagtgtgaatatagttaatggcacagaactgtacatttaaaaatggttaagatggaaaattttctgttacatatattttactgcaatttttttaaattttattattatactttaagttttagggtacatgtgcacaacatgcaggtttgttacatatgtatacatgtgccatgttggtgtgctgcacccattaagtcatcatttagcattaggtatatctcctaatgctatccctcccccctcccccaccccacaacagtccccagtgtgtgatgttcccctttctgtgtccatgtgttctcattgttcaattcccacctatgagtgagcacatgcagtgtttggttttttgtccttgtgatagtttgctgagaatgatggtttccagcttcatccatgtccctgcaaaggacatgaactcatcattttttgtggctgcatagtattccatggtgtatatgtgccaccttttcttaatccagtctatcattgttggacatttgggttggttccaagtctttgctgttgcgaatagtgctgcagtaaacatacgtgtgcatgtgtctttatagcagcatgatttataatcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaagatcgccattctaactggtgtgagatggtatctcattgtggttttgatttgcatttctctgatggccagtgatgatgagcatttcttcatgtgttttttggctgcataaatgtcttctttcgagaagtgtctgttcatatccttcactcactttttgatggggttgtttgtttttttcttgtaaatttgagttcattgaaaaattagaatttttttttttttcccttttttagaggcaaggtctcactctgtcgcccacactggagtgcagtagtgtaagcatagctcactgtaaccttgaactcctgggctcaagcaattctgtcatctcagccagctgaagtagtaactgtaggttcacaccaccatgcctatttttgtttttgtagaaatagggccttgctttgttgccaaggctggtcttgaactcctgacctcaagcagtcctcctgtctcagcctcccaaagtgctgggattataggtgtgagccactgcacccagccttggagatttttaataaagaagcttgtcaattaaacaaacaacaaaaagccctgagactgaatgagataatcaagagagtatgtgtagatagagaagaggtccaaggaaggagtcttgggtgactctgatgtcaagtgaggacatgaggcagaaacagcagtgactgagaaggagccacctagtaagaaaggaggaacaccaggacagtgtggtattctggattccaaacaaggaagttactgctaattttaaagctcttctcaggctgggcatggtggctcacacctgtagtcccagcacttcgggaggctgaggtaggtaaatcacttgagctcatgtgtttgagaccagcttgggcaacatggtgaaacctcatctctactaaaaatataagaaattaaggccaggtgtggtagttcatgcctgtaatcccagtgctttgggaggtcaaggcagccagatcatttgagatcaggagttcgagaccagcatggccagcatagtgaagccccatctctactaaaaatacaagaaaaaattaaccaagcatggtggcgcatacctgtaatcccagccactctggaggctgagacatgaaaattgcttgaacccgggaggcggaggttgcagtgagctgagatctcgccactgcacttcagcctgggtgacagagcaagactctgtctcaaaggaggttgcagtgagctgagatctcgccactgcacttcagcctgggtgacagagcaagactctgtctcaaaaaaaaaaaaaacaaaaaccaagaaaagaaaaaaaaactcttctaagaggatttttttttcctggattaaatcaagaaaatgggaattcaaagagatttggaaaaatgagtaacatgattatttactcatctttttggtatctaacagaaagaagatctggatattgtatgtgaaaggttcactactagtaaactgcagtcctttgaggatttagccagtatttctacctatggctttcgaggtgaggtaagctaaagattcaagaaatgtgtaaaatatcctcctgtgatgacattgtctgtcatttgttagtatgtatttctcaacatagataaataaggtttggtaccttttacttgttaaatgtatgcaaatctgagcaaacttaatgaactttaactttcaaagactgagaattgttcataaataaactattttacctgcagagacctctgatatatgtttcttgatggaagtacccagtaccacctatgaagttttcttgtcaaaaaatcaaatgtgaatctgatcattacttagatctaagtaccaatatatgaaaaatataggagacaaggaagcatggtaaatgatactgagattgggagactacatggaaaaagacttgttcccttcaacagatagacagcagggaaaaaagaatagagaaaggagtaaagaacctgtagattaaaagacatttaagggacatatgaaccaggtccagtgtatagatcttacctaaatcctgatggagcaaactataaaaaaatttttttgagacaaatgtttgaatacaggttgactatttgatggcattaaggagaaattatgaattatcttggtataagaatattgtcatgggtttttttttttgagtccttacctgttaagatacatactaaaatatttgtgggtaaaattatatgacgtataggagtatatgatttagaaaacggattaaaatataaaaggataaaataggatcttatattttgtgactcacttcctgttggatatctttctacccagtaaatatagtcctatctaggttttaatggctacatgtatgtactgtagtttgtttaaatggtttcctattgaacatttatgctctttgccattttttcctgtttaacgttctgtttttttttttgtttttttttttttttgagacagtcttgctctgttatccagactggagtgcagtgacatgatctcagctcactgcaacctctgccttctgggttcaagctattctcctgcctcagcctcctgaatagctgtgattacaggcgtgcaccactatgcccagctaatttttgtattttgggtagagacagggtttggccatgttggccaggctggtcttgaactcctgaccttgaatgatctgcccgccttggccttgcaaagtgctggggttacaggcatgagccaccacgtctggccttgtttaaggtcctgatgagtattcttataggtacactgtgtttcgtttaattatttccttaggataaatttatagaaataacattccttggtaaaagaatacatattttaaaaactgtattagtttcctgttgctgtcaaaaaatttccagaaacttagtggcattaaacaatacaaattaattattctacagttctggagatcagaagatacgggtcttactaggcctcactaggctaaaatcaaggttttggcagggctgtgttcctctatggaggttccaagggaccagagaaactactttacagtagttattttaagggaatgaaagtgaagatggggttgggcagtcaaagaggctgttacttttcatttttggcctttcagtagtttgaatttttttatcatatacatgtattactttaatttttaaaaagtaaaaagcagctgtgattcagtctctgtaatttagatcaatttacatcaaactagggtggtctcatgtgttgtcttgctcacagtgaccactagattattccaagaagggacaatttccaagacttggtttacactgagacggctcctgattttaaggataccttagatcaaactctaggaaggcagtttcattttggccttgcagttccctgggtcattttccaagcccatggcctcctggagtcttcgcctagctgtaggttatctttgtggctattatttcactgtaattatacaggaagatttattgagggatttctgtgtaccagccgtggttctcagcactttgtatactttgtattaactctgactcctgacagtaactctacagaggttctgctgttacccagttttacatagaaacatggccagcggacgcagttagaaaatggcaaagtggggattagaaactaggcagtttgactccagagtctgtgcccctgtccacttggctccactgctggggaagaggcctctgaagcagcaggaccatctgctgtgccgtgtgtagtggtactctatcttcctggtgtgatgttgtgttctactttgcattttcatgtctttccttatacaggtctcaaaatcatttacttttttttttttttttttgagacggagtctcactctgttgcccaggctagagtgtagtggcatagtctcactcactgcaacctccgcctccgaggttcaagtaattctcctgcctcagcctcccaagtagctcggattacaggcacatgccaccacagctagcaaatttttgtatttttagtagagattggtgtttcaccatgttggccaggctgttcttgaactcctgacctcaggtgatccacccacctaggcctcccaaagtgctgggattacaggcgtgagccaccccacccagccttatattttttaatgatgcacattagctcaattacataaaccagggaaatccagctaggacctggtgatttctgagcctgacccatgtgactttcaatgaactgaacttgccacagctgtatttactgtctactgagatgctgtcacacagaccccgtcatagcacagttcctgagttacatctttacatactgtagtatccttcttgtgaaaaaagatacagattccaaaggtctgagaaaccaatcttggttataaaggggaaaaatggtcatgggtttttaaaatttgttttgtcttaattgcatttcaaatttacatttctaaatgaataattgcttatataaagcagttttgattaacaatataaaacactatctatttggagtgattcctttacccatttctgaaggcaagttttaaaaattactagaagacacttcattgagaatattattaaacatgcctatagttctaccacctcaacacaattgcttattaacacattaatgttttggtgtgttttggactttttaatatgtatttttcacttgttctagtaattatgctacagattgatcatttctttttcaacatgtcatcaaagcaagtgagcaaagtgctcatcgttgccacatattaatacaaaatggaagcagcagttcagataacctttccctttggtgaggtgacagtgggtgacccagcagtgagtttttctttcagtctattttcttttcttccttaggctttggccagcataagccatgtggctcatgttactattacaacgaaaacagctgatggaaagtgtgcatacaggtatagtgctgacttcttttactcatatatattcattctgaaatgtattttttgcctaggtctcagagtaatcctgtctcaacaccagtgttatcttttttggcagagatcttgagtacgttttcttttctccttattgataaattgataatcctcaaggatgattattaggtgatactcttacttcatggattcttaaaagatatgatttaacatattacaagtgcctagcaaggtgtctgttacacgtaggtattttaagtaaatggtagctgctgatgtaatttctgcccctttgcccttcagttggggtattgctttggaccgattagagggctgtggctgggatgctaaaggttcatgtttccttagctggctcctgagccaccagctcccaccacctgtgtatacctgtgctagtttgccttcccacaagtagctgctggctatctgttatgctggtacagttttcagaaactgatgaatggcctttgaacagaacaaaaatgagattcagaataacaaaattgcacctttgtttttataagcactggccattcactagttgaagactggtaggaatacctaattcatgccaaaagaaagataatttttaaaaatcacacaggttgtttgtagattaaaagggaaaataggctaggtatagtggctttgcctgtgagtttgggaggctgaagtgggaggattgcttgaagtcaggagtttgagaccagcctgggaaacagagcaagaccccgtctctacagaaaatttttaaaaaattagctgggcatggtgatgcatatctgtagtcttagctactccggaggtgggaagattgcttgagcccagcagtttgaggctgcagtgagctgtgattacaccactgtactccaaccttaaaataaataaataaataagggaaaatatcttcaacaaaggatagttctgtctgtttctcagtcttcctcaacagataaatgtgtgaagtaatggaaggtggagatttcagattacacaacattaatgctaagggcgtttgactctgtgtgaattctaattgccctagatctagacgggctgatactattagaatcccctgtcactaactgaagacagagttgtaagttaatgccttcctagatagcctagattgtggtatgctgctgcatgctaaaatggctccccttccatagcaggatgaaatagagtcattatcttggcaaccagcccctgccaatgtgctctcagtctgcctttccagccccttctctctacctattcccagctgccatgtattctaaagcctctatgctttcatttttgtttttgccttcctggatggtctttcctgctgtctccacctgaaactattcctctctaaagaacagatgaattgccatctctctgggatgcttttacccaccctcactcccacctcaggctgaatggacccttctctagatcgcttagcatattgttctacagttaggtaaaaagtctacctatcactagatcaagagctttgtttttttttattaatttaattttcttttttttttttcttttttttttgagacagagtctcgctctgtcgcccaggctggagtgcagtgcacaatcttggctcactgcaagctccgcctcccaggttcacaccattctcctgcctcagcctcccgagtagccgggactacaggcgcccaccaccacgcccagctaattttttgtatttttagtagagacggggtttcaccatgttagttagccaggatggtctcgatctcctgacctcgtgatccacccacctcggcctcccaaagcactgggattacaggcatgagccaccgcgccgagccccaagacctttctttattaccagggcttccacagacctgacacatggtagttcctcaataaataattgcagaattactgaaaaattttactgttaacttaggcagtggtaaaaccattgtttggtagctcagaactcagcaagtaaatagcaacatttgctggaagaacagatagtttttcaaatccaattcaaggactgggtatggtggctcatgcctgtaatcccagcactttgggaggccgaggcaggcgtatccaggagttcgagactagcctgaccaacatggtgaaactccgtctctactaaaaatacaaaattagccaggtgtggtggtgggcacctgtaatctcagctacttgggaggctgaggcaggagaatcgcttgaacctggtaggcggaggttgtagtgagctgagattgtgccattgctctccagcctgggaaacaagagcaaaactccgtctcaaaaaaaaaaaaaatccaattcaaatgattatggaagtagtggagaaataaacaggaaaatgataaataattaagataatatataatatggctatattttaatctattgttgatatgattttctcttttccccttgggattagtatctatctctctactggatattaatttgttatattttctcattagagcaagttactcagatggaaaactgaaagcccctcctaaaccatgtgctggcaatcaagggacccagatcacggtaagaatggtacatgggagagtaaattgttgaagctttgtttgtataaatattggaataaaaaataaaattgcttctaagttttcagggtaataataaaatgaatttgcactagttaatggaggtcccaagatatcctctaagcaagataaatgactattggcttttgtggcatggcagcctgccacgtccttgtcttttttaagggctaggagattctttattgggatggcaaaagtcaatggcagggtagttgtcattgaaagaagattaagcttgaccccagaaggcatgggttagagcccagccttgtcactcaatggttgtatgtccagaggcaagtcacttaacatcccttaaccccagttttctcatctgtcaaatgaagcaaagaatacttgccctcttgacttaaagggtgtctgatgagacatatgactgtatcattagctgggagaaagtccatcgtgctgcctatgtatagtgcctcaagttggtctctttcccttctatgattacacaaagcactccgctgtcatgttatccatcccgcccctccattccaagtcccatctagagcacatcttcttgaagtccactgtaacctgcctaatcctggatgtgacgagccaggcaggaggcagaaaagaatgtgtgttttgcaatacatgttaagagacatcttgggctgggcacggtggctcacacctgtaatctcagcactttgggaggctgaggagggcggatcatctgaggttgggagttcgagaccagcctgaccaacatggagaaaccccatctctactaaaaatacaaaattagccaggcgtgatggcgcatgcctgtaatcccagctactcaggaaggctgaggcaggagaattgcttgaacccgggaggcagaggttgtggtgagttgagatcatgccactgcactccagcctgggcaacaagagtgaaacagggtctcaaaaacaaaaacaaacaaacaaaaaaaatcttttaccacggtgaccaccatgtgatttccaagaacttcaaatgatctaagaaattttgtgattattactagtttgaaaaatactttttttttttttgagacaaagtctcactctgttgcccaggctgaagtgcagtggtgtgatctcagctcactgcaatcactacctcttgagttcaagcagttgtcctgcctcagcctcttgagtacctgggattacaggcatgcgtcaccatgcccggctaatttttgtatttttagtagagacagggtttcaccatgttggccaggctggtctcgaactcctgacctcaggtgacccacccaccttggcctcccaaagttctgggattacagacgtgagccactgcacccagcctgaaaaatatctttgaatgccatgtgatactatacttgtcagtttacatgtgtgtcccactaaatcatgtactctcctgagcaggatcatgctttgtcttcatattttctgtacaaagcaaagactctgacacaaagctagcccccagtgcatagttgagaaatcagtgaatgaatgtgggaggcaggaaaaatgtcctttaattcttctgttaatgctgtcttatccctggccccagtcagtgcttagaactgtgctgttggtaaatataattggattcactatcttaagacctcgcttttgccaggacatcttgggttttattttcaagtacttctatgaatttacaagaaaaatcaatcttctgttcaggtggaggaccttttttacaacatagccacgaggagaaaagctttaaaaaatccaagtgaagaatatgggaaaattttggaagttgttggcaggtacagtccaaaatctgggagtgggtctctgagatttgtcatcaaagtaatgtgttctagtgctcatacattgaacagttgctgagctagatggtgaaaagtaaaactagcttacagatagtttctggtcaaggtttagccaccaattttgcagtttctctcatctccccaggaaagagcagttggtctttagatcaatgagagctcttttatggcagacaaaacaaagtgactctagccaacttgagctaaaaagaaatttagtggaaggctaggagttaccacatgaagtgtgtgcagctgccccttggagagaataagaaccagggtgcctctgggacttaacatcattactgtactccagttgttttcattcttttcctgactttgctctagagtcagtttcctaacagagtacattcgatgatcatgtgcccatatctgtggggagaagatttcttgattggcagtcttactaagggtgcatatcaagtagaatggaatagaggtagtttcctaaaggaagatgagaggctgttaccaggaggaggagaagggattcaggacagatgaaaacaacgttatatccatgatagacttacgctgctggtacagatggtacaggtggcttcagtataggctctccgaacccacatatcattgattatgatagggatatgttaactatttttcagtgtatatatgtatatgtgtgtgtgtatatatatgtatatgtatatatatatgtatgtgtatatatgtatatgtatatatttatatatgtatatgtatatatttatatatgtatatgtatatatttatatatgtatatgtatatatatttatatatgtatatgtgtgtatatatatatttatatatatgtatatgtgtgtatatatatatatttttttttgaaacggaatttcgctcttgttgcccaggctggagtgcaatggtgcgatctcagctcactgcaacctctgcctcctgggttcaagcgattctcctgtctcagcctcccgagtagctgggattacaggcacttgccaccatgcccggcaattttttttttgtttttttttagtagagagggggtttaatcattttggccaggctggtcttgaactcctgacctcaggtgatctgcctgccttggcctcctaaagtgctgggattacaggcgtgagccaccatgcctggccatttttcagtatttcttttttttttttttttttttttttttttgagacagagtttcactcttgttgcacaggctggagtacaatggtgtgatctcggctcaccgcaacctctacttcccaggttcaagcaattcgcctgcctcagccttctcaagtagctgggattacaggcatatgccaccatgcccggctaattttgtgtttttagtagagatggggtttctccatgttggtcaggctagtctcaaactcccgacctcagatgatcctcccgccttggcctcccagagtgctgggattactggcatgagccagcgctcctggcccatttttcagtatttctaaaaaaaatctaaagtgggtcaaacatttcaccttaatagaatgacaggtttgtacatcaagtttctttgctttttcttggaattttatactttttttttttttttggagacagagtcttgctgtgttacccaggctggagtgcagtggtgcgatctcagctcaccacaacctccacctccaggttgaagcaattctcctacctcagcctcctgagtagctgggattacaggcacatgccaccacacccggctaattttttttttttttttgtatttttagtagagacagggtttcaccatgttgtccaggctggtctcgaactcctgacctcaggtgatccgcccatctcggcccaccaaagtgctgggattacaggcgtgagccactgcacccggcctttttcttggaattttatcaatcagtgtcagaatattcattacctcctaaaaataaaggagttctagttggctgttttgattctaggtgtggtaaagtgaaatattgttacttaataaatgcattttgctagacacaatccttcggttcacgagctctgtagagaaaagagaaataaccgccaaccaagaaaagattgggagatactagaataagacccaggggcaggaagaagccagtgagaaggagggcatgttgagagctctgagagagaataaaagcaggggttgttggagctagcttctcaagatgtccttgaggcaaaccagacctttgggacactctgaaaataaaactgaaagtgaagagattgtgggccgaatgtggtggctcacgcctgtaatcccagcactttgggaggtcgaggcgggtggatcacctgagatcaggagttcgataccagcctggccaacatggcgaaacgccatctctactaaaaatacaaaaaaaattagctgggcctggtggcaggcgcctataatcccagctactcgggaggctgaggcgggagaatcgcttgagtccaggaggcggaggttgcagtgagctgagatcgtgccattgcactccagcctgggcaacaagagcaaaactctgtctcaaaaataaataaaaataaataaaaaagagatagtggcgtgatatccttgattctatcagcaacctataaaagtagagaggagtctgtgttttgattcagtcacctttagcatttttatttccatgaagtttctgctggtttatttttctgtgggtaaaatattaataggctgtatggagatatttttctttatatgtacctttgtttagattactcaactccactaatttatttaactaaaagggggctctgacatctagtgtgtgtttttggcaactcttttcttactcttttgtttttcttttccaggtattcagtacacaatgcaggcattagtttctcagttaaaaaagtaagttcttggtttatgggggatggttttgttttatgaaaagaaaaaaggggatttttaatagtttgctggtggagataaggttatgatgtttcagtctcagccatgagacaataaatccttgtgtcttctgctgtttgtttatcagcaaggagagacagtagctgatgttaggacactacccaatgcctcaaccgtggacaatattcgctccatctttggaaatgctgttagtcggtatgtcgataacctatataaaaaaatcttttacatttattatcttggtttatcattccatcacattattttggaacctttcaagatattatgtgtgttaagagtttgctttagtcaaatacacaggcttgttttatgcttcagatttgttaatggagttcttatttcacgtaatcaacactttctaggtgtatgtaatctcctagattctgtggcgtgaatcatgtgttctttcaaggtcttagtcttgaaaatatttatagtgtagtagaactattttatcctccaatgctccttcttttccttgtatttccattatcatcactttaggatttcacttatttatcattcaacatttattaattgcctctcatattccaggctttgtgctagaagttagggatataaagacaaataagatatttcctgcccttaaagactagattcgtgttgctaagtcttcattatcaagaaaagcataagtggggaaaagtgcttgcattatggattcctcatagttgctcccctctgcatgtaaaaatcaccatttccatcatagattcctagcggtctcaggactttataaagcccaaagtgcctatgtcataatatgaggaaaaatactgagacccttccatatatgggaggtatatggatgagacagctcctgacttcacttttcccagaaatctgaaaagcagcagcagtcattccagagcccagtttctactttgaagggcagattatttattctttgagctaacctgactgaggaacaattagtttgcttttaatttactattttctttttcttttcttttcttttttgagacagagtctcactctgttgcctaggctggagtgcagtggctcaaacttggctcactgcaagctccgcctcccgggttcacgccattctcctgcctcagcctcccgagtagctgggactacaggcgcctgtcaccacacccagctaattttttgtattttttagtagagacggggtttcatcgtgttagccaggatgatctcgatctccagacctcgtgatccacccacctcggcctcccaaagtgctgggattacaggcgtgagccaccgtgcccagccactattttctttctaattgttaatgaattaattttttaaaactgtgctcctagagcgaagggagagctctgtttacagtgtaacttttcagagcttctttaactagattttaagatcagaattagttgttgtgaaatcttagggactgtacaagattagaaatcctctatagcagcatttcccaaagcaggcttccagaacactagcctcatgaggcattttgggaaaaaagagtttgctggttcagtgtgtatgggcagtgccacaagccgtaccctccgttgaagacactcattccacacattactgcataaaaagcttccaccagccattcggcaaacttattgagtgtctgctatttcctgggtattgtgctatatggtagggttatagtagtgaacaaagaagaaatgatgcctgctctcagctgactttgcagttggaaagacacatgaaataattacgccattcattagcagattgtgctagatgcctcactggaaaaataaaggacatgatggaaaactctgtagggtcagagaaagggatcattagagaaggttctttgaagaaatattttttgaaatatgaaggataaataggaattaactaggtaccaataggttaggagtagagctttccagacagagggactagttcttgggaaggtctccagacagaaataagtgtggcttgtctgaggacctcttattcgcctattaaccttccctccccagtaaacactcctgggaacaacacacattgtagaaccacgttgtggtgctgttcagtatagcaagtaattcagcagagataagttcttggaatctcatctttgggatttagttactaagatacattcaagtttgagcaaaataaggtctcagagcttggattcattgttctgttccagcaattagagcagtacctggcacatagcacaagtgcttgaaaacactgactgagtagggtaggtgggtgagtgggtgggtgggtgggtgggtggatggatggatgggaggatgggtgggtgaatgggtgaacagacaaatggatggatgaatggacaggcacaggaggacctcaaatggaccaagtcttcggggccctcatttcacaaagttagtttatgggaaggaaccttgtgtttttaaattctgattcttttgtaatgtttgagttttgagtattttcaaaagcttcagaatctcttttctaatagagaactgatagaaattggatgtgaggataaaaccctagccttcaaaatgaatggttacatatccaatgcaaactactcagtgaagaagtgcatcttcttactcttcatcaaccgtaagttaaaaagaaccacatgggaaatccactcacaggaaacacccacagggaattttatgggaccatggaaaaatttctgatccataggtttgattaaacatggagaaacctcatggcaaagtttggttttattgggaagcatgtataatttttgtcctaagtctgtgctcagccctcccacatgtgctcattgctggttgactgttggagtctggttcttacctctaagaggaagcccaggagagggcataaagccagcacactgtcctcacctgatggtgtcagagtccttacgagtaagccctagccagaacattgctggaagagatcaagggccactgtttgaaattgcacagcaggatacggaaaaggggtaccttaggtataggcattgtcattaaagaaattgctaagatacttgagattttcctgtttaaggaatgagctttatgatacaaagagcagttctaaaaattagggagggaattaactaaattaattaggatatttctcaaattcctttacagtttttgtctctctgctgatatagtgtttacatgattgttatttactaaacaaatgctattttgtattgtgctccttataacttaattgtttattacaaggttttgatggtgacctaccaacaacaagtaatcccaaacacagtctgaattttttgttttccatccagaaataagatgaatctttccatttccgtgttttcagttttcatcatttttatcctataggttacttatctttattttaaagcatttcataataattttatagtttttgttttgtttgcttgtttgctgttggaaatggaatattccctccttccatttagactgctaaccagctgtaaatgtttcaaaatatgcatgttttacagcagttgttcaaagcaatacaggaacagtaaggacagagccagtcattttacaaccacattctgttaaactgatgtctattagcagggtttttcctattttattaggaaggacttacacctgatatataacaaagcttgttttaatcaaggctcagaaaatgtttttcattagtttttttcctaaccatgaagaataactgctttgtaacacacatgctggctataaagcagacaaaaaattcactgtaggtgctgcctgactggcctctgtccgtgtttctgttggggctgcttaccacagcctctgcattatcattagctagtgtgttcacaataccaagttcccagtagcaaagaaaggtcaagctcttacgcatgccattcatttatctacactgtgcaggcgcactcaggtggcagggacaaagaccactcctttggcgcatctcaagttcagaattctcagtagaggggctccagctgtccttttgtcaggtgcccatgcctgctccaggcctgtgtggtcaggacacgtgttacagagtacagtgacattaatgatggggccatggatatggtcagcactcagaggatgttagtctcttcattgataaagtcacaaccacttttcctgttggaaataaaaagatttgacgtatccttgtctacagcaacacaggacaacagataatcagcaggtcatctaaatctgttcagagagaaaggagagctgtttcctgaaaatacatcttcccctgattttagtcttatttttttctgcctttattgctttctaccctcttcaaaccagcctcatttcctaaattaccttgaatatgcattgacacttgtactgcctgaaattctggaaaactcagtatggctactccaccgtcagaacttcctgagcaaagttagttgctctctcggctcactgttttgttttgttttgttttcctgcctcaggtttatttgtacaaatagcacaggaggaccagccccatgcagatggtagcccaggggcgggggtagggggtcacaccagtccttctgtcctcatgttggcagagatatctactctgaagcctttgtaggggcctgggcacctttgggagcctgagctggaactgaaggtggagctgcagcctgggccttggtttgatccttggccttggcctttggccggcacagcctgagccccttggcaatacgggcacgagcacgcttcccaagcttgggatgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggcccttcttgttgtgcttcttggcaaagtgcatgttcctcaggaacttggggtccacccccttaagagattcgtatctttgtgatcggggtttcttgataccatttctgtgccattttcgggactggttgtgtgtggtgtggttcttggacttcgccatgtctacaccttaagccgcggctcccgaagcacctagaaccggaagagttggctcactatttagcacacacacacgtctataatagtgctggccacttggggttggaattagtttatttatcagcatgttgtctcccagcacttggtgtgtgtgatatgcagtatgtatttgcagaatgaaaagtctgagggctgacatcatatttcccactgtgcccagaaagagcacagttagtccacatgagctaatgggggcaaagggaagtgaggagggagaatgtactgccttatcatgttttctattacttggctgaagtaaaacagtcccaagccgatagtaagatagtgggctggaaagtggcgacaggtaaaggtgcacctttcttcctggggatgtgatgtgcatatcactacagaaatgtctttcctgaggtgatttcatgactttgtgtgaatgtacacctgtgacctcacccctcaggacagttttgaactggttgctttctttttattgtttagatcgtctggtagaatcaacttccttgagaaaagccatagaaacagtgtatgcagcctatttgcccaaaaacacacacccattcctgtacctcaggtaatgtagcaccaaactcctcaaccaagactcacaaggaacagatgttctatcaggctctcctctttgaaagagatgagcatgctaatagtacaatcagagtgaatcccatacaccactggcaaaaggatgttctgtcccttcttacaggtacaaggcacagttttccttcatttattcactaatttagcagaacctcactaagagcctcctatatgccaggctctgcgttagcaataaaaggaatgccatgcctcaccccatcaggaggtgctgatagcttgtaggcggagtggaaacagatgtgctctagaggctctaaatattacttctgctggggtcagttgggaagccacaacagctactgttcatcttccataaaagacaatcagccgggcacagtggctcacacctgtaaatcccagcactttgggaggctgaggtgggtggatcacaaggtcaggtgtttgagaccagcctggccaacgtggcgaaaccctgtctctactaaaaatacaaaaattagccaggcatggtggcgggcgcctgtagtcccagctactcgggaggctgaggcaggagaatcgcttgaacctaggaggtggaggttgcagtgagctgagactgtaccactgcactccagcctgggcgacagagcgagactccatctcaaaaaaaaaaaaaaaaagactgggttctgttctgtggaggttcttgtcttaacatatccactgttgattgcccagatgttgatgtaattaatttagcagtcgtaaatagtttagcacttgcattaaatagaccaaaccccatagtaggtatttgaaatacagaataaatgtgaggtacccctgctctaaaggagtttatagtccagagctgacttatggaggatttctttctattatttctgggtctgctactaatttgtctatttcatatcctaattatccttgttttcattttgattgaaagggggagagcatagaaattgtggtaaaaggtagttttattttttatttgagatggagtcttgctctgtcacccaggctggagtgcagtggcacaatctcatctcattgcaacctccacctcccgcgttcaagcaattctcctgcctcagcctcccgagtagctgggattacaggtgtgcaccaccacgcccagctaatttttgtatttttagtagagatggattttaccatgttggccagtctggtcttgaactcccgacctcaggtgatcctctcactttggcctcccaaagtgttaggattacaggcctcagccactgcacccagcctaaagttagttttagattaagtgttttcatgttttcccttgcaaagtaataaactggtcaagttatcaccttgttccatctccatattaatcagggtccaaacaggagatagaaaccatgcaacaatttgagtagttgaataaagaattataaacaggagattagagtaataggggattagatagtaagaggtgaagagataggaacagcagatataaagaacaaccatttcctcctatggctgagataccatcccctcaccacactcccccacctactcactgagatgcagaccttattgaagagaatgtaactggcttgctgcgaggtaaagtcaatgaggcgctccccagtaccactctgaggggatgctggggaaaactgcccatgagaagagggcacatgctgctggccacttgtgctaaagaacttgaagtctgataggagtgcaccctaacctggcatagaaaccctttcttcctgctgagtccctctagcaccttatactggcaaagctttacattgcaaacctccattatcacagagcaagcaatgaaagatggactcagagctgaggcgataaattgatagctagcatagcctctaaactgacttttatgactacattttatggatagaaagtgttcttatatatattgtttctttacataataggggacttattcatggctgcagatgagaaaacagatcctaagaagttaagtgacttgcccaaggtcacacaaagaattccactagttctaaaatgacagtaattacagttaacatacattgtatgtggcagatacatataaagcacatggcattaatttttttttttgagatggagtcttgctctgtcgccaagctggagtgcagtggcacgatctcggcttactgcaacctctgactccctggttgaagggattctcctccctcagcctcccgagtacctgggattacaggcatgcgccaccacgcccagctaatttttgtatttttagtagagacgtggtttcatcatgttggccaggatggtctcgatctcctgaccttgtgatccacccgcctcggcctccccaaatgctgggattacaggcgtgagccaccacgcccggccacttggcatgaatttaattcccgccataaacctgtgagataggtaattctgttatatccactttacaaatgaagagactgaggcaaagaaagatgatgtaacttacgcaaagctacacagctcttaagtagcagtgccaatatttgaacacactcagactcgatcctgaggttttgaccactgtgtcatctggcctcaaatcttctggccaccacatacaccatatgtgggctttttctccccctcccactatctaaggtaattgttctctcttattttcctgacagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccaggtcagggcgcttctcatccagctacttctctggggcctttgaaatgtgcccggccagacgtgagagcccagatttttgcctgttatttaggaactttctttgcaagtattacctggatagttttaacattttcttctttgaacctagttataaaggtattgtgctgttgttcctaggcttagagtcataaggcctgagctcacttcctcactttgcctccatctggaaccttagaccaacttcctaggaaaacgagctgtctgaaaacagaatagggtgcctcttcaatgtgctcttcactggagatgttcaggaggaggctactcccacctacacagggtgcagtggagggtctgggccccagggaggcagcaggaagagtggaaagagcggaggctctactgttggacagacctgggttaccagccgtgtgactagccttccctggcctccatatccccctcagtaatgaaggaatgtgtcatccccaaatccagggacagttacaagcagtcagtgaacagaaagtgtctggtacaggttctaagtgcttattattctaagtcacttcacttacctgagttctcagttttcctatctataagataagcaggttggataaaatgttctccaatatactcctggtcctgagatgatgtgattgtgggcagccctttaatcatggtgaagatgttcatcataagcacactgaaactacaaaataggaatataaatattttctccattaaattatgctggatcctagaagcaaaaactggaactgtgaaaccctacttcacagaaaacttaaaattcccaagcagatgaatgcttctcggaaggacactgacagttacctacctggaaagaatctagatggaggtggcatgggcactaagcggtgagattaaacccagttagggcagccccaccagccttggaacccacacatctggagattgttgatgcagagagaaaggttcctactggtgagacctgaaagggatatgtggcaggtgggaggaagaagttctgtctggaaaccaacccttgttcctccgttattgattgactcctggtaccaacatgagccctaggtcttatagaggccataagtccctatgccttatagtgcccatggatgagatgaggccacacatgcccccagtgggttaacatgtctagcgtgggtaaggctcttggagcactatgatacacaggaaatgcccagtaactcttagttggtttgatatctgttcccattgctcacttaagctcagtgcccctttactgatccttttattctgcctccctctgcacatgtgcattgagactcctatctgagacacacactgtgttgggtgcccagggatgcagcatagatgttgctgccttccacagaagcgctcatggtctgctagagaatatatcccatgggagagaaaaacagactcgggagaatatagcaggggcccttgtcctggactttggcagttaggaaagggagggaagagacatggaggctgggacccaaaggctaaataggaatttgctgggccaaaggggagggggaatgaaaagagtgtttctggcagaggaaatggcaaggataaaggcctggaggcgcaagagaatatgtgtttgaggatctgaaagttgagtgcagtgggtccagtgttctctaccctggctgccattagaattacctgggaaacttttagaaaattccagtgtctgggccctccctaaaacaataaatcattcttgggtggtggggtctgggcatcaggattgtttaaaaccctccccaggtactgtcatgtgcagctggggttaagctgtgctggggtctgagtatggatctgttagggcaagtggcggtgatggagttgaggctgcagaattcaggccaaatagagaggttttcatcaggatattaaagagtttagatttcaatttggtgggaatggatgggatcttatttgcattttatgaagagctccctggttgcaatatcagaatggattggagaggagcaagatggaagcctacagtgatttgggagaagtggtgagggacttgagacacaggaagtagccccattcactaatagttgagtatgtagatttgctaggacctggaaatggtttggctggtggggagtgggaagaaaggcccaaagtgtgaaatgaagatggagagcacattgcctagcccagagtgattgccatttgctctgtcccagttgaggtccaaggggttggccagagatcatggagtctgtggctccatggggagaagaacctctcagcatgcctccttgtcttatcctgggttagtcagattcattttgttagattacattttttttccagtggaactctgcttaagtcctgaccagtatgttttcagaaggatcagagggcctgcccttgtccattggtgcatgacaccagcttggtgggttccttgctgctccctgttttcatagggttatcagaataccttctctccctgccaccagcaggtcacactggctcctgactttttggcccatggaaccaccatctttctgcttcttagattgtgccttgtactccactgatcatggccagtacatcagaagccctggtttgcagtgaatgcatttgatatggaaatcaggaaccctggggataccactcatcatatttggttgctgtgtttttcctccaatctttcaccataacaacaatcaactcaaaagatttctataaccacttgtgtgggggtttctccccacacactaaacaagcagtcagttccagagtggacagcagctggtctcctccaatttaattccaacactgtctacttggagatagcattagatcccacaggttgagggtgcagtcccctagactgcccccagtctcctgcttcagacaccagtcacaagtccaggactctagaagttctgaccagtttcaagttggggttcccacaaccccccactttatttttgattaatttgctggagtggctcatagaactcagggaaacacttagttttctggacttattacaaagatttaaaaagataccaataaatagccaaataaagagatatacagggctagatctggaagggtctggagcgcaggagcttctgtccccatctacttggctcccagcagatggatgagttcttattcattttcttgtcagcttcgacatgttcagctctctggaagcccgcaaactcttgtcttcttgggccttttatggagacgtcgttaggcaggcatgattgaaacatggacaactgtgtcgaaatatgattggacataaaggggtctaaactcagtgaggcctgtttgttcagattcttcttggcctctctgtggccattctttcctccaggatatggggcaggacccctatggaatgagggtcttatgacccacaatcaaattagagtcctgccttgggcaagtgaaaggaaagcaggagaaggtaagagaaattctgttgcctaagaccttctgaggcctaaagcaccccaacattataacagaagacgataacaggactatgggagttatgagctgggaaccttggacaaaaatatatacatattaaataaatattaagtgtatatatatacttacgtatattaagtgtatgtgtgtgtgtgtatatatatatttttttaatttactggttggttttgggaagcagaaattaccataactactcttaaaaatcttttaagtctctttgaagttagaaaagtcactgtacctttttgtttccattggccctgtacttcttattataccccagcaggaggagcataatgtgttgttatatcattctggtgataagattcataagtgggttcagctggtgacagcctgattccctcattgtaaacttatccatcaacatgtagcttaatcgtttcaccttttgtgatgaccattacctgaatcagttatttcattagattgcaagattatgcttttctgattttatcatttcttctgtattgactgtaattctttggtatagaagaactttcccttgttaatagctatttggttgtcctgaagtacagttcttactagaaagtaagaccaaatgctgaattatatccctctagctatcaattttcgaaggaatgaatggtgtcctagtaatttccagtggtgtttaattacgttttcccttctctttctccttctcttattccctccctctccatctcctccctcctcactttcagttttttgctctttcagtattttgtcatagctgttaacagagcaacatattttaatcaattgtagtcatttttctttttggtgctcaaattatcccgtcttagtcccatggaagcaagcccttggagctagggccctctaccttttgatggatttccatttgtcttgataatttccttgtttctgacaagacaagatgttgcaggcacattttatactttcccagcccaaaccctggaataggccttttctccgaggagctctagttcattttagtgggaaatggtatttagagactataatctgggatctgggagtcctcattgctactgagtagtcattacttttaggcttttccagtggtcagagctaggaaatatgtatatttaaaaatggacagttgaatggttgttgccaggagctgggaggaaggggaagtgagaaattgtttaatgggcacagagtttcagtttggggaagatgaaaaagttctagagatagctggtggtgatggttgcgcaacaatgtaaatgccactgagctctcatttaaaaatggttaaaatggtaaattttatatatattttaccacaataaaaaaaagtcttcttctgggagcacccccccaagacaaaaatatgaaaattttacactgatacttccatttcaagataattttaagattataaggattttgcttaattcttgaattttatacctgtaaaccttttatacttcaaatttcgggcagaattgcttctataacaatgataattatacctcatactagcttctttcttagtactgctccatttggggacctgtatatctatacttcttattctgagtctctccactatatatatatatatatatatatatttttttttttttttttttttaatacagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccaggtatggccttttgggaaaagtacagcctacctcctttattctgtaataaaactgccttctaactttggcttttcatgaatcacttgcatcttctctctgcctgacttgccctctggaatggtgctggaatggtcctgtggccttgtccactgtctgcctttgaccataacttgaaagtcacccaccatagtgtcctttgaaataacttaaatgtccacagttccaagcatgagttaaaaacacttcagaatgtagagtagttgttcaattgaataaacacacacaccagaaaaaaaagcaagtttatcttttatttttagtaaagaattttgatagagcctcaacaccagaaatggctagagagagaagcctaacatatctggaggattatttttcatcctacttaaagctgctttcacttttttcaggaaaaaacacacgttctgaatctaatttataaaactccctggccgggtgctgtggctcacacctataatcccagcactttgggaggctgaggcaggtggatcacctgaaatcaagagttcaagaccagcctgaccaacatggtgaaaccccatctctactaaaaatacaaaattagccagacgtggtggcgcatgcctgtaatccccgctactcgggaggctgagacaggagaatgacttgaacccgggaggcggaggttgcagtgagccgagatcgcgccattgcactccagcctgggcaacaagagcgaaactccgtctcaaaacaaacgaacaaacaaaaaccccaaaaatccctgaagtacgtgagctagtggtgaaagaaagctggagaaaaggagcaggaataataataataataataataataataaagattgtcatttaattttgagtacttccagtgtacactttgcaggtactctaagacattacctcactgaaatctctaaggtagatattctttatttaaagtgtacttgtatgaaacctggagctcaaggtgaaggaatttgcccaaggctgcacttgcactatcgtggcactaattagccgtgtgaactgggacacgttacttcagtttgctcatttctgagtcagcctagcaagatgacttctaagaattttttccagccgggtacattggcctgtaatcccagcacttcgagaggccaaggtggaagggtcacttgagtctaggagttacacacaacacacacacacacacacacacacacactagccaggcatggtggcaaatgcctgtagtctcagctactccggaggctcaggtggaaggatcacttgagcccaggaggttggggctgcagtgagccatgatcacgccactgcactccagcctggctgacagagtgagatcctctgtctcaaaaaaagaaaaaaaaaaagatttttttccagggaataataaaggaagctaatatttatggagcatctacggtgtgccaaatactttgcatacgttatctcatttaatgctcttatccctgcagggaaagtattaacatttgtttatcacttgcagaactaagtgatatttaccacagagtagacaaatattttcaagcccaaaatcaagtggtatcacttttctgctgagaatgtttcagtggtttcctttgctcttgggataaaacttaaatccctcaccctacccttgctccaaccctccactttccttctcccatgtggtgatttggccatacagctcttgtggctgatctgaactgactgagctttttacccttttgctcttgctgttcttacagcctgggaaccccctggttacctcttggcttggtgtggtggcttacatctgtaatcccagcactctgggaggccaaggcggacggatcacctgaggttgggagtatgagaccagcaagtcacctcttgccagtggcctttgtccattgagtctgaagttctttctcctctcatttccccatcattctattatgctaccttgttttattttcttcattgtgtttattgatacttaaaatgatctcttttctgttgctgtttgactctcccactagaaagtaagcattgtagatcgggcactgtggctcacacctgtaatcccagcactttgtggggcagaggcgggtggatcacctgaggtcaggagttcgagaccagcctggccaacacggtgaaaccccatctctactaaaaatacaaaaaatagctgggtatggtggctcgtacctgtaatcccagctactcaggaggctgagacatgagactcacttgaacctgggaggcagaggctgcagtgagctgagatcacaccacagcactccagcctggaagacatagtgagactctctctcaaaaaaaaaaaaaaaaaaaaaggaagtaagcattgtgagggcaggtaccttctctgttttgttcattgctggatgtagttagtatacagcagtatctgatggatggatagatggaggaatgaatgaatgagacttcacaaattcagctcacttgctcaaggccctgcagctctacgggatgaagctatactccagagtcctgctacattggctgtgtggccagctgctgggatctgagggttgtcagataagcagtctaccagagaacagactgatcttgttggccttctgccagcacaggggttcattcacagctctgtagaaccagcacagagaagttgcttgctcctccaaaatgcaacccacaaaatttggctaagtttaaaaacaagaataataatgatctgcacttccttttcttcattgcagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgagggtacgtaaacgctgtggcctgcctgggatgcatagggcctcaactgccaaggttttggaaatggagaaagcagtcatgttgtcagagtggccactacagttttgctgggcaagctcctcttcctttactaacccacaatagcatcagcttaaagacaatttttgattgggagaaaagggagaaaaataatctctgtttattttaattagcattaattggtattcttgttaaaccataggagtcagagtaaatcagccatttcaccaattttcagtttgtttctgtcttagctaacagcagtgtaatggtcagcaaaattcttatcttgtgtactgaatggcatgtcctgttgctgaaagtgcacaggcttgggaggtagccatgagctcaaatcctggcactaccacctctcttgtgtgaccttagactcctgacctttctatgcctcagttctttcttacctataaaatgaaattaattttacccttaaagatcatcgtgctgattagagataaaatataaataataacacttgttacagagcaaggagttgacacttttatattctgaagacaaagtggtaaatcattatcatctatgtcagaaatagcttttgagaatacctgagtatagaactatcttgatccctgttacttcaaaactaaaataatggttttaggaattaaaaggtgaggctagtcacctccaagggatgaactgactcagggattgaggtatataacagtgaactggtccaaacaacagtcctgaccccactttatgagtgagactatgagtaatggtctaagtgtagacatcattgtccagggctccagtaggcagctctgtacttgagaatttagcagtgacccttctatttttcatctattatacctttttttttttttttttttgacacagggtctcactttgtcacccagctggagtgtggtggtgcaatcatggcccactgcagcctcaacctccctgggcttaggtgatcctcccacctcagcttcctgagtagctgtaattacaggcatgtgccatcatgcccagctaatttttcttttcttagaggtggggttttgccatgtttcccaggctggtcttgaactcctaggctctcacctctgtcttccaaagtgctgggattacaggtgtgagccaccacacctggcctattacacatttcttaattaaagtagtcaaatttgaaaactgttacaaagtgtatcttaaaatacgacgatctggtttaatttttaaaagatatgagtagccaaggagcaattctgtgcctttcccactagtccctaaccttttaaagcagctgcttcttggctgggctcagtggttcacccctgtaatcccagcactttgggaggccaaggcgggtggatcatgagtcgagatcatcctggctaacacagtgaaaccctgtctctactaaaaatagaaaaaaatagctgggcggggtggcggatgcctatagtcccagctactcgggaggctgaggcaggagaatggcatgaacacgggaggcagaggttgcagtgagtcgagattgtggcactgcactccagcctgggcgacagagcgagactccatctcaaaaggaaaaaaaaaaaaaaaacccatctgcttttgattcagtggcttctttaattttgtcggtctcagtcaccatttgtctaagcaaattcaggcaggcttcaccttgcctttctacatttgttcccttttcttagcattttgggcctttgtttacacgtgggaaaagacccacaggtcgtctctccctttgggcaggatacaggcttcctgtgactgaggttttgctagctgtagaagtggctgccaattggcttctggtttttatttccatgatttgctccagtggctcttcccttccatcattgttagctttcaagctaggaacttttaaaatgcttttaaataaaagtgagctgttacttgatgcatttagcagtcttcctcacagtggttttgatagacagactccctcagtttggaatttatgagttttctttaagggtttgtctccctcatgtatagcaggctgttgaaagttacaatgtcaataactttctgaatagtatcaaactgttttcagtgcagtgtattaacaaaactaacctgcctcaagtttggtcagctttggagtcttactgaggctaaaatgataaatctaaatgatttaaaattgtgtattcctacacagtatctcacttaattatgtaatagtcttgtgagtgaggcagagcagatgccgttttctctattttaaagatgaggaaaatggaatggaaaatggaaaggacagactaattgcaacatcctcgcaatcaaaaacaggcccaggttcatgccttgttggcagtgggttgctactggctgtggccttcatgcaggaaggctagatgcataaccaggtcaacagcccgtgcaggacaagcacgccatgtaattctgattccatcgactgaggctggtgttttcaaacgtgctggtgtagggtcttacagacagagtcatctgtgctatggggaatggaatgtgctcttgctttggagccagaactcctctgaagctcccaccacctacaccattcagaggccagacagaaatttgttcaccattttgggcatgattttcgtgcttttgtaaaatgtgcttcactgcagcccttactgggctgtggtgatgaacacttaagatactgtgtgtgtgctttataatctgtaaggcactgttcaaggggagggacctctgccatgagcccctacccactggtatctggttgacatccaaagccccagcctgggagaagctgattctctagttgaatgctgtatagggatttgactgaggctcagatttggtgaggaagaccactaaccttaacagaccaacaggctggctactccctgatgaagttccccaggccatgaaagaagtaagagatacattccttgtaacagctttcttagttgcacctgtatgattatttgatcagtgtgttgtctgtgcagggatcatgtctgtggagctcaccacctcgtcctcggtgctgagcagagtgcctggcatgtgtactcagtagatatttgctaagggagcgagtcagtgattgagaggagcagcctgggaggtaaagccctagaatctttattttaaagggatatcaaagttgaacattcagttagacagttctcttgagtccagggatttacccatccatggtggacacactttcagttaaaaagtaaggttaattttgacaggttgcagtatccaggcaagcattctatggaataaggctcatctcagggattagtaatgactgaattaacttactgctagtcccataattttgacgttaattaatggggttaagaaatgtcataagctatttggtaccatttaaagtgaaaatacccttaacgttttttgcctccagatatccacacttaatttcattttcttgctctttggtgaacagtcctgggtctgaatgtatatatccatggtttgtcactaggtgacaggtttttttggaacaagaaatcagttcagtgaacatttgtcaagtatcttctctgtaaaaagtgtaatgtgccaagctcagaagtaggaagtgaaatggataaactatgacccctgccttaaagaacaccatggtgttgtatgggaattgtttaggtagaatgaaagaaatcctctaatagagatatgaggccagttcagcagaaagccagggtgagatctcctgagagggatggaagggtgtcttgatcatctctggtagcagcaaaggcactggcatacagtggccactggaagacaaccagcaggggatgggggcgtttacccttgcaagtgagcattaggaactagaggactgattgccctttcttcagctttggtttcccttgctgcagaaaaagatgctgagactcatggcctcggttatgaactcagatatgtggtttggctttgaagcacagatggattttgtccgattttggcagggaaatgcctacagacagcactatgggcatatttaggttagggacgaaatgcaagttgattaagtcctgataagaggctgtgaagaggtccaagaagcctcacaatgcccaatgaagaaaagccctgtgcttggtgctgccgcctcccttccccgtcctgctggcagggctgcgcttcagtagctctggatgcgtcagagcagtccatgaacattctgtgtggaaaatctctgactgttttagtggattacactgctctccctttcctccagtgcctcgttattcagtattatttgatgttctccagcttttaaaataatcattttccgcctacgcagaacatcctgtagagacgttgaggttccagtgggaacagagaggaatacttattctaaaaatgaagaaaataaacctttttttatggagtgggtgatagtattgcagaacttctataatagtatgagaattcacttgtggtgccaaagcttaaaaaaaaagtatagtaaaaacataatgtataggcttattgctgtgctatgacccatgccccgttttctccaacctctcttgtcctcactcttcctttttgctggtgatatttttacttatttcatgaaaaaaaagataacatatacacacacatagatatatgcacaagtatatgtatatatgtgtgcataacacacataaacatatacattggtaaatttaaaaacatatttatgaaatatatgtagcatctacagaaaaacatgaacacttgtgagaatagcatctgcctaaaaaataggacatcaccatcacctttgaggctcttatgtgctgctcccctgtgccattcccttcccttcttccttagaggtgattactattctaaattttgggattattatttcctttttttattatagtgttttaattacagttttattacctgtatttgtattcctaaaaatttgtttacttttgcaagctttagattttataaaagtagaattacactgtaagtttaatttttctgtaatttatatatagctacacatatattcctaagattcatccatcttgttacatatagctctggtttaccttttctgtataatatagattctgcttcgtgaatttacagttcattcattcttctgttaaaggacagttggaggactcatatggcctcagtctctgtgtccccacatgccaccctgcttcccagcctcatatgagttgattggtggcctggcatactggatgagaagctctaggtcatatatttaagagagttattgctgggtcataaaatgacagattgttttccagaggggtcatattgatttaaattatcaccaacaattatattgtcagatttttaccagtttggtgattgtgaaacagtgtctgatggtagtttttatttgcattttcttggttgaaataaagttgtgtatttcagccaggtgcgttggctcatgcctataatcccagcactttaggaggccaaggtgggcagatcacttgaggccaggagttcaagaccagcccagccaacgtggcaaaaccccatctctactaaaaatacaaaaattagatgggtatggtgtcacatgcctgtaatcccagctactcaggaggctgaggcacaagacttacttgaacccgggagatagatgttgcagtgagccgagattgtaccactgcactccagcctgggcaacagagcaataactaaataaataagtaatcaattaataaataagtatatttcctcagctgttaagtacctgttcaagttttttacccaatatttgatgggctctttttttgtcttttctaattaatttttggagtttttgatatattctagatagtaatgagttacatgaaaatatccctagtttagggatcctctagtaactttttaaaatgaatacttgttttaggaacagaaattcttagatttaatgtaggcagattttatcaattgttctttacagattggctttgtagcttaagaaatccttcctaactttgcaataattaaagatatgctcttagattgtttcctaaaagactgatacttaagcctctagcccacctggaattgattttcacagatactacattttttactagttatagattggccccttcgtagagcaagtccgatagctgccatttttatggcagcatgtgctcacttagtgtctctgtcaaattttggtaattctcacaatatttccaactttttcattattactatatctgttatggtgatctgtgatcactgatctttggcattactattgtaattgtttggggcaccattaagctcactgtcttatgtgggcataaaccatgcccacataagacagtgagcttaattaataaatgtgtgtgctcagacccctccactgactgggtgttcacatgtcttccttactctcctcaggcctccttattccttgagacgcaataatatggaaactaggcaaattaataaccccacagcgtccacaagtgtttaagtgaaaggaagaggctgggcgcaatggctcacatttgagctcacaaatgagcccatgctcatttgccattccaaaaatcccagggcccttaagaattatgctaactctactctgcctctgctctataaatggaacaacaaagcctagatgacagcacatctttttagaacatgatttactgaatattttaagcccattgtggagacctactgctcagaaaaaaagattcctttcaaaagcctgtaatcccagcactttgggaggccaatgcaggtcgatcacctgaggtcaagagttcgagaccagcctggccaacatggtgaaacacgtctttattaaaaatacaaaaattagccaggcctggtggtagatgcctgtagtcctggctattcaggaggctgaggcatgagaatcacctgaacccaggaggtggaggttgcagtgagccgatatcatgccattgcactccagcctgggcaccagagtgagactacgtctcaaaaacaaaacaaaaaaaaaaaactgaaaggaagagcttaatgagaaaggcatattaaaagccagtataggttgaaagctaggcctcttgtgcaagttagccaagttatacatgaatggtaaagcaaaacagctttattgctgtaataaagaaagttttagtggtctggatagaagatcaaatcagtcacagcattcccttaagccaaagcctaatccagggtaaagccctaacttgcttcaattctttgaagactgagaggggtgaggaagctacagaagaaaacttggaagccagcagagattgatgaggtttaagggaagaagccacaagtgctgatgtagaagctgtagcaagttatccaaaagatctaattgatgaaggtggcttacactaaacaacagattttcaatgtagacaaaacaatcttctattagaaggtgtcatctatgacttacatagttaaagaggaaaagtcactgcctggcttcaaagcttcaaaagacaggttgactctaataggtactaatgcatctggtgactttaagttgaagccagtgctcatttgctattccaaaaatcccagggcccttaagaattatgctaactctactctgcctgtgctctataaatggaacaacaaagcctagatgacagcatctttttagaacatgatttactgaatattttaagcccattgttgagacctactgttcagaaaaaaagattcctttcaaaatattactgctcattaacaatgtacctggccaccctagatctgtaatggagatatataaggacatgaacactaacacagcatccattctgcaacccatggatcaaggagtgatactgactttcaagtcttatttaagaaatacatttcatagggctctagctgccatagatagtgattcttctgatggatctgagccaagtaaattgaaaacctctggaaagaattcatcattttagatgtcctgagaaacattcgagattcctgggaagaagtcaaaatatcaacattaacaggagtttggaagaaattgcatccagccctcatggataactttgaggggttcaagacttcagtggaggaagtagctgcagatgtggtggaaatcacaagaaaattagaattagaagtggagcctgaggatatgactgaattgctgcaatcccatgataaaatttgaacagatgaggagttgcttcttatggatgagcatagaaagtagtttcttgagaaagaacttaattctggtgaagatgctgttaatattgttgaaatggcaacaaaggatttagaatattatataaacttggtaaagcagcagcagggtttgagtggattgacactagttttggaagaatttctactgtgagtaaaatgctatcaaacaacatgacaagctacagagaaatctttcatgaaaggaaaaatcaattgatgcagcaaacttcactgttgtcttatttcaagaaattgcaacagcttcctcagccttcagcaatcaccaccctgatcagtcaacagccatcatcagggctagatcctccaccagcaaaaagataacaattcgccgacagctcagatgactgttaccattttttagcaaaaacctttttaattttatttatttatttattggagacagagattcactctgtcgcccaggctggagtgcagtggcacaatctcagctcactgcaaccaccacctcccaggttcaagtgactcttgtgcctcagcctcccaagtagctgggattataagcatgtgccaccacgcctggccaatttttgtatttttagtagaggcaggattttactatgttggccaggcttgtctcgaactcatgatctctggtgatctgcccacctcgggttcccaaagtgctggtattattggcatgagccactgcgcccggccagcaaaaaagtgtttttaaattaagctacctacgttgattttagacataatgctatttgcacacttaatagattacagtgtggtgtaaacataagttttatatgcactgaaaaacaaaaaatttcacatgacttgctttattgtgatattgactttattcctgtagtctggaactgaacctgcaatatctcagaggtatgcctgtatctacttgttctgtgatacttgttattgtcagtttgtttggatttaccacatattatttgatcataattctttcctgtagatgttttatggtctgcctaaacctttagtggggcctttgatggcttagtcctttcaggcttaagacaatagaagtttatttctcagagttctaaaagctgggaagtccaagatcaaggcaccgacagatttagtgtctagtgaaggcccgcttcctcatacatggcaccttctagctgtatccttacatagtggaagggaatagctagctctctggagtttctttcataagggctaatcccactaatcccaattatgagggaagacctaatcacctcccaaaggccccacctcctaatagtatcaccttgggggttaggatttaacatatgaattttgtggggacacagacattcaaacaatagccatggcaaacttttttgctttgtctaattcactcttattttgaaaagtatttgtgttgggtttaaaactccagattggtaattattttttcttagtgcattgaaggtaatagtgtatcattttctgatttctactcttgctcttgaaaattcagctatcaatcttaaaatttattacctgttgaaaatccagctaccagtcttatattttatttacttagtgggtaatctctcttctgagtacctttaagatctcctttcagaaataccatgtagtaaccctgtgtgtcacgtgtggattttgttgggcttgctagctgagacttgacagttttcatcacttctgggatattctcaggtattttgtcttcaaagtcttcagatattgtcctcttcctgccctctctccgactccttctggaacatgagttatgtatttattatctcccatgtgcataagttatctttacatattttcaatttctttatctttctgtgctacattctggataattttgttgatctaccttccagttaattagcttgttaactttgtcaaatctctttttaagtctatcttgatttttcttttcaattattgtatttttcatttttaaaaactttatgtgctcttttggaaatcttgatcccaggagatagtggatagtgtcctgctgcttactcatggttttaatagttcttgagcatgctgaacatacttattttatgttatttgctaatctttccaattcctgaaacctttacagatctcattctgtggattcttctggattctaattcatggggcattttttttgttttttgttaattcctcatactttatctgtggggaattacttgaagcctgggttgacaatgaaattctgcagagagaatttgcatttgattctactggaggaacagtcagccccgatatcagtttaaattaaaatctctgcttaaggttttcaggcaacctgcttagcatgaatcctggctggaaaagcatgtgaggaccagtttatgattacacattcacagggtgtcatgttttcttccaacaccaatgctagaggtggcagttttgcttactgcccttggagggacaggggagtgggcatgggcatagtagtatggttttccttttcactgggggtgcagcccttggagtctcagcttaatgtgttggggaagtggtctcctattagactctccatttcaaaccattccatgattttgtcctccttttgccaccttccgagcctgtaaaaactaatgtttgtgattcctgaggtttctctaatgtcttttaataaagttgacctcagagatctcgttacctctctgagttcctgctttgtcttagattttgatccttgagtgttctttaatcttttagcaattccttgttgcatgttaaaagattagttatattttattcctcatttgtgttcgttttcaccaggaggctcaattcaggcttctttgcttacttggtgtctctagttctggtgcctggtgctttggtcaatgaagtggggttggtaggattctattacttacctgttttttggttttattttttgttttgcagttctccgggagatgttgcataaccactccttcgtgggctgtgtgaatcctcagtgggccttggcacagcatcaaaccaagttataccttctcaacaccaccaagcttaggtaaatcagctgagtgtgtgaacaagcagagctactacaacaatggtccagggagcacaggcacaaaagctaaggagagcagcatgaggtagttgggagggcacaggctttggagtcagacacatgtggtttcaaatccaagttcgaccatttcccatttatttgactgtagacaagttacattcctaaactatgtctcagatttctcatctgtaagttgtggtattactagttaacatgcaggggttttgtttgtttgtttgtttgtttgtttgtgagggtaagaaataacccaagaagcctagtccttggtagttgctcagtgccctataaatgttgtgaaccaggtggtgagggtttggtgctgctagagaattctggtatctgctctgtgcaacagagtactgtaggtgatgcaagagaaagaagacctgatgccttctttcctcccagctttgagaatggagcaaaggcctaccccagccaccaagtgagccagtgggcttgatcagcacaggaaaggtgaccccggcagtttcatttgactattgcatggctggcaacatttctattgattgtttccagggaccttggcggatgagctcctgttgagtctagcatctctgttaaatctgttctcaaataggtaatgcatatgggaggatgctgccaccttgcatctactagacatcacctatctactgtgagactctccctctaagccctgctgtggcctcagagtgcttattggccctgtgagtggggcagccactatacattgcatggagttggtacatgagatagaaacctattcgccatcccttgaaactgccccagtccagaagcttcctgttagcacatgtacctccttgtatgtattcagaactcattccatttaggcttggaaacccgtttggtgcaactctgttcaagttccattgtctgctttgagaatgcttgggcttgtatagtgagctgtcactttttaatttgttaggaattctactcgccttgctttttcttttccagcatgtttaagggaatgacctccaaggccccaaatcacagttgtattcatgttctttcatttcacagatacaatccaggccagtcccagatttgcagctgttaataaatgtgaatggttttccagtaagggggtagaaaaacatagggagagaaccgggttcagagttcaatatctggattcaagtccttcctttagcactttactaactgatgtagaataagtcagctactcaataggtgcctcagtttccccaccaaaatgcagacatagaaggtgctttgtctgctttgatgagaagtctttaagcaagtctatggggttcaatgtgttttaagaactataaagtaccatataaatgtggcctttattcccattgtgttcttggaagtaattcaatatagtgtgtacttcatagctgcttttggactattgccagccagtgtatcatcctaaactacatgtcagcatagtataatcctgccttaggtctacttttgattatttaggaagactccctgcccttcctatacatttcacataatttttaataagttgtaaaaaagtgatttataggattctttgtaagtgggggaagttaagcagacaaaaagtttttaaatcttactgcagagtgtcaggaaccttttatagcaccagacaggtagggacagaacatgagtggcagcaagccagacttggtcttagtgctctaacctgtctgttagaggctggccagtcagacccctggttgaagacgttgggaatcccagctctttggaggggtaagagattttgttagactgttaaccagattccacagccaggcagaactatttctgtctcatccatgtttcagggattacttctcccattttgtcccaactggttgtatctcaagcatgaattcagcttttccttaaagtcacttcatttttattttcagtgaagaactgttctaccagatactcatttatgattttgccaattttggtgttctcaggttatcggtaagtttagatccttttcacttctgaaatttcaactgatcgtttctgaaaatagtagctctccactaatatcttatttgtagtatgttaaatttttctaaaacttctaaggatagttgctgtattgtatgatttgcatatggaggtatctataagaagttttatactttttagcaaaatagtcatttggtagccaacttaaacaaatgtttattaatatagaagttaataatatctactgatactcggccgggtgcggtggctcatgcctgtaatcccaccactttgggaggctgaggcgggcagatcatttgaggtcaggagttcaagaccagcctgaccaatatgatgaaaccctgtctctactaaattacaaatattagcagggtatggtggtgggcgcctgtaatcccagctactcaggaggctaaggcaggagaatcatttgaacccaggaggcagaggttgcaatgagctgagatcacgccactgcactccagcctgggcaacagagcaagattccctcaaaaaaataaatatctactgacacttaatacttggaaagggataaaaataaacattgtctaaagccgtggtccaaacacaacccctgccaacaattttagtccatttcttccaagacttttttttttctatgccttttgtgaaaactgtcaaaaactttttcaatgctgaattttagttctgagttaaaaatcatactacctgtttatatggtttcatatccacttttttcatgtgatatactctacaaaaagcctgctgagattttgattgggattatgttgaatctagatcaatttagggtgaaaaacttttgttagataaatcccttagtatttcacatttttaaatgctaaatggcatttttcaaaaattttcttttttcttttcttttttgagacagagtcttgctctgttgcccaggctggagtgcaatggcaaaatcttggttcactgcaacctccgcctcctgggttcaagcgattctcaaactgcctcagcctcccaagtagctgggattacaggcatgtgccaccatgcccggctaattttttaaactatttatagtagagagggggtttcaccatgttggccaggctggtcttgaactcctgacctcaggtgatctgcccaccttggcttcccaaagtgctgggattacaggtgtgagccactgcacctggcctcaaattttttttttttttttttttaagagacaggggtctcactcttgcctaggctggagtgcagtggcgtgatcataggtcactgaagctttgaactcctaggctcaagtagctaggaatacaagtgtgtaccactacacctggctaatttttttaaaaaaatttttttcgtagaaacgggagtcttgtgttaccaaggctaatctcaaactcatggcctcaagtgatactcttgcctcagcctcccagagtgctaggattgtaggcatgagttacttcacccagccaaaaaacttcaatttcctattgtttatttgctagtatatagaaatacatatagttttgtaccttgatgctgtatcttgcaaccttgttaaactcacttactagttctagtatattttttgtagattctatcagattttctatatatgtatcatgtcttctgagaataaagaaacttttacttcttgctgtgcaaactgaacaccttttctttctttctttctttttttaagacggagttttgctcttgtcacccaggctggagtgcagtggctggatctcggcttactgcaacctccacctcctgggttcaggcaattctcctgcctcagcctcctgagtagctgggattacaggcgctcgccaccacgcccggctaatttttttgtatttttagtagagatggggtttcaccatgtggccgagctggtcttgaactcctgacctcaggtaatctgcttgtctcggcctcccaaagtgctgggattacaggcgtgaattactgcgcccggctgccttttatttctttctcttgactgactgcactggctagagcctccaatacaatgttgaatagaagtggtaagaatgggccaggcatggtggctcatgcctctaatcctagcactttgggagagtatggtgggcaggttacttgaggccaggagtttgagatcagcctggcgaacatggtgaaactctgtctctattaaaaatacaaaatatagttgggtgtggcagttcacgtctgtaatcccagctacttgggtggctgaggcatgagaatcacttgaacccaggaggcggaggttgcagtgagccaagaatgcaccactgcactccagcctgggcaacacacacacacacgaaaaacgaagtggtaaggatggaaatccttctcttcttcctgatctaagggggaaaggggaaagttacaaaacattcagtatgctgttagccatataggtttttttgtagatgcccattatgaggttgaggaagttccctctgttccttatttgctacagattttatttaggattggatgttgaatttttttcaaatgctttttttgcatctactgagataatcatatgatttttcttttatagtttgttaatatagtgaattacattgattttcttatgttaaaccaatctttgcattcctgggatgaactctgcttggttataatatataatcctttttatttattatgggatttgatttgctaaaatttttattataattattttatctgtgctcatgattgttactagtttatagttttcttttagtctttggtttttgtatcagggtaatgctggcctcatagaatgagttggtaagtatcccctccttttccattttctgaaagagttttgtgtagaattgatgttaaaattattgcttaatgtttggcagaactcaacagtgaagccatctgggcttggagattttcttcatgggaaggtttttaactgcaaattctatttctttaatagtatagagctattcaggttatctgtttcttcttaggtaagctttggtattttgtttctttgaagaaatttgtcgcatttaatctaaatttttaaatttactgacataaagttatttataatatttcttattcttttattatctatggatctcttggtgacataacctctctcattcctaatattggtaatttcaggcttttctttttaacttggtcagtctggctagaggtttatcaattttattgatcttctcaaagaactaacttttggtttcatagatttttctattttctatttcattgatatctgctctgacttttaatctttcttatacctattttggtttaatttgtcttctgtttcacatttctttttttttttttttttttttttttgagacagagtcttgctctgtcgcccaggctggagtgcagtacagtggtgcgatcttggctcactgtaacctcagccttccaggttcaagcgattcctgtttctaagcctcccaagtagctgagattacaggcatgcaccaccagctaatttttgtatttttagtagagatggggtttcactgtgttggccaggctggtctcaaactcctgacctcaggtgatccacctgccttggcctcccagagtgctgggattacaggtgtgagccactgtggctggcctgtttcacatttcttaaggtagaagctgaggtcacggatttgagacctttcttcttttctaatacaggtgttaagtgctacaaatatcccttaagcactgcttcaacagcatcccacaaattttgatagtttgttttcattttcattcagttcaaaataccttctaatttcccttttgatttcgtctttgacctacaggttttttagaactgtgttatttagtttccaatctcttgaggatttttaaaacaatatgttattgatttctaatttatttccatctcagtcaaagaacatacttgcctttttttatacatttattgaaactttttttatggcccagaatatggtctgtgttggtaaatgttccatgtgtacttgaaaataatttgtattctgatctcattgagttgaatgttctaggtatatcaagttgatagtgatgcccaagtctcctgtatctttactgattttctgcctgttctgttattgagaaaggggtattgaaacttccaactataattatgatttgtctgttctctttgcagttctcttagtttttgccttcatatatatatacatatatatgtatatatatatatatttttttttttttgagatggagtcttgctctgttgcccaggctggagtgcagtggtgtgatcttggctcactgcaagctccgcctcccaggttcacgccattctcctgcctcagcctcccgaatagctgggactacaggcgcccaccaccacgcccagctaattttttgtatttttagtagagacagggtttcaccatgttagcaaggatggtctcgatctgacctcgtgatccgcccagcttagcctcccaaagtgctgggattacaggcatgagccactgcacccagcccatatattttaaagctctgttattgggtacataaacatttaggattgttatatccttttgataatggactcttctattatgaaaagataatatactgtgggtttataacatatgtaaaagtatgagtaacatattatcagaaggggagaaatggaagataacttaggcatcttatttttaagcatagttttccctttgtttctgcattagatgatttacctgaaatgtcattcaatttaacttactctccatcctcacccgcccagctttggttatgaggcagtagaaagaaatgatctgcctgtggttttctagaaatacgaaagttgagtccttaaggctacacagaaagaaagtacctccccagggcttcacccttcccatcctttcagcaggctttttgtctgtcgtatcttctctgttgaaatggccattgacaagaggaggaaaggggttttgttgtggattgttcaggcacttcctttggggtatatgggggatgagtgttacatttatggtttctcacctgccattctgatagtggattcttgggaattcaggcttcatttggatgctccgttaaagcttgctccttcatgttcttgcttcttcctaggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggtgtgacagccattcttatacttctgttgtattcttcaaataaaatttccagccgggtgcggtggctcatggctgtaatcccagcactttgggaggctgaggtgggcagataacttggggtcaggagttcaaaaccagctggccaacatgatgaaaccccgtctctactaaaaaaatagaaaaattagccaggcgtggtggcgggtacctgtaatccaagctgctcaggaggctgaggcagaagaatcacttaaacccaagaggtagaagttgcagtgagccgagattgcaccactgcactctagcctaggcgacagcgagactgcgtctcaaaaaaaaaaaaaaagaacgttccaaggtcaggactaggcctcccctcagaagcagcaagtgacatatgtgacatcctctccactccctatttgcatttctaggttatataactgtactactatccatgcatgcctactcttgttcccagggtgaaggacccagacatggagagccgaatccctgcaggccattataaatgagattatgccatttgctcccatttcttcttattctttcatttttggggctctccatcttgatgtgttctttggatcgtgaacagatccaaagaaaaggttgttctgccgtgctgtttgtcaggatgaaaaactcttttttaagtgtttaggtctgcccccagtgcccagcccaatcaagtaacgtggtcacccagagtggcagataggagcacaaggcctgggaaagcactggagaaatgggatttgtttaaactatgacagcattatttcttgttcccttgtcctttttcctgcaagcaggaagggaacctgattggattaccccttctgattgacaactatgtgccccctttggagggactgcctatcttcattcttcgactagccactgaggtcagtgatcaagcagatactaagcatttcggtacatgcatgtgtgctggagggaaagggcaaatgaccaccctttgatctggaatgataaagatgataagggtgggatagctgaaggcctgctctcatccccactaatattcattcccagcaatattcagcagtcccatttacagttttaacgcctaaagtatcacatttcgttttttagctttaagtagtctgtgatctccgtttagaatgagaatgtttaaattcgtacctattttgaggtattgaatttctttggaccaggtgaattgggacgaagaaaaggaatgttttgaaagcctcagtaaagaatgcgctatgttctattccatccggaagcagtacatatctgaggagtcgaccctctcaggccagcaggtacagtggtgatgcacactggcaccccaggactaggacaggacctcatacaatctttaggagatgaaacttgcccatctctaaaatttcgggatttctttgtacccaacaaggttcaaacacaacagtcagcttttattcatgatttttacttccatctgctgatgtagaacatacctccagagtgacctcagaaattgtcaaatgtgaaaacacaagccatcacagtgagaaatgggaggttgagttagattgtctaaggctggagagtccatatactcccactgttagctctgaagtgtgtagccagtcttcagattctgggtcagttgcctcagtctctcttagcttttgccttactctttatccgaccactgccctgccaggaaaacaaggctctataactcctcttacaggtcagcttgacacaaaaagggtgcctggattcctaatgtttcattgtcacttttcccagtcagatgataatgcttttcaaatcaacatatattttgggggaggttggaagggagagttgaaatattctaagaatcaaagagtagcccactttaatcagagtatgacccctgattgctcacagtcatctcctgagcagtgtgagcgagtttcagatgaggaggctgaaggccagtcaggcatgctcgaggattccaagtctgtaggtgggagggcagagatttagtcctgttggccaaagcctctagggaatttctcactccagtggagaaggcaacacacttaccaaactgtgtggaaactatctcatttgattagaaattttacctcaagaagaggaaggacagttgagaaagaacattttcttacacatgagacagctaaggcttacaagaaggagaggaataatgaggcaaaataatcctcattaatattttcattcctcccctggggattagaactactttcagacccgattttaatggtaagttaggtacttcctacagttgccatccaaatatcagtcaggatcagacatgatgttagctcctgctacaataaaaccattttctccctgaatgaaaacaaaggttccacaggagacagtcccacagagcagtggcttcttttcctccctttaaaacctcatgttggctggacacagtggctcacacctgtaatcccagcattttaggaggctgaggtgggaagatggcttaagcccaggagtttgaggctgtagagctatgatcacaccactgcccttcagcctgggtgacagagcaagaccttgtctctaaataaacaaacaaacaaaaaatcctcttgtgttcaggcctgtgggatcccctgagaggctagcccacaagatccacttcaaaagccctagataacaccaagtctttccagacccagtgcacatcccatcagccaggacaccagtgtatgttgggatgcaaacagggaggcttatgacatctaatgtgttttccagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 2587 - DNA, 57070 bp, Homo sapiens; identical to SEQ ID NO: 2586
  source 1..57070: mol_type = genomic DNA

SEQ ID NO: 2588 - DNA, 57070 bp, Homo sapiens; identical to SEQ ID NO: 2586
  source 1..57070: mol_type = genomic DNA

SEQ ID NO: 2589 - DNA, 57497 bp, Homo sapiens; identical to SEQ ID NO: 2585
  source 1..57497: mol_type = genomic DNA

SEQ ID NO: 2590 - DNA, 57497 bp, Homo sapiens; identical to SEQ ID NO: 2585
  source 1..57497: mol_type = genomic DNA

SEQ ID NO: 2591 - DNA, 57070 bp, Homo sapiens; identical to SEQ ID NO: 2586
  source 1..57070: mol_type = genomic DNA

SEQ ID NO: 2592 - DNA, 7654 bp, Homo sapiens
  source 1..7654: mol_type = genomic DNA
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggtgggcaaacacctagtctagagttggggagggctgtccgtgagggtgttgagtgtcccagagaggatgcagggcctcagaggagatgctttaggggtgtgttggtggtgatgggcgtatctgaagaacagaggtgtccagggttaggcagtggggggtcttgtggaggctttgagcagtgatggccagaaatgggcaatggggctttcctaggtgggaaatgggaaatggtttggggtgggggaggcattggagggttctggggtaagcataggctgggagtgaacaggggcaaaccttatgcagctgtggggtagaaatgggctagaggcatccaggggtgagaaggagctgaggatgtctaaggaggggagatccctgggtggtcagaaagcactggtgtctggaaagcatttaatgctttattaaatgttagtccctgctgggcatgacggctcacacttgtaatcccagcactttgggaggctgaggtggtaggatcgctgaagctcaggagtttgagcccagcctaggcaacatagtaagatcctgtctctacaaaaaaattaaagaaatagccaggcacagtgatgtgcacctgtagttccagctatgcagaaggctgagatgggaggatcgcttgagtccaggaggtccaggctgcagtgggctgataccgtctctccgaaaaagaaaaagaaaaaagactccctccatgagtgtctggagggagtcctttggccccagctgggcagagaaaggggtcagagatctggcatgtgtgtgtcccttcatccacaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggtgagccggggccgtgggggcagcggggtggggcggggaggccaggtctggctcttgggccagcggtgaacatgtcctgtcttggacgcgtccctgggtttcactatttaatgtgtggcccctggggagtgtccccacctctgagcctctgtttctccttcagggaaatggctcttgcaatccaagtcctcctgccagggccattgtgagggtctaagtagacaaaaaaaaaaaaaaaaaaaacagtctggaagcaatttatagatgagagcgtggacggcagagagcattgtgtatgttgaagtctctgcgatatggggtgtccctgctgccccgctccagcctttcacttctgacctccttcctctggctcttacgctacaggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcgggtgagaacgtgaggagggaaaatccaagagacctgggcggggtcagggaagggaggaccacggagagcgtggaggcagcagtggccccggcttcctcttgcctgcccgcgctgccctggcttatacggcccctcctgccagacagtgcacagggccagggcgccaggctgggagagcttcgcgcaggcgggatttcagcccgcacttatttcggagcccttgccttgggcagcgcacaatctgcgcagcagtactcggctaaccctcttcctctcgacctgtttcttcagagcacggagacgggtatcccttcgacgggaaggacgggctcctggcacacgcctttcctcctggccccggcattcagggagacgcccatttcgacgatgacgagttgtggtccctgggcaagggcgtcggtgagattctgagtcctcctggcccctgattcccttcattctctcccactcatcacccgccgccctaactccggtcccccctcctcctgcagtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagtgagtgagggggctcgccgagggctgggggcgcccaccacccttgatggtcctgggttctaattccagctctgccactagtgctgtgtggcctgcaattcaccctcccgcactctgggcccaattttctcatctgagaaatgatgagagatgggatgaactgcagaccatccatgggtcaaagaacaggacacacttgggggttataatgtgctgtctccgccttctccccctttcccacatcctcctcgccccaggactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgaggtacctccaccctgtctaccaggttcagccccgccctctcatcatgtattggcccccaaaacgcggctcttccctcccatcagtttgtctttccactctcattggtcctcaggacgaccgtgactccgcccacctacaccacatttccaccactatccctgacttccaatggccccgccccagccactaaggttcggccttttctgcccagctggccgcctcttccttggtctggtgtcccaggcaccgcccacgggtctagcctcttctcaggagtgctctacagcgccccctaggccaccaagattgtttagctccctgtcgggtcggcccctgactccttattggactcatccatctggctcatccaaggccttgggtctctccagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggtaggcgtggtcccgcggctccggggctggggttcccggcagtggtggtggtggggtggccagggctgggggctcggcccggcgctcacgtctcaggctccctctccctccaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtgaggcaggggcagggatgggaggaggaggggaaagggcgtggctgtgccacagtaccaaagaattgggggttggggatcgggggaggaacggggcgtgcaggagaggtgggacctcaacgtctgtctggaagcagagcctgggcccagtcgctgccatgtcagtgcttagaggtggtgataaagagactctagagagagataggtgtgacttcaaaagccagtctactctgggcatggtggctcacgcctctaatcccagggctttgggagacccaaggcgggaggattgcttaagcccaggagttccagaccagcctcggcaacatagccagactcccatctctacaaaaaataaatgagcaaggcgtgaaggcacatgtctgtagtcctagctactctggaggctgaggtgggaggatctcttgagcccaggagttcgaggctgtagtgagctatgattgcaccactgcattccatcctgggccatagaggatgtcgcttaaaacgaaaaagaagaagaagaaagtcctgtggtttgggaagggaggctgagtgaggaggggcctgtgtgccagaggaggcttcactgagaagcttaggggagcagatgttctaggggtacagaggtatgcaggaataggaagagtctcaccccgtgtctctttttaggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggtgaggaggcggggttgtgtggatgcgggagggggctttgcggaggggctgcccgtcccttcccgcccactggccctgtgtccaaggcttagagcccgtcctttccctcctcgctttctcaggaagtactggcgattctctgagggcagggggagccggccgcagggccccttccttatcgccgacaagtggcccgcgctgccccgcaagctggactcggtctttgaggagcggctctccaagaagcttttcttcttctctggttagttacctactttccctcccccgcccggtcaatccccatcagtcaaggaggctcaagagaccatcgataacccacgaaacgtcttgtgcgttttagaaaaatacgccccctggcggacgcagtttagcaaacgtaggggcggctgagtttctgccccctcctctccacgccctcgcgtcgctctacccagcgcctctgcccctgggttgcagggactgcgggcacgcgggctaggaaaggcctcgccggaatctccctcctcgcgttctaggagtacgtgctccctctgcgcccccaaaccgacgtgaccctcctcccctgcagggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggtgagcgccgccgcggccgccggcagggggagcccgggcgccgtcggtccgtccgctagccggctcagcacctgtctcctccgcgcctgcccgcaggttcgacgtgaaggcgcagatggtggatccccggagcgccagcgaggtggaccggatgttccccggggtgcctttggacacgcacgacgtcttccagtaccgaggtgagggctgaggaggatcccttcgtgagacaccacactaagctcctcttagtgagtggtcaaattctgagcgaggaagaaaaagcccttggaaatggaaacaaatgccccagcacagacaagatcccagcagaggcagaggccttctccaggtcatttaggaagtcagggatgcaaccaagaccaggacccagatttcctgcctccccggctggaagctctttctccttcagtacaggacggcaggtggtttgtatggaagctcagttattagacaacagtcatcaagtgccgataatgtgccaggcactgtgctacagggagagataagacaattcacagctctgtgactttgggcaagtcactgcttctctactcttcgagcctcagtttccccatctgtaatatggggactatagctggaattacacttgacttccctttcttaccagtcacatccaaacagttgacaaggtgaacaagatttcctgccaccaaaatctttttcgagtctgtcattttttttgccatcttctttataaacaccccagcccaaaccatactggctgtccaggacctttaacaaattccatgagattagagagggggtaggagtgaagggcaatggtcttgggagtgaccccagatgaattccaaggtcaaagaaattaagaggatctgacactccacccccgtgttctcatctcttcccactcctcctgttatttactctgctccacccacactggctgctctttgaacagatcaaggtcattcctagcttacagcctttgtgccagttgttccctctgtctggaaagcttcccctccagattgtcactgggccatcccactgtcttccttcaggtttcagtgctaaggccattgcttcaatgaggccttctttgatgcttattatctatttacttgtttttattttctccatagctttctatattttctttttttttcttttttctttttttttttttttgagatggagtcttgctctgtcgcccaggctggagtgcagtggcacgatctcagctcactgcaacctccgcctcccgggttcaagcgattctcctgcctcagcctcccaagtagctgggattacaggtgcctgccaccacgcttggctaattttttgtattttttagtagagacggggtttcaccatcttggccaggctggtcttgaactcctgacctcgtgatccacccgcctcagcctcccaaagtgctgggattacaggcatgagccaccgcacccagccgctttctatattttcaaaaccaatctcatttatttatgtgtttgcttaattgtctcttgcctcactagagtgtaagcaccaagataattgagatcatgcctgcattttttctgcttatccccagtatcttgaacaaagcacatagtagatgctcagtaaatgatgaatgaacagatttgttcaatgaatgagcgttgaatgaattgttctgagcattaagatagttggtctattcatttgttaattcattcacaaaatgtgtatggtgtacctactgtgtgctaggctctgtggcagtgctttgggcactgaggtctgtgccctccagcatctcacagaacctcacagcatctcacaggttggggggatggaggtgatatgtgaaaaccttagaaagttctagaaatggcagaagagatggttgtcaagatcttgttcctatttctgtatatgtgggagaattagaatcactcctcttatgcctgcctgtctcctgcagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaaccttta

SEQ ID NO: 2593 - DNA, 4354 bp, Homo sapiens
  source 1..4354: mol_type = genomic DNA
tagagttcaaaatgttttttccaatttatttagaaaaatagactctggattcacattcaccccagggctatgtgggatgacagcaaggagacacctgagatgaaatgaggaaggtttgaattactggtatccaaggggctgggggcaaaagccagaagcctttgtcccttcagagccagagtggcatgagtgtcttggctcccctcctctccctcccttcagtagtcttcagccatggccagtaagacaaggctggtccagccgtggaaagggcggcagcccatgcctcgcccatcgcggtcactgtactgctcccaaagaaagcctgtagcctggtactggcgccatacattgcctaccacgttggcacggagctcaccgtggagtttggcagcccgagcctggtgaggaccctccagatgcccatagtggtggagtgctcccaaagccaggtagttgacattgagccacacagcaccccgccagtaggggggatcatgctctgaattgcgctggccataaaaggagctggaggctgcaagggagcgtaaaccaaaggggctccagagatggcggctgtcggctagaatgtccagcaggggcccaaggcgggatgaggtggggtccagcagtcgcagcagcaagggaaaaagactgacatagccaagagcatctacatactgcagttgaggttggggccgacccaccacccgaacgagcccctgagggggcctgggcttcagctgtactgcttttgtgtggttcccaaagtctgcaaagactcctagctctggggcccagtgcagctcatccaggctctctgctgcctccagtgaggcagccagtgggcccagctcagcagctacctcagcctcacccagatgctctgccagccgcgtcagcacacgggcacccagtgccacccaacatcgcaggtccaggtgccgctcggttactgaagggtgtgaagcccgggggtagtcatccagcccagagggtagggtcttggggttcagtaaggttggtaaggcagggtcccgtccccgccagcggtaagatagtggcagtgggcctgcctggctctgatggagccaggaaaaccaggcatgcaggcggggcaaggcctttcggaggaaagccaagtcgtcagggtcaccaacctctagcatatgggctacaggcaaaagtagggttggggggttggcgtggactgctcgttgtactaggaattctggaggcacccgggctcgggcctcatcccccagtatctgctccctcccaatccagccatcagcatttagcagccccagccagtggccaagggcttcccgggtgagggagggatcccaccgctgaaccaccagctggtgaaagccttcatcccaaaggaagcctcgtgggaagaatgaccgggagggcactgctgtaaaaagaggtacgggtggaaagagggctgggtccaccttctgctcagacccttccaccccgatgtctggcaataccagcccttgtccgtagaagtagccaattccaccaaggaggccgctgagggcagcctgacccaaaacctgctcgccagagctcaggcccttctccttcagctggaaggtcttctcaaagcgctctctaaagccttcagcatggctctccagggcctgggtcagtagactgcctgccagtcttggcagggcttgatttcctcctgcctgggcactgcctgattcaaacacaaactctatggaaatgggaattttcagggtcacctgctgtatcaagaactgcccctgcccttgcccacttggacctctgtcctcccacttcagggatcctggcaagccgaggtagcgttcagggggggcccctgggggccgatgctgaaaccagctatttaggcgactctttaccatctctgtcagcaggggcagtcctgggttggaggtccagaagacattgtagcttgaaggggagaagataaataggaaatattattcaagagaaggcagtgggcattataaagagaaatacaaagtgttcaggagtcaggttgggaggtctcaggcaggggacatggagactggtgaaaatgggaataaccaccccttccatcccccaacattcttttcccccagttacctgccatacttgggggctgtatcccctggactggttggtggcaaaagtgtaaagcggaagtcaccaagttcactggtgtgcccactgataaacttcaactgccccttggccccaacctctggtagtaggacttccttgccatctgtcaccacatagaagaacagggagaccaaagggagggcagaagtacctgagtcctgagtgaccaacgaggacagaaaagaacagtgttagattggcattctctcttgaattccctcttgagaatcagccttagtgagggaaaggaacagtaggcaggggtaatgtaaacaacatacgtctggcagtaatgagggtcactgagggtaaccaggtacacccaagcgggatgagataaagagccttgcactgggtgccctgggagataacagtatacttttgtactatgtcctacactaagaactctacacagttgatttcatttaattctttttttttttttttttttttgaggcggagtctcgctctgtcgcccaggctggagtgcagtggcgcgatctcagctcactgcaagctccgcctcccaggttcacgccattctcctgcctcagcctcccgagtagctgcgacaataggcgcccgccaccacgcccagctaattttttgtatttttagtagagaccgggtttcaccgtgttagccaggatggtctccatctcctgacctcatgatccgcccgcctcagcctcccaaagtgctgggattacaggcgtgagccaccgcgcctggcttttttttttttcttgagatggagttttgctcttgttgcccaggctggagtgcaatggcacgatctcggctcagcgcaacctccacctccctggttcaagcaattctcctgcctcagcctcccaagtagcttggatcacaggcatgcgccaccacgcccggctaattttatattttcagtagagacggtgtttctccattttggtcaggctggtctggaactcctgacctcaggtgatccgccagcctcggcctcccaaagtactgggattacaggcgtgagccaccgcgcccagcctctttttcatttaattcttacagtcctgtgagttaagtgctattattatctacattgtacattttacaagcaaggaaatcaaggcttagagatggtaaatagaaatggttatacaggcagttgtttaaggcaggatttaagccaggcagccagagcccacttcatgctgcatttgctggcagcaagggaaggatggagggggtctgggctgagaaaagggtgtcctgaggccctgacctgaggctctacagtcactctccagctccagtcccctccgtgctgacccccaggcctcttgacgaactcagtggtgagccttaaggccccatcctggatgtgttggcgcccgaaggagaggccgtcgtggaactcccagccatagggacccacaccgtccccctgctcacacgtgtgcctgagcttaggagtccccggggtggtgccctgctgcgcccacatcagtcctgggggtagaatggccacgtaagtcaaagagcaggggacctgtccctccgggtctccgggtcatccctcttcataactctcctgatccattccttcccacccttgctctcgcttcaagctggggcgcccagattaggagtccgcctgcctgcccgccctggggcccggttaccggtgaggaggggcttcgggctgcgggtcttcatgccgaagtagacgtgagggcggtaggttccccagaagaggtccggggccacggcggggctggaggagtcggcaggcaacacaggaggcgcggagtgcagcgtgaccgcccgccgcgcacggtaccacgccagcacccagcgccccgacatacccagggccaaagacaggaccacgacggccagagccactcctccagccgtgctacgcggcccgccgccccggccgtcccgtcgcccggggcctccccgagccgccctctcggctgtccgcactccctctgccggcactgcgcggcgccgccgctcgccccgagccatcctggcactgaggtccgcgtcacaagagctcggagaggcggcagtggagcccgggtcctgcctcacctctccggctcccgcctctcgccctggcgaccaccgtccggttagcgacacctgccagccagcgcctgcgcctccgcctccgcctcccgccggaagt

SEQ ID NO: 2594 - DNA, 4354 bp, Homo sapiens; identical to SEQ ID NO: 2593
  source 1..4354: mol_type = genomic DNA

SEQ ID NO: 2595 - DNA, 21144 bp, Homo sapiens
  source 1..21144: mol_type = genomic DNA
tgtcttccccaaagcactttaatgcattcaccaacccacagtccctgcccgctggctgggcaagagaggccagcccccatctggaggctcctatggcttcccacacctagtgtgtccaggaaggctgagcccgcacacattcccatcaataggtgaggggcgtgagaatgaagaggcggtcttcctctttgcggatccagcgcatcagcttatggatggcactgacggctgacgccttggtccccagggggctgtaacacatgtagagctcaaaggcgcctgtcacctggagaaggggcaaagggtcgtcatctaggttagaggcccctcatggcccatacctaggacctccataaagcccagcccatcccagggctgccttacccaggccaggaggttctcgttggggcccgtgtagtaaatggtcttgagtgggcgagaggcattgtgggcacgactgtgcaagtactggtagaggcccagcagccgctcctgctcctcttcactggtgtatggggcctcaatctcagggctgcagacagggtggagggagtgggtttgcaaaggaatgacttccactgtcttctctagagatttagaaacacctattcctatccaggaagactctatcttatgtcctaccctccaggtgctcccttaggacagggcattgtctccccaccatagcaggcaccccaggacagggctgggcccactgagactagagctatgtcccctcttaccccctaagctcatagtgtctttggtgacccctctttggagaggccaggttgagtttagatgtccaagacagagtgacagatctggagtagaggaaaggtgagctaggaatcctgtgggccaaaagggacaaagggaggccatatcttcccagcccctctgctgggggagggggtggaggagggctgtgcttcctgagctggaccaaaatgacccctaaagtagagttgctccagggcaagggaccccggagacctctgttccagtttccttctctgggtatattgggcatttccaggccttctggttaataaagtagagagggtatgctcatggggtgatggagagtctgggtctctggtgccagagtaaaacaggcccagcacactggtctgcttccaaaggtagggacagcttcagggctacatctcagagctcaggaccaaacagcctcccgactccacatgtccctgtcccgctacagcagtgccctcaaggccctccctcacctggtgaagagtcccgagctctttgacttatagaggaagtgacgcaggtcagggatgcccacttgggcaacgctgtagtagggtgtgcgcagtgcctctcgcagggccaggtgggctccgcgcttgcgaaggcgctcctggaagcggcggcggcagtcagagactgcaaagaagtcctcacggtcagtggagacaagcagcaggcagaggtcagtgtcaggctctaggtaagagatgtgtgcgtggaagaagccggctgcgttgaatttgggcaggcacacgggcgtccaggcctcgccctcgcgaaaggacgaggaggaactaatgaggttgaagagcaggtgcaggtcgatggggtgcagaaattggtcctttcggcgcacgagtgccacgagctggttgcgggccagcaggatggagaagaccaggctgcgcgcacgcgcctgctgcaggctggcgctcacagtgtcgcgcacggccgccgccaggggcaggcaccgtgccgcccccatcaggaagctggggtctcgtgccatgagctgcagcaggttgtcggtgatgcgctctgagcccgagagtaggcgccgcaaatcatagttctgcttctgctggaagatgtggctcagctgcgcaccggtaagaaggcttaggatctggtagtagatgtagagcagctcctgcgccagctcttgtgccgactgccgcgtacgagccaccgccactagcaccagcgggctccggcgcacgaatactaccttgtagccatctgagagcgggacaggaaagaaggatgtcagcctcagcggcagctccctccgaaaaccgccttccagcgcagctcttcgctttccccatcctttcctcgctcagagctctgcgcacagtaggggtttaaggatgttcaggataaaaacccattgctccttctccctgagggctcagggcctatccctgccacttgcttcaaagactagctccctctgaaacacacattcttatgctaagtgctaagtcaactggcaactggcaagggctggctgggtggagctcaggacctgggagatagatagattagatagatagatagatagatagatagatagatagatagatagatagatagatagagtttgttgttgttgttgttgttgcctccccagggggattctcactctctccaaaggcaaagcccatgtcagaggcaactttggtcctcgccgcagccccatgaggccagcagtgttgttatcttctgttcaggtgaggaccttgaagctcagagaggtagagggacttaccctcagtcacacagcacatcccagccctctggtctgcaggggtccaaaacctgctatgaatgaaccttggccaggggagcccgccccattccctctccaggtggctcacctgcatggatggagcggatggcgttcttgtctgcctccaggaaggacaccagggccaccataacacccatagtgctggaaagtgcctcctcagacccatagcgggagtacacaggcttccctgcctcactcagcacaaagacatgcttctggtgcaggcgccatgcctccgtggcatcctcctcatccccctcggttgtgccctccctggggggctctgtggctggtcgcccaactgcccctgggggttccagccaatcctcagagcttcctggcagcatctcctcctgcaggtcccgggccacacccgtcagctgggtgcttagctcgctaaagtcctggctgatctggcgcatgtctgtaggcagcggcgggggacccctggtaccctccttgtggctgtccccagaagctgccccatcctctgactcagtcaggtcctcgtaggaacgggcatggacgaacatggcaccctcctggcccgcacctgcaggccaaaagcactggtgcttagaggggtagctagtggcagacactcctaccagcaaggtgcctaacgtggtcactccagcatgactgcctgtcttgttaggatcaagccactgttcccttctgccactgtctgccatggatgatgcttctctgcaacttacagcccaccagtctcctctcatcgtactggaaagaagacccaaaccactcatggcagcagtggtggctggtatctgcctacctctcattcccatctcccaccccactcccttgcccatcttggtcacactggcctacatccatctgctctcagatactttcaacacacccccacctgcctcaggagctccacacctgctgtcagctgtctcctacctccccaagaggccggctaattgtcacacttaagctctcagggaagatgttagttactgacctccaaccccaggcactctatatatccctttttgatttctcttgtggcacttgccagttattgtccttctccccaactacaatggtacccagtaaggtgccggaacgcagcacctcaccctgtgtctggagcactgcccatactcaatgaatctctctctctgggagaaagctcccctaccctactcaggccatagctcctgactgaccccactataatggcgccgcagcctgtgactgcctcagggcagggaccaggtcagtcttcctttattgattttttgacaaaatagtttaacagatatattttgagtctctcttgcgaattcagccctgtaccaggcactggggatataactgctctgcgctcaaagtgttcacaatcttgtggaagagagagatgggcaatatatgcataaagagataaaattatgaaataattagtgtgctatacagagcatggtcagagcaggcctaactcgtgaggaggggagaaggagccggggaggtgcgctgtagacacagggaacagaagagcccacaatggcagccagaaagctcagggcgagcagcataacatgaagtggagaggaaagccagatgcagaatgagcctggcctcctgccttatccccagaacctgacaaatatccaatgagtgactgacaaatgcatgaataagtggaaaggaaaaagtggttgggaatcctaattccccctggagactgctctggttggcagctggctgaggctgtacacttgcccatacctggctccattccctgggccattcctggtgtggggctctcagctctctccatactctgtccatcagaaggagtcaatgtgccatcaaggcattcgctgcttctcttcctctgcatgtcagtagccatcctttgagctctcctgtggggcaaacaaatgcaacatcgatggcttttggcagggtcacaggcataatcaacagtggtagtaagtacaggaaagtgtcctttatcaggactccactaactcaaatctctagaaaatggattctgagaattcctttcaaaaaaatatatactgttccttttctgattataaaaggaagacatattcattgtaaaaaaaagacttggaaagcacagaaaagtagaaagaaatatcaagattttcctaccattcaggatctttcactgttcatacgttagtgtatttccttctagtattttttttttttttttttttgagacagtgtctcgctctgccgcccaggctggagtgcagtggcataatttcggctcactgcagcctccccctccggggttcaagcaatactcgtgcctcagcctcccaagtagctgggactacaggtgggcaccatcatgcctggctaatttttgtattttttggtatagacggggtttcaccatgttggccaggctggtcttgaactcctgacctcaagtgatctgcccctctcggcagattgttgttgttgttgttgttgagacagggtctcactctgttgccaaggctggagtgcaatggcaccaacacagctcactgcagccttgacttgggctcaagcagtcctcccatctcagccttcccagtagcacatgccacagccagctaattttcttttcttcttcttctttttttttttttttttgagacggagtttcgctgttgttaccctggctggagtgcaatggcgtaatctcggctcaccgcaacctccacctcccaggttcaagagattctcctgcctcagcctcccggggtagctgggattacaggcatgcacctggctaattttgtatttttagtagagacggggtttctctgtgttggtcaggctgctctcgaactcccgacctcaagtgatccgcctgcctcggcctcccaaaatgctgggattacaggtgtgagccaccgtgccccacctttcttttctgaaacaggtctggctctcttgcccaggctggagagcagtggcgtgatcttggctcactgcaacctctgcctcctgggcttaagccatcctcccacctcagcctcctgaatagctgggactacaagcacatgccactgcgcctgcctaatttttttttttttttttttttttttgagatggagtcttgctctctcacccagtctggagtgcagtggtgcgatctcagctcactgcaacctccacctcctgggttcaagcaattctcctgcctcagccttgcaagtagctgggattacaggcacctgccagcacatccagctaatttttatatttttagtagagacaaggtttcaccatcttggctaggttggtcttgaactcctgaccttgtgatccgcctgccttggcctcccaaagtgctgggattactggtgtgagccactgcgcccgcctaatttttgtattttttatagagacaaggtcttttcatgttgccctggctggtctcaaactactaggctcaagcaatcctcccacttcagcctcccaaaatgttggaattacaggcatgagccaccatgcccagcctggtcttttagaaaatgtacataaaatgtaaataattaaacaaactgatagcagcagctaacagttattcagtgtcagcgtatcatgctaagaggtttctgtggattaagttacctaatcttgatcacgcctctatgaggcatgtgttcctgtcaggctagctttatagatgaaagaactgatactgagagagcttaaggagcttgcccaatgttactacaggaaagaagtgctggatttggatctgggagttgaaacaactctgtatcctgtatccagtggctcactcctgtaatcttagcaaagattggaggccaaagagggaggatcacttgagctcagtagttcactagctggggcaacaaagtgagaccctgtctctacaaaaaattttaaaaactagccaggcatggtggcatgtgcctgtaatcccagctactagagagactaacatgagaggatcacataaacccagcaagtcaaggctgcagtaagctgtgactacaacactgcactccagtttaggcaacagagtgagaccctgtctcaaaaaactaaaactaaaaataaataaaaataaaaattaactaagttgaccaatagttctttttggatatctaggtgtttgcagataaaaaagtgagacacaggcaacaggcttgtcttcaggctgcagccctgcttttctctaaatatccttttgtaccttttgaatttggcacaaggagttgtcttaacaattaaaaacaactatagacatgtcaactctcagtgcccatgtaatggccaggatagattcagccggatctccttgtccttccacagccccaggcccaggtggaggtggccacaagtgaatgtcagtggtaacagagctagctgggtggctcaccgaggctggtagcaaggcttatttggcctctagggtccttcaatggcaggctgaaggatcctcacttgtcaggcaacatacagttcacccaagaggggatccattccaggtaccaatcctttaagaaagagggatctagctggatggactagaagggcagagactcatggagcaaacactgcaggcaggccaggggcccaggaggcactggtgttagtgtgagcaaagtagacctgagcctgcatcccagaacacagagtctggtgggaataactgagctcttgtcccctcctagctgtgtaaccttgggcaaatgactcttccctggaagcatggcataaagtaggtgttcaaaaaagttcatgaaaagggtggtcccaaacagatagcatcaccatcagtagcatttgtgtggcatcagccagtctgtgtccaagaacattctctctggacctggcatagctccagtcaggcagctcctatgtgtgtgcccaaagaactaattttcaacctcttctttttgtcacctttaagctatgtaattctttctttaattgaatcttttgcagaagctccacgtgcaaacagatagggaagcagagcctgtatcctgacagctggcctggtggccactcctgcactgagcctgaaggaccgcagagcacatggagggttgggcaccactgccaacagcatcaccccacacagaataaaaccaaagaaagaaggttggggagataatctggggattttctaggcccccagtcccatccatcaggacaatcaagagtaatggttcccagcaagagtcagagcccagaaggaaaaggcgcaggctgccttgtcagacagtgggccagaggaactaagaggctgcatgccctcaacaggaacctgcggtagcatccacagaggtcccctctgagactgagactaagaggagcaatccaaaacaaccaccacaacaccacaaggcccaggatgctgaatgccaaggaaactagggcatgtctaagtcttgcgcaagaacacacaggccacgtaaatctcatagaccagtaattccaaagctatcctaaaagccagagtgggctctgagagatgagtctgcccaagtgcaggccaagagtaagctgctcctgacagtaccagggttgtggccagggcttccaggcctatctgggctcaagcgatcctcctacctcagcctcctgagtcgctgggaacacaggcgtgagccaccatgcgtggataatttttgtattttttggtagaattagggttttgccatgttgctcaggctggtctccaatacctgggctcaagcaatctgcctgccttggcctcccacagtcctgggattacagctgtgagccagcacccggcctggaatgccctacatttcttttcttttcttttcttttcttctttgagacggagtctggctctgtcgcccaggctggagtgcagtggcgctatcttggctcactgcaagctctgcctccccagtttatgccattctcctgcctcagcatcccgagtagctgggactataggcgcccgccaccacgcccagctaatttctttttgtatttttagtagagacggggtttcactgtgttagccaggatggtctcgatctcctgacctggtgatccacccgcctcagcctcccaaagtgctgggattacaggcgtaagccaccacgcctggccggaatgccctacatttctatgtctcctcactttcctactcctctagtcaacttcacaccttttctctcttcaaacatccatcatctccttccctgatggtcatactcagcactatcagcaaatgaccttgccttccatttcaccgagaagacagaagtcgttagaagagaacttccggggcgagtgtggtggctcacgcctgtaatcccagcactttgggaagccgaggcgggcagatcacctgaggtcgggagtttgagaacagcctgaccaacatgaagaaaccctgtctctactaaaaatacaaaaaattagccaggcatggtagagcatgcttataatcccagctactcaggaggctgaggcaggtcaatcacttgaacccgggaggcggaagttgtggtgagccgagattacactccagcccaggcaacaaaaccaaaattgcgtctcaaaaaaaacaagaaggccaggcgcggtggcacacacctgtaatcccagcactttgggaagccaaagtgggtggatcacctgaggtcaggagttcgcaaccagcctgactaacatggtgaaaccccatctctactaaataaaaaaaaattagccaggtgtggtggcacgtgcttgtaatccaagctacttgggaggctgagacagaagaattgcttgtacctgggaggcagaggttgcagtgagccgagatcatgccactgcactccagcctgggcaacaagagcgaaactctgtctcaaaaaaaaagaacaaaaaaaaagaacttccggagattaccaccacgagcttacctcatctgccagaataggccttccctcttttttttttttgagacagagtctcactctgtggcccagactggagtgcaggagcacgatcttggctcaccaaaacctccacctcccagattcaagcgattctcctgcctcagcctcccaggtagctgggattacaagcacccaccacttcgcccggataatgtttgtatttttagtagagacggggttttaccatgttggccaggctggtctcaaactcctgacctcaaatgatccacccgcctcagtcccccaaagtgctgggattacaggcatgagccaccgtgcctggccccctcttcttactaaagatgagctgttcatgctccatagaggctaactcctccatgtgtacaccagagcccagcccctctcacctactcaggtacatggcttcagcagctgtccctcctcatcagtttccccttctcccttatccattaccaatatggtgatatttcttgtcttcaaaaccccctcccagcagggcttggtggctcatgcctgtcatcctagtactttgggaggcctaggtgggcaaaccacttgagcctaggagtttgagaccagcttaggcaacatggtaaaaccccatctctacaaaaagtacaaaagattaaccaggtgtggtggcatgcacctacagtcccagctacttgggaagctgaagtgggagaatcacctgatcccaggaggtccaggctgcagtgagtggtgatcacaccactgcactccagcctgggtaaagggagtgagatcctgtctcaaaaacaaaaaccaaacaattttgggggtgttcgctttgtaataattcactgggctatacttatgatttgtgaacttttctatatgtttgttttacttcaaagttaaaacaaaacaaacttccccttaactctacattccccactagctatcaacccatttttctgttgccctttataaaaaaacaaacaaaccccctcaaaatggcaaataatatttggagtttgcattagtcaggtaggctagactattctgtgtaaaaaatggatgccaaatgctacaggttttacacccaaagatctttttttattttttgagacggagtctcactctgtcacccaggctggagtgcagcagcgccatctccgctcactgcaacctctgactcctgggttcaagcgatgctcctccctcagcctcccgagcagctgggattacagacgcccaccaccacacctggctaatttttgtatttttagtagagacggggtttcactatgttggccaggctggtctcaggtgatcctgacctcaggtgatccgcccaccttcacggatccaaagtgctgggagtacaggcatgagccaccgcacccagccccaaagacctattttttgctcacataaaatctactgtgggactggtagcaattcagagtagctcccttccaagcagtgattcaggaatccaagccactagcaccctatagaagccattcggaacacatgccttccacatcacctggcaagggaagacagagatggaggatcatgtaccagctcttaaatacttcgtagctcacattggccagaaccagtgatgtggccagagggactgggaaatatatggagctcacggatatctggaaagcaggaattgtctctgccgtagcctctccatttctcccattctctctaaaccagttctgaacagaatctcacctccattactccatcaacactgctcccatcaaggtcaccaacgacctccaggatcatcttacttcacccataaacaatagataatttggttatttcctctctcttgaaacattttctcctcttttatggcataccactcctttcttggctctcttctgacctcatggactactccttctgagtcctttttgcagttcttactgtaaaggggcacagaattcagtctttggacctcttctctgtcttcactcaatcccttggtgatctcatttggtctcatagttttaaattccctctacatattaatacttttttttaatctccagccccaatatcttttctgacttaaagaggcacacacatttaactgtctacttcatgttatctcaaggttatatgcctcaaactgaactccttaaaaaggccatctcctggccaggcgtggtggctctcacctgtaatcccagcactttgggaggccgaggagggtggatcacgaggtcagaagtttgagaccagcctggctaacctggtgaaaccccatctttactaaaaatatgaaaattagctgggtgtggtggcacacgcctgtaatcccagctactcaggaggctgaggcaggagaattgtttgaatgtgggaggcggaggttgcagtgagccaagatcgtgccactgcactctagcctgggtagcagagccagattctgcatcaaaaaaaaaaaaggtcatctccttaaaaagttgctcctagctgggtatggtggcttacacctgtaatcctagcactttgggaggccaaagcaagcagattacttgagcccaggagttcaagaccagcctgggcaatatggcaaaccctgcctctacaaaaatacaaaaattagccaggcgtggtggcacgtgtctgtggtcccagttactcaggaggctaaggtgggaggatcacaggaacccgggaggtagagcttgcaatgagccaagatcgtgccactgcactccagcctcggcaataagagtgagaccctgtctccttttttttttctttttttgagatggagtctcgctctgtcgcctggactggagtgcagtggcgcgatctcagctcactgcaagctccacctcctgggttcatgccattctcttgtctcagcctcacgagtagctgggactacagacgcctgccaccacacccggctaattttttgtattttttagtagagacgaggtttcaccgtgttagccaagatggtctcaacctcctgacctcatgatccgcctgcctcagcctcccaaagtgctgggattacaggcctgagccaccacgcctggctggtagagaacctgtctttaaaaagaaaaaaaggccgggtgcagtggctcacgcctgtaatcccagcactttgggaggctgaggtgggcggatcaccaggtcaggatatcgagaccactctggctaacacgggaaacccatctctaccaaaaatacaaaaaattagccgggcgtggtagcacttttttttttttttttttaagagatggggtcttgctctgtcaccaagtctggagtgcagtggctattcacaggtgtaatcaccaccccaccatgcactacagcctcaaattcctgggctcaagtgaacttcctgcctcagcctcccgagtagcagggactacaggcacttaccacttctcccagagttttcaccatctcagtaaaagacaatttcatggctgggcatagtggctcatgcctgtaatcccagcactttgggaggccgaggtgggtggatcacctgaagtcaggagttcaagaccagcctggccaacatggtgaaaccccatctctactaaaaatacaaaattagccaagtgtggtggtgcatgcctgtaatcccagctacttgggaggctgaggcaggagaatcacttgaacccatgaggcagaggttgcagtgagccacgatcacgccattgcactccagcctgggcaataagagcaaagctctgtctcaaaaaaaaaaaaagaaagaaagaaagacggccgggagcagtggctcacgcctataatcccagcactttgggaggccgaggtgggcagatcacaaggtcaggagatcgaaaccatcctggctaacacagtgaaaccccgtctctattaaaaataaaaaaattagccaggtgtggtggcatatgcctgtaatcccagctaccccgggaggctgaggcaggagaatcgcttgaacctgggaggcagagttgagatcgcaccaccgcactccagcttgaacccaggaggcggaggttgagatcgtgccaccacactccaccctgggtgacagagcgagactctgtaaagggaggaaggaaggaaggaaggagggaaggagggagggagagaaggaaggagggagggagggagggagggaaagaaggagggaaggaaggagggaaggaaggaaagaaggaaggaagcaaggaaggggaaggagggaaaggaaggaaaggaagaaaggaaggaaaagaagaaaggaaagaagccaggaaagaaggaaagaacgaaagaaaaaaagacaatttcttttttttttttttgagacagtcttgctctgttgcccaggctggagtgcaatggcgcgatctcagctcaccgcaacagtgcgatctcagctccacctcctgggttcaggcaattctcgtgcctcagcctcctaagtagctgggactacaggcgtgtgccaccacacaggctaatttttgtatttttagtagagacagggtttcaccatgttagccaggctggtctcaaacccctgacctggtgatccgcctgccttggcctcccaaagtgctgggattacaggtgtgagccaccacacctggccaagaaagacaatctcatcctttcagttgtttggtgaaaaaccgtggagtcagccgggcacggtttctcacactttgtaatcccagcactttgggaggccgaggcaggcagatcatgaggtcaggcgatcgagaccatgctggctaacacggtgaaaccccatctctatgaaaaatacaaaaaattagccgggtgtggtggcgcatgcctgtaattccagctaccccgggaggctgaggcaggagaatcccttgaacccgggaggtggaggttgagatcgcgccaccgcactccaccctgggtgacacagcgagactctgggagggaaggaagggagggagggagggagggaagggaggaaggaaggaaggggaaggaggggaaggagggaaaggaaggaaaggaagaaaggaaggaaagaaagaaagaaaggaagggaagaacgaaagaaagacaagctcttttttttttttttttgagacagtcttgctctgttgcctaggctggagtgcaacagcgcaatctcagctccacctcccaggttcaagcgattctcatgcctcagcctcccgagtagctgggactacaggcgtgtgccaccacattggctaatttttgtatttttagtagagacagggtttcaccatgttggccaggctagtctcaaacccctgaccttgtgatctgcccaccttggcctcccaaagtgctgggattacaggtgtgagccacctcacctggccaagaaagacaatctcattctttcagttgtttggtgaaaaaccttggagtcggccgggcacggtttctcacacctgtaatcccagcactttgggaggccgacgcaggcagatcatgaggtcaggagatcgagaccttgctggctaacacggtgaaaccctgtctctactaaaaatacaaaaaattagccgggcatggtggcacgtgcctgtagttccagctactcaggaagctgagacaggagaattgcttgaactggagaggcagaggttgcagtgagccaaaatcgtgtcgttgtactccaggctgggtggcagagcgagactctgtctcataggaaaaaaaaaaaacaaaaaaccttggagtcatcccttacgcctctctttttttccccacacctcatataccaaaccatcagcaaatcctgttagctctatttcagaatacaggcacatccagcaaaatgtctctagttaacattttcaccatagaatgcctttttgtttttaatatccagcttggttgtcagccttcaagatggtctctagtaatcctcaactcctgctatgcgactttgcatactccctttccacactgagcagggctgacctatgcaaccaataggacactgtgtaaataacaatgtgtggctggggacagtggcttatgcctgtaatcccagcactttgggaggccaggatgggctgatcacttgaggtcaggagtttgagaccagcctggacaacatggtgaaaccccatctctactaaaaatacaaaaattacctaggtgtcatgacgggcgcctgtaatcccaactgcttgggaggctaaggtatgagaatcacttgaacccggggggaggcagaggttgcagtgagctgagatcgcactgctgcactccagcttgggtgccagagcagaccctgtctcaaaaaaaaatgaaaaaacaatgtgtgacttctgaggctaggtcataaaagacattgtggcttctgccttgttctcttggatcattccctctagggaaagccatcagccatgttgtaaggacatgtaagcagctctatggagagaacttcatggcaagggactgagacctcctgtgaacagccagtaccaacttgctagtcatgagtgagtcatctcggaagcagatcatctaggcccagtcaaaccttcagatgacttcaacgtaataagagaccctgagcttgagccatccagctaagccactcccaaattcttgacccacaagaactgtatgagataataaatattgttgttttaagctgctaagttttggcataatttgttacacagcaatagttaactaatataccaaacttatgttgattcagcttatgtttatttatttatctattgagacagggtctcactctgccacccaggccgaagtgcaatagtgtgatcatggttcactgtagcctcaacctcccaggcccaagtgatcctcccacctcagcctcccaagtagctgggaccacaggcatgtgccaccatgcctggctaattttttaattttttgtagagacagggtctccttatgttgcccaagctgctctcaaactccttgactcaagtgatctgcctgcctcagcctctcaaagtactgggattacaggtgtgagccaccacacctggcccagtgtatgtttatacagaaaatatgtatatttacatcattaaaatcttatctatatttttaacaaagtaatgtgcatttaaagcttcaaattatattccaaatagaactgatagaaaattactgagtgccagcctggctgacatagtgagaccctgtctctacaaaataaaaaatcagctgggtggggcagctcatgcctgtagtcccacctacttaagaggctgaggtgggaggatcgcttgagtacaggaggtcaaggctgcagtgagccgtgattgtgccactgtactccagcctgggcaacacagcaagaccctgtctcaatcaatcaatcaatggaaaatatattaagttgaagatttcacacagaatgtccaattttcatgaaacagattactgatgttaagtgggaaatgcctatatccagaatctgaccacttgtcacctccacagctaccactgtggtcaaagccaccagtgtctctctaggagattgttgcagtaatctcctatctagtctcccctcttttgcccttgtccctgcataatctgtgcttcttacagcaaagtgattctcttgatacagaactcaggtcatgcagttcctctgctcacaactctgtaatggtcccaccttactcagtgagaaagccaatttcctcacagtggtgcacaaggccccactcaacataactccttccccattacttctttgacctcatctcttatcctttttccccactaactgtgattcagcccagccatagtggcctcctggctttccttaagcctcctgggcactctttaactttagaactttgccgttgctgaactttccccctgcaccccacttcacctactccattgcctgggctagttatctatgtgactcagtccctcactcccttcaggttgctgctcaagcattaccttatcaatatccctgctccttacccctcttgccctgctttatttctctggattgaaggttaccctgtgacctaccacaaatttcagtatggctttaagccacatgcgggaggagttctattttttttgagacagaatctcactctgtcacccaggctggagtgcagtgatgcaatcacagctaactgtagccctggcctctcaggctcaaatgatccttccacctcagcctcctgagtacctgagactacaggcacgtgccaccacgcctggctaattttttaatttttatttttgtagagatggggtctcagtatgttgtccaggctgttctcaaactcctgaactgaagatcctccctcctagggctcccaaagtgctgggattacaggtgtgagccaccacatccagccaacagacatctttgggagggagattttttttttttttgagatggagtctcattctgtcgcccaggctggagtgcagtggcatgatcttggctcactgcaacctctgcctcctgggttcaagcaattcttgtgcctcagcctcccgagtagctgggattacaggtgtgtaccaccatgcccatccaatttttgtatttttagtagagatggggtttcatcatgttggccaggctggtcccaaactcctgacctcaggtgatccaccggcctcggcctcccaaagtgctgggattacaggcatgagccaccgcgcccagctgaacttgtgtttttatccctcaggcaattaaaaaagaaaaatggaagggaaaactgaaagatctctgaagaatgcccagctctgtcacacctgtgatgtggcctctggaaacccctgcctgtggggaagacttatcactggtactactcaggtgttcaggaacaatggctccgaagttagagggacctggattaacctggcctggtctcagttttctcatttataaaatgggatagtagtattgattccttgggttgtgggaagattaaatgaaataatccatgtaatttgattacatactcagttgctcccattagcacatcctgattattcttacttagcattcagtccatgtgtgactgcacttataataccacatgaatccagtggtctgtgccatgtaaatcgggcctctgagattttgctcagcctacagtggcatatgggcaaatacgcttctgaccttgcaaagccaggtgggccctagcctgaagcgactcaccttcaggctagggctatcatatagacagttgggagtcaggtcaaagagctgtcttatagacagctgggagttcctccaggctaactggttgttcactggctctggagttgcaggaatagacaacgggctctctgctgctcttggaagtatctcctaaattaaactccttaattagccaggtatggtggcaggcgcctataatcccagctactcaggaggctgaggcaggagaatcacttgaacccagggggcagaggttgcagtgagctgatatcgcgccattgcactccagcctgggcaaaagattgaaactctgtctcaaaaaaaaaaacaacaaaaaaaaacaaaaaactccttggtctgccacatgccactgctctgtgacgttgcacttttggttcaaagacccaaacaaggtctacaatagcttacttattctgtcctcagggcccactctccactgatcccttgtgggctttagctgactaagcccagtgtggctgagtggtacccagcacggtacctgcatggggaagggttggcgggggccagatcagctggccagagctagtggatgcttccttcacaatagttctcctgccacctgagatcatacagtatctcagcatctcctaggtcagtctggggtccagccagaggcctgatgaagcaaacagctctctgaatacttactctggaaactcagacagggaggctgagtgaatcacagcaaaatccaccccaacccccattggagccacaactgtgcaactgaagctcctgggaggctagaattgaagaagttaggcaaaggaggtctcttagaaccagccccagatgccccttctcagggaacccttctcagacaacccctctagaagccccaggccttgcttttcctagaagtgccctgctatgcctgtgagcaatgtcaccaaacaagttggctcaatcagcccttgtagtgtgcctctctcactcaggcagccttggagcagagaaggccttcagaagcccctccctactgactccctaccactcctgctccctcttcttgcttggatagcacttcatttcaccttaaccctttggagcggcctgtctggaaaggaggtgccaggatacaggatgtgtggcagacaaggcccaggtgaggctgtgctatggctgcttcagcaggatgcctactccatgctgagatcacagtctggtccttgtcacttctggcggttacttccctccctgacaaagggtgctcactctccctctgcaaacttgtgcccagaaagggtggctcacccagtacaagggacaacccagttgcaccaggcaaactggtgcaaagtccggccaggcgcagtggctcatgcctgtaatcccagcactttgggaagctgaggcaggcagatcacctgaggtcaggagttcaagacgagcctggccaacatggtgaaaccccgtctctactaaaaaaatacaaaaatacaaaaaattagctgggcgtggtggcgcatgcctgtaatcccagctactcgggaggctgaggcaggagaatcgcttgaacctgggaggcggaggttgcagagagctgagatcacaccactgcactccagactgggcaacaagagtgaaactccgtctaaaaacaacaaagcaaagacccaagccccttccaggtgctgccccgctcatcccagttacctctgttgctttttgagaagactctaccggccgaatatgtgtacgtttgttggcggggcgggggtgggggagtggggagagtcctacctggccactgccccctaccggatctcgccctcccagccaaaggatgggttccagatctcgccttttgtattccccagctggggactagccggctgagggaccgcagggagacacagtcttcccattgcaaacgatagcgttgatggctggaggcccccgtcttcaagcccctccctccaaagatgacagctctccagtctctaggtgcctccaggccacgtgggctggcagtcaactcacctgtttctcagaggagtccaggacgcacagaaggtgccggtcactgccctctgccggacccatggaggggtaagggtgtccggccggggccggcctgagggcacagcttcgcggggccccggccccctgcgtacacagacatggccacagcgcaggcaccgctccctcccaccgccctcacccggccgccggtgcaggaagatagctttcgccggcctctcgcggccaaggcccagctccagccgctcagcccgactcggcccgcccccggggtgcattgtgggaaatgtagtccttagcgtttggccgcctgcggcgccgagggactggttctgggctcctagtcccagcagagccgtgggcaggtcctgacccgggtccgcgattgcctcatccggcgccgc

SEQ ID NO: 2596 - DNA, 21144 bp, Homo sapiens; identical to SEQ ID NO: 2595
  source 1..21144: mol_type = genomic DNA

SEQ ID NO: 2597 - DNA, 8708 bp, Homo sapiens
  source 1..8708: mol_type = genomic DNA
gcgaagtgggcctcgctctcccgggttagcagccgtagccagatccgttgaaaggagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacaggtgtttgtatatctctatttcctgaggcccagtagagtctcctcttttcggaaagtgttggaggggggacgtatttgggcatgattttggatgtctcgtcctattgaaatccgtggggaaatgagcagtaggagtgtgtccaagggggcctgactctataaaggcttttcagaagtttctttcaccgcccgtcaccctcgattcccctcccactcagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggtatgactccacttagtggggtcttaaaaggaatccttaggggttgtcattgttggacgggggaagggtcagtgggtgaccagtagggagtcttgggacttaagagaagtggcttaaaccatcgccgggtcaggaggaggtcactgtggacacatggtgtagtttacatcattgaggaagtcattggctgtcaacggatgttcactgggggtttggtgtgagtttaggtcattgaggaatcaaaaagggggctgttaggaccaaagagggtcactgaggatttagagtgtttagatcaaagaatgcgctgaagaaagtcaatagactcaacagaggaggactgttgagaagttagtgtttttgaggagtagggtgttatttattaaataatagaagtgggaaggggaatcagtggagttcgatgggcactcagagtatttacatcattgaagtcacttgtagactgttggggaagtctttaagggaccaaatgttagtggatgtgtaaagttgttcatttgagatttaatggaagtcactgagaagtctgtgccattgatcactttggaattagtggatgtaaatggagtcattgggaaggatcagtggacctcactgagaataaatgtggatggggaggttgaggacttgggaattaatagcaggtaagagcagttattaggagggagtaaagatatttggggacatgggagtgtcagtgaatgtcagtgacagaatatgcaattattgggattttatgggaaaattattgagacatagttgcacatggataataatggttgtcattgggggatgaatggaaatcaatgggaataaatggatgtgtcagtaggggctgttgaagttgtgggttttagtgaatgttaatgatggtcatgggtaggggcaatggaagtcattaaagtcttgtgtgttagtggatattatgatggttactgtagggaggggagtggataccaatgagattgaaggtggtcaggggagtgactgaaggtctctgaagtgctgggtgttagtggaggttaatgatggtcattgttgggggtaggggggagtagacatggagtagaataacttgtggatcagggcagtcatggagggtcattgaaaaaccaggtgttaatgattgttaatgtggggtcattggggtgtttgtgaaccacagtgggagtgaatagtggattaggggagtcctaaatatctgggtgttagtggatattaacgacagtcattgggagaaatagtggacattaccaagaatataaatgggcaaccaggagagttagtaggggtcatcaggtatcagtgggcatcactgatagggtagtagcgggggttggggcattcaaacagttaagatattaatagatgttaatggtggccattgggtgagcagatatcaggagaaaaaatagcggtcagaggagttaatgggggatcattgaagatgaataatcgtcatccagagtcaatggggtgctttgaagactttggaataacagtgattgaaagggaagtaattggtctgtaggaacatagcaagtccagtggaataacaatgagaatatgttggtttattagggttttaggaagttcattggaacctaaatgttagtggagatcattgcggggtcctagggcagtcatcgggtcattgaggggcataggagacacttggagttctgcgtcagcatgcaggggtcatggaggggctagtagatatttggtgggtccttggggatgtgggattagttaggagttcacatgcagatgacccaccaggggctccctttcaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatctactcgcggtatggtagtgtggaggcgctgtcggctaccatgggtgtaatgaccgccctggtgtcctttgtgcagagtgcgggagatgccatccgtgccatctacgctggtgagcaaacaggtgggaggcagaatgggggacagtgactgggaatatggctggcacgggtaggtctgtctgcctcaggcactatccagccagccagggttgggtccatgtgtgtggatggtcagccagagctctgtcagtggcgggaggtgggggggttcatctctgtctggcctgctggtttcttagtgattgacttgctgggatctcagtgactagctggatacttctgtgtcacctgagaggataactgtgggggctgtgtggttgagctgtgtctttctggctctgtgtcagcccttgtaccatctctacccgcctgcccgtggtctttgctgtgtatctaacctacttgttcctttgtccatcccatcatgtctctgcaaatgtccagattcctccagcttgtccttaccccagtccaggtgcccacagagtgagcatgtggactcgggcctggtgtgtgtatggtaggagagggcagaagagccccactgtctccctctggtcattcctgatccagctgtacccccccttcttaccccttccttccctagaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcgaaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggttgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccaggtaggccctgaccctaaggcaactggctgggtgggaaggcctgtcaaaccaggaagttcagcatctcagggatgtgactcaggagagataaccagccatgcttaagaaagagggaagagaacaagtctctgtctgatgatggagcatcagccacagacctaaaggaatccccctcttctggtggacagcagggccctagtactcagggaatctcctagtttgatgagggaaggtcagcctccaacccctgagaatcctcaagtctcatgggagaggctcagctccctaacttcattgaaatctctagactgagggaggaaatgggccagccaagaaggccctggactaaccttgtcctccacctccctccatcatggcagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtaagttgggcagggctctgagtgaattaattccccacttcaagcctcctttccctatattgtatcccctccagccacagtgcctccaccaaacacagcaggcctctggctgggctgtgccttgcctgcaacactgtccctgcctttacacacacatctttgaagcccctgacaactaatgaccgtgtctctaatccgacattagcctcaccctcctgtgtgcttctcccagattagcaaccaggacagtgtctttgactttccagaggccccattaactaccactgctgtgcctgccgattccccagtagcccaatccatgtgtttggaggcaccccattcatcaccagctcattgtgactccatgagtccccagcactcctcagactacaggcgtggtcccttgctgtgccctccacctggggtatccttccctttggtctcctctgggctccagccctcacttcctatgggtttgctaaaggtcagctactaagggaggccagtgaaggaggcctcatcagaaatggcacctgccatgtaatgcatatttattaatttattgcgtgactgctgtggatcaggtattgtcctaggctaagaattttgtttttaaatttttttaactttcattttcaaataactttagacttagaagctgcaaaaacaatataaagagtttttatatttatatttataaagagttataaagggcgtggtgaaaaccacgcctggtcagatggtggttttcctaactccatcattctttctacatttattggctgggattttactataaagagtaacatggggccggacgtgatggctcacgcctgtaatcccagcactttgggaggctgaggcaggctgatcacttgaggtcaggagttcgagaccagcctggcaaacatggcaaaaccccgtctctactaaaaatacaaaaattagctgggcgtggtggtgcgcacctgtagtcccagctattcataaggctgaggcaggagaatcgcttgaacctgggaggtggaggttgccgtgagccaagatcgcgccactgcactccagcctgggcgacagagtaagactccatttcaaaaacaaaaaggaataacttttccttctcctatttattgaatttttaattttctatcaatattgtctcatggatttttctttaattcagtgagctaaaatccttctctagcatttattttggtgttcagattgcctctgatttagccggtgggtaccctgatttagccaggctgatccctgtgtctctgacacgtccccttcactatgtgagcacatcttacttgactttctctattccagtcctcaactcagccatttttccatggagcccttataccttttagtagagattggaattttaaaaccaagatatgggccagacacggtgcctcacgcctataatcccagcactttgggaggctgagtcggggtgggagttggggggagtgggcggcgagtcacaaggtcaggagttcgagaccagcctggccaacagggtggaaccccatctctactaaaaatacaaaaaattagctggatgtggtggcatgcgcttgtatcccagctactcgggaggctgaggcaggagaatcgcttgaacctggcaggcggaggttgcagtgagccgagaccgtgccactgcactccagcctgggtaacagagtaagactctacgtcaaaaacaaaaaaacaaaaacaaacaaaatatatgttaggagcagaattttaaaccaagtgatcagggtggcctccctgagcagatggcatctgagtggagtagggaggtattgagctacgtggatattaggaggaagagtacacctggcagagggaaaggactgatatgctatgaggtggaaccaagcctggctatgtttgaggaatagcaaggaaagggtagagtggccggagcagagggagtgaaggggagcgctctgggaggtggcacaggaaaggcgctagtgaccttgtggggtcaggcctctccatgtggtatgaggcataaattgagttcctctttatattattccctggctgtagatgatgaaaacatagttgtaggagcttagagcaggaccttgtacacaataggttactgacagaatattaaacattgttactgttttccccagttcccaatgagcaaacaggtctagagagtacccacacacacaaccagcatcatccagttgaagtcactaggtccagctgaaattgcacaatatcagcttacctaccttagcccagtatctaggcagcacctggtaggaggtgctgccaggtacatgttccaggttgcaggaggcagacatgcagctgcactggggtaggcaggattgtccatagccagctctggcccatctgactctgtctcctccgaaacccccaggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggccaaggtgtctagggtggcccacgggggtgctggaattggcacttcagggccaggctatgcttgggactggcctgagggtattttaaagaaaaaaactacataaaaggcctaaaagtaagacccacaaggatattcctttgcccttcttgtacttttttcatctttaccctgccagaaatgacccgccctcaatgctggctgctgctaacattaatgagaaggtggccttcagtgtccacctgtggaacccaggacacagcacctgactgcacacagtggctgaaatccagcatttttacataggagatgcacttagcctctaagcctcgttttactcatctgtgaaacagagataagtaaccctctctcatgaactctttgatgaggatttgtaaacgaaaacagactcgaactattgtgtaccaccacatagcacatgcacgtctgtcccagactttgacaacctgcacaagacaagcagcctaaagcaggagagacctccctagggttttgtgtgtgtgcacactaccctcactccccaactggccattaccctagttctgcccttgtttgtggagttacagcctcaaggttgtagcatgtgtgctggcaatcagggccgcagtgtgttctgcgcctgcccagagctgactcctgatttaaccgctggcgtaaccgcgggttgcacgcatgcgtgctgaaaagcctttcaccctcacgtggtttcttttttaaccagtcatcaagcgaggctcgcgcgcaggccccgcgttggaaaatggcggggaagctgaaacctctgaatgtggaggcgccagaagctactgaggaggctgaaggtagtgagggcaagtgggctgcactcctttctctccaaccagggcagaaaggagggaggattcgtcccattacaataatgaaataatgatattctaatttttttaaataaaatgttaagccttttgttattgaa

SEQ ID NO: 2598 - DNA, 80162 bp, Homo sapiens
  source 1..80162: mol_type = genomic DNA
aagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggtgagggccgggacggcgcgtgctggggagggacccggggccttgtggcgcggctcctttcccgcctcagagagtgggcggtgagcagcctctccagtgcggaggcacgggggcggaacgttggtgcttgtgcggattccgccgtccccaggttctgcttggctccggagggacgcccccctcagccctgaaacccgtgcctctccagccgccccggatctgaacttgtgatcacggagtgtttacgtcgtgccaggcattttaatgcattgttctagttcattttccagcagtcgcattcctcgccttggccctacatgtagcgctcattacaaacacggccagaatctcttattaacaaacagcagccaggagtgagatttaaaatagactgggggtttaggagacccttttatgacacgtaattctgctcccacgacgctcccatttataccgccggtccagctaagggtctggtaatggagcgccgttgaagagcagtatgatgaagtggtcaggaccaacggactctggagctgggctgcttgggatcaagtcgctgcccctctgcttattaacgtgtgaccttgggccagtcatggacgctatctgcttcagctcagcattcagtgctctccgtcacccgaccccatctatccaggattatctctccctggaaagctacaaacgtctcaccctatgtgggccaaatgttctggataggcctagttaacctcttctctccctgttttctttgcgctttcttgcagctatgtagttatgctaatgaaaagagcatcctagggggagcagagttgtggattctagtcctgactagaggactagtgcaaatgcgatactcctgatgaaaaatgtttcattcgttagatataaatgtgttaggcagggttatggacactagatgaaaaaagaaatacctctactttcatagagatcactattggacagcaaggcagaaataattacaattcaagttggaggcttatggaggtgagcttgtaagaggttacaagaggcgccaaggcaggatcgccaaagacggaagactttggaagagtctcatacaacggaagaggcgttatatgagacaccaaagtccacgttgagtcttggtggactagaagtttgctagggagagggcttgaaacgaggtagattggcgttgctggtgtagaaaaggaaggagactggcccaggtgggtggggttagatgaccaaaggcttttagtgtggtgttgagctgttgaaattttatgctgtagccaatgaaaagtctgaaatgttttttttttttttttttctgagacggagtcttactgtgtcgcccaggttggagttcagtggtgtaatcctggctcactgcaacctccacctcctgggttcaagcgattctcctgcctcagccaccggagtagctgggattacaggcacgtgccaccacgcctagctaatttttgtatttttagtagagatggggtttcaccatgttggccaggctggtctcaaactcctgacctcaagtgatccacccaccttggcctcccgatgtgctgggattacaggtattagccactgcacctgacctacatagattttacataagactttaaaacagggcgggcgcagtgactcacgcttgtaatcccagcactttgggaggctgaggtgggcggatcacaaggtcaggagatcaagaccatcctggctaacatggtgaaaccctgtctacactaaaaatacaaaaatcccagcactttgggaggctgaggtgggcggatcacgaggtcaggagatccagaccatcctggttaacactgtgaaaccctgtctctactaaaaatacaaaaaattagctgggtgcggtggcaggtgtctgtagtcccagctacttgggaggctgaggcaggagaatggtgtgaacccggaaggcagagcttgcagtgagccgagattgtgccactgcactccagcctgggcaacagagcgagactccatctcaaaaaaaaaaaaaaaaaaaaaaaagactttaaaaaaaattataagaaaggacagaccaagtgcagtggttcgttccagcacttagggatgccaaggtgggaggattgcttgatgctaggagttgaagactagcctgtgtaacatagcgagacccatctctacaaaaaaattaaaaagttacctttagaacttacgatttttatgtgtagactccatataagcagagggtctatgcttattcactatttattaccttccatagtccctgcacatataataggtgcttcataaacaatttaatgaatgaataaattactgagaaaacactggaagtttttgggttagcattgtgttaggtgcttgatatggtctggctgtgttcccacccttatctcatcttgaattcccatgttttgtgggaggtacctggtgggacataattgaatcatgtgggcaggtttttcctgtgctgttctcctggtagtgaataagcctcacaagatctgatggttttaaaaatgggagtttccctgcacaggctctctctctttgcctgccgccatccatgtaagatgtaacttgctcctccttgccttcctcaatgattgtgaggcctcctcagccatgtggaactggctgcagagtcattaaacttcgttcttttgtaaattgcccagtctcaggtatgtctttttttatttttttttgagacagagtctggctctgtggctaggctggagtgcagtggtgcgatctcgactcactgcagcctccgcctcccgggttcaagcgattctcctgcctcagcctcccaagtagctgggactataggtgcacgccaccatgcccagctaatttttgtatttttaatagagacggagtttcactgtgttggccaggatggtcttgatctcttgacctcgtgatcttcccgcctccgccttccaaagagctgggattacctacccagctgggtatgtctttattagcagcgtgaaaacagactaaaacagtaaactgataccaatagagtgggatgcagctgaaaagatacccgaaaatatggaagcaactttggagctgggtaacaggcagaggtcagagcagtttagagggctcagaagaagaccagaaaatgtgggaaagtttggaacttcctagagacttgttcaatggctttgaccaaaatcctgataatgatatggacaatgaaatccaggctcatgtggtctcagatggagatgaggaacttgttgggaactggagcaaaggtgacacttgttatgttttagtaaagagactggtggcattttgccctgccctagagatttgtggagctttgaacttgagagaaatgattttgggtatctggtgggagaaatttctaagcagcaaagcattcaagaggtgacttgggtgctgttaaaggcattcagttttaaaagggaaacagcatgaaagtttggaaaatttgcagcctgacaatgtgatagaaaagaaaatcccgttttctgaggagaaattcaagctagctacagaaatttgcataagtaatgaggatcccaatgttaatccccaagacaatgggaaaaatgtttccagggcatgtcagaggccttcatggcagcccctctcatcacaagcctagaggcctaggagaaaaaagtgatttcatgggccagcccggggtccccatgctgtgtgcagcctagtgacttggtgccctgcatcccagctgccccagctgtggctgaaaggggccaacctagagctcaggccatggcttcagagggtgcaagcctgaaaccttgacagcttccaggtggtgttgagcctgcaggtgcacagaaatcaataattgaggtttgagaatctctgcctaggtttcaaagatgtatggaaacgcctgcatgtccaggcagaagtttgctgcaggggtggggtgctcattgagttcctctgctagggcaatgtagaagggaaatgtagggtcagagcccccccacagagtccctactggggcaccacctagtggagctgtgaaaagagggctaccattctccagacctcagaatggtagatccacagacagcttgcaccatgtgcctggaaaagctgtagacacttaacgccatctcatgaaagcaaccaggcagtgtgctgtaccctgcaaagccacaggggcagagctgtccaaggctgtggttgcccagctcttgcatccgcatgacctggacatgagacatagagtcaaaggagatcattttggagctttaagatttgactgccatgctggattttggacttgcatggggcctgtagcccctttgttttggccaatttctcccatttggaatggctgtatttacccaattcctataccccattgtatctgggaagtaactaacttgcttttgatttgacaggctcatatgcggaaaggacttaccttgtcttgaatgagactttggactggaattttgaattaatgctgaaatgagttaaggctttgggggactgttgggaatgcatgattggttttgaaatgtgaggacatgagatttgggaggggtcatggcagaatgatatggtttggctatgtccccacctaaatcccatcttgaattcccatgtattgtgggagggacctggtgggagatagttgaatcatggggatggatctttcccatgctgttgtgatagtgaataagcctcatgagatctgatggttttaaaaacggaagtctacctgcacaagctctttctttgcctgctgccatccatgtaagacatgacttgttcctccttgccttctgccatgattgtgagacctccccagccatgtggaactataagtccagtaagcctctttttcttcccagtctcgggtatgtctttatcagcagcatgaagtccagctaatacagtgcttgaacatgtaatatctcaaatctgtaatgtactttttttttttttaaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggtaattatcttcctttttaatttacttatttttttaagagtagaaaaataaaaatgtgaagaatttaattgtgttttagtattttaagtagattgtgatagtagaatggtttgagacactttaatagcaattagcatgtggtttttaaaaagttgcagtttggctggtcgcagtggctcatgcttgtaatcccagtattttgggaggctgaggcaggtaggttgcctgagcccaggagttcaagaccagcctgcccaacgtggtaaagccccatctctactgaagataaaaaaatttaaaaaaattagctggggctattggcacacacctgtggtcccagctaatcaagaggatgaggttagaggatcacttgagcccaggaggttgaggttacagtttaactttcagaggccaaggcaggaggattgcttgagtccaggagtttgagaccaccctggggaatgtagggagatcccatctctatagagggatagattagatagataatttctgaggggaggggagggggagggccagggaaggggagggaaaggggaggggagggcagggccagcagtaaggtcataatagagacatgtatctgtaagatccttataataggtgaggatggccacaaattagcgccacagatttgtatttttagtagagacaaggttttaccatgttggccaggctggtcttgaactcctgacctcaagtgatccgcctgccttggcctcccaaagtgctgagattacagatgtgagccaccatgcccaaccacaagcatttatttatttatttatttatttatttatttatttatttagagacagtcttgctctgtcgccaggctggagtgcagtggcgccatctgggctcactgcaaactctgactccctggttcaagcttttctcccgcctcagcctcccgagtagctgggattacaggtgcatgctgcaacacccggctaatttttgtatttttagtagagatggggtttcaccatgttggccaggacggtctcgatctcctgacctcgtgatccgcctgccttggcctcccaaagtgttgggattacaggcgtgagccacagcactcagccagttatttttttataagaaaacattttactggccaggcctggtggctcacacctgtaatcccagcactttgggaggccgaggcaggcggatcacgaggtcaggagttcgagaccagcctggccaacatggtgaaaccccatctctactaaaaatacaaaaattagccaggcgtggtggtgtgcgcctgtattcccagctactggggaggctgaagcaggagaatcgattgaacccttgaggcagaggttgcagtgagttgagatcgcaccattgcactctagcctgggtgacagagcaagacttcatctcaaaaaaaagagaaaacattttattaataaggttcatagagtttggatttttcctttttgcttataaaattttaaagtatgttcaagagtttgttaaatttttaaaattttatttttacttaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacaggtaagcaaattgagtctagtgatagaggagattccaggcctaggaaaggctctttaattgacatgatactgtttcatttaaggaaaaataataaaaaaactcttttttttgtatctaattaaaataatgttctgatgtttacagaaactttgtatatttaattggacattagaacaagctgtttgttgtgtaagatttattttacctcagatcttttctcccccctttcctttctgtcttgtgttccaaaagagtaattattacggtaaatattactgtaattatggatttatcaaataagatgcagttctttagcattttttgataaatcgagtggaactttagcctgttattttactatttgttttattttaactaaattctgattgtgtcattttttttttttttttttgggaccgagtctcgctctgtcgcccaggctggagtgcagtggtgcgatctcggctcactgcaacctctgcctcccaggttcaagcaattcttctgcctcagcctcctgagtagctgggattacaggtgtgtaccaccacacccagctaatttttgtatttttagtagaggtgaggtttcaccatcttggccaggctggtcttgaactcctcacctcgtgatccacccacctgggcctcccaaagtgctgggattacagccatgagccaccatgctcggctttgattgtgtcatttgtataggcatgtggtttattatttagttatttttttttttttctttgaggtggagtatcactcttggtgcccaggctggagtgtaatggcgtgatctcagctcactgcaacctctacctcctgggttcaagcaattctcctgccccagcaggagtagcttgggattacaggcatgccccaccacacctggccaattttgtgtttttagtagagacagggttccaccatgttggtcaggctggtcttgaactcctgacctcaggtgatctgcccacctcagcctcccagagtgctgggattataggcatgagccacggtgcccagcatatttagatttttttttttttgagactgagtctgactctgtcacccaggctagagtgcagtggcacgatccacgatcttggctcactgcagcctccaccttatgggttcaagcgattcttctgcctcagcctcccaagtagctgggactgcaggcacatgccaacacgcccggcttatttttgtatttttatagagacggggtttcatcatattggtcaggctggtctctaactcctgaccttgtgatccacccgccttggcctcccatagttctgggattacaggcatgagccacagcgccaggcctagatgtttcttaaggtatgtatctcccaaagattctttttgtggtcctcaagtaccataagcaccgctggagataacacatgtgatgggcatttttagcatagattgtatctaagcaactttccacaagtaatagttctgttaagggttgttattgtggccgggcgcggtggctcacacctgtaatcctggcactttgggaagctgaggcggccggatcacctgaggtcagggattcgagaccagcctgtccaatgtgctgaaaccctgtctctactaaaaatgcaaagaaaaaaaaaatctagccaagcatggtggcttgctcctgtaatcctagctacttgggaggctgaggcaggagaattgcttgaacctgggaggcagaggtagcagtgagccaagatcgtgtcaccgcattccatcctgggcgacagtgagactctgtctcaaaacaaaaaaagagttgttaccgttgggactattttttgaaagctttatgtgaacgtaattttatattttgatgaaaatttagtttattgatgtaaaaagtgtatcagtacatcatatcagtgtcttgcacattgtataaacatttaatgtaggtgaatctgttatcactatagttatcaatgttataattttcatttttgcttttcttattccttttctcatagtagtttaaactatttctttcaaaatagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggtacatggattataaatgtgaattacaatatatataatgtaaatatgtaatatataataaataatatgtaaactatagtgactttttagaaggatatttctgtcatatttatctcaaaacctaaactgtgtatcaatgatattaagcttttttttttttttgagacagagtttcacttttgttgcccaggctggagtacaatggcgcgatcttggctcaccacatcctctgcctcccaggttcaagtgatcctcctgccttggcctcctgagtagctgggattacaggcatgtgccaccacgcctggctcatcttttttgtatttttagtagagatggggtttctctatgttggtcaggctggtctcaaactcctgaacctcaggtgatccgcccgcctcgggcttccaaagcgctgagattgcaggcatgagccactgtgtctggcctatttttatagtttatgtacttggaattatataatatattctgcctagcttctttcattcaatatttgtaagatttatccatattattgagtgtagttgtggatttttgcatttatatttcatagcacgagcatgtcagaatttatccattttacttcccttctgcccgccactgctactctccccattttacctttttttttgtttttttgagatggagtctcagaatttcgctctgtcgcccaggctggagtgctgtggcacggtctcagctcactgcaacttctgcctctgggttcagctgcacgccaccatgcctggctaatttttgtattttcagtagaggggattttgctatgttggccaggctggtcttgaactcctgacctcaggtgatccacccaccttggcctgccagagtgctgtgattacaggcgtgaaccaccgtgcccgacccccattctaattttgatggacatttgggtaattttcatttttggctgttataaatactgctgcaattacagttaattttcacagtttttttttttttttttttttttttttttttttgaggtgagtttcgctcttgttgctcaggctggagtgcagtggtgcgatctcagcccactgcaaccttcaccttctggattcaagcaattctcctttctcatctcctaagtagctggggtttacaggcatgtgccaccatgcccagctaatttttgtattttaatttcacagttctggaggctgggaagttcagaattaaggcactggctgatctgttgtctggtgagggcccacttgttcatagataaccattttctcactctaacctcacaaggttgaaagggcctaatttttgtgtttttagtagagacggggtttcactatgttggctaggctggtctcaaactcctagcctcgagtcatccacccgcctcgtcctcccggagtgcttggattacagcatgagccactgcgcccggcccccattttagttttgatggacatttgggtaattttcttttttggctattctaaataatgctgcaattactgttaattttcaccttgtaaaaaccattttcaaatctcaagagattaacctttagttttcttggtttggattgggaaggaacaccaaggaaaatgagggacttcagaatttattttcattttgcatttgttttttaaaatctttagaactggatccagtggtatagaaatcttcgatttttaaattcttaattttaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcaggtaaaaaaaaaaaaaaaaaaaaaaaaaaagggttaaaaatgttgaatggttaaaaaatgttttcattgacatatactgaagaagcttataaaggagctaaaatattttgaaatattattatacttggattagataactagctttaaatggctgtatttttctctcccctcctccactccactttttaacttttttttttttaagtcagagtctcacttgttccctaggccagagtgcagtggcacaatctcagcccactctaacctccacctcccaagtagttgggattacagttgcctgccaccatgcctggttaatttttatatttttagtagggttgcggggacagggtttcaccatgttggccaggttggtctcaaacttctgaccttaggtgatcctcccacctcggcttcccaaagtgctgggattacaggcttgagccatcgtgcccagcctactttttacttttttagagactgggcttggtggagtgaagtggcaagatcatagctcactgcagtattgaactcctgggctcaagcgatcttcctgcttcaacctcatgagtagctgggtctacaggcacaagccaccatgcttgcctaattttaaaatttttgcagagttggagtttcacagtgttgcccaggatgttcgctcactcctgacttcaagtgattcttctgccttagcctctagagtggtagctgggattacaggcatgaaccaccatgctctgctattttttttcaaggtttttttttttttttttttttttgagagactggtatgactatgtatgctccctaggctggagtgcagtggctattcacaggaagtgccatcagagtgtactacagcttcaaactcctgggctcaagcacttctatcatagtctccaaagtagctgggactacgagtgtgtctcattgtgccttgctctcgaattgctttttttttttttttctggtttcaagctatctatgtggtattagtcctcactttatgaataattttgtatactactaatagcaattttttttttttttttttttttgagacggagtctcattcttgtcgcccaggctggagtgcagtggtgtgatcttagctcactgcaacctctgcctctccggtttgggcaattagctgggattagaggcgcctgccaccatgcccagctaatttttgtatttttagtagacatggggtttcatcttgttggctaggctggactctaactccaggtgatctgcctgcctcggcctcccaaattgatgggattacaggtgtaaaccactgggcctggcctagcaatttaaaatgacattctaagaagttttatgtctaaatctgcagtaagtggctgggtgacgtggctcatgcctgtaatcccaacgctttgggagtccagggtgggaggatgacttgaggccaggagttgagaccagcctgggcaacatagtgagactctgtctctacaaaagaaaaaattagcggggcttagtggcgtgcgcctgtagtctcagctactcgaaaggctgaagtgggaggattctttgagccccaagggttctggcttgccgtgagccaggatggcaccactgcactccagtctgggcaatagagtcagaccctgtctcaacaaataaaataaaactgtagtaattataaagtggttttggctgggggagaaatgtacagttgaacatacggattaagaggttgaaagttggtcttaggaagaggaactttttgtggaaatttcttaatatttgaagaatattatgttattgttcctctgtttttcatggcgtagtaaggttttcactaatgagcttgccattctttctattttattttttgtttactagggttctgttgaagataccactggctctcagtctctggctgccttgctgaataagtgtaaaacccctcaaggacaaagacttgttaaccagtggattaagcagcctctcatggataagaacagaatagaggagaggtatgttattagtttatactttcgttagttttatgtaacctgcagttacccacatgattataccacttattgtaatatgcagttttggaagtatatgttaccatttaactgtacagagtacatagtaatagagtggtaattatttagattgattaaagaactcatttttttaaataagttttttttttttcactataaaagtttattttatttgagatggtatggtatcgaacatgttcatattgtgtgtaatcgtgggtaaattactcaacctttatgtcatagtttcttcacctttaaaatgacattaataaaagagctacttaataggattataagcatgagatgatttaatatacataaaatacttacagtctgatatataggaagcacttaactctttatcctagaaaagatttaaggtgaccttaacatatatgtcagaaaatctttaaaattgtggaaataaaaggttgtataattctgctatcctaaaattactagtatttcaatatattttattttagtcttttcttttagatacaagttttaaaacttttaagtgaagtgtaatatacgtaagtactgcttgatgaatttaaggtgatttctaaagccaggtttgttggggaagaggagtgggatttagtgatttagaaccagaaattggggctgggtgcgatgtctcatgcctataattccagaacttcgggaggccatagtgggagaattgtttgtgccccggagttcaagaccagcctgggcaactcagtgagacgccatctctacaaaagaaaaaaaaaaaaaattagctcagtgtggtgacatgtacctgtagcccgagctactcgggaggctgaggtgggaatatcaccctggcccagaagtttgaggctgcagtgggctatgattgtgccactgaactccagcctgggcaatggagtgaaaccctgtctcaaaaaacaaacaaaaaaagaaactgaggctgggcacggtggctcacacatataatccagcacttggggaggttgaggcaggataattgcttgagcccaggagtttgagaccagtctgggcaacaaaatgacaccccatttctaccaaaaaaaaaattgtttaaaattagctgggcatggtggcatgtgcctgtggtcccagctacatgggaggctaaggctggaggattgtttagcccaggaggttgaggctgcagtgagccatattcatgtccctgcactccagcctgggtgacatagtgagacgctgtctcaaacaaaaatcaacaggccagatgcagtggctcacccctgtaatcccaacactttgggaggccgaggtgggtggattacttgaggtcaagagttcgagaccagcccggccaacatggcgaaaccccatctctactaaaaatacaaaattagatgggcatggtggtgtgtgcctgtaataccagctactcttgaggctgaggcatgagaatcgcttgagttgggaggcaaaggttgcagtgagccaagattgtgccactgcactctaccctgggtgagaaacgagattttgtatcaaacaaacaaacaaacaaaaaaagacgcccaaaatcaacaacaacaaaaacgatattggaatgattggatccccaaagataaatgtttgaggtgatggatatctcagttaccctgagttaagtattatacattgtatacgtgtattaaaatattacaaacccccaaatgtgtacaattatgaggtatcaataaaagagattggaaggactgggtaatttgcaagtaattaaggcaatttacaatttttaatttttatttgtgaataagtagttatacgtgtcaaaattcaaaaaggacaggtggatatacagtgataagtcatccccccttctctgtcagctccataaagagcccctgtcttgcatggctccagggtcacatttcctattgtattttgccaccacctgccctgggagcaacagtgttagtttcttgaacatccttccaagcagagtctgggcctacacaagcaaaacaagtatgtctattctctctcctctttaatttttttaaaggaagtgattgataatttaacactcaagctataggtcattggttatatttttaatttccaatttatgggaatagaggaagtgtcagtgatccccttctggtttaagaactggaggatgcatgtgtttagaccctttagaaacctgaaatgtcacctaatataattatcagagtaacactttttagtaagcaagctatctatcaaaagtaggtttttgaagaagagggtaaggaaaggttactttcatgggacatagcaataatttctaaaatctaatggttttacaagacttgttcattagaagtaacatctgtgaggatggctttatgagtcaaaatattatctgcttaataccccacctgtagggtaagaagaaatgtttttttcttggtgacaatttttagcagcaagcggggagggcctgtggcttccaaggccaaacgttgaaataccacagactaggaagaaaaagatccactccttatacaggatttgtttgtttcttcttttttcttcatttttgtagagatgaggtctcactatgttgcccaggctggtctctcttttttttttgagcccgagtttcactcttgacgcccaggctggagtgcagtggtgtgattttggctcaccgcaacctctgcctcccgggttcaagcgattctcctgcctcagccttcctgagtagctgggattacaggcatgcgccaccacgtccggctaattttgtatttttagtagagatgggtttctccatgtgggtcaggctgctctcgaactcccggcctcggatgatccacttgcctcggcctcccacagtgctgggattacaggcgtgagccactgagcccagccatgctggtctcaagcaatccacacccacctcagcttccaaaagtgctggcattacaggtgtgagcccccgtgcccagcctgtttcttataattattcctctttctcaactctgtctgctgtggtacctcatgcttcctagtttaagccttcttgggagttctcaggagaaatctgttatctcccttactaagcatttgggattgatgttccttccaggttactataaaaccaagttttttttggttcttttttttttttcttttaaaagaaatgagattttgtcatggttagcctggtttcaaactcccaagctcaagtaatccaccttcctttgcctcccaaagtgctaggattacaggcatgaaccactacacccgatctgtactgttcctctttccattcactaaaacctacttgcaactatgagcatatgttattgccatctagaaatgagtttctagggacttgttcctttttgtactttatttaaacagtcgaattagaaattattattatcattatttattttttgagatggagtcttgctctgttgcccaggttggagtgcagtggcgtgatctcggctcactgcaacctccacctcctgggtttaagcgattctcctgtctcagcctcccgagtagctgggactacaggcatgtaccaccacacctggctaatttttatattcttaatagaaacagggtttcactattttggccaggctggtctcgaactcctgacctcagatgatccactcaccttggcctcccaaagtactggaattataggcgtaagccaccgtgcccggccaaaattatttataataagcaaggcatggtggcttgtgcctgaagtcccagctacttgggaagctgaggcaggaggatcacaggttcaggtccaccctgggaaaatagtgagaaccttccctatccccagtcttcaaaaaagaaaaaaatttgctggagaaggtcacacaatgctgataggtcccattgtgctttcatgctttctagttttcaatgataactggttgttacttttattgtctgactcattatagtgaccaactcccgattttttactttgccttaagccttcagctatctcctacctctaagcggatgatttcttccttaacacttaaaacctcaaaatttatctgtacttccactcttttactctctggctctttctcagaagaagaaataacacttttatttcttttcaaagccaacctttccatactttacttggagacatatttctttttttttgttttgtttttgtgagtggagtctcactctgtcgcctggtctggagtgcaatggcgcaatctccactcagtgcaacctctgcctcccaggttcaagcgattctcctgcctcagcctgctgagtacctgggcttacaggttagcacaccacacccggccaagttttgggtttttagtagagacagggttttgccgtgttggccaggctggtctctaactcctgacctcccgatccgcccgcctcaggtgcaagccaccgcgcccagccctagtgtagcaatcttaatcagaaatatgtctctggctgggcgaggtggctcatgcctataatcccagcactttgggaggccaaggcaggcagatcacctgaggtcaggagttcaagaccagcctgaccaacatggagaaaccctgtctctattaaaaatacaaaattagctgggtgtggtggcatatgcctgtaatcccagctactcaggaggctgaggcaggagaatcgcttgaacctgggaggcggaggttgcggtgagccaagatctcaccattgcactccagcctaggcaacgagcaaaactccatctcaaaaaaaaaaaaaaaaaaaaaaagattgctatgttaatcttatttatttatttatttattttgagacagagtctcacactattgccagggctggagtgcaatggcataatcttagctcactgcaacctccgcctcccgggttcaggtgattctcctgcctcagcctcctgagtagctgggattacaggcgcccgccaccacgcctggcttattttttgtgttttttagtagagacggggtttcactacgttggccaggctggtcttgaactcctgaccttgtgatttgcccacctcagcctcccaaagtgctgggattacaggcgtgagccaccgtgcctggcttatgttaatcttattttatataaaaagaaataatattaaactagaaggcaataaaaatgccaaattcaatacacaaattattttgtcagcatttccacaagaataaactattttatatgctaacatatgttcaatgttccttacagaattctgacattaaaaatgaaaaattaccaaagcttcagatgaatctataaatggacaaaagaaaaagcttaaaaggataaagagcaacactccaagtgcatgtataaacataaggactcttgggacttaacctttttaaaaatctttaggcctagcacagtatttgctatttaatgtatcaaatgggtggttttgacttcattaatccatatataggacagatgaaaaaaagaattatagacttgtaattacagttctttaggaaccatatttgctctcagccttttaaatacgctgtcaggcaattccagtcagcacttttgaaaaaaacctacctacctacctacctacctatctatctatctatctatctagagactgagttataagactagctagtttttgtattttttgcagagacaggatttcatcatgttttctaggctgttcttgaactcccaggctcaagccatccacccgcctcagcctcccaaagcgctgggattacaggcgtgagtcaccatgcccaaccaattccagtcagctcttaaaatgaaagcctagaaatggtagggttaaagaggggacagaatgttgattttaaaatacctagaatttggccaggtgcagtggctgtaacccagcactttgggaggccaaggtggccggattgccttggcctgcctcagcctcccaaagtgctgggattacaggtgtgagctcaggagttcgagaccagcctgggcaacacggtgaaaccccttctctagtaaaatacaaaaaattagctgcatgtggcggcgtgcacctgtggtcccagttacttgggaggctgaggcaggagaattgcttgaacctgggaggcagaggttgcagtgagctgagattgcgccactgcactccagcctgggcaacagagtgagactctgtctccaaaaaaaaaaaaccccaagaatttgattaattctgttggaattttaagagttaactgatccccaaaatgactcagctgtatgcaatttaatgcaatattaattcgcatgttgactctcagaattgcatacagctgagtcattttattgagtaggattgataagtatactatgttatgccaacagtaactgtgatgcttctaaaattgtgatttttaaattggcattgtcacagaaacagcagagtagttgtttttttctttaagcttcttttagccagaaacataaactgaaactgtaattattactgcaatcgtatgttgaatagacttgtgaaactagcaatttattaggcttttaatgatatctggaccaaaggctgagggagctgtgctgtgtgtatgttgctttgtgctttgttttttagaagcttgtcgtttctttgccattttacttctttctttttttttgagacggagtcttgctctgtcccccaggctggagtgcagtggcgcagtttccgctcactgcaagctccgcctcctgggttcactccattctcctgcttcagcctcccaagtagctgggactacaggcgcccaccaccacgcccggctaattttctgtattttttagtagagatggggtttcaccatgttacccaggatggtcttgatcttctgaccttgtgatccgcccgcctcggcctcccaaagtgctgggattacaggcttgagccaccacgcctggcccattacccattacttgtttcttaatgttacattctctttccctctttttttttttttgttttttgagatggagtttcgctcttgttgcccaggctggagtgcaacggtgccattttggcccactgcaacctctgcctcccaggttcaaatgattctccagcctcagcctcccaagtagctaggattacaggcacctgccaccacgcccagctaatttttgtatttttagtagagatggggctttgccatgttggccaggctggtcttgaactgctgacctcaggtgatctgtctgcctcagcctcccaaagtgctgggattacaggtgtgagccactgcacccagtccttaatgctactttataggtgaaaattgtgaaataacttaaatttcattttaattaaagttaatttttgggaaattaacgaaaggttgacattttattcttttgaatattgcagttgttatttgggtttaaattggggggcttaggaaggaaagaagcctgatggttgtttctgaattttctgaaaattatgtttgatatgctgtatatgaaatccagcttggagagaatatgtccattgttaaggaaaaattaatgaagatttgatctagataaggcattccaatcatttggaagtggtttgagtatctttttttctttttttaatttgagacagagtcttgctctgtggagtgtagtggtgcaatcttggctcactgcatcctccacctcccgggttcaatcaagcaattctcctgcttcagcctcccgagtagctgggattacaggtatgggctaccatccccagctaatttttttttttggatggaatcttgctcccgtcgggcaggctggagtgcagtggtgtgatctcagctcactgcaacctccacctcccagtttcaagcgattaagtgattctccttcctcagcctcccgagtagctgggattacaggcgtgtgccaccacgtcgccaccacgtctggctaatttttgtatttttagtagagacagggtttcgccatgttggccaggctggtcatgaactcctgacctcaggtgatccacctgcttggcctcccaaagtgctaggattacaggtgtgagccactgtgcctggcttaagttttgtatttttagtagagacggtgttccatcatgttggtcaggctggtgtcaaactcctgaccatgcgatccgcctgcctcggcctcccaaagtgctgagattacaggcgagagccaccgtgcccggcctgtttgagtatcttttaaaaccagtaaggacaaactagaggtgtcagctctcttcatgggctttggagaaacaagacaaaaaggaaagagatgtttcgccgggcgcggtggctcactcctgtaatcccagcactttgggaggctgaggacagcggatcacccgaggtcaggagtcaagaccagagccattgcactccagcctgggcaacaagagcacaactttatctcaaaaaaaaaaaaaccaaaaaagaaacaggaaagagatgttttgattttttaagtctagagtgttctgttcttactctacagcacttagcagtagtccatctatcctccttgtttgttctttacaacaaaaccccattggttctctcttaccaagtttgctttattcttggtttatcctttgtaagatgtgaaagggatatgaagagcaaataggaagtgttactcttgctgcttgagagaaagctgttttacaatttgttggcaaacaatttgtaaaagtacaacaaaagtgtgcatttttggcttcttatttatgttttatcattgctatatctcataatttgtgatttttaaaataactttttatttgaaaagcactacagggtcacgtcatgtttttaaaaaataaattaagaaggtaaacacccgtacttctactttacctctagtcctagtctatggtggtaatcagtgttaacagtttagtttgtgttcttacccttccaggggttttttttctctatgtatacagatatatgcatttttaaaaacatagttaacacttaaaaacaatatgggatcgtattaggaatacaatctgtattccttcccaacagtatatacagtttttttccatttcactatgtatctatttataaattttttatttctaataatttctcttgaataggtgagacatcatatagtataaaattcagtagaaaatcagtttttcagaggtacaaaattggctgactttgcacagactcctttcatttcacaggtagggatgcacagccacctcttccaccgacgagaggaaaggatatgtgtgcctgtgggctcttcaactctgttgattagttatgatttattttctggtcagtttgagaggaaacagtgataaaatactgggaacagggaagaagcataagattattattgtttttttttttttttttgagacagagtcttgctcagttgcccaggctggagtgcagtggtgcgatctttgctcactgcaagctccgcctcccgggtccatgccattctcctgcctcagcctcccgagtagctgggactacaggcgcccgccaccacgccctgctaattttttttttgtatttttagtagagacagggtttcaccatgttagccaggatggtctcgatttcctgacctcgtgatccacccgcctcggcctcccaaagtgctgggattataggcgtgaaccaccgcgcccagctttaattttttttttttttttttttttgagacagagtcttgctctgtcgcccaggctgaagtgcagtggcgcgatctcggcttgctgcaagctccgcctcccaggttcacgccattctcctgcctcagcctcctgagtagctgggattacaggcacccgtcaccatgcccagctaattacgggacctcgctctgtcgcccgggctggagtgcagtggcacagtctcgctcactgcaatctggcaagtgattctcttgcctcagcctccagagtagctgggactacaggtgtgcgccgctacgcccagctaatttttgtatttttagtagagatagggtttcgccatgttggttggccaggatggtctcgatctcttgacctcgtgatccgcccttctcggcctcccaaagtgctgggattaccggtgtgagccatcgcacctggccttcctactttattaagatacctaagggatttctgtgattgttaggattcaaatttctgtgagcataagaatcaagctgtgtgcataataattgcatgggatttcacagctgggccccattcccagggattttgtattatctacctccaagtgattttgatgctggtgatccttggaccagacttggtgaagctcaatgcttagctaggaaagccccaaaaatttgctttattggattgtgtaatttgactacatccattgtttcttttttcaaatgtagagttatatgccacaaaaatattttccgtagcagtaggcatcctaattaatctcgatgtttgtttatagccccattgatggggctataaacttggcagcaaattgttttcccactaatttggcattttccataaatgtttgtttatagccccattgatggggctataaacttggcagcaaattgttttcccactaatttggcattttccataaaaaacacgtatctgttgttagctgcctagacgttagctggacatggtttaggttacttttctcttaaaaagtaaattttaattcaagttcctttaagccagcagtctcaacctggggcagtttttccctccaggggacattcagcagtgtctagagacatttttggttgtcatgctgaggaagagagtgtatagtgggtagaatccagggatgctgttaagcatggaacagccccttacaacaaaaaattatgtagcctaaaatggcagtgttgccaagattgagaaattatgctttaaatgtgtttttatatatggccattttgtgtttactctggagataacatgcttttcctcatataacatgcttgataaacattttggtaacacaggaattgtaaatgctggtgatgtcagtaaatagttaagaaatttagggctgtgcgcggtggctcacgcctgtaatcccagcactttgggaggccgaggcgggtggatcccgaggtcaggagatcgagaccatcctggctaacatggtgaaaccccgtctctactaaaaatacaaaaaaatgagccgggtgtggtggcaggcacctgtagtcccagctactcaatttagaaagcagatttgtttcctttctatacctgtgtaatttgaggtttagtttactgtcacatcgtttataaacataaggaagatcgttgctcatctgatagcattccgaaccttgagtcatctgtaatgcctatggcctccagaaaagcttctctaatactgtacttagagatgtgtaaaatatgtaggaacattttcccaccttcgattgttagtttacctttcagcttcagtaatttacctttcagctattactttagtaacatcttcaacattgtttttcaaactgcaaggtgtgacccagtagtgggtcgttaaattagtaggtgacagagcatttttgaagaattaaatacaatagaacatagcagagtgggctcacgcctgtaatcccagcactttgggaggcgaggctggcaggtcacaaggtcggcaggtcacaaggtcagaagatcgagaccttcctggctctaacatggtgaaaccccgtctctactaatagtacaaaaaattagcggggtgtggtggcatgcgtctctagtcccagctactcaggaggctgaggcacgagaatcacttgaatccgggagctggaggttgcagtgagccgagattgcaccactgcactccagcctcagcaacagagcaagactatttcaaaaaaaaaaaaaaaaaaaaagaaagaaagaaaaaaagaaaatagagtgtatcacataattagagtagcaagtattgatttgtgaaacctattttaatcatagatctatgtatgtatgtgctggattgtgatgtaaagacatttcttgctgtggttacactgaaaaaaatgaaaagtcactgatttccaataacttacagaagcagtatgaactacatattctgtcgttcttgaaacaagctgagattttattgactttgggaagcagtagaattattttagttttttaattaacagtttttggctttgtactgtcaagaggtaattttagaaagcattctaaaaatgtaagtactggatttggcaacattcttgaactgtaattctgtttcgttaaacatcactatttacatgtgcaacagcgtgtctgtaacaatgtcccagtaatgaaattctttcttctatttaaggcatgtctgtttgataaaagtcaaacaaaattgggtatatgtcagtgtcttatgatactgcttaattaaacattaatttgactcttagctaatcaggaaatgtttgcctcacagtcttacagagctttccaccttctaaaaaagctaacgtttcagaatagattcaggattcaaccttctttctgtctttttttttttttgtttgagacagagtcttgctctgttgcccaggctggagtacagtggcgctatctcggctcactgcaacctccgcctcctgggttcaagcaattctcctgcctcagcctcccgagtagccggggttacaggcgtgcgccaccatgcccagctaatttttttgtatttttagtagagacagggtttcaccatgctgggtggccaggcgggtctcaaacttctgaccttgagatctgcccaccgtggcttcccaaaatgctgggattataggcgtgagccaccgcacctagcctagattcaggctgcttctttttttttttttttttgagacagagtcttgctcttgttgcccaggctggagtgccatggcatgatctcagtgcaccacaatctctgcttcccaggtttaagcgattctcctgcctcagcctcccaagtagatgggatcacaggcatgagccaccatgcctggctaattttgtattttttgtacagacggggtttctccatgttggtcaggccagtctcgaactccctacctcaggtgatctgcctgcctcggcctctcaaagtgctgggattacaggtgtgagccactgcgcccagcagattcaagctttttaaatggaattttgagctgatttagttgagacttacgtgcttagttgataaattttaattttatactaaaatattttacattaattcaagttaatttatttcagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggtaacaagtgattttgtttttttgttttccttcaactcatacaatatatacttggcaatgtgctgtcctcataaagttggtggtggtgactcactcttaggacacattcagatttcttttttttttttttttgagaaggagtcttgctccgttgccaaggctagagtgcagtggcacaatctcagctcactgcaacctctgcctcctgggttcaagcgattctcctgcctcagcttcctgagtggctgggattacaggcatgtgccaccatgcccggctaatttttgtacttttagttttaccatgttggccaggttcgtctggaactcccaatctcaggtgacccacctgcctcggcctcccaaagtgctgggagtacaggcgtgagccacagagcctggccatgttcagacttctaataacaggtttgtattgactcttagcctcatggcagaagccaagagacatgagacagcttagaaatttttgctttttggaaatgaatgttagagttactggtttgtgattaaggcctattgcactgacagaggcagtgaaaaagggtttgattgccaaggaagattcacagggcctagaatggcagtggttatgcatctacagtttattacaggagaaggatacaatccagtagcaggattatggtaaggatatgcatcacagtcaaaggctgtcatagcaagtcatccagagagttcgggtgcaagttccagttttcctttgttgtgtaaagtctgtggtggggtgcattttctctctcagagcaggatgtgtgcacaggacaccttggaacctaggagcccaaaatagagtcttcactggactttttaatatttttcttgtcaagcggacatgttcctgttctctaactagcctcttcagtggaggtcagaggaagagcctcattgagaccaagtgcaactcatcaatcacatgaaacaatgctgataaataaaccacctaaatatcccctgacccacaaatacaaaacaacaccattcaatcagtatttttcatgccttgatcaggggtcattgccatgcaggaactttaacaaaacagtacaggctaataatagaattgttggaattaactcacacagcacacctatgagagagagttaagatagagggtcttggtggtctctaacagttgaattcaaagtgaagttaccagagtaaagtgagcaaagacacatattagtacaatattggtagataaaatcacgttgctctaataagcatagttttaaactttaaccatgtttctccagtaattttagtaattatattgttgttatgtctaatacataaagcattttttacttttttaaaaaatttttaggcaatgtggggtccaaagtaattaaaaaaaaatttttttaacataaagcatcttaaaattttacttaatcatgatcacttagaaccattaaaacatacgttttgatattatggggaagcttcgttgttcctttgtagacagacttaaagaaatacaactttatgatgacaagatataagataattatagatttaaattttatagaaaccttttcccttatctagtgcaagaggtagctaagtgcttattttctcaaagtactgtgttataaaaagtattcctagtgtagtcaaagcttctctttagactgataaaacttagagcacctgcatttacttccaacaaagcagaattaaagaaaatgagacttggccgggtacgtttgtaatcccagcactttgggaggccgaggcaggtggatcatgaggttaggagatcaagaccattctggctaacatggtgaaaccctgtctctaccaaaaatacaaaaaattagctgacatggtggtgcgcacctgtagtcccagcttctcaggtggctgaggcaggagaatcgcttgaacccaggaggtggaggttgcagtgagctgagatcacaccactgcgctccagcttgggcaacaaaaaaaaaaaaaaaaaaaagaaaaagaaaatgagtctttactggctgggcacagtggctcacacctgtaatcccagcactttgggagaccgagacgggcagatcacctgaggtcgggcattcgagaccagcctgaccaatatggagaaaccccatttgtactaaaaatacaaaattagcggggcgtggtggcgcatgcctgtaatcccagctattcgggaggctgaggcaggagaattgcctgaacccgggaggcggaggttgcggtgagcagagatcgtgccgttgcactccattctgggcaacaagagcgaaactctccatctcaaaaaaaagaaaatgagtctatactttgctgttttcatactctcttagtgtggtgtaggcagccatgtatcccccttgtgcctctatttctccattctgtgaatgagtgtcttccactgctgtgcttttctgattccgtaacctttgtttgtttgtttgtttgtttgtttgtttgttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaatgagcgtgctgccttcaagcatctgtttaacaaagcacatcttgcaccacccttaatccgttcaaccctgagtggacacagcacatgtttcagagagcacagggttgggggtaaggtcacagatcaacaggatcccaaggcagaataatttttcgtagtacagaacaaaatgaaaagtctcccacgtctacctctttctacacagacacggcaaccatccgatttctcaatcttttccccacctttcccccctttctattccacaaaaccgccattgtcatcatggcccgttctcaatgagctgttgagtacacctcccagacggggtggtggccgggcagaggggctcctcactacccagtaggggcggccgggcagaggcgcccctcacctcccggacggggcggctggccgggcggggggctgaccccccccccccgcctccctcccggacggggcggctggccaggcggggggctgacctccccgcctccctcccggatggggtggctggccgggttgggggctgaccccccgcacctccctcccggatggggcggctggctgggcagaggggctcctctcttcccagtaggggcagccgggcagaggcgcccctcacctcccggatggggcggctggccgggcggggggctgacccccccacctgcctccaggacggggcggctggccgggcagagcggctcctcacttcccagtaggggcggccaggcagaggcgcccctcacctcccggacggggcggctggccgggcagaggggctcctctcttcccagtaggggcggccgggcagaggcgcccctcacctcccggatggggcggctggccgggcggggggctgacccccccacatccttcccggacggggcggctggccgggcagagggtctcctcacttcccagtaggggcggccgggcagaggcgcccctcacctcccggacggggcagctggccgggcggggtgctgacccccccacctctctcctggctgggcggctggctgggcggggggatgacccccccatctccctcctggatggggcggctggccgggcggggggctaacccccccacctcccttccggacggggtggctgccgggcgcagacgctcctcacttcccagacggagtggctgccgggcggaggggctcctcacttctcagacggtgtggctgccgggcggaggggctcctcacttctcagacggggcggttgccaggcagagggtctcctcacttctcagacggggcggccgggcagagacgctcctcacatcccagacggggcggcagggcagaggcgctccccacatctcagacgatgggcggcctggtagagacgctcctcacttcctagatgggatggcggccgggcagagacgctcctcactttccagactgggcagccaggcagagaggctcctcacatcccggacgatgggcggccaggcagagatgctcctcacttcccagacggggtggcggccgggcagaggctgcaatctcggcactttgcggggccaaggcaggcagctgggaggtggaggttgtagcgaactgagatcacgccactgcaccccagcctgggcaccattgagcactgagtgaacgcgactccgtctgacatcccggcacctcgggaggccgaggctggcggatcactcgcggttaggagctggagaccagcccggccaacacagcgaaaccccgtctccaccaaaaaaataccaaaaccagtcaggcgtggcggcgcgcacctgcaatcgcaggcactcggcaggctgaggcaggagaatcaggcagggaggttgtagtgagccgagatggcagcagtacagtccagctttggctcggcatcagggggagaccatggaaagagagggagagggagaccgtggggagagggagaggagggagagggagagggaaccttttgttttattccagtaggaccagctagaaacagaaggtgattgaccagtattagggatggaatcagggtacaattatggagacaggctatctaaacaattcactctcaccatttaaatcagctgtttgatcattttttttccatatatctttaccatcgcatagtaaataatatcctttttattttcaagagggagtattggccttaagttaggaactctcttaatttttttcccccatcatcccacccgcacttcttactccttacttcctacttgcttttattctttactggctctttaccactgcgtatttttaggtgcatacatctattttttaaaaaagcacccttgttcctgggtcctcttccagtaccatctattaatatatctctctccctctttccactcccagctgggtttctgaaagcgtgcacttcccatcttccattcattcatctggtttccagccctgaccacagtactgaaatggcatttgctaggtgacctttatttttttttaaatccagtgaatgcggtatagtccccccgcttttttctttctttttttttttttgttttttgttttttgtttttttgagacagagttttgcccttgttgcccaggctggagtacaatggcgtgatatcggctcacggcaacctatgcctccccaggttcaagcgattctcctgcttcagcctcccaagtagctggattacaggcacctgccaccacagctggctaattttgtatttttagtagagatgggttttctcgatgttggtcaggctggtttcgaactcccgacctgaggtgatccacacacctctgcctcccaaagtgctgggattacaggtgtgagccactgcgcccagccttggtatagtctttaacgaaagttcactgatcttgaaaattttgatcttgaaactcttttttttttttttttttttttttttgagatggagtcttgctctgtcacccaggctggagtgcagtggcacaatctcagctcactgcaacctccacctcccaggttcaagcgattctcctgcctcagtctcccgagtagctaggattacaggtgcccaccaccatgcctggctaattttttgtatttttttagtagagatggggtttcactacattggccaggatggtcttgaactcctgacctcatgatccacccacctcggacctcccaaagtgctaggattacaggcgtgagccaccatgcccagccttgaaactctcctaaggttatgttaaacatttttgtattcttggttttctttttgttccatgggttatttctctttatccttctttttagctttcttaagtgttcctttaccttatcaaattctatttttggctcccatttcacttaataagaggaaaagctgggatttttttttttcttttgtggagacagagtctcactttgttgcccaggctggagtgcagtggtgcgatctcagctcactccaacctccgccttctgggttcaagcgattcttgtgcctcagcctcctgtgtagctgggattgcaggcatgtgccaccacgcctggctaatttttgtatttttagtagagatgggggtttcaccatgttggccaggctggtctcgaactcttgtcttccaagtgatctgcctgcctgggcctcccaaagtgctgggataaatttgagccattgtgctcgtctaagctgggattctttgaatgagttcttagaggcttcctgaaactttgtgcaacattttgtgtatgtgtatattttctggggaaaggatttgtaactttctattttttgagagggagtctctgtggctcagggtggagtgcagtggtgtgatctcggctcactgtaacttctgcctcctggttcaagtgattctcctgcctcaggctcccaagtacctggaattacaggcatgtgctaccacacctggctaattttgtatttttagtagagacagggtttcattatgttggccaggctgggaatttgtaactttcatcagatatcccaagggatatatgtctttcctggtagagagggaagaaacaaaaaacgtgtgtaaataccctcctctcccccagaaggtaagaagtactgctctgcacattccttgggtgatctttctcactccctgggataattaaggaagttagggattggggttgagggtaacttggcatccttccccaacctccctgtataggcacagtctaatatacttgatgacagtttgcaacaagtcaacaatttcctacttttctggtgttaggtttaagttatatagacctatggtgatcataacattatctaaatcagatgcttcacattataggtcttgcagctgatgtccagtttaggtgtttgaagtggcttagcctggaaaatgttacaggggaaaatctgctttccatgtgttatgctcagagctgtgttcttttcttttacacaatatgtttgacatttgttgaattttaggtgtaccctggtcattaggaactccctaaaggatctctgtgaggttttaaaaaaacaaaacaaaacaaaaaaacagtggcattttgcagaactcagtatagctctttaccatactgactgcaaggagaaagtaaaaagtgagactaattttgcaattagtctcccaagtttctttacaagaaaatagaccaaaggtactatgtttaaaagcaaaatcatggcttaaaagtttttctttttcttaatatattaatatattgctataaattgagtattgctctcttgctatcttgtgtttttttggtttttgattaactctaagcttaatgttattcctgacaaataaataaataaataaataaataaataaataaagtgaattcagagagacagtagagggcagcagccgtttagaaagtagattcacattgagtgattacggctcttttaaatctttctccactaagagatagctaatttccgaaaaggtatacttggcctcccatattccttatgtctcttaaaactaaaaaagctgggacaaaacttaaaataacagtattctacggttagggcaaatttctgatactgcttaaaacaatttaccgaggtatctttatttttttttgagacagggtttcactctgtcacccaggctggagtgctggagccttgacctcctgggctcagctcaagtgttcctctcacctcagtctgccaagtagctgggactacaggcatgcaccatcattcccaactaattttttaaaattttttgtagagatgggggtttcatcatgttgccaggctggtctcgaactcttgggctcaagcaatctgcccacctcgtcctcccgaagtacagggttataggcatgagccaccactcccagcctcagatttttttattgatgaattttattataacagctacaatactgagatgcataacccttccctttcctgatacccagttatcatctgtttctgtttaatacactccttaagtacctcacatttgctattcccctgccccccatggtctatgcatcttcttcattgaagtggtagtagtctttgttagctcatctggtcatgtcatcaattcagagcacattacctctttagttcagaacacattaattgcttcccataatcttcaggacacggccccatttcttcacgtggcttggccattgcttccctgttcagcttcccccacactccctcacctacaccttctgtctcagtatagtactgctagtctccagacatgccatgcctttttatgcttctatgcgtgttttcctgtctttaatgtccttgtccatgtgatgaacccctactcatttttccaagattgaactcaaatgtcaccttttctgtgagcttctctgctcttctcatgcagagtagaagtgtttatctccattgcccttgaccctaaataacagtacattagtataataatcacattttttacctgtttgtgtgctttccttctaaatggagaataagaatataaaagtgatttatttggcatttctgcaaagggagatgataaaaagaatctgcgttacttagcctttttaaaaaacccttagcctatgaaggctactatttaaggtttggttggattttgtatgttggaaatatgttctttaaatctcatcttcatcagtttataaaagcaatataagttctttgtagatcattatcatgccatccagatgtagtcattattgttttgatataggttgtttcagtctttaaaccaaattatacactgttccgctgtaactcttgttttgaaaacagatttgttccaatgtgggtggtatattagggaacaatttgagcataatgtaaattttgagtttgcttatgcacaaatccctaggcaacactaggtgaatgcagaaaaatgcatgcagctgaactcagcagtgtagatatatacaaaagatacacatacacacgctcttcaaatacctaccttattttcctgtatgtgttatgaaccatacccattcacatctggtattacaactttgccacccatttcagacagtattcctttgaccattctgcagtaactcagaagctgcagccctttagaagtctactccactgtggctcacgtctgtaatcccagcactttgggaggccgaggtgggtggatcatgaggtcaggagatcaagaccatcctggctaacacggtgaaaccccgtctctactaaaaaaaaatagaaaaacctagccgggcgtggtggtgggcatttgtggtcccagctactcgggaggccgaggcaggagaatggcgtgaaccggggaggcagagcttgcagtgagccaagattgcgccactgcactccagcctgggcgacagagcgagagtccgtctcaaaaaaaaaaaaaaagaaaaaaagaaggccactccacaagcaaaccgcagatgttttgcaaggtgacttatttattgtaatagttgtgtatttcttaaccatttcacatgtataaaactgtgctactacttttatgaggttcctgtctttattttttttaacatgtcgctggtgaaggttctgagagttgtggcttgaactccagttttctcataagcacggttttttgttgtttttttttgaaatggtctcgctgtgttccccaggctggagtgcagtggtgtggtctcggctttctgcagccttggcctcccagcttaagctatcctcccacctcaagctatcctcccacctcagcctcccaaatagctgggactgcaggcgtgagcctttgcccacctaatttttatacttttgtagagacagtttttccatgttgccaggctgctttggaactccttagctcaagcaatcagcccgccttcacctcccaaagtgctgggattacaggtgtgtcctaccacacccagacggctctggtatttactgcatagtgttctgatttttaggaatacatacgttgcattatatagcagaactggctgtattcaaaagtctaatagaaaatattgatagggtgataatgtatatagtactaattgtcagttgccataatttaactaatattgttttactttttactttttttttttttgagatggggccttgctatattacctaggctggtcttgaactcctgagctcaaggaatcctcttgcctcaacctcctgaggatgtttgacattttttgacttttttttttttttttttgagacggagtcttgctctgtctcccaggctggagtgcagtggcatgatctcggctcactgcagcctccacctcccgggttcaagggttcaagcacttctgcctcagcctcctgagtagctaggattacaggtgtgcaccaccaccacggctgatttttgtatttttaatagagatggggtttcaccatgttggtcaggctggtcttgaactcctgacctcgtgatcctcctgtgtcagcctcccaaagtgctgtgggtacaggcgtgagcctccatgccggccggctttttggcaatttaaatagttacagttacctattataattgatatttagctaacatctatttttattttaatattccaggaaattattatgcagaaactttaaaggtctgtgtacttctctggtgttttgattttttttttttctttttctgtgagtaattttctaaaactggtttctaggccaggctatttatgtcttgctttttattttttttggcgatggagtctcgctttgttgcccaggctggagtgcagtggcgctatctcatcttgctgcaacctctgcctcctgggttcaagcagttatcctgcctcagcctcccgagtagctgggactacaggcacatgccaccacgcctggctagttttttgtatttttagtagaggtggagtttcaccgtgttgcccaggctggtctggaacttctgagctcaggcagtctgcctgccttggcctcccaaagtgctaggattacaggtgtaagccactgctcccagccttattattttatttttatggattcggggtatatgtgcaggtttgtcccatggatatattgtgtaatggtgagttttggacttctgttgtgcccatgaacattgtacccaataggtggtaatttttcaattctcatccctctctctgcctctgcccttttggagttcccagtatctgttaattctctctgtatgtccatgtgtacccattgtttagctcctctattttttattttattttattttatttttgagacaagagtcttgctgtatcacccaggctggagtgcagtggtgcaatctcagttcactgcaaccttggtctctgggttcagatgattctcgtgccttagcctcccgagtagctggaattacaggtccgtgccacgatgcccggctaatttttgtattttcagtagaggtggagtttcgccatgttggccaggctggcctcaaactcttggcctgaagcaatccgcctgccttggcctcccaaagtgctgggattacggtgtgagccactgctcctgaccccatattttttcttttaattataaaggtaataatgtaaaaagaagtcaactcccagtttaactctagcagagtaaccagtgttaatttttttttttttttttttgagacggagtcttgctctatttcccaggctggagtgcagtgatgccatcttggctcactgcaacttctgcctcctgggttcaagccattctcgtgcctcagcttcctgagtagctgagattataggcgcccagtgccacgcctggctaatttgtgtatttttagtagagatggggtttcaccatgttggctaggctggtgttgaactcctgacctcgtgatccacccgcctcgatgctgggattacaggcgtgagccactgagcctggccaatccattcctttttatggctgagtagtattccattgtgtgtgtgtgtatatatacatatatatacacacatatacatatatatacacgtatatatgtatgtatgcgtatatatgtatgtgtgtgtgtatatatacacatatacatatatatacacctatatatgtggtatgtgtatatatatgtggtatgtatatatatgtggtatatatatgtggtatgtgtatatatatatgtggtatgtgtatatatatatgtatatatgtgtgtatatatgtggtatgtatatatatatgtatatatgtggtatgtatatatgtatatatgtgtgtctgcatatatgtatatgtgtgtatatatacacgtatatgtgtatatatatacgtatatatgtgtatatatacatatatacgtatatatatacacacacacatatatatacacatatgcaggcacacatatatatacatatatatatatacataccacagtttctttatccacttgttgattcatgggcatttgggttggttccacgtttttgcaattgtgaattgtgctgctataaacatccgtgtgcaagtatcttttttgtataatgatatcttttcccctgggtagatacccagtagtgggattgctggatcaactggtagttctacttttaaggaatctccacactgttttccttagtggttatactggtttacattcccaccagaagtgtagaagtgttccctgttcactgcatccacaccaacatctatttttgattttttgattatggccattcttgcaggagtaaggtggtatcgcattgtggttttgatttacatttccctgatcattagtgatgttgagcatttttttatgtttgtttgccatttgtatatcttcttgagaattgtctattcatgtccttagcccattttttgataggattgtttgttttttttcttgctagtttgtttgagcttgttgtagattctggttattagtcctttgtcagatttatagattgtgaagatttttttcccactctgtgggttgtctgtttttgtctgtttccttctgctgactgttccttttgccatgcaaaagctctttttttttgagacagaatctcgctctgtcggccaggctggtaacaaagacacaggtactggtaataactgccatggcttattgcctacattaatgatgaaagcaaatgctaaatttcagctagaggctagagaaaataagcctggaattttcttttatgtttatatactgctatgaataccaggagtccttgggttaagactgtagggctttctaaagcctgtgatcactagtggagaatgtagctttacaaagtctagttggaaattggcaactgggggttagtacaagttacaaggaagggatggaatttaagatgctagtgaaagcttggaggataagggagcaggtgaactcataaggaagtttatgaactgagaagggctgcagcaaagtgggctcatgtgcttgaggagccagaggacatgttgagggtgacataggttctgaagttcgtacagatacttatgcagtatggattcttggaaaaccttctttagtcatgtgatagaaaaataacagcttatggaaaaaacagggttgaggcagacctgaaaatacatgaaattttaaaaaccgcttctaacagaagcataacagactgtaataaaaactgtggccttcctggcatttgcacccaaacaacagcattagccaactctttgaagccttagatctgtggctcttgttttctcctttgaggtgtaggtccttgagggcatttgcttctaatagaggctagtttcatcagaattaaaaatctgaaccatggtatgaaattcaattcttttttttttttcttttttgaaaacactggcaaatgttttgtatccttgagctttcccacatatcttaacatagtgagtggaaagtacagtggctgttaagccaactactctgaggtcttcactgctaaggcttactcttaattgtgtgagagcttaaccttgatccctttaaaacattaatgggctagaaaaaaaaccattcataaaccagtgccacctctgaattttgctaccacaattcccttatttaccaatagtgcatgagctaatttggaataaagaactaggcattgtagcacaacagacattatgtgggcaaagtgttgtttatattctgtctaaatagtgcttcacatgtatgtactattttctaaatatgtatagatgcttttgtgattaataataaaacatgaattcttaaaacaattttgctgacttcatagtagcttttcaccgttttttcagtagctgctaaaatttctggagaagtttgggaactattgttttggagtgaaatgcagtgtgttagatatcacttgcagaattcttctaagggtatttattggcgattagaaaaaaaatccttgtgttataccagtagtaatacaaagtaattgttcagcttctgttaagtgtaaaggactatacaagtattgtgtatagttatctcatttattattttctgggtagctattgttattattacttcgtacaaaaagggaaaaggaggctcaaagtatcatgctccagataacagagccagtaggtagcagagctgggattgctacccaggtctctagtcctgctttttcacactatatactcattgcttcacttactccttcatacatgattccccagcatgtactcttttttttttttttttttttttgtttgagatagaatctcgctctctgttgcccaggctggcaggcagtagtgtgatcttgggctaactgcaacctccatctcctgcattcaagcagttctcctgcttcaacctcctgagtagctgagattataagcctatgctaccacgcctggctaatttttgtatttttagcagagatgaggtttcgccttgttggccaggctggtctcaaactcctgaactcaagtgatctgcccacctcagcctccgaaagtgctgggattataggcatgagccatcatgtccggcctccccatcatgtacccttaaataccatcaagcacagttccattgtgtaaaaacttggcttgatttaacctgttaattggaacactgtcattaatggaaattaggaatatgaggtaagctagaggttttattttaatgactttgggttattaaatctataagaaatgaaattcatttagtcataattaatgtcatgtttctgcatctatattacttgttgggtttacagacgaggtagtgtattattagtgggaagctttgagtgctacatcatctccctttctataaaataaattgagtacgaaacaatttgaattaaaacacctgagtaaatagtaactttggagacctgctgtactatttgtaccttttggatcaaatgatgcttgtttatctcagtcaaaattttatgatttgtattctgtaaaatgagatctttttatttgtttgttttactactttcttttaggaaaacaccagaaattattgttggcagtttttgtgactcctcttactgatcttcgttctgacttctccaagtttcaggaaatgatagaaacaactttagatatggatcaggtatgcaatatactttttaatttaagcagtagttatttttaaaaagcaaaggccactttaagaaagtttgtagatttttctttttagtatctaattgtagcacctttgtggacagtggatgtaatattaagtgacagatgggaaaaggatttttaaaaaaatagcaactgtttcagtggatgaaataaagattattagcagagaaaatgaatattgggcataactgtcctggtgaaagacaatctcataaatgaacaatttcataatttcgtaaatgcaactgcattttattttcaaagagaaggaaaattatagtcactggaaacggaaagagaagttagaggtaaacataggacacacaagaaaactttcattttgtttattttcttgtttttcttttgagacagggtttccctctgttacccaggcttaagtgcagtgacactatcatagttcactaacccctcaaattcctgggttcaagtaatcctcctgccttagccttagtaggtgtaaatacaggtgtgtaccaccatgcctggcgaattttaaaaaaacttttttatagagatgagctctcgccgtgttgcccaagctggtcctaaaacgctggcctcaagctatcctccggcctcagtcttagcctcccaaaatgctggggtttcagtagaagccaccatgccgggccacttctgtttcttttccatgtagagttctttgcaggaggaggttagaataggtgtgcatctcctaaatagttgtcgaatataactaaaaagttaaccaggactctaaatactatttacttctaaaatttgttaattgggaacatttagggtttaactgatctatatcttatgtctttaacaattttgaatgataattatatgtaaagtaagaacagtttgtgaaatagttgaaaatatccttacatgaaagtgaattttaaagcacagtttatgtaatgttaatgttttgttttgtatctgttaaaaatttgtttatatgaacaagtttacaggtttactgtggtgagcccgttgaatatagtgggttttttttgtttgttttgtttttgtttttgagatgaagtctcactcttgtcccgaggctgatgtgcaatggcgcgatcttggctcactgcaacctctgcctcctgggttcaagcgattctcctgccttagcctcccgagtagctgggattataggcacctgtcaccaaacccggctaagttttgtatttttggtagagatgggatctcagcatgttggccaggctggactcaggtgatccgtctgcctcggcctcccaagtgctgggattacaggtgtgagccaccatgccgagcctgaatatagtgtttttaagttgcaggactttaaaaataatattttgaaatttttctaagttaaattccctgttaaaatggtcatgcaggaatatacgcttgcattattcatattagggtaactgtttggtttgctagttgttagattctttgcattcctttttttttttttttttttttttttttttgagacggagtttcactctttttgacaaggctggagtgcaatggcgctatctcggctcacctcaacctccgcctcctgggttcaagcgattctcctgcctcagcctcccaagtagctggaattacaggaatacgccaccaagcccggctaattttgtatttttagtagagatggggtttctccatgttggtcaggctggtctcaaactcccagtctcaggtgatcagcccacctcggcctcccaaagtgctgggattacaggagtaatcccccacccttttaaaaaaatgagacagagttttattctgtcacccagggtggagtgcagtggtgcgatcatggttcaccgcagccttgaatctgggctcaagtgatcctcccacttcagcctcccaagtagttggaaccatagatgtgcatcaccacacctggctgatttttaaattatttgtagagatgaggtcttgcttgttgtctaggctggtcttaaacttctgggcttcagcagtcctcctgcctcagcctcccagagtgctgagatgatagacatgggccactgcccctggccgcatttttcttttcttttcctttctttttttttttttttttttgaaacggagttttgccattgtcgcccaggctggagtgcagtggcacgatctctgctcactgcaacctctgcctcccgagttcaagccattcttctgcctcagccttccagttatctgggattacagtcatgtgccaccacgcccagctaatttttgtatttttagtagaaacagggtttctctatgttggtcaggcttgtcccaaactcctgacctcagatgatccacctgcgtctgcctcccaaagtgctgggattataggcgtgagccaccatgcccggccctaactgcatttttcttagtatttgtggtttgagttaatacttgccctatgtgatgttgatttattattactggatcattaagtgaggtttaaagaagctaaatgccatttgctctatgccctctggattttaaaagtgcatgggtgtgcacgtgtgtaggtataaatgtttccatattctagtatattctgtgtcagtgatagagcagtcttagagctgtcttttccatttacttgtaggttaagaagccaaaaaaagttgtgtcatcatcccgtttaggaaaacttacattttggctattgtttcctctagtgctgctattagtggaatgattttaggtgttcaactttcagatcaatgggagacagaaatattgttctgagacatctggaagccgaatgtgttttattcctgcctgtctgaggatgtggtcttgcctttgatagggcaaagttatttgtaaacattgctttaaataaaaacatgtaaaggtgtttttgatggttaacaaaaactatgagtataatagagcctagtccctattacggactggtattgatctggtgtgggaagagtattgagcttttcagtgtcacctacctgtattcccttgaagggacccagagcccaggcaaagctctgctgaggtcgggcgtggtggttcacgcctgtaatcctagcattttaggagaccaaggcgggtggatcacctgaggtcaggagttcaagaccagcctagccaacatggtgaaaccctgtctctactaaaaatacaaaaattagctgggtgtggtggtgcatgcctgtaatcccagctatctgggaggctgaggcaagagaattgcttgaacccaggagacggaggttgcaatgagccgagatcatgccactgcactctaggtgggtccctgagtgagactccatctcaaaaaaaaaaacaaacaaaaaaaaaaaaaaaaaaaaacctctgctgaaatgctacagttaattttgccatttgtggtcagcattcttcttctaaattgctataatcttgccttcatattatgtgtctcaaatttaagcaggtatcagaatgtccacgggaacaaattgccatggctctaagcccagaatcagattcttcagatctggagtagggctggggaatttgcatttctaacacacaagtttgttgatgctgtttgtctggggtccacgcttgcctaacttctgatgtgatttatttctgccagtttctttttttgttgttgttttatttttttgagatggagtctcgctctgtcactcaggctagggtgcagtggcatgatcttggctcactgcaacccctgcctcctgggttcaagcgattctcctgcctcagcctcctgagtagctggggttataggcacactgcaccacacccagctaatttttgtatttttcgtagagacagggtttcaccatgttggccaggctggtcttgaactcctgacctcaggtgatccattggcctcggcctcccaaagtgctcggattacaggtgtgagccacccaccatgcctggcccttcctaccaatttctatcctccctgaaatgctgcacacttaggcagtcactggacaatatctgccccaaaattggtttgtataattgagaatatttaagaggttgttaaaatttgaaccactttctattcttctattaagtgtacacatctattaaagatccccttgtagctctttttatctgggccatcacatttctgcccagcagatgcagaggccctgtcctctcttccacctccccactacctctccttccctacttttggactgtaaaagctgtctttctgcagttaattgttttattctttgtaggttctactcgttgataatgttatctactgctataataattacagacggcaacaggatgatcaaatcttggatattttaaatttacattatgccttttttattttatttttttaaagtctctgcttgacagcaaataagcctaacgttccctaacaaatgatgatgtcccattaatgatttgatgacttcctgtttgtagtttttatttagagtgcttgtgggtagtttttcataacgacatttaaaaatcaggatataaataattttttaagttttttttttaggcggggcacagtggctcacacctgtaattccagcattttgggaggctgaggtgggcagatcttgtgaggtcaggagttcaacaccagcctggccaacagggcgacaccccatttctactaaaaatacaaaaattaggccgggtgcggtggctcacacctgtaatcccagcactttgggaggccgaggcaggcagatcacaaggtcaggagatcgagaccatcctggctaacacggtgaaaccccatctctactaaaaatgcaaaaaattagccgggcatggtggcaggcgcctatagtcccagctactcggaaggctgaggcaggagaatggcttgaacccaggaggtggagcttgcagtgagccgagatggcgctgctgcactccaacctgggcgagagtgcgagactctgtctcaaaaaaataaacaaataaaaaataaaaaaattaaccaggcatggtggcgcatacctgtagtcccagctacttgggaggctgggacagtagaatcgcttgaactcgggaggtggaggttgcagtgagctgagatcacccactgaactccagcctgggcaacagagcaagactctgtctccaaaaaaaaaaaatgtatttttctttgaagcttttctacttttaaatgtaatgtatagtattataacaagtgaacaaaatgatacaaagaagtatggcgggaaaggtgtggtagagatgggaaaacatatttcctccagcctcttaggttcattggaggagcttgggaattcaactgacacacgacagatttacaggagaaaagttttatttcaagtacacatgagagcttcatagaaaagaagtgaagacctaaagaaacagactggagagttcatatgccattttaataaaggataatgtattagtctgttctcatgctgctaataaatacatacccaagactgggtaatttataaagaaaaagaggtttaatcgactcacaattgcacatggctggggaggccttacaatcatggcagaaggtaaaggaggagcaaaggcacatattacatggtgtcaggcaagagagtgtgtgcaggggaactgccctttataaaaccatcagatctcgagagacttattcaccatcacaagaacggcatgggaaaaacctgcccccgtgattcaattacctcccaccgggtccctcccatgacacatggggattatgggagctacaactcaagatgagatttgggtggggacacagccaagacatatcagataataaattgtggagaggcagtaagattgaagaaaagaggtttgagcttcgaggggtggtaaattgtgggaaggtaattatttggggcaaactaatggcacataaggattgttttagtaaggcttgttatgcatacccaaaacaagtgccatctccagtaatttaagagtctatggtgatcaagagtagttctcttcctgctagaagaggggtgggagagaacaccttcacaaagggaaatttatattctgccttcatgcagaaagggggcgagcagagagttcctacgtatactgtttcttcattatcttcctctcaaaagaatacttaggctaaagtggcatgatttggggtgacattctgatcctcttcagtgacaatccttgatatttttccttctttctctccaggtaaacagtgttaacatcctggtatgcttcccccaattccattatactaactctgtattgtgggttaaagattttttactttgatcagcagtatttgaaacatacctgttatactagatgtactctgactgtaaaatagtggtcagtgttacttctttaatgatgctgtgggattaaaggattttattataaatgctgggaagagcctggatttgaggaaggtaagcagtgcagttaggtggatgtagactagaagaggtcatttgttctcatttcattgttgcccctatgacatgcccgtttctttcttttttttctttttttttttgagacggcgtcttgctctgtcgcccaggctggagtgcagtggcgcaatctcacctcactgcaagctctgccccccgggttcatgccattcttctgcgtcagcctcccgagtagctggaactacaggcgcctgccaccatgcccagctaattttttgtattttcagtagacacggggtttcaccatgttggccagggtggtctcaatctcctcacctcatgatctgcccgcctcggcctcccaaagtgctgggattacaggcgtaagccactgcacccagcctacgtgcccatttcttaaagtagaaaatttagtagttgatgatgtcagggaagaaaagctttttctctgccttacgttaagtagttgggggcaaattaaattaataaaagacagattagtgagagaaaaggctgtaagaatttggactttatataccatcataatagaggaagtaaagggagatgaagggcacttaagggaaaacagatgacttgtaggaaagataaatgaacccttaagagaatagatgagaaatatgaaggttttgtgacaatgtctgtttaggtggttacttctcttcttgttatgagagtcagtcttctggttgctggaaactgctaggagatttataacaattgggctctttcgagaggctcttcttttaagcagataagggagttcacaaaaaagcctgttctcaaatgatttcagcacacacacacacacacttacgacacagttaagtactgtgccagtaagatgtgagttgtgcatttcttttttttctctgagtagactgtttgaggttatttatatcaggacttgttatgcaggtaactgaaaactcaacataatctaggttatgtagttaaaagtatggagagaaggtaggctttatttagagttgcttgatcctgtagatctcttctaccttttgtaattttaatttcaaccaaggatggttccctttttggccctaggaccagttagcagttggggcaccattccaagcaagagtcctgcagtttgtagtgatgggaccatttaaacagtgattgtgaccagggacatagaatgggatgattggcccgaggtaaccatggttgggtatggagtcagcttccctgtaggaagagatagacaaagtctgagcactcctgggaagggggaggaagggaataactgttgtgtaaatcatcagcagtgtctactaagataccatctgtaaccataggcttctatgttttataatataaggctgtcttttaaataaatcagattccctgttaaagatctgttctagattccctagggggttgacctcatatagtatcttctttttctttggttacaaacttttaaacttgtctgaggttataaggtgaattcaactgtccactgtcaatgtagatatttttaatggatttagggatttaaattacatgattcagaaccactttgaggaagtctagggaatatcagttgtttctgtataatttctgaaagcttcactgttttctaggtgtgcacttaattcatgtgatgaagggaacagtatttacatgagtggtttggttaatttttcccctcctaagcttagctttgtgtatcgtgcgtgcttccagtgtttttgtggctgctttacataagtcttttagaagtattttctatttttgaagtaaatgtggatcaaaaccaccccaagacaggattgaaaaaaagacagtttttcgcaagaaagtaaataattttatttagcttgggactttaaatgatatgtcttaaatgtaaacatttctatactgcattttggccatcttttgatactagttttcagatgcatattgttatttcatttattattggaaaagtagtaactttaaacaaatttttattgaaaatgctgacagaggccgagtgtagtagctcacacctgtaatgtcagcactttgggaggccgaggcgggcggatcacgagctcaggagatcaagaccatcctggctaacacggtgaaaccccgtctgtactaaaaatacaaaaaaattagccgggcatggtggcaggtccctgtagtcccagctactcaggaggctgaggcaggagcatggcatgaatctgggaggcggagcttgcagtgagccaagatcgcgctactgcactccagcctgggcaacagagcaagactccatctcaaaaaaaaaaaaaaaaagaaagaaaatgctgaccaaaaaaaatgaaatagttttaaagaagccacagttgtgtgatcctgatacaactatatcattattgtatgagtatatatgagttataaaaatagtatatgtaaatgcttcataatttttattattagaaatgaaaaagtataacaaggggggtattcatattctctccacttagaattaaccctcaacatgttgacatctttgtttatagtaatccttttttgttttttttgttttttattatactttaagttctagggtacatgtgtacaatgtgcaggtttgttacatatgtatacatgtgacatgttggtgtgttgcacccattaactcgtcatttacattaggtatatctcctgatgctatccctcccccctccctccacccctcaacaggtgtgtgatgttccccttcctgtgtccaagtgtcctcattgttcaattcccacctatgactgagaacatgcggtgtttggttttttgtccttgcgatagtttgctgagaatgatagtttccagcttcatccatttccctacaaaggacatgaactcatcattttttatggctgcatagtattccatggtgtatatgtgccacattttcttaatctagtctgtcattgttggacatttgggttgattccaagtctttgatgttgtgaatagtgccgcaataaacacacgtgtgcgtgagcctttatagcagcatgatttataatcctttgggtatatacccagtaatgggatggctgggtccaatggtatttctacttctagatccctgaggaatcgccacagtcttccacaatggttgaactagtttacagtcccaccaacagtgtaaaagtgttcctatttctccacatcgtctccagcacctgtcgtttcctgactttttaatgatcgccattctaactggtgtgagatggtatctcattgtggttttgatttgcatttctctgatggccagtgatgatgagctatagaaatcctttttagaaacaacagagccttgttgtaaaacaggtaaatgtacgtgaggacttcaaaaagtttgtggaaaaatggaattaaaagataaaatttaaaaacacattttaaatttatttcccaacataagctcctcaagttcaagacacttttataaatgatgatctcagctgtttagttcatccgtaaagaactgagggtactagaaattttaccatgtcaatgcagtctctttacattactaactaaagaaaaataggtgctctttaaagatcttttaagattaggaacaaaaagaagtcagaagaagccaaatcaaggtggatgcttaacgactttccatagaaacttacaaaattggccttgtttgatgagaagagcgtgcaggaacgttgtcatggtggaaaaggactttgatgatgctttccctggcatttttctgcaaaaacttgggataactttctcaaaacactctaataataagcagagcttatgttctttatccccccagaacatcagcaagcaaaatgcctgaacatcccaaaaaactgttgccatgacctttgcccttgactggtccacttttgcttcgactggaccacttccatttttggtagccattgctttgattgtgctttgtcttcaggatggcattggtaaagccatgttttggctcctgttacagttctttgaagaaatgcttcaggatcttgatcccttgtttaaatttctatggaaagctctgctcctgtctgcagttaatctgggtgcaacagttttgtcacccatcaagtgaaaagtttgttcagctttaatttttcagtcagaattgtgtaaactggaccaattgttgagatgcctgtagtgttggctattgtttctgctgttagtcattagttctcttcaattagggaatgaacaaaattaatttttcctgaaaaattgatgtggatggtctgccgctgtgggcttcatcttcgacatggtctcatcccttgttagaacaagttatccgtttgtaaactgctgatttcctaggagcattgaccccataaaattttcataaagcatcagttatttcattattcttctatgcagacttcactataaatttgctgtttggtcttacttcaattttagcagaactcatactgctctgacatctaaactgatgtcttagccttcatagtgtctctgactagatcctattcagacgtgttatagcaaattagtaaagtttattttggtgccaaaaacttttgaatccacgcatagttttttcacaacacattttccatgaactttttgaagacccttcatatattataagaagaaagttaaaaatatcccctgcatctactactcagaaataaccactgttaacattaagtctgttctcaactctaggcattattgagggttttgaggacaggtcttgaaaatttctatggctaccttttactgggtggagactagcatgtatagttgaccgcataggttaatccctccactcaaaaagccacaattttaaagtgtagtattcactagcatttagtatattcacagtgttgtgaaatgaccaccaccatctagtttgaaaatatttcatcacaaccaaaagaaaacctcatatctattagcggtctctcctgtttccccagacaccggcaaccactaatgtactttttgtctctgtggacttgtcagttctggacattttatataaatggaatcatgtgaccttttatgattgacctctttcacttagtataatgttttagaggctcatccacattgtagcatgtgtcagtacttcatttccttgtgtattggtccattcttgtactgctataaagaaatagctgagactgagtaatttataaagaaaagaggtttaattggctcatggttctgcaggccgtacaggaagcatgatgatggcacctgctcagcttctggggaggcctcaggaaatttaaaatcatggcagaaggggaagtgcggcgtcttacatggtggagcaggagcaagagagagaagggggaggtgctccacacttttaaacaactagatctcaggacaagtcagtcactataatgagaacagcacccaggggaaaccgccctcacgatccagtcacctctcaccaggctccacctccagcactggggattccagttccaattcaacatgatacttgggtgggggcacatatccagaccatatctcctcgtatagctgaatagtattcccttatatggacataccacatttattattaatttattgattgattgacaggatcctgctctgttgtccaggctggagtgcagtggtttgagcatagctcactgcaggccttgaattcctgggctccagtgatcctcccacctcagcctcctgcgtacctgagattataggtgtgtgccaccacacctggctaattttttttattttttagcagagacagggtttttgctatgtttcccaggctggctttgaactcctgggctcaagcaatcctcctgccttggcttcccaaagttgtaggattacaagtgtgagtttagagaggtataatttcttactcaacttcaagtattttatttctcttatcatttgttgtttggtttgttaattatttggaagtatatttttaaatttccaagcttagtgtgtgtcagtttcataaaagttccccatgtatttaaaaattggatgtgtactctaattttgggattgctttttcattgtctatatatgcttgctaatttttgatctgctgggttactgagaaggatgtgggtttctccatctagttctatttttggttaatatgttaggcacagagctgttgtttttttgtggtgaattgaatcttcatcattctttagggactctgtccttaataatgctttttttgccttacattttgtttcattgtaagagagctatgtcagagtactttttaaaacactttttaatatggtatatatttttttcttttttaatgaggttttttaaccgtaagtttaagcaaaataaagcttaataactggattttatttagttttaaatttaatttgatttttttttttttgagactaagtctcactctgtcgcccaggctggggtgcagtggtgcgatctcagctcactgcagcctccgcctcccgggtttaagtgattctcctgccttagcctccctaggagctgggattacaggcgtgcgccaccacgcctggctaatttttgtatttttagtagaggcgggctttcaccatgttggccagtctggtctcgaactcctgacctcaggtgatccacctgcctcagcctcccaaagtgctgggattacaggcatgagccaacactcctggctaatttaattcgatttttttagtagcagttttagtctattatgtttgttgtagttactagtatctttggatttatttctacctaattatttggtgattcctcttcttcctggttccacttacacattaaaaaaaaaaacaaaaaaaacttagaatagagatggtgtctcactatgttgttcaggctgctctcaaactccagggctcaagttatcctcctgccttggcctcccaaagtgctgggattacaggtatgagccaccatacctggtcccccttgcccattctgttttacttttgtattgcttgggtttctaaaattccattttgtcctctccctttgctcttccccaatcctatctcatcacacacactggtttggaagatagccacttttttttttccaatgtgtttacttatcttatcagagtcaaaagcctatcagtatcttctcagatatcccaaaaaatactaggaccttaagacacctaaaatcaggttacatttcttcataattgtctagtattctagttctatcagttttacctctcagatctccattctgtaagtcaatgttaagtttagatttgtccatatgcatacgagtttctttggtattcaatacttcctgtatatttttaagaagttcctttgttggaggtctgttaggttttatttgtttgaaaatgtctgtatttcacccttgttcttgaaggatggtttttctaggtatacagttcttttttttttttctttgatacagttttgctcttgttgcccaggctggagtgcaatggtgcgatcttgactcactgcagcctccacctcccaggttcaagtgattctcctgcttcagcctctcgagtagctgggattacaggtgcccaccatcacacctggctaatttttggtatttttagtagacggggtttcaccatgctggccaggctggtcttgaactcctgacctcaggtgatctacctaccttggcctcccaaagtgctagggttacaggcgtgagccaccgtgcctgacaaaggcctaactttccttcctcattcttttcatcttgtttcttggtttcatcatcccattttttagtttcttttcagtctccttttgtgtagcctgaagcaataactgtgtttctgatgcctaggtaagtatactgtaggtaggctgatactgttcagctagtacatagtagaagtcagatgtcacatttttagaatactccagttctagataagaataccttgttgggtgatatattttattatcctggattgtttggcggatgtaatggattgctgaagacgcccagtttcctgtgtggcccttgagtatttattttagtaagttagaggctagttgttcacttttcccttgtttaactggggactcctcagcagccctttcaaaacagtataacctcatctgagaaaggaaaatgtaaggatattcattaagttttcttctctccagatttgggattatttttaggaattctcaagagttttgttgacttaccaactaggtttcttgaagatggtgagtgaggataggaacttggcctggtttggctcacctctcagattcattggaagaggcaagttcattagcacagtttcagtccaccattacagcatttttttcctgaattattataagtcttagtcaatatttccagataatcatcattatctgtttaaattactgcacagtattctattttactgatgtaccattgtgcaaatactatgatgttttattatttttaagttttgctataacagataagtctgcagagattttattcagctctgtattgttttgcttctgttgcattgtttcctcagattgaatttctaggagtagaattgctatgtcaaagagaataacaagtatctctgagccttgccgcatactgcttttttcatttttaaaggttataccaagttagagtctcactagaactgaatgagtgtactaattttactgtagctagtttctttttttttaaaaaaaaaaaaagctgtagaataatctcaaggttgcttaaatatttctgtcttttattcttacagcatttcctgtggattagttcactacttattttcttatctgtgagttgtaagtgcttacacatgcccacttgatgaccttgatgttttcttacacatggaagcaagtgctttttgtaaaagaatatattaacctttatctttttacattttgtgaagctttttttttaatgtttcatcttttaaaaattaggtttattcagaattttaaattttaatattatattgaatttcttttggttggtttaaattgagaaagttattttatgtatattctctttttttgctagctttctgtaatttgattttaattccttattccttgcatagtttgcttctggtatgttaaagtgtgctctctctaagtgggtagtaattaggaacaatttatctcaacctcatttattgaatgttttaaatcaagagaacggactctgttatattaagcttctatatataattgtctgtttcactgtaatgcctagtaaggatacacttcattctttttttagatgttctttcacaatttcatgtaaattttagttgttttgtttcaaaaaacaattcctattgaacaatctctaggaatagatagcttaataataatattagatctagttttctcttttcatagtttacctcttctttcttttctttcttttttttttttttttgagacggagtctcgctgtgtcgcccaggctggagtgcagtggtgcgatctctgctcacagcaagctccgcctcccaggttcgcgccattctcctgcctcagcctcccaactagctgggactacaggtgccccccaccactcctggctaatttttttttttttttttttttttttttttttgtatttttagtagagacagggtttcattgtgttagccaggatggtctcaatctcctgacctcgtgatccgcccacctcggcctcccaaagtggattacaggcgtgagccaccgcgcccagcctctgtctctcttttctttttctttttcttttcttttcttttcttttcttttcttttcttttcttttcttttcttttctttcctttcctttcctttcctttcctttcctttcctttccttttcttttctttcttttcttttcttctctcttctcttctcttctcttctcttctctgtctttttttgacgagtctcagtatgtcacctaggctggagtacagttgcacaatgttggctcattgcaacctctgcctcccttgttcaagtgattgtcctgcctcagcctgccaaatagctgggactacaggtgcgcactgctacgcccggctaattttgtatttttagtagagatggggtttcaccatgttggccaagccggtctcaaactcctgacctcaagagatccacctgcctcggcctcccaaagtgctgggattacaagtatgagccacgatgccagtccaattcttgtgtagttttttaatcagctgaatttaacattcaaattcttcttttaaatcttccaataggcagttatctttataaagatcctatataatcaagactttgtttctgaatattttatgtatgtttttgctactgtaaatgagatctatttctcattgtggtttcttgctgttattactggtaagaatttagtgaaacaaagtacttaagagtatgtctttaaattgtgagattttgatgaacttttaagaaataaaattctttagtttcttagagctttttgagatttctaaggtagatccttggtttgggcaacatataactattacaagttttgcacattgaacgttatttggtaatttttagagaggacattttaaatgtttaggaaaaatataaataaaatgtagaatactattgggggcatatacatcatcagcactgtaactgtttcatatgaatcatttttgtacatatagaactctaaagtcctaatgaacagaattttacatttctataaatagaaagtccttaatagttgtgactgaataacttatggatagcaaattatttaactgaaaacagtaaaatttaagtgggaggaaatatttgctttataatttctgtctttacccattatttataggattttgtcactttgttctgtttgcaggtggaaaaccatgaattccttgtaaaaccttcatttgatcctaatctcagtgaattaagagaaataatgaatgacttggaaaagaagatgcagtcaacattaataagtgcagccagagatcttggtaagaatgggtcattggaggttggaataattcttttgtctatacactgtatagacaaaatattgatgccagaattattttataagttccctgtccccaagatgatgacttcacatctctgtcaaacagaaatcgcccaacaggcccttgtatgatgtcatttaaacaagccctattttaaatgtcacctccactggtaacaggatactcctaggaggatcaccaagcccaattcttctaggagtagtgcattgattaggctttggggtttccaagcagttcattaatgtcacttttggaaaaagtctgtctttcataccagcttattaattccctatgggttcacacggttttttttcctggattttcatcaaacatgtgtaaggtactcagtacaaagaagtttagaaatccagaacaaagcagtgtatttaagtagtagtaaacttccagataatctgatgcccatatctacatatataaaaaatttgcaaatagttctgtagagagtccaaacatggagtagatccctaattaagagcctttgcattaaagtccaccttcctcatttcatagctaaggatattgaggctcagagagtttatgtgtctggagttaaagttattttgtgtttccttaatttttgacttactagaaagttaaagtacctacagatttctgtgtttcactatatgttaacttgcttggctggaagtttttctgctgataattggttttatgaaggaagaatcctgttaagaatgcatcattggactgggtgtggtggctcacgcctgtagtgatcctagcagtttgagagaccgaggtgggcagattgcttgagtccaggagtttgacactaacctgggcaacatgatgaaaccctgtctctacaacaaatacaaaaattggccatacatggtggcacgcacctgtggtcccagctactcaggaggctgaggtgagaggatcacttgagccagggaggttgaggctataatgagccataattgcactactgcactccagcctgggtgacagggtgagatcctgtctcaaaataagaaaagagaatgcatcattggccaggcacagtgactcatgcctataatcccaatactttaggaggatcacttcagcccaggagttcaagactagcctgtgccacatagaccacatttctaccaaaaatcaaaaggaaaaaacttgctgggtgtggtgatgcacacctgtggtcccagctactcgggaggctgaggtgagaggattgctttagcttaggtggttgaggctgcagtgagccatgatagcaccactgcattccatccagcctgagggacggagtgagagcgacaccttgtctttaaaaaaaaaaacagaggaatgcatcatagtatatattaaattattgcctatttttttatctattttattgagtgctaataagaaaattaatggcaaaaacttgttttttacagtataaattaagtttaatttcattttaaaattaagtaaatttgttttattaaaaagtatgttgaaagcaacataaatagcactcaaattgagacagaaactgtaactgtagtataagaagcattaggctgggaattgggaaacacgagttctagttgcagcttggaaactttttctgaagctctttacaaattacttaatttctctggttttcaccacattgttctatagcattaacatgttggattcattgctttaattcttagacctacgtgtcatcagaaatgccattacactttgaggatttgagccttattttaaataaagttgtgatcctcatggcagcctaggtttacatgtgttaaataaacagtattctgtaaataccattgtctttcatgtttagtgatgttgctgttgttaacactgcagtgaaatgcatatataagcaaactacattacatactcatgaacatggtcctttgttttgaaactttgatcactgattgttcgcagtctttcattgtggaactactctttcactttgaatgttttgagaggttcctttgttcagatcagtccgatttcgtttctgggtgggtctctactttcccttttctcactggtcaagcgaggtctgtctaattgtttgctactactaacatttgatggccacgcttcagcaagtacatttgtagattctctctctctgtctctcttaatttgtggtctagagatcatattggttaatgaaattatgaagagggaatgtatttataaaaactcaaattcttgatgcagaaggtctagctgattgtgaacccaaaatatccgagacaggtcacaaccaatttagaaactttattttgccaaggttaaggatgcatccatgacatagtctcacaaggttctaatgacacatgcgcaaggtggttagggtacagcttggttttatacattttagggagacatgagacatcagtcaacatgtgtaagatgtacattgattctatccagaaaggcaggacaacttgaagcaaggggctttcaggtaataagtagataagagacaaaaggttgcatacttttgagtccttgatcagcctttcactgaataaacaagcttagtcttgttagtgaatctgcgtttttacataaacagtaggtcagaggaagcaatcagaaatgcatttgtgtcaggtgagccgagggatgactttctgtccctcacctgtgaagataagctatcagtttccattgctagggtgaaattcaacagaattgtttgagagtgaacatctggaggcccacaaggactttccttgtggaggggaagtatgtagtgagggaagtatgtagtttttaaatctttgtcgctatcttatttagaaataagatggaaggcaggtttgtctgacatagttcccagcttgacttttccctcggcttagtgattttgcggttccgagatttattttcctttcacatatcagtcagatcatttggtttgtgaagtttcctatgcttaacagaaaatatgtgcactagttttcctagagtttcattgtcagagtctcaagtttttgtttggaaattgtatttggtcacattaattatactctatgttagttccaaagaaatacctttggttaagaaaagaattctcatgcataactcctcgagggtggggttacaccttaatccatcctcaggtgctcatggtaattggggcaaatatgttgcccagtgctggtgctctgcagccttggatgggtttacccagaaagcagctttcaagtcagaaactaacattcataagggagttaaggattttataaatagatatccataattcatgtagttttcaagtaagtagtatttgaatcttttctggttagataataattgtgagtatgttgtcatataataacagtatgtttttcactatttaaataattttagaattacattgaaaaatggtagtaggtatttatggaatactttttcttttcttcttgattatcaaggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacaggtttgcaagtcgttattatatttttaaccctttattaattccctaaatgctctaacatgatgtgaatgttctatgataagttttactaatgtagtcatcaggtaagagtcaagctttcttccatagagcagtcagctgtcgcaacaccatttgttaaatagtccgtctgttctccattgactgaagtggtactttgggtctattttaaagactctacttttacctcgtctcaccattcttttgtctacacaaaatatattttatcgcttattctgtgttaccatatctattagagctagttccccctcatatctctgctttagttattttcacatgtttcttttatcttttttttttttggagatggagtctcgctctgttgcccaggctggagtgcagtggcatgatctcggctcactgcaagctccgccttccgggttcacgccattctcctgcctcagcctcccgagtagctgggactacaggcgcccgccactgcgcccagctaattttttgtatttttagtagagacggggtttcaccgtggtctcgatctcctgacctcgtgatccgcctgcctctgcctcccaaagtactgggattacaggtgtgagccaccgcgcccagccttatcttttttttttttccccctgagacagagtcttgctgtgtcgcccaggctggagtgcagtgacgcgcagtcttgactcactgcagcctccacctcccggattcaagcgattctcatgcttcagcttcctgagtagctaggattataggcatgcaccaccacgcctagttcatttttgtatttttagtagagatgggttttcaccatgttggacaggctggtctcggactcctggcctcaagtgatccacctgcctcagcttcccaaagtgctgagattacaggtgtgagccaccgtgcctgacccacatgtttattttttctaagaaaactttactatcatttatcaagttaagaaaattattctgatatttcaattgggtgtttaaattagttgagggaaatatgaggccattcactagatgataggttttttttgttttaatcatgtttcatgttgaaacaaaaaagttttttcctgccagttttctggctaatctcaggaagtccctgaaacaaattattgataagtaaaaaaaattatttaaaaaattttaaattatatttaaaatcttctgtgacttatggtggggggaggctaaagcctttctccttctgtactgttctggaaactatggcctgttctactccctcccctcctgaattttcccagaactttacaggtagcttttatatatatgatcccctgtcgtctgtttaacaagtactttgagtgtctattatatgcagacattctaggtgttcagacaccctagtaattagtttgttcctcataattctcagtaaagaagacatgtatatttctcattttataggtgaagaagctaagactttacttttcctcagttagacagctagtgctggtgggtgcctaaacttagatcttccattgccaaatctaggtgtgttgtttttccagcacactagaatcctcctggttcaagaaatgtatatattttagcttggataagatacaacttttggagtgttctaatcatcttcaagtttttcgtggattagttataacatatgaaaaaagatagggctgaatgggccacatgatgccaaaagtgaaaaagtcactcactagattatgacctgcagaatctggtccttgcctgcctctgcttttatattttgcagcttgtcccttcacacagtggtctcacttttataatgtctttccctcatgcatttctttaattctttttatttgcctgttccatagtagtctgtttgtgctgctacttgcccctgtactgttcttgagctatacatatacatgtctgctgtgccattgagtgattccatcaaggccacaattatcatcttgatgaactgattttctcccactgctgataattacttctctctcctttctttctcctttacatcacctctttttgttcttaatttcattccctccttgatgccagtgagtatttttttcttattttattctcatcttccttgagtattgtttatttcaacctctttttttttttttttttttggagaagggtttggctttgtcgctcaggctggagtgcagtggcacaattttggcccactgcaacctccacctcctgggctcaagccatcccacctcagccacccaagtagctgggactacaggtgttgcccactgctttgtatttttaatagacacaggatttccccatgttgctcaggctggtctcgaactcctgggctcaagcagtccacctgccttgccctcccaaagttctgggattacaggattacagatgctgtgcccggcccaacctctaattttaattttctcttcaaattgttcaataagatttagtttcaagacattttcctggccgggcatggtggcttacgcctataatttcaacactttgggaggccgaggcaggtggatcacttgaggtcaagagttcaagaccagcctggccagcgtggtgaaaccccatctctactaaaaaatacaaaaattagccgggtgtggtggtacatgcctgtaatcgtagctattgtggaggccgaggcatgagaatcgcttgagcccgggaagcagaggttgcagtgagttgagatgacaccactgaaatccagcccgggcaacagagtcagactacgtctcaaaaaaaacaaaacaagctgggcgccgtggctcacgcctgtaatcccagcactttgggaggccgaggccggtggatcacgaggtcaggagatcgagaccatcctggctaacacggtggtgaaaccctacctctagtaaaaatataaaacattagccgggcgtagtggttggtgcctgtagtcccagctactcaggaggctgaggcaggagaatggtgtgaagccgggaggcagaggttgcagtgagcctagatcgcgccactgcactttagcctgggtgacagaacaagactccgtctcaaaaaaaaaaccatttttcttattttgaaaacttttggtattgaaagatatttatactacagtaatgagaaatactgtgtgtgtgtatatatgtttgtgtttttttttttgtttttttctttctctctctctcttttttttttttttgacagagttttgctcctgttgtccaggctggagtgcagtggtgctatctcgactcaccacaacctctgcctcccgggttcaagtgattctcctccctcagcctcccgaatagctgggattacaggaatgtgccaccacacctaactttgtatttttagtagagacgggttttccccatgttggtcaggctggtcttgaactcctgacctcaggtgatccacctgcctcggcctcccaaagtgctgggattacaggcaccctgcctgtgtttgtgttttaaaaggggtaatagcttcagtcttttttttctttctctgagacggagttttagttttgttgcccaggctggaatgcaatggtgtgttcttggctcaccacaacctccatttcctgggttcaagcgattctcctgcctcagcctcctgagaagctgggattacaagcacgcgccaccatgctgggctaatttttgtatttttagtagagacggggtttctccatgttggtcaggctggtctcgaactcctgacctcaggcaatccaccgacctcaggtgatccacccgcctcagcctcccaaagttctggggttacaggcgtgagccaccacgcccggctgtcttcaatcttaaataaggattccatttaaatattttgtaaaaggacacagatcacagttttactcaggggaatataattgttatagcaggaattgtgccattgcgctattccaaacagtgtaaaagaacattaataaattgaattctaactacatttgtccctaaggagttgttcgttttccacttgtatttccattttaattatcattatttggatgtttcataggatactttggatatgtttcacgtagtacacattgcttctagtacacattttaatatttttaataaaactgttatttcgatttgcagcaaattgacttctttaaatgaagagtataccaaaaataaaacagaatatgaagaagcccaggatgccattgttaaagaaattgtcaatatttcttcaggtaaacttaatagaactaataatgttctgaatgtcacctggcttttggtaacagaagaaaaatcatgatatttgaagtgtgttttgttattttcgcaagccattacattctgactatttaatatgttaggtttcctatataaaataaggcatggtatgttacagtaggacacataactggaagttactcttgcacatagaaacaaaaaatggcagaaaagcacaaaacttactatagttgtaacagggaaaggaaacactagggcctacaacgtactaatgtcttgggtcatctatgggctcatgaggctctaggttatggaagtaaataccactgaaaagcaaatattaattacacatgaggcaagcctttttgagttctgtatgtcattttgtagattttgagttcattctagtggcaccatttgagatcattttcatgtaattaaaggaacacagcaacctggcactgtgttattgcccttagaatggaatgaatatatgtttagcacaaggtaggaagtgatgcgttaagttggaaggctttgccgatcatggtgtgtatgttgactaacctttattgtgcctttaaaaaatatactcaagaactaccttaaccaagtaattaaagtcaagattaccagttgtgggacaaatgacatgtacttcctggtgtgatatagaaggaaggacacagtatcacctatatagtattcttgaccagaatatttaacctgattttaaacaagaagtaaaaattcaaataaatttagattgtggtgcattcaaggcctgaactttaataaatgtccatgtcacggcagcaaaaaagaaatcaacaggtcttaaagagacagggcaaccaaacgcagtaggcagtagttgattagatcccaatttagaggttggagttggggaatagctatagaggacactattggggcgaattgagaaagtttaatatgagacaatatggtgttagtgtcagatttcttgtgtgaaatggtagtgttatgattaggagaatgtccttgttctcaggatatgcatgctaaattatttaaggacaaatatttttttaaaaggttatgtgcatgagtaattctataaattgtgttgctattatgaattgtcatggtaaatcaaaaggaaacataaaactcaaaaggttttattttaatacactttatgtattgaaatgaatggaattgatttgtaaagattacatttttgcttgttggtgtcagataactgtgacgtaataatcttttgctgaattatgtttcttaggctagatttcattttaaagaaccctgtaaataccatttatttgaactgtggatcttccttaaaaaataatatttattaagcacctagcagggtaaagtttttagattttaacatttaaattgaaggttttatattagaagtcaacctgaatttaaatgaaacttcttcttggtctgatattacatattatgagctatttttatttaaaaatgtaatggcggccagacatggtgattcacacctgtaatcccagcactttgggaggctgagctgggaggattgcttaagcccagaagtttgagaccagcctagccaacatagggggaccccaactctacaaaaaaatccaaaaaatattagccggctgtggtggtacatgcctgtagtcccagctactcaggaggctgaggcaggagaatcacttgaacccaggaggtcgagggtgtggtgagccataattatgctactgtacttcagcctgggcgacagagcaagactcccatctcaaaaagtgtaatggatcactttaataattttctatcatacaattaagtcataaaaggtcatgctattaagagccagttatgtgacatgccaagtatagactcttaattaagatgctttggtttgctttttatttatttatttatttttcagatggggtcttaccatgttgcccaggctttagtgcagtgatgcgatcatgactcactgcagcctcaacctcctaggttcaagggattctccccacttagcctcccaagtagcttgggactactacatgtagtagtgccaccacacctggttaatttttttttaattatcttttgtggagatgaagtctcactctgttgcccaggccagactcaagcagtcttcctgccttggcctccgaaagtgttgggattacaggcgtgagccaccctgcccagcctagttttcttttttttactataaacttattcttgtcagtatgctagcaattttacaagttttaaagtagttatagcaagtacttcactcatgtttaattcttaaaggcttctattgctatataatagggtagtctgaattcttcaaaagtgtactgaggccaggtgcagtagctcacacctataatcccagcattttgggaggccgaggcgggtggatcacctgaggtcaggagttcgaaactggcctaaccaacatgttgaaaccctgtctttactaaaagtacaaaaattagctgggtatggtggcaggtgcctgtaatcccagctactcaggaggctgaggcaggagaatcgcttgaacccaggaggcggaggttgcagtgagccaagatcacaccattgcactccagcctgggcgacagagcaagactctgtctccaaaaaaaaaaaaaaaaaaaaaaaaaaaaagtatactgaaacagaggaagataattaggtctgcttggccattgttaagttgatttttattttcaaaacatttgatcactgttgtggggaacaagggaataaaaaataagttaaatttccagcccctagattaaactaataatttttggttttcctagaattaaatgcttttatcttgaatgttctgtgaagcttttgacatgattgatagctgtatgatagtctgaatgacatgtgggtcatgcaccagcccctccaacctgttaacatttagaatctattcagaaaaatttaagcattgttaatttcctttgttttttgtctagcatgtgtcagatttttttaaatgtatttattaatagcttttaatgttaatactctagaacagtagaatcttgaaaatgttttaagtgacaattagagatttaaatttatgctgacatcctctgcatgtgatactgatgaggaaagaaagccaaactgtcttacggtcagttcgtacaatataccaggccttgatggtcacatttcaacttgctacctttttgcttacatttttcttatggtgattttgaggtgtcattctggtttctcagatacttaaaatataggaaaaggtgtgtcttaaaattgagagaatgtcttggataagcagctgtgtagttttatattttgctgataagggaaggtactctatttttgttttttgtgtgtttttgtttgtttgtttttgagacagaattgcccaggctggagtgctgtggcgcaatctcagcttactgcaacttccaccttctgggttcatgcaattctggtgcctcagcctcccaagtatctgggtttacagacatgcaccaccatacctggctaatttttgtatttttggtagagatggggtttcgccgtgttaccaggctggtcttgaattcctggccccatgtgatcccccggcctcatgcgatctgcccgcctcagcctccctaagtgctgggattataggcgtgagccacccaacccagccagtactctgtttttgatagctattcacaatgggaaaggatgtagcaacacattttaaccctatgttgagttttaggtgggttcctttgaaattttgttaaggctaacttttgttaatttttttaaaaaagtgtaaattaggaaatgggttttgaattcccaaatggggggattaaatgtatttttacggcttatatctgtttattattcagtattcctgtgtacattttctgtttttatttttatacaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggtaaaaaacctggtttttgggctttgtgggggtaacgttttgtttttttttttttttttttaatcttggagtagaaatatatttaaaattgatggagaaaattcccagttcttaacattagaaagggaatatattattcttaccagttagtaatctattcacatttggtttagagggaagatttagaaggtgagataaaagcttgtgagagaatagtgtattcatgtgaaacttcttccatgggttcagagcatttagaaacaaacatcccttcacactcaaagcttacctttgagccagtcctccaatagtgaggtctttgaaggtcaggccaaattggctgtgggaggacctcaggttaggataggaattattttaagacatggcactatattcatgtgaaactcgcaaaaactagccttgcatataggctcatgtatcatgtctcagctgagatgtttgagagatcttaactagattctagaaaacaaaaaaggaagtagttttggggcaaatatatttgggaaacagtttattgtatttcctttccccaaatggattttcaagttcttcatataatctaaccccaacaaataaattgcctgtttttcaaaagaaagatcatgtcttcaggtttttgtgtggggtttaaatgattcgaaagatttgaccatactgatacattcactagtaaccttagttactaatgagtaatggttttgagttaatcagttaggcctgaactacttttctggaagttagtaaattatctcacaggcagccctgtgagccatgggaaaatgtgtatatggtctttctaggccacagtcaaattacaggtatatttgtcatggcttctcttgatgaaaggcccagtatcggtttgtctgaagatatataatagcattgcttttgggggtaatatgggcagtaactctgtccacatctttgggcaggctgtggttctgcctttatatgctatgtcagtgtaaacctacgcgattaatcatcagtgtacagtttaggactaacaatccatttattagtagcagaaagaagtttaaaatcttgctttctgatataatttgttttgtaggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtaagtgcatctcctagtcccttgaagatagaaatgtatgtctctgtcctgtgagaaggaaaagtatatttgcagattctcatgtaaaaacatctgagaatgtttgtcttagtttaatagttgttttcctgtggactttatatactttgtattgtcttaaaagagtgattgatggtagctacggaaaactttgatttttaaaattgtctctttaagtagacaatttataagctactggtacgagttcaccttataaatctccactaccatgtttttgcttggactgttcacacttcctggaatggtccttcttgccgtttatccaacttctttctaatttttaagtccctaatgatgggaattctatttctgtagtgatttttctggtcatacgaccgtaaggtcatgggtgtttttctctgaattcctcttgagatgcctgtaacttgaaccacgtttttattctagacattactgaaatgttttgtctttatttcactttttaggagcttccttgaaggtagggactataccttctatttcttggtatctttttctttctttttttaaaagttttttagagagacagggtctcactcttttgcccagactggtctcgaactcctgggctcaggtgatcttcctgccttggcttcccagagtgctgggattacaggcatgaaccaccgtgatcctccttatttcttagtatcttctaaagaacattaaatatagtaggtgcctagtaaattatgtattgatttaacttctttgaggttctgttgtttgtgaagaattataaaagcaatacaaatgtttgtatagtaattaagcaacaggttaatattcatgacttaaaagattaaagaaataagcaaaacatgttagctggcaactcacagaaaaagaattaaattgccaatgagcacacgagcacatgaaaaattagcaaaagtttcacccctttacatatatttggttaaaattgagaaaagaatagtaatagatggtattggtaggactgtggcaggcacacaatttacatgaccaccaaaagtgtatgcaggtatccatgtcaccacaccctggtctcatcttcattcagttttatttattttttttaatctcggcctatttgattggcacgaaatgaatgatagctgccttatttggaattcctttgattactactagtgtgcttgataatgtaaaacaatattcaaaatctgtttttcctttcatccgttgtttgttcatgttcatgacctttttttttttttcctattctcctccctccctccctccctccctcccttccttccttccctccttccctccttccctccctccctcccacacaaaggtgtgtgctaccatacctggctagtttttaatttttttttttttttttttttttagaggcaaggtctcactatgttgctcaggctggtctgggctcaagtgatcctcccacctccgccttccaaagtgctgggattacagacgtgagccatcatgcctggcccttgcccatttttctattgaagttttagtgctttttattgactttgtttatatattaagataatccattatgtttgtggcatatccttcccaatgtattgtcttaattttgtttttgtatgtgtatgttaccacattttatgtgatgggaaatttcatgtaattatgtgcttcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtatgtactattggagtactctaaattcagaacttggtaatgggaaacttactacccttgaaatcatcagtaattgccttattctaagttagtataaattattgatgttgttatagaacccatttaccccttaattcacagtctgggggtaggaacatgtacatcatatttctgtatctcatagtaggaccactcattctaaagcattcacagaaagaattatctgtactctttttgggacagaatctcgttctgttgcccaggctggagtgcgatctcggctcactgcaacctccgcctcccgggttcaagcgattctcctgcctcagcttcccgagtagctgggattacaggcgcctgccaccacacctggctaatttttatatttttagtagagacggggtttcaccatgctggccaggctggtctcgaattcctgacctcaggcaatccacccgtctcggcctcccaaagtgctgggattacaggtgtgagccaccacgcccggccagaattatctgtactcttgaacatcaccatggaggcattttctgctacctcccatggcagtatgttttcttgttgaattaggataacaaacaatatgctttcaagttccaaagttctagctgttattgtttaacaaaatcttcattataattagcttattttgtgtttaagagtgtgttatagaaacaggttcatttaaagctgggggttccagaaatcttgaaatagtagttatcacatgcagagtgacttatctgttgttgtttcatcctttcaggaaagtttgtcattcgtgggcttgggatctagtcagatccctgtattgatgagattcacatgttataaggctttcaaaggttttaaaaatcatactataaggattgatttcactagtcaccagaataactttttcagatagcgctctgattttccacgaacacgtttttctgcatcagttggttgcacatgagtgagataatcttggttctttatcctttgttatttgtacttcattgggaatccttttgagttagtatatttgagtcattattattattgctgtagaattcaggaacttttagtagatctggcagcataaaattttgcttttaaatcattgtttgtgttttgtatgctatagaaatgggttcagaatattttttaaaaggccagatgaagtgtgaagatagaaaaacttcatccttcactgtgaatgtttaacaaacatttgcttctactttatttttgtttgcttcctttagttgtgcaaagtattcagttctagaatgcatgagatatatgacaaagccaaaaaattctttatagttgataaataattgtggcaaaaacagctgtatagtaactttgcaagcatcatttgattaaatgcttaaaaagtcttgactcagttttaactatttcctgcaaataatcaatatttaattaaagctactccaaattagtgacactttacgtgtctgtctttctccctccccttctcccttctcccttcccccttctcccattctcccattctcccttctctcttcttcctttcctcttcccttcccttcccctttcccttcccccttccctcttctcttcccctcccccttcccatcccccatcccttcccttcccccatccctttcctttccccttcccttccctcctcttcctccttcccttcccccttcctccttcccttcccccttcctccttccctttcctcttccctttccccttcccttcccccttcccttccctcttcccttccccttcccctttcccctccccctctcctcccctcccttaccttcccatgaaatgagaaagcctcagagatagtggcttgattaatttttctttagattaagatatttgtctaagcctttaaggtttatctattgagcttttttgtctcctatttttatttttcctactatgtttgtcgaggataaaatacagcactgtgtgccaagtcataatcacttttcatttgagacttaattaaaatgcctttattttaatgatatatttggctaatgtatttgaagtaatccgaaattaagttttctaatgacaaggtgagaaggataaattccatttacataaattgctgtctcttctcatgctgtcccctcacgcttccccaaatttcttataggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagaggtttgtcagtttgttttcatagtttaacttagcttctctattattacataaacaggacactaagatgaaggttttttgttgttgtttgttttcctctgtgtttctagtgcttattttttaatcagtttttttgatggcaaagaatctatctctgtgttattttgatttctgcagtatatacatctgcatgatcaatattcgatttcaagtaccaaagtaggagtaaaggaatattaacctaggtttaaaattagtcatttcactaaaattagttattatggacgatagatgtctaggtatatctttgttcataaacgaatatatcaagttcagttattaaattacacattaggtaagaaaaggacaaagaaataaaaaagcatgattcataattcctgccctctatttgtctagaatttagttgggaagataagaataacgaacgtgacacagagaataaagtggcatatgacaaatatttattcaagaaagctatatgtggacgggatgtttcagttctcatgggagaagtggattttatggtgcctttgagtaatgggtcatatttgggcgttcacacagaaagacccaagcatatgcctaattttttattattattattttttatttatttatttattttttagacggagtctcgctctgtcgcccaggctggagagcaggggcgcgcgatctcggctcactgcaaactctgcctcctgggttcacaccattctcctgcctcaggctcccgagcagctgggactacaggcgcctgccaccacgcccggctaaattttttgtattttttagtagagatggggtttcaccgtgttagccaggatggtctcgatctcctgacctcatgatctgcctgccttggcctcccaaagtgccgggattacaggagtgggccactgtgcccggcccttttttttttttttttttttaaattagaggattactagttctcttcaattataaaaataaaagaatcttatttcactgcctggtcctggaaacatgtactgcaatatacattgtgacaactttttacctgtcatgtttttagcttttacctgtgaatgtcttatcattgttcttatctgaaggatagatagttgctacaataataatagatggtgtgtatggtttttgagcctaaaaagtgtagttttatctgttgtacctatacaagcaggagaaatataacttgttaataattttaggtatggcaggctgccatcctaaatatgaagtggtctttgtatttgcactttaatgtgttgaaatcatagctttcagtgatccaggattaggcagactcttttatgcaatctcttgtttccagttagaatagaagtcgtgtacttttgataacattaattataatatattttgagccctgtgaggttggtaacattattcccattttatgaatgaggaatgtgtgttaaggagtttgcccaagagtcacatagcaagtcatagtcatgctctctgaagcagcaataacttggcaataaaataaaaatgaagcatcttctgtatgtgttaacttttcagtgactgtttatgccttccagtattctttgtaaaccttgaattctttttttcacagatgattaaagtttatcaattgtaaaggtggaggaatttgggaactagacagtgcacacataaataataaatatgttcttcaaatattgggtgggctaatgtgggaggagtttgagaccagcctgggcaacatagtgagaccctcgtctctaaaaatatgaaaaataaaaaaaaaattttttaaatgtgtgatatgtttagatggaaatgaaacaatttgtcactgtctaacatgacttttagaaaagatattttaattactaatgggacattcacatgtgtttcagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaatttga

SEQ ID NO: 2599 - DNA, 80162 bp, Homo sapiens; identical to SEQ ID NO: 2598
  source 1..80162: mol_type = genomic DNA

SEQ ID NO: 2600 - DNA, 22731 bp, Homo sapiens
  source 1..22731: mol_type = genomic DNA
agcggttaggagggcggggcgcgtgcgcgcgcacctcgctcacgcgccggcgcgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaagggtaacctccgcgtgacaggaatgagggtggggcgcgtggagtttcccacaatctgtactttagttaaatacccgagaattcacctcctgtgtccacagctctccacgcccctcagccctgccccgcagccctgtagcagaagtacttagtgctttgcattctgcgcgccaccctaccccggcctcctctgtgaatcgttgcttccgaaccgccctcactttttgcatccgcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgaggtctctgaggggagtagaaacttgaatggagagttgatgggaagttagaataaaagagggttgggagccgggcgcggtggctcacacctgtaatcttagcactttgggagactgaggcgggcggatcacctgagctcaggagttggagaccagcctgggcaacatggcgaaaccccgtctctactaaaaatataaaaattagccgagcgtggtggcacgtgcctgttatcccagctactgggaaggctgaggcaggagaatcactgtaactcgggaggcggaggttgcaatgagctgagattgctccactgcacttcagcctgggcgacagagcaagactccgtctcaaagaaagaaagaaaaaaaaaacagggttgggaagagctgggcaagtctcttacctcctgagtggctgtttcacattcactaaatgggggtgatgatgcctatctcagagatttgagaaaatgattaaattatataagacatggtaaaccctacacttatgagtgattctaatagtgatttcctttcttccttgctggacagatccatctgtgtgtgctgtggaattcaggatacttgggcattgcctactatgatactagtgactccactatccacttcatgccagatgccccagaccacgagagcctcaagcttctccagagaggtggggatggaaccatgaattcctctgctctctgggattgcagatgtgttacacacacacacacacacacacacacacacacacacacacacacacatattttttttttctagacagagtcttgctctgttacccaggctcaagtgcagtggcgcaatcttggctcactgcagcctccacctcctgggttcaagcaattctcctgactcaacctcccgagtagctgggactacaggcgtgtgccaccacacccagctagttttttgtgtgtgtttttagcacagacggtgtttcaccatgttggccagggtggtctcaaactcctgaccttgtgatccgcccaccttggcctcctaaagtgctgggactacaggtgtgagtcaccacgcccagccatgttttacttacattaactcacctcactgtctagcatattttgtgttgctgtaaggaaatacctgactctgagtaatttgttaaaaaaaaaaaaaaagttttatttggcttatggttctggatggttggaaagctcaaaattgggcatcttcactggtgagagcctcagactgcttcaactcatggaagaagggaaggcagggtgtgtagaggtcacatggcagagaagaagcaagggggagggagatgccaggctctttttgacaaccagctctctcaggaactaatagagtgagaacctctcactcatacccaccaacacactccaggaagggcattaatctgttcatgagcgatccactcccatcacccacacacctcctgctaggccctacctcacaacactatcacactggggattaaatttcaacacgatatttggcagggacaaatcacatccaaactatagcactgactcaatatattttacagttgcttcacagaggctccctcttttgtttttatgaattcatttcattatttaacaaatatttgtgaggctgttttttggtttgtttggttgttcttttttgagacagtgtcttgctccgtcactcaggctggaagtgtagtggtgccatcttggctcactgcaacctccgtctcccggattcaagcaattctcctgcctcagtctcccgagtagctgggattacaagaatctgccatcacgcctggctaatttttatatttttagtagaggcagggtttcaccacgttggctaggcttgtcttgagctcctggcctccagtgatctgcctgccttggcctcccaaagggcagggattataggcatgagccactgtgcctggccacaaatatatatgacgtatttacaatgtttcaggtgcttcagattcagccctgggcaaatcagtcatgtctgttctccaggggtttacagcctagtgacaacatccagaacatcccacttccctctcaccatcccaccactcttaactacttttctaaatctcaacttctacctgtgttcccactgtgcagagcactccctactcctagggaggaaatgtttttgagaaggagaggggtaggaagaggagggctatgggttttctcttagtcaaagacaaagatcctttaactcatttgatctctgttctccttccaagttctggatgagatcaatccccagtctgttgttacgagtgccaaacaggatgagaatatgactcgatttctgggaaagcttggtaaggacttggtaaaggatagagggaaaatggggaaggactaatatatggaatattccagggggctagaattgggtgagagggagtgtcagacagaggtagaaggactgagatgtaaagaatgatagccttttctttcctcccccacagcctcccaggagcacagagagcctaaaagacctgaaatcatatttttgccaagtgtggattttggtatctccttccttttgctttgcctaactccctgttccggtgtcccattctttcccccaactctaccttcatcatcacagatctcccctctgccttatgtcatcctaaacctttgtgctcctcatgccctatgacctgtccccccaagatctctcctgctccctaccctttaataacctgcagcttattgggaagcctctgcttaagtcatgtctagggatgagggcctcccctgaggagtggtgacactttttggacagggttttattgttggaattctccccattaagttaaagccttttatcaccaaaccaaaaggcactgcctcagtgacccttattatgatccataaggcacttctataactttcctaggtttacaataagaacaggagtgtactatcctaattagatattaaggcattagtgttactagttctattaataccattattttgaccaaaatcctcaattccagacagatgtctactttcctcagccatttatctttctcaggctgtgctttcagacaagtatctttatattatatgtagaataaaaagagaattagactaagagtctgaaaatttggttcttgctctagctttccattaactgcctgtgtgagcttgggcaagtcaaataatctctcttgcttctattgtctcattcttaaaatggggtgaaaaaattgagctacaagaccgttccctttgcttgcctccctcaaataggtctggagataagcaaacaacgcctcctttctggaaactactccttcatcccagacgccatgactgccactgagaaaatcctcttcctctcttccattattccctttgactgcctcctcacagtgagattggtcctgggggataagggctgggaggcggcacaagtgctagggctgaattctgggaggtactggcctagccctggaaaatagtaactttccctggtgctctgcagcccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgtaggtgattcaccccaaccccaaccaaagtaatgtgggattgggaggcctgaaaagtaaagtgggggtggggtgtggatgtggctgtgacccagtgggtcaagtgctctaggacacccgggagaatctaagggctaatgagactttgggaagaagactgggacaatattcagagagggggacaaaggaagtggagttgtggaacgaactcagactgcttcctgcttttttgttttctgtcctcaggactcatctggtgaacatagatcaagacacttacaggtaaagaggtggaggcatgctgctgtctctggggagggagaaggattaagtttaatgccccaataatcctaatgaggctctagtttccctaatcctggggctattaagatctctctccttgaaggaaagggaaggggggttttgagggaaagagaggaagaaaagcataaagatactagctttcttttctatagggagaaactgaggcaaagaaaagtaagggacaaaccttacatcaagatatgatctcggctgggcgcggtggctcatgcctgtaatccccgcgctttgggaggccaaggcgggtggatcgcctgaggtcaggagtttgagacctgaccaatatggtaaaaccccgtctctactaaaaatataaaaattagctgggtgtgttgtgcgcctgtaatcccagccactcaggaggctgaggcaggattgcttgaatccaggaggcagaggttgcagtgagctgaaattgcaccactgcactccagcctgggcgacagagcgagactccatctcaaaaaaaaaaaaaaaaaaaaaaagacgtgatctcaggaggatatcccctgtccccattccatttatcagtcctcaattcttattcccttcaaaagtccaagttaccccaaactcctccatttctcctcgacagtgttctacagatttttaagagtgagtctcacccctcagtgtacaaagtggccagtggactgaaggaggggctcagcctctttggtaggtgtgccccatccctcatctcacattacaaagacctaccagaaaagcaattggctccaaagatgtgtcccagcctcccttcccacttcactcccattgtcagatatctctttcatgccaatccaaatttcttacctatttgtaccccccgccccccaagcttgagcatcttcccatactttgtggctgtacagtgttgttgcatatcagccattactttaccaattctgtgttccttccctgggtttgtatgaatgtttctactagttgggtacctgttagggactttgggagaccttgtgtatagagaagagttttgtaactgcataactgcctatttgatttgtatagagtctttatcagttgtctctggctttagggtatattagggacatctccgcaaatatccatatagtttcatatctcagtaagttgtgtccaggttttttttttttttttttttgatacagagtctcgctctgtcgcccaggctggagtgcagtggtgcaatatcagctcactgcaagctctgcctcctgggttcacaccattctgctgcctcagcctcctgagtagctaggactacaggtgcccaccacgatgcctggctaatttttgtatttttagtagagaacgggtttcactgtgttagccaggatgatctcgatctcctgacctcgtgatccgtccacctcggcctcccaaagtgctgggattacaggcgtgagccaccgcgcctggccagttgtgtccagttttgtgtgtgtgtgtgtgtgtgtgtgtgtgtgtgtgagacgaagtctcgctcttgtcccccaggctggagtgcaatggtgcgatctcggctcaatgcaacctctgcctcctgggttcaagcgattctcctgcctcagcctcctgagtaactgggattacaggcacctgccaccacgcccagctaatttttgtatttttagtagagacggggtttcaccatgttgcccaggctggtcttgaactcctgacctcaggggatccactcgcctcagcctcccaaggtgctgggattacaggcatgagcgaccgcgcccggccgtccagttttttacatatgtgtgttgggctcttgagttttttgtttgtttgtttgttttttagatggaatcttgctgtgtcacccaggctggagtgcagtggtacaatttaggctcactgcaacctccgcctcttgggttcaagtgattcttctgcctcatcctacctcagcctcctgaatagctggaactacaggcctgcaccaccatgcccagctaatttttttgtatttttagtagagatggtgtttcgccatgttgcccaggctggtctcaaactcctgagctcaagtgatcctcctgccttggcctcccaaagtgctgggattataggcatgagccaccctgcccggccagctattgagtttttgtatttttggaggggcgggagggctcttgagttttttgtgttttgtttgtttgtttatttgtttcgttttgttttgagacggagtcttgctctgtcacccaggctggagtgcagtggcgcgatctccgctcactgcaagctctgcctcccgggttcatgccattctgcttcagcctcccgagtagctgggactacaggtgcctgccaccatgcccggctaattttttgtatttttagtagagactgcgtttcaccatgttagccaggatggtctcgatctcctgaccacgtgatccgtctgcctcggcctcccagagtgctgggattacaggcgtgagccaccgtgcctggccagttcttgagttttaactaggtctgctttgtgtatttttctggctaagtgtccctgtgagtgtccatcccttcccccatctccatgtacggtaatcccagctcatatttgtggccaggcaccagctttggctgcctttgtgccctcccaggccagcttcctcaacaaccagcacctctgacctggatgcctcagcttagacacataaacacattccattccctgtccctgccttgtaacaagttcactccctgccttatccctcacaggaatcctcaacagatgccactgtaagtggggagagaagctgctcaggtgagtgggtcccacacatactacacactaatgcatgaattccatatgcacactacatactaaagcctactaatggcagtatacagattctcacatacaccaccccacctagtagtagtaaagcaactgccctttactgagcactggctaactgcatttcatccttataacagctttgtgtagtagctgatatgcatctcattttttgttgtcagcgcaggtacacatatacccattgatgatacacagacttgcacacatacaagcagcaggaaaaaacacaaaatgtaaggccgggcacagtggctcacacctgtaatcccagcactttggggggccaaggtgggtgaatcacttgaggtcaggagtttgagaccagctggccaacatggtaaagccccatctctactaaaatgcaaaaattagccaagcgtgttggtaggtgcctgtaattccagctactcaggagactaaggcaggagaatcgcttgaacccaggaggtggaggttgcagtgagccaagattgtgcactgcacttcagcctgggcaacagagtgagactccgtctcaaaaaaaaaaaaaaatgctaatgtaacacatggctatgttagcatggttatctttagttatagaaaacacacttcacatttctgtgatgactctcaaatttgtgtctctagttttgaactccgtatgtgaatgttaattgcatatcaccacctgcagttttcacaggcagctcaaactcagagcatccaaactgatgcccaccagatctgttcctcttcctgcattccctttgctggttaatggcattgctggcagtacaccttctcaagccatgaaccttggattgatgctagaaacaaaaaacctgtcattccaaaacagagatctaagcatgtcactcctttttttttttttttttttttgtgactgagtttcgctcttgttgcccaggctggagtacaatggcacgatctctgctcactgcaacctccacttcccgggttcaagcaattcttctgcctcagcctcccaagtagctgggattacaggcgcccaccaccacacctggctaatttttgtattttcagtagaggcggggtttcaccatgttggtcaggctggtctcgaactcctggtgatccgcccacctcggcctcccaaagtgctgggattacaggcatgagtcactgcgcctggccgtcactccactttttaaatagcctaagtagaaagaaaataacataaaccttaggaggttttcccattaccttcaggattaagattagcatcttaagcagtataatgatgttcagggtccatcacgtttaccccagttttaatttccagactcaccttccaaagccccttctaagtcctttcctactggatctaccttatattctagtcatttagggccacttgccattatggaaacatgtcatgcctgtgtttatgctgctccttctggaaagtctttttttttttttttttgagacggagtctccctctgtcacccaggctggagtgcagtggcgcggtctttgctcactgcaacctccacctcccaggttcaagcaattctcctgcctcagcctccggagtagctgggattacagggacccaccaccatgcctggctaatttttgtatttttagtagagatgggatttcaccatgttggccacgctggtcttgaactgctgacctcgtgatctgcccacctcggcctcccaaagtgctgggattacaggcataagccactgtgcccggcctggaaagtcttttccttgttctgtacctatcaaaatcttacatccaggtcaggcgcggtggctcacgcctgtagtctcagcattttgggaggctgaggtgggtggatgatttgaggtcaggagttcaagaccagcctggccaacttggtgaaacttcacgtctaccgaaaatacaaaaattagcccagcatcatggcgcatgcctctagtaccagctactcaggaggctgaggcaggagaattgcttgaactcgggaggtagaggttgaagtgagcccagattgccccactgcactccagcctgggcaacagagtgagattctgtcttaaaaaaaaaaaaaagtgcatcctcttcaaggtgcaatccaactgttaccctttggcttttacaggtacctgtaaggagttgatgtgcaccttctttgtgctcacatagtgcttgtttatgtttttctagttgcactgtcacatcatgttagaattagcagtcagtgaatctgcttgcctccatagctatgaactctatctagtagctatacctgttacctcagtgtctgacacatggtcttgtacatagtagcactcaatgtgtgaacacaacgcaaatgtaaacgcactggtgacatcatctctaaacagagtggaaacctttgctagcctcaggtgcacaatccttcccctacctcacctcccgctgcaatatgtatcttgtaggagttaatttaggataatctctgaggtcatctccaggtaatcagcatctccaggaatcggcagggtaatttaattacccacacattcttcagtgcttcaggtgcagatctttaatctcagccacagatgggagggagagaattctcagtggagaagagagctggatttaaggtcggggaggaatgcgtattccccaaatggaatcagacagggcatgagatcatataacttgaagaatcatcatataatctaatgaactaaggacaggtgacatatttattaatatttctgtatacgaatttattttaatttattaggaaatacctctaacgtacaaaaagatgtaaataataatatagggccagatgtggtggctcacgcctataatcccagcatttgggaggctgaggcaggaggattgcttgaggccaggagttcaagaactaaaagctgtacaggcaccaagaatatgactgaatgtcacagtatgctctaaagggcactgtcctaggagtctggagacatgattttgagacttagctgttctcattggcggtatgactttgggcaagttgcttatcttttaacggtttcattttctcagttgttaaatttacagtttggtttaactaaagtctctcccagtacgagcagggcgtgagtcagagatacctaagtgtttagtgcagcgcatgtgctttctaaagtggggatggctatttacagactggcctacactgttctggtgggagccctcagtgaccaaggagcagaggtacctgaaacccacccttgaagccatctggatgctccgcttcattcaaatctggggtgttctaacccaaagtaactggccacagactgcaatgtaagatacaaatcttcaggacctagtgtgtgcacatgttggctcttatataagatggcatccttagtacttgttctatgtagaaaagaatttgtgggctcacaagtccctacagagtctcacactctcatggccaataagtatacagggatacccggaattagacaaacacagatgagacatttatttctgtatatgaatttattttatttatttatttattttttgagacagagtctcactctgtcacccatcctggagtgcagtggcctggctcattgcaagctccacctcccgggtttacaccattctgcctcaccctcccgagtagctgggactataggtgcccgccaacacgcccggctaattttgttgtgtttttagtagagacggggtttcaccgcgttagccaggatggtcttgatctcctgacctcgtgacccgccctccttggcctgccaaagtgctgggattacaggcgtgagccaccgcacctggcctgaatttattttcatttattaggaaatacctccaacacacaaaaagatgtaaataattagccgggcgtggtggctcatgactgtaatcccagcactttgggaggccgaggcaggtggaacaccagaggtccggagtttgagaccaggctggccaacatggtgaaacctcatctctactaaaaatacaaaaattagccgggagtggtggtgcacccctgtaatcccagctactccagaggctgagacacgagaatcgcttgaacctgggaggcggaggttgcagtgagctgagatcgcaccactgcactccagcctggacaacagagcaagactctgtctcagaaaaaaaaaaaaagatgtaaataataatactatcgggccaggtgcagtggcttatgcttgtaatcccagcactttgggaggccatggcaggaggactgcttgaggccaggagcttgagaacagcctgggcaacatagcaagacctcgtctctataaaaactattaatagtaatacaaatggccaggcgcagtagctcatgcctgtaattccagcactttaggaggctgaggcaggcagatcacctgaggtcacgattttgagaccagcctggccaacacagcgaaaccctatctctactaaaaatacaaaatttagctgggcatggtggcacacacctgtagttccagctgctggggaggctgaggcaggagaatcacttaagcctgtgaggcagaggttgcagtgacccgagatcccgccactgtaccctagcctgggcgacagagcaagactccatctcaaaaataataataataatacaaatatctatatatccatcagccaatttaagaataagacatgccgggcgcggtggctcatgcctgtaatcccagcactttgggaggccgaggcgggtggatcacaaggtcaggagttcaagaccagcctggccaagatggtgaaaccccgtctctactaaaaatacaaaaattagctgagcacagtggcgggtgcctgtaattccagaacctgggaggtggaggttgcagtaagccaagattgtgctactgcactctagcctgggcgacagagcaagactctatataaaaaataaaataaaaaaaaagaataagacactattggccgggtatggtgactcacgcctgtaatcccagcactttgggagccgaggcgggcagatcacgaggtcaagagatcgagatcattctggccaacatagtgaaaccctgactctactaaaaatacaacaattagctgggcatggtggcgcatacctgcagtcccagctactcgggaggctgaggcacgaaaatcacttgaacccgggaggtggaggttgcagtgagccgagatcgcatcactgcactccagcctggcgacaaagcgagactctgtctcaaaaaaaaaaaaaaaacgaaagaataagacgttgttgaagccccttaaatgtccctccccaatccttttttctctgcagtgttgaccattattatgaattaaagcttatcatccctaatgggacagttatgttttcacaggaagaatatgaaaagatgaatgtctgttgctgttacccagagacactttcacagctaaaaagacatacaaactcatactgactcaccgtctcttactcagcctcagagtgagctgcagtgttggcacacaaatacctcaacacactgctctccttctaaaatattgacaagctccgttacttatatacatggaatgacacacggtcttatccgttgaaactgtgatatgtagacacaattatgctcacatctagcaattttcagtagatacatgtaaacacacctgaatgggtaggacactgcacttgccactacattcccatagcacatcgtggatacatattgccacaatccccagggactgcaagcacactttttggcaaactgagatcaagatgatagatgtaacttgtagtacccccacccaaaccctcacttccaggctatggttcacacgtccgactcatgacctgggggagctcagttctcgtctggacgtcattcagttttttctgctgccccagaatctggacatggctcagatgctgcatcggctcctgggtcacatcaagaacgtgcctgtgagcccagggtggagggcagggaggtggggaaggaggttgagggctgatactgggcagtgggcttcttgaggggcattagagtgagggaagagaaaacagcggctgtaaccttgtctgactgtagctgattctgaaacgcatgaagttgtcccacaccaaggtcagcgactggcaggttctctacaaggtaaggccttccttcttgaatcccaaaagtccaggtaaaggccctcagcctgtattccagactgtctgtaccctagacatgctgtccaattttattctaccctcttttttttttttttggagacagcctcgctctgtcgcccaggctgaagtgccatggggcgatcttggctcactgcaacctccgcctcctgggttcaagcaattctgcctcagcctcccgagaagttgggattacaagcgcccgccaccatgcctggcaaatttttgtatttttagtagagacaggatttcaccatgttggccaggctggtcttgaactcctgacttcaggtgatccacctgcctcagcctcccaaggtgctgggattacaggtgtgaaccaccaggcccggcctccctctttttttttttaactttgtattcaggaaaatgtaaaaaatatttagaataatataattaacccccatgtacccaccatgcagtttcaacactttaacttacgccaatttttttttatttctttttctttttttttttagacagagtcttgctctgtcgcccaggctggattgcagtggtgcgatctcggctcactgcaacctctgcctcccaagttcaagtgattctcctacctcagcctcccaaatagctgggattacaggtgcccaccaccacactggagtgatttttgtatttttagtagagatgggatttcaccatgttggccaggctggtctcaaattcctggcctcaagtgatctgcccatctcggcctcccaaagtgctaggattataggtgggagccaccgtgcccagcctagtatgtgtcatctatatctttttctactttcccctcttggattattttgtgggttttgttgtcgtttgtttgtttttttaaataaggtcctgctttgtcacccatactagagcagagtggtgcagtcatatttcattgcagcctctaacttctgggctcaagcaatcctcccaccttagcctccagagtaactgggactataagcctgagatgctgcacctggctttcttggattattttgaagcaagtcccagccattatatcatttcatccataaatatttcagtgtaatttcttttttctttttttttttttttttgagatggagtctcactctgtcaccaggctggagtgcagtggcatgatctcggctcactgcaacctccgcctcccaggttcaagcgattctcctgcctcagcctcccatgtagctgggataacaggcacatgccaccatgcccaagttttttttttgtatttttagtagagacagggtttcaccatgttggccaggatggtcttgatctcctgacctcgtgatccacccgcctcggcctcccagagtgctgggattacaggcgtgagccacctcacccggccaatatttcagggtaatttctaaaagaaaattattttttaaaaagaataacagtattgttatcttactttaaaaattgtattatttggtatcatcaaatatctgaaatttttcttttttgagacagggtctcactctgtcacccaggcttgagtgcaatggcacaattgtagctcactgcagcctcaaactgttgggctcaagcgatcctcccccctcagcctcctgagtagcagggaccacaggtgatggccatcacaccgaactaagtttttattttttgcttgcatttatttatttatttatttatttatttatttatttatttttgagacgggattttgctcttgtagcccaggctggagtgcaatggtgtgatctcggctcaccgcaacctccacctcctgggttcaagtgattctcttgcctcagcctcccaagtagctgggattacaggtgcgtgccaccacgcccagctaattttgtatttttagtagagacagggtttctccctgttggtcgggctggtctcgaactcccgacctcagatgatctgcctgccccggcctcccaaagtgctgggattacaggcgtgagccattgcacctgaccaattttttattttttgtagagacaggatctcactatgttgctcaaggtggtctcaaactcctgagctcaagtgatcctcctgcttgggcctcccaaagtgctgagactattggtgtgagccacgatgcccagtcagatgatggccctagtcctttttaatctaccggttccttctctatcttttctctcttgttctttctttctttttctctttttcttctcctggcaatttgttgaagaaactagattattatttgtcttatagtgttttccattagcctggattttgctgtttgcatttcctagatgtttttggcacatttctctctcttctatagtttctgtaaattaatatttagttctagaagcatgattaggttcagagttttttttttttcaatactgttttagaagtagaggaacataatgtctgatatgtccgattgtctctctttttctgatgttggcaaatgttctgatgtttaatacctaaatctattattcatttatttatttatttatttagtttgaggtgagtctccctctgtcgccaggctgaagtgcagtggcacgatcttggctcactgcaacctccgcctcctgagttcaagtgattctcctgcctcagcctcctgagtagctgggacttacaggcgcacaccaccacgcccagctaatttttgtatttttagtagagacgggatttcaccatgttggccaggatggtcttgatctcttgacctcaggtgatccacccgcctcagcctcccaaagtgctgggattacaggcgtgaaccactacacccagccatctattaattctttagcaattacaaagtagtagcatttaaatctctgattctttcttcatttattagccagaaatttctgtaaagagaaacttccttttatgtactatttggttgccaagtgatagaaatcatatagaaatacagaaaattgcttgatatttcccccactcttttttttttgagacagagtcttgctctgtcaccaggctggagtgcagtggcacaatcttggctcactgcaacctccacctcccgggttgggtttcaagtgattctcctgcctcagcctcccgagtagctgggactataggcgtgtgccaccatgcctggctaatttttgtatttttagtagagacagggtttcaccatgatggccaggatggtcttgatctcttgacctcgtgatccacccgcctcggcctcccaaagtgctgggattacaggtgtgagccaccatgcccagcccttttttttttccccaatatggaacgcttcttgaatttgtgtcatccgtgcccagtggccgtgctaatccctgtaaccttcgaaatttcagtatatgtgctgcagaaatgagcaccccccacctttatttactagctatcaatatggtaaattagttccctaacattctccaagatagccatgagatttttttgttttttgtttgtttgtttgtttgtttgtttgagatggagtcttgcactgttgcccaggcaggagtgcagtggcgcgatctcggctcactgcaagctctgcctcccgggttcgcgccattctcctacctcagcctcctgagtgcctgggactacaggcgcccgccaccacgcctggctaattttttgtacttttagtagagacagggtttcaccctcttaaccaggatggtctcaatctcctgacctcgtgatccacccgcctcagcctcccaaagtgctgggattacaggtgtgagccaccgcgcccggccctgatagccgatgaggtttttttgtcattgttcttcttgtatcattacagactcatggccttttatagctatatttctctttctcccgactctgtacaaactcctttgttttagagtttgcacaaccctctatcaaagcacctaccacctcacttttaaatcttctgcatgtatttctgtcttccttcctagactgtgagcacatctgggacagggaccatatctttttttgtttatttgttttgttttgagacagagtctcgctctgtcggccaggctggagtgcaatggcgtgatctggctataacctccacctcccgggttcaagagattctcctgcctcagcctcccaagtagctggaattacatgtgcatgccaccaagcccagttaatttttgtattttgagtagagacagggtttcaccatgttggtgaggctgatctcgaactcctgacctcaggtgatctacccacctcagcctcccaaagtgctgggattacaggcatgagccactgtgcctggccaggaccatatcttaattgtctttgtagtttcagtgtttggtacagtgcctctcactgtttctttttgcctttgagatcttccctctttgttactgtgatcttccctactggtctttgttcttctgagtctgtccctatcaccacctcaacccgagctggatgtggcctgtcctcctttttgtgtttctctcacagactgtgtacagtgccctgggcctgagggatgcctgccgctccctgccgcagtccatccagctctttcgggacattgcccaagagttctctgatgacctgcaccatatcgccagcctcattgggaaagtagtgagtagaaggaaaaagggagtgcacccagggaggtcagggagagagaatgcagtgtgcaagatggggaaacatggaagatattgaggtcaattggataaagaatgggatggtgggaggaggcagcagaacttcagggaagtatctggagggtgagagttaaaggaggactgcagggagaattggggcccaaggagagctgaggaacaggacagagggtgccaggtcctaagaaacagtacttatctcctcaggtggactttgagggcagccttgctgaaaatcgcttcacagtcctccccaacatagatcctgaaattgatgagagtgagtgttgggtgtggatgggcctgtgagccctgcgcagtgatggagtaccatccttggcaggtggtcaccacagctggggatcttcatagcaaccagggcaggagactcacttttgataaccacgtgtcttccaccctcgtagaaaagcgaagactgatgggacttcccagtttccttactgaggttgcccgcaaggagctggagaatctggactcccgtattccttcatgcagtgtcatctacatccctctggtgagggcaggagagtgggtgtagccttcagatgtcttttgggggagatattaggcttatgaaagacatactggtagataagaaaacttgtggggcagcctgaagaacatgaacacttttttgtggggatacagggatcttttaagctccctctagggtggggaggtgtccagtaagtctccaagcaggagagtagagtatctcctctttactctccccagattggcttccttctttctattccccgcctgccttccatggtagaggccagtgactttgagattaatggactggacttcatggtaagaccctcaacctctgtaaggtgagtgatgaggaaaatgagtcagcagctgaggaagagcgttactctacagcagcactgcccaatatgggatctctcctctgtagttttactctgagctttaccagcactgagacaaaggaaagagaagtcagagttaggggctggaggtggggttagaaagatggggaaggagaggaggaccaagagatgcaaagtccacagctttgaacccctgtacccagtttctctcagaggagaagctgcactatcgtagtgcccgaaccaaggagctggatgcattgctgggggacctgcactgcgagatccggggtgaggaaaagccagaggttatatgcattgtaagatgtttaaaaaaagcagcagccaggggaaggaggggagtgggcaacttggggatgcttccaacaggcccctcctcttcctgctctctgtctcgctcactctgactctatcttttcctctgaatgtcttgaggtctcagattgtatctgcaacctgtttccagatccccctaggggcctctgcctctccttcactttcccctggaactgacctccagctcccttcctcacccactcccagaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcaggtaagaatagaggcgggtggaggaatagacatgaggggcccaaaggctacatcttctgggggttcatctatcttgatccacaagccatgcgaggtgcctctccgcccactgcagacatcctctgatggaactctgtgcccgaacctttgtgcccaactccacagaatgtggtggggacaaagggagggtcaaagtcatcactggacccaactcatcagggaagagcatatacctcaaacaggtgaggagaagccctgcagcctgggcctctggcgtctcctgcatctactccacccctacttgccagccaactcaggctcctgcagctcttctcccattttctgaccccgctcttcatgaaaggaccatcacccacatccctgtgcttccacctcacatgttcttattctccactggagagccatgctctaatggaactttccgtggcccaaattccttcacctgcctctgagtaggtacacaccactcccaagtatgtctctgcccacgtcccgtgcctcttcactgattctaaattagcccacagggctatggtcaggattcggggaggagagacagagtcagtgtgtctgttacctatttctcctgtttcaccctgtccatttctctttgatgtgccattcatgccttgagcctcactttcacctcagcccacggcaccaggccccaggccctgtctccttccctattcaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtcaaagggaacaaagggaggtgggattgaggaaggggataatgggaaaggaacccctgaaaatgctcataacaggaaagcatgccctctgctgcatgccctttatactaaaagtggggagcactaaggtcagagataagaagaatcaataccataaacatttcttgaacccttgtttcatgtgagtcactgttggcaaagaggatgaacaaagcgtgcacctcaccattcaagaacttgcagtgcagtagggagggcatgtatacagctttattcacaggccaactgtggtcagtgcgttacgggcttccaatactaactttcccttgtccaccttatacccagcaggtggcgaaagcagtgaacaatgccactgcacagtcgctggtccttattgatgaatttggaaagggaaccaacacggtgaggggagaaactgatgaggggagaaactaaggaggggaaaatggaggaggatgaaggagcatgacagtgaggctgggcctctggaatggaatagggctgtgtgggcagaaaagaaatagaacacgagacagggaaaggcagtgcaagtgcagaggggcatatggggtccccatggctccgaatgctaacctctgccctctttgcaggtggatgggctcgcgcttctggccgctgtgctccgacactggctggcacgtggacccacatgcccccacatctttgtggccaccaactttctgagccttgttcagctacaactgctgccacaagggcccctggtgcagtatttggtgaggagaccaatctagctcctcggggacccccaggctgggcatttcccagaggtggggattggctcctctatcagaacaagggctccctcagcacagagaccacatcccttcccttttctccctccccacaggattggccaagggtttcaggacaggaaggaggtgattgatgatacactgtcttttattctcttttaagaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtgatgagatccaaatgtgcaaccacctccacatcagagctccctttcattcctagtcctactgggcctgggtctaggtccacaggatttctgacccttatttccccttctcttccccactccccttactcctcccaccttcttgcttgttcctaggtctcagacttgatccgcagtggaaaacccatcaagcctgtcaaggatttgctaaagaagaaccaaatggaaaagtgcgtatatggccccagtgtctttaccctctctgcatcttctcctgcaactcttctccccttttcagggactcagccttcctccagcactttgcccttcagaaacccaccatttctttctgaaatccctaaatcttcaagatcccaggttttctgtgccacagcctctcccctctgcccagggatttggttgtccattctgccataaatcttgcgattttctctcttcttcagttgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaaga

SEQ ID NO: 2601 - DNA, 22731 bp, Homo sapiens; identical to SEQ ID NO: 2600
  source 1..22731: mol_type = genomic DNA

SEQ ID NO: 2602 - DNA, 22731 bp, Homo sapiens; identical to SEQ ID NO: 2600
  source 1..22731: mol_type = genomic DNA

SEQ ID NO: 2603 - DNA, 22731 bp, Homo sapiens; identical to SEQ ID NO: 2600
  source 1..22731: mol_type = genomic DNA

SEQ ID NO: 2604 - DNA, 23872 bp, Homo sapiens
  source 1..23872: mol_type = genomic DNA
ggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccaggtagcggggtgggggtggggtcgaaggcgggggcatagcggcggggcgcttggaacccggcgaggggaggctcgcacagggggttgggggggtgcacggcctggccctgggctcggaggaggcggggccgcagagttggcttgaatgagtgcaggggtcgagtctggagcatttgggggtgtagcttgtaaacagggtcggaggagagaggctgtgcaggaagagggctgcaggggagacgcggagagttcgggccttttggagggaggagacgcgtcccgccaggtgggggtgctgggctaaggaaggggcgacgcgcgcagctccgggtggggagggggcctgggaggtgggagcactgggggtggggcgagaaggggaaggcgcccggcccacttggtgggcggggcggggggcggggtggcgggaaggaggaatgcctgcgggaggccgaacggggagagtccggtggtgtggggtgcgaaaggaggttcctcggccggcgcggagatagtgagttggggctccagtagtcgatcgaggtagacacttagaggtagttaagagccgcggtcgccgagacgccttggggacggtgggccttcggcctaggtgaggggccgccgagggggtgggccacgagctgcgagcgcgggggggtgtgtcaccatggggaccgcggggcctaattgggcggggcggggccgtggggagccgaagtgctgggatccggctgggtccttcggtaggtaggctgcacgtgcaccgagacgaagatagaatattttgacgtatgtggaaattcgtgtcgagtggaaaatattttattttatgaaatagtgtaatttttatggggcaccactgggcttttagaggccttaatcgggcgctggacaaagatgtgtggacgtgagtgactccggggaagcctgtcgggagttgtcctcactttatgggcagttaagtgcttttttttttttttcctttttgagagagagtttcgctcaagtccaggctggagtgcaatggcgcgatctcagctcaccgcaatctccgcgtcccggcttcaagcgattccccagcttcagcctcccgagtagtcgggattacaggaatgcgcccccacaccccgccaattttgtatttttagtagagacggggtttctccatgttggtcaggctagtctcggaattcccgacctcaggtgatccacccgcctcggcctcaaagtgctgggattacaggcgctagccaccgcgcccggtctgtttagggctttttatccgggcagctggcgacattttgaaaagcttgcttttgctgtttgccagatacatatatatgtattttgagacagagtcttgctcttttgtccaggctagagtgcagtggcgcgttcttggctcaccacaacctctgtctctggatcaagagattatcctgcctcagcctcccaagtagctgggactacaggtgcgccccaccacgcctggctaatttttgtatttttagtagagacgggtttcactatgttggccaggctggtatcgaactcctgacctcttgatcggcccgcattggcctaccaaagtgctgggattacaggcatgaaccaccgagcccggccgtttgtcagatactaaacacaaagtttaatggtcgctatttgaacaaacgaagaaataaaggctcagaaaaaataactcattcaagataagagccagttcgtgttttttgtttggttttgttttgaaatggagtctcgctctgtcgcccaggctggagtgctgtggcgctttctcggctcactgcaacctctgcccgccgggttcaagtgattctcctgcctcagcttcccgagtagctgggattacgggtgtgcccaccgcggtccggctgatttttcaccatggagtttcaccatgttggccaggctggtcttgaaactgctgacctcaagtggtccacccacttcagcctcccaaagtgctgggattacaggtgtgagccaccgtgcccggccgctagttagtggttttgagtaatggatttcaaatccatttaaatccagtttaaagtgtcctaaaggaattctgagatttttctaagtgtaattatagtgttacccttgtttaagcgaccctttcccgcagtttaaatatatatagttgtgcattagtagaatatgcttgtggggaacagagccagcatccgcaataacaaactcctggttagaaaagcatgacgtattgtttacttgagcatgaattgattgttgaatccaaaccaaacgggtgtatttattgtaaggatgtactttacattcatattgaatagcgtatgttatttgtttcttgaggttgagtttaagagacttgtaaaaataaaacgtatacatttcacctcccgttatggagaggattccagggtattcaagaaagatgggcatttgatactaggtttctaaagaaactgcagtgtctagatcactctgccgagcacagcattaggcattatggatcctggatacaaccatgaacaggacaaagcaaagaggcaattgtagactccaagtggaaaggggacggagaggatgcgggtcaggctaggctctcagctctgtaaaccgaaaccagaaggacaaataagcttagacagattatagtgagagtgggaagctggttcaggaagaggaaggtctgcaaattgtgggtaggatgaaaggaggaggagggagcattggagaagttaagcagagatccaatcatgaacagtctgatgagctacagagacattcggacttactccatgaatcatttaagccttaaaacatgttgagcgtattttttttttttttgagacggaatttcactcttgttgcccaagctggagtgcagtggtgtggtctcagctcactgcaacctccgcctcctgggttccagcgattctcctgcctcatcctctcaagtacctggtattacaggtgcctgccaccacgcccagctaatttttgtgtttatagtagagacgggtttcaccatgttggtcaggccagtcgtgaactcctgacctcaggtgatccacccacctcagcctcccaaagtgttgggattacaggcgtgaaccaccgcacctggccgtgagccaccgtgtctgtccgagcatcttttaatgtttgtcatttagatttcttcttgtgctgaagtgtttgtcttttgctgtttcttttttttttcctagttctttgtcatttgtgtgtgatataaatgtcttctttcacaatgagttctttcatttagtttatggctttgttgttgttgttgaataatagaggtctcactttgttgcccaggctggtgttgaactcttgctctcaagcgatcctcccacttcagcctcccaacctgttgggattacaagtgtgagccaccacacccagccttatggcatctttcgatgaacaaattattgattataatgtggaatttgtccttttattttctctgtggttagtgtttctataggttttatttaagaaatccacagggaggctgggtgcagtggctcatgcctgtaaacccaacactttgggaggccaaggcaggccaacatggctagaccctgtctctccaaaaaataagaaaattagccaggcatggtggcgtgtgcctgtagtcccagcttcttgggagactgagatgggaggatcgcttgagtccaggaggttgaggctgcagtaagccaagagatcatgccatgcactccagcctgggtggcagagtcagaccctgtctgccaaaaaataaaataaaagttggtgaaaatgttgattatatattttaggaacaactagtaattgacatcaaaattatgggctaaagagaaagcaaaaataatgtgattttaaaccagaattcaaaagatctgtttagcgtatgtttagacaaagccattacttattatatcaaagttttaacatttattttgtgagctgtcagcttttcctcttaacatttttccccaccgtcttaaaaaaccccaagaataccggacatttaagactcacttaaagctttaaaagcacttgcaaaatcctaaaatcataatttaaggtgtttttggagggcaggagcaatggtggcaggcagtgttttgctttgttgcccaggctgaagtacagtggcagatctcggttcactgcaccctcgacctattcggctcaagtgatcctcccacctcagctttctgagtagctgggaccccaagtgcacaccaccccatgcctggctaatttttaaatttttttgtagaaacaaggtctcactgtgtagcccagatggtctcgaattcctgggctcttaagagatcctcccaaagtgctgggatcataggtgtgagccaccacacctggcctattttggcattcttgaaaaccgcaggattaccacggataaaattttaaaattacctttaaagaattcaggtttacacacaaaaaaaatttggtttgttagcagtgagtgaagaaaaattttgagaaatgtttaaaatttttagttttgttacacaatacattttactacctgtttaattatcttttttgactcagaaaccagtttcctgggtccaggatgtttagtggtactctttttcttcaagctttttagcattggaggaactgcatattagtaaaatttttagtcttagcattttatagcttactgctatttcttttctttcattctttctttcttttttttttttttttttttttttttgagatggagtctcgccctgtcacccaggctggagtgcagtggcacgatctcggcttactgcaacctctgccttccaggttcaaatgattctcctgcttcagcctcccgagtagctgggattacagatgcccgccaccatgcccagctaatttttatttttttagtagagatggggtttcaccatgttggccaggccagtctcgaactcctgacctcgtgatcaacccgccttggcctttcaaagtgctgggattacaggcgtgagccaccgtgcccagcctttttctttttctttttctttttttttttttttttgagacggagtcttgctctgttacccaggctggagtgtagtggcatgatctgggctcactgcaacctccacctcccgggttcaagggagtctcctgcttcagcctcccgagtagctgggattacaggcgcctgccaccatgcccagctaatttttgtatttttttagtagagatggggtttcgccatgttggccaggctggtcttgaactcctgacctcaggtgatctgcctgcctcgtcctcccaaaatgctgggattataggagtgagccactgcgcccggcccagcatactgctatttctttctttctttcttcttccttttttttttttttgtttttttttttttttttttttttttgtgagacggagtctgtcgtccaggctggaatgcagtggcgttttcttggctcactgcaacctctgctgcccgggttcaagtgattctcctgcttcaggctcccaagtagctgggattataggcctctgccactgcacttggctaatttttgtatttttggtagagacggggtttcaccatcttggccaggctggtcttgaactcctgacctcgtgatccacctgccttggcctcccaaagtgctgggattacagacctgagccaccgcacccggcccatactgctatttcttaacagcagagaaattatgtgtcagattctgtaagtgtaatggtatataaaggataaaatgatgttgaaaaacaaaattttttgtttaaatgcttatgtttctaatattttatttcagaaaggaatttatttcaaaactgataatggttggatccagcttttcacacaaacttttttttcctagtgaggatgcacatttatcctgtaaacaaatggaagacattatttttttaattgcttgcttagaaatgaaataattcttttctaatgatcttttaaagcatgagacctcatacatcatttaaaacaatttatactgtattttacacatgacaaagttctaaggtaacagcccttttctaagactaaagttacagtcctccctttgtatctgagggggattggttgcaggacccccctgtgaatacccaaatccttggatgtccaagtcccttatgagatgtagtatttgcatataacctatacacatcttcccctgtactttatctctagattacgtacaatacctaatagaatgtaaatgctttgaaattagttgttcagctgtattttaaattttgtattttttttcctttttttttgagacagagtcttgctctgttgcccaggctggagtacagtacagtgatcacagctcactgcacctttaacctcccaggctcaagctgtcctgcctcggcctccccaagtgttgggattacaggtgtgagccatcatacctggtcactgttttttattggttttaaatttttgatttaaaatttttaatctaggttggttgaatctggactggaacccaaggatatgtttgttgagcatactgtatttactttggaatacaactagaatgcttaacttgtatgttaaaaatactttatttggccaggcgcggtggctcacgcctgtaatcccagcactttgagaggccaaggcgggtgaatcatttgaggtcaggagtttaagacgagcctggccaacatggcaaaaccctgactctacaaaaaaaaggtaaaaataagccaggtgtgatggcgtgtgcctgtagtcttggctattcaggaggctgagacacaagaatcgcttgaaccggggaggcacgttacgccctcagttgttgacttgagtttttccgtagtttgtagggggagggtaatagagtattaggtagcttttggaatacataggagtgtaactggaaaaagattccaagcaagtctaatgaattagataatttacctaattagtaaattatgtaatcagtatgctttataataatattgtgagttagatcctgtttctgatatgtacataccatattgtataggtgctactaatttggagagcatatacagtgagtccatgcctttttcctgccatcagcattataccaaaattctgccatggtttttaaactttgattctgagaaagtttctcaccctaataacataactatatttgtgtttgtcttcatagttaaatatgcattatgatatcagcttgcatacattttttaaatgacttgaatatctgactttaaaaattattctagaatttctgtgcttcaatattaatgccagaagacttggaattgtttatttgtaggtaactgcctttaaggaaacttgaccaaatattaactaagttatgtatttccttttggcaacagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggtaagagtcactactgccatgtgtgtgtgtttgtgtgtgtgtgtgtgtgtgtgagagaaacagacagacaggcagacttttttctatatgatgaaattaagtgtattttaccccagtaaattgcaaggggtggcagttgtgaaagcttctggcatgggaaagggatgtaacatggtctttagctggtttgttttgtggaatggaatttttatttctgtcctttgagtgacttacagcaatattatacccttaataagggtaaactaaactgtccccccatcttgaagggtccaagagaaagttaatgtcatcaggatacatagcctatagatagcgacattctctagggaaagatggagatgcgcactacctggccttcaaactactcactaatgaacacatctgagttgagtttcacaccaaactcctggaaccataactttcttttcccagatctagtcttgtttatcacagacatcaacagcctggcatgtttagcctcacttgggctaggtgcaccccatcgtctcttgtacaagttctctttctttcttttttttttttttttttctggagacagagtctcactctgttgcctaggctggagtgcagtggcgcaatctcggcccactgcaacctccgtctcctgggttcaagagtttcctacctcagcctcccgagtagcttgggattataggcacacgccacgttgcctggctatatatatatattttttttttgagacggagttttgctcttttggcccaggctggagtgcaatggcgcaatctcagctcactgcaaccgccacctcccgggttcaggtgattctccttcctcagcctctaaagtagctgggattacaggtgcacaccaccaagcccagctaattttttatttctagtagagatggggtttcaccatgttggccaagctggtcttgaactgctgacctccagtaatccacccacctccccctaccaaagtgctgggattataggcgtgagccactgtgcccagccgcccagctaatttttgtatttttagtagagacggggtttcaccatgttggccaggctggtctccaacttctgacctcaggtgatctgcccatttcggcctcccaagagtctccagtctagtacgttgtcgtactcggtgttgtaaaatccaaacaagggtcagtttcccaggtaactgggaaattcccagaatcacactctttcgtcatagtgctcatcctacaaaaaaggattgggggcattttgtctaaaattaaatgtaaatggtgatctgacatacaggtggaaagagaattgggaagttttgttctctcttctaccaacttgccacataatcttggccaagcaaagtaacttgttttttcttttaatctttttaaaagaaatagagacacagttttgccatgttgcccaagctggtctcaaactcctgcctgagctcaagcagtctgcccacttcggcctcccaaagtgctgagactacaggcataagccaccatgcccctgggctcggccaactttttcgttttcttttcaagagatgggggtctcactctgtcacccagcctggagtatagtgttgggatcatagctcactggagccttgaactcctgggctcaagtgattcccccctgttttagcctcctcagtaaccgggactagaggtgtctgccaccacacctggctaatttttatatagttttttttttttttttttttttttaaagagatgacggtcttgctatgttgcccccagggtggtcttgaattcttggcctccagtgatccttctgcatcaggctcccaagtagttgggtgatctggctaaagtaacttattttctgatactgtttacttatatttagaatgaatctcattggggttgcactggggccgggcatggtggctcacacctgtaatcccagcgctttggaaggccaaggcaggtggatcacctgaggtcaggagttccagactagcctggcaaacatggtgaaatcccgtctctactaaaaatacaaaaattagctgggcatggtggcacatgcctgtaatcccagctacttgggaggctgaggcaagagaatcgcttgaatctaggaggcggaggttgcagtgagtcaagatcatgccaccgcactccaacctgggtgacagagcgagactgtctcaaaaaaaaaaaaaaaaaaaaaaaaaaaaaggctgggcacggtggctcgcgcctgtaatcccaacactttgggaggcccaggcgggtggatcacgaggtcaggcgttcgagaccagcctgaccaagatggtgaaacactgtctctactaaaaatacaaaaataagctgaaatcccagctactcgtgaagctgaggcagagaattgcttaaacctggtaggcggaggttgcagtgagccgagatcgcgccactgcactccagcctggggaacggagtgagacttcatctcaaaaataaataaataaataaataaataaaataaaataataaataaagtaaaaagatctctcattgaaccagatgatatatgaagtctcttttaggaccaatttcgagatttaaaaaatttggcagaattactttttttttttgcagcggagtccagctttatcacccaggctggagtggaatggcacaatctcagctcactgcaacctctgcctcctgggttcaagcgattctcctgcctctgcctcccaagtagctgtgattataggcgcccaccaccaggcccagctgatttttgtatttttcagtagagttgaggtttcaccacgttgtccaggctggtctcaaactcctgaccttaagtgatccgtccaccttggcctcccaaagtgctgggattaggtgtgagccactgggctggcccagaatgatttttaaaaagagatcagtaaggccaggcagtggtggctcacgcctgtaatcccagcactttgggagactaaggtaggtggatcacctgaggtcaggagttgcagacaagcctggccaacatggtgaaaccctgtctctactaaaaatacaaaaattagccaggcatggtgacacatgcctgtaatctcagctactcaggagggtgaggcagaattgcttgaacccgggagtcagtttcttttttctttttttgagatggagacccactttgtcacccaggctggagtgcaatggtgcagtcttggctcactgcaatctctgtctccggggttcaagtgatcctcctgcctcagtctccttagtagctgagactacaggtgtgcaccaccacacctggctaatttttgtatttttaggagagatggatgtcaccatgttggccaggctgatctttaaactcgtgacctgaagtgatccacccgccttggcctcccaaaatgctgggattacaggtgtgagccaccacgcccagccctaaagttgtattttgatggaacgaactgttttgagaaataaattttaacgcgttgagtctgaactgggctgccctttcaaaatgtgaaggccccttaaagtagcacattggttggttattcttttatttatttagatatatctgatctagttgtctttgggacaaactcatatttaatatcatagctgcatgtaactgacagtgtagtctttgtcttcctgaagtgtttgtttgttttttgagatggagtcttgctctgtcgcccaggctgaagtgcagtggtgcgatcttggctcactgcaacctctgcctcccgggttcaagtgattctccttcctcagcctcccgagtagctaggactacaggcatgtgccaccacacccagctaatttttgtatttttagtagagatggggtttcaccatattggtcaggttggtcttgaactcctgacctcgtgatctgcctgcttctgcctcccagagtgctgggattacaggtgcgagccattgtgcccagctagtaagtttttaagaaagattctcaaacctcttttaaatcgtctgcctcacttgaagaggtatgccctacctgtttagggctgtagacccaggtcattagaagacagactaagtagtcctgggtgaacccatagggcaccttcaaggaggtaaaattggtgattttagtttcaccagtagtttttccctgaatatttattccttttgtgctttattgatctatctatatcaataaaaagtaatggggcataacaaattatacttgtcattcttgttcattagggcaaatgttgtaggttgagtcaagtgtccagccaacaagttattttatgtgtgtgtgtgtgtgtgtgtgtgtgtatacatatatacatttttttttttttttttcatcgagacagggtcttgcactgtcgcccaggctggagtgaagtggtgcaatctcggctcactgcaacctctgcctcccaggtttaagtgatcttcccacctcagcctcccaagtagctgggactacaggcgcacaccaccacccttggctaatttttgtattttttttttggtagagatggggtttcaccacattgcccaggctggtcttgaattcctgacctcaagtagtccgcccacctaagcctcccaaaatgctgggattacaggcgtgagccaccacacctggcatatatatattttaagatagagatggggtttgctatgttgcccaggctggtcttgaactgctgggattacaggcgtgagcctctgcacccggcccttattgtttataaatacatttctttctaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtgggacacggcaagcattcagttgttatttatgttagggtgatgggggaagaaagggggagggtgtattaacaagataccttgttttatatatgtgtgtgtatatgtattattttattatacatacatgcatacttctgtagttccctggactgtaggataagttaggttacttagaatctcaacagctagcatcgtttttacttaggttttcaagcctactggcagggtaagcaagaggtagtaccattttggtaagaagtagagagctagggacagtaaagatggagtaatatatatatgagggtatagtcaggccctagaaattaattatccagttttatgctttttataaaaaaactgagatggggtcttgctatgttgcccaggctggtctcaaactcctgagttcaagggatctgcccacctgggcctcccaaagtgttgggattacaggcatgagccacagcacccagccccagctttatgcttttaattctaaaactttttttgttgtattttgcattcataagaatagatgttaaataaaccttgaaatacaaccttggctcaaacgttaatggtcatggataaagtgaattaaaacttgttaggggccaggtgtggtggttaatgcctataatcccagcactttaggaagctgaggcagttggatgtcctgaggacaggagttcaagaccagcctggccaacacagtgaaaccctgtttctataaaaaatacaaaaattagctgggcgtggtggcacacacctgtagtcccaaccacttgggaggctgaggcatgagaattgcttgaacttgggaggcagagggacttgggaggcagagggtgtagtgagccaagatcgcaccactgcattccagccagggtgacagagcaagaagactgtcaacaacaacaaaaaatgttatagaagtgaaaaaaattgattaatttagaacaagcttgtccagtctgtggcccaggatggcgtttaaatcagcccaacacaaatttgtaaactttcttaaaacattttgtgatttgttgttgttgtttagctcatcagctatcattagcattagtgtattttatgtgtggcctaagacaattcttccagtgtggcccagggaagctgaaagatcattatcctctgatctatcatattaatgagctgcatcctaaaagacattcatctataactaagctcagtttcatgttttgttcctttttcaatagataagatagggaatgagcaagttaataaagtgggtattttaattttaaggttgaaactaaggatcataacattatcagaggtctagaactggatggcagctacagagatcatttagcctaatactggtttaacaaataatccgggagatccgtgatatgtgaatgtgctaggcctgagatgagacagccaattgtggaagagcaaacactagaaccagtataagttgcttactgctttcttatgctattaatgagcatatcgcctcctgatatttatgatatatggtcatgccaacagctttgtcataaatagaactcccatggcagcaatcacttaatcttgtagttagaggtggggtctcaccatgttgccgagctggccttgaacttctgggctcagcgattttctccacaggcacctgctactgtgctcggtgcagcactttgtgtttttgaacataacctcaagatgttattgtcttcatagtaaaacaaaagatgaggcttagaactggatcactttgcctgtctcttcttacctcctcccagttcaaaatgcttgcatctcttaatagctagcattcccttggattttgcacatgagctcaaactcaagcctcagcacaatcttttttatagttttagtcttttagccagagtcgacttaccccccatacccactctgcttccttcataatgctgctttccctgggcagagaatccttgcccttcttgtattatgtcactttgtggggttggtgtctgctacacttacagcaagtccagagattttttttccaccacgtttgcaggagaactattggcatggaaaatgacaattgttttaatgtcaagtgaaactgaagttgatgttcattgagaggtttctaatttctagaggtgggttctttttttggcatatgaagttgcagcatattaagagaatttacagtagtacagatggggttatcccatccacaacttatgatggggttacataaactaaaaacgtgtttaatacacctaccccaccgaatattgtagcttgggcgtagcctaacctatctcagacgtgctcagaacacttaaatgttagcctaaagttgggcaagatcatctaacacaaagcctattttataataaggaattgcctatctcatgtaattcatcgaatactgtactaaaaatgaaaaacagtggctgcacgggtaccattataaagtcaaaaaatcataagttgaactgtcttacattatggttttccaaattttgatttgtttttaaatactctttccttgcctggcaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttgggtaagactttgaacaagcttgttctcaggctttgataagtagtgctgtttgccagctgtatattatccctaaaaataagtaataaggtatatatggtacatattttgacatgcatatacatatttgcatcctgactaggctgcccacagcaatttaagttacttgaaactcgcttttatcttagtagccctttggcctttcttcagtttttttttttttttttttttttttgagacatggtcttgctctgttgcccaggctagaatatggtgacacaaccatggctactgcagcctcgacctcccaggcttaagtgatctttccacctcagcctcccaagtagctgagattacagatatgcaccaccatgcatggctaatatttaaatgtttgtagagagatggggtctcactgtgttgccaggactggtcttgaactcctgggctcaagtgatcctcctgcctcggcttcccaaagtgctgaggttacaggcatgacccattgcgcctggccctttcttcagtctttaataatcgaacaaaaggtttttgtttttagacagtgtcttgctctgttacccaggacagacctctcgtgtcagcctcttaggtagctaggatttacaggtaagcaccggcgtgccctgctttatttttttggtgggggaagggggaagggagttgaagcttccctatgttgcccaggctggtcttgaactcctggcctcaagtgatcctccagtctcccaaaagtgctgggattacaggcatgagccaccgctcccggcccaaaagatttttaaatgtgttatacttcatgagacaggctttattttagatcgaattttatttatcaataaaaagttgagctttttattatttggtgaatactgtttcaaggtgctttgttacactatctgttgatccaacatttaaaaattgttttattacaacctttgcatttcagtgaatccatctgcatacaattttaaaagaatcattccttttttctgtagccaaattgtcaaagattctttcctacaattgatttttcaaagccctgagttaggaatttacaatttggcaaccatctcaacttcataagcaattttgttctttaaatgtcacggccaacattacctggaaccattgctgttttatagtttaggtttatgttgtatattttttttaattttttagagacggggtcttgctgttttcagactggagtacaatgggatgactagctcactgcagcctcaaactgctgggttcaagtgattctccttcctcagcctcctgagtagctgggactacaggtggtcaccatcacacctggctaatttttgtatttttggtagagacagggtttttcccgtgttggccaggctgttcttgaattcctgacctcaaagcgatctgcccgccttgatctccgaaagagctgggattacacgcatgagccactgcgcccagccctgttttttttttttttttttttttaaataatggtagtttacttgaatttgtaacacagtaacacaaaactattttgatctgaacgcaagtatctaatggaacagaataatatacttccttttagtgtgctgcatttggttactgggtaatttaaaattcttcctcagcacaggtgttcaaaaaccagtcttcagagattgttttcatatcagtgtgccaactttggcacattctgctaagtaagaggcttaagtgtagcatgtttctgctgttttgtgtttgttttgttttgttttttgagacagagtctctctgtcgcccaggctggagtgcattggtgcgatcttggctcattgcaacctctgcctcccaggttcaagtgattctcctgcctcagcctcctgcgtagctgggattacaggcatatgccacgtgtattaggcactgctaatttctgtatttttagtagagacgaggtttcaccatgttggtcaggctggtcctgaactgctgacctcgtgaactctgcccgcctaggcctcctgaagtgctgggattacaggcgtgagccaccgtgcctggcctctgctctatcttttagctttcccttggcacttctatggtccagatgttagagggtaagtattttgatgggggagatcgttggactgtaattgaaagttatgtcttataatgaaatgtgttatataaagaagacctataaaacacttaggctgataaaacccccaaacgatgaagcctcacttttaccctctcttttaacagatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggtaactgattcttaaagttttgttatcagaaagtcatttgtgacattaggaataacatacttaggtgatcattttccaaacacagttacataaaagtcagccagtgacttaataggaagcaaagggaaattactccctgtgttataaaattgagaattatatttagctgaaacatcgatgcttaatgttaaggggaatatatgttaaaaaggggaaggaggtcagtcattcaggtcatgaggccctttgacttgaattcatttcctcagaaggtaggtatattcatagtgaacaaaaatacaaaggctgtatgaaaagatgaaaatgttacaggtttatccttaaattagactcatttgcagaaatgcaaatgaggtaagaaagcaaatatagttcatgacctctagcaactgttgaaaactgctctttagggatgacatgctggcccttttttttttgttgttgccaaggctgaagtgcagtggcaccatcacagctcactgcagcctcgaactcccaggttcaacccttcctcctgcctcagcctccccagtagctgggactacagatgtacaccatcatgcctagctcatttttaaaaaaattttttatggcattgtatttatcttctctttataaccaggggttgaccagccacagaacttgtaaagttttttatatttttaaaaggttgtaagaaatagtagtagttggctggtccccgctgctctcctgcattatagtatacttctgttcacctagtttgctagagagaggcagtatagtgtgtatagtgatttccaaactttttctttaaatcagaatcacctgaaagaatgtgacaacgtgtaaaaaaaaaaaaaaaggtgcagagattccatcctgacatggattcacttgattggaattgattctaggcatctcagtagttttaaagagctcctaggtgattctattctggccagcgttgagaatcactagggtagtgggttggtaagcaggctctgatgttttaaaggccaggtgaggccctatgcctcttgtctctcttagcctcaactttctccatgttagcaaatggatttcagaacagaaccaacgtacatgtgattgtgaaagttgttttagagtgcctagctcttacgtaagggttcataagaaagacaaaagtttatgaaactgttactaccagtcataaaagaccttttcctccctcattcacaggctggcttattagctgtaatggcccagatgggttgttacgtccctgctgaagtgtgcaggctcacaccaattgatagagtgtttactagacttggtgcctcagacagaataatgtcaggtgagttttttgtttcccacttaagttctcattcagtcatttagatgtgataaaagatatttgcttcttgtatatgagccttttaaatctaatatttgatttttctggtgttactttaaaaacatcactttttaagaactgcatagtctctctctcttttttttttttttgagatggagtttccctcttgttgcccaagctggagtgcaatggcacgatcttggctcactgcaacctctgcttccaggttcaagtgattctcctgcctcagcctctcgagtagctgggattacaggcgcatgccatcacgcccagctaattttttgtatttttagtagaagcggggtttcaccatgttaggctggtctcttaactcctgacctcaggtgatctgcttgcctcggcctcccaaagtgctgggattacaggcgtgagccaccgtgcccggccaataattgcatagtctcttaatgagatttaatcttttataccaatatgtgtagctcatgatagctatataacctagaagatgaatttatgtaatatgatttgcaaaatgagtattcatttgtgatttttttttttttaaggtgaaagtacattttttgttgaattaagtgaaactgccagcatactcatgcatgcaacagcacattctctggtgcttgtggatgaattaggtaagacattaaacttctcatttgaagactatctatcttaaaaacatttgtacaaataactatttttatagaagattatctgaagtacatttaaacaatatgaatgtttttagagcacgcactcaccattgtggcacagaccgatagttggagataaaaggtgatattgtgaaaggtttttgattacccattaattattaggccttacactgtttagttgtaataaaacatttgttatactacggggatgagaacactaataggaggactcaggaagtttatgaccttgagcgatactgtattttctttaaaagaaacctcactccccatgggctgctaagcagactcgtgtagctaaacaaggcctatttatagaatgcttttagacgtggatgtactaaccgatgttgcttttctgtcctagcatttttgttttaattccttttttgttttaattcctttgagttacttccttatgcatattttactttaacaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggtatgtgcaaattgtttttttccacaaattcggttttttgagagggcacttctcttgctagcacatgtatcgctaatatttttctttcttaaggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcggtaactaactaactataatggaattataactaactgaccttaagtttcaaagaaacagtaaaaggggaagggatgatgcactatgaaaaaacaaaaaaacttttttttttttttttttaattttaagggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 2605 - DNA, 23572 bp, Homo sapiens
  source 1..23572: mol_type = genomic DNA
attgaccaatgttcaagcctattggtaaaggtactccgggctcgcgcgctctgattggctggcctgaagtacaacgcctcctccccttgaggcacgggcgctctgggttgtgggagttggggagctgctccggcttcggcgcggaggggcggcggccggggaggcggcggcggcggcaggtgagaggccggggtcgggcggccgggcggcgcgaggtcctagacccaggacgacgctgagccaggcgtccagcttctgtggctcagtttacccagctctgagagtcttgccccgagggatcggcgacctcaatctgacagtcgtgattttgagcttgacaagcaaggggattccccgctctgagcctcagtttttctaagaaatggggatcacgatagtacttagctcatagtacacctgaatcttagcgtaaggtaatctacgtaaagccttaagcggaggataattttgcgttatgtataaaagtgtaaattgcacacacctatagaccctgcaagctcctttctaggactctgtcctgcagaaatactcatttaagtgtgcaaaacgaggcgtactgggtgttttctgcagccttgtttataattgtgacacattggaaacagcctaaatgtccagcaaagagttctttctgctccatgatttcatgtaatttctacctttaatagtagtagttgtaaaagctgaaacgaagaacagagccagtaataagtagctctcagtaattgaatgattagtaggtgccagacaccgccaagtgtttcccttgcgttaatttaaccttcctaacatccaccgaggtaggtacggttattttctctccatataacgtgtggggaaaccgaggttcttagccatttaagtgagttaactaagatgacatcactggggagtggaagagctggcatttgaacccagatctgttggatgtgtccagttgactcctgcattgcctttctggtacgtagcaagtgctggacggtaactaccttttttgttattatgatgggcttgaactaggtgttctaagatctcttcctgctggttctgacatctagagatctttgctcttctcattggctttcccttttaggattcccaggagccatgttgtcagaagtcctactggtgtctgctccggggaaagtcatccttcatggagaacatgccgtggtacatggcaaggtacaaagccgttagagcctttaaggattgggtaccccttctccctgatgctaattttgtaagaaggtaaaaggacaccctgaggcacagcttgggagcagatcagagagatcaggttctccccagccaggcaaggaaaagatttcttatgcccactgaagggattcttgggcctcgctcggtatgatagcaaaaagatgattataatataaagccctgtgagtggaatgagatcacctaggagtgagctttgatgcagaaggaaagaggtttgagaactgagctccggggcactaagacatttagaagttggaaggatgatctagcaaaggagttgaaaacatccattatctcattttacccttacagctacccccaaggcatacccttttattatcctattttacaaatgtgcaaactgaggcttaggagagaagtggtaacttgatccaagtcctatataccttggtagagcttggtgtgaacctaagtctgtctgaaaccacctctgctgcactctgcttttttttttttttcctgagacagtcttgctctgtcaccggagtgcaatcttgcgatcatggctcactgcagcctccaacctcagcctcccaagtagctgggaccacaggtgtgtaccaccatgccccactaatttttttcttttatttttctgtagagacgtggtctgacactacgctggtctcaaactcctgggctcaagtgatcctcttgccttggcctcccaaagtgctgggattacagatatgagccaccacacctggcttctcactgctattctttatgttcttatatttctcattgaaaacatggtgattatggggaagtgattccttggtattgagaacctctgaaattttgcaggcagaaggcaaagtggattttaacttttagctgatcgatggtggctgttcccaggcttagtgggagagcatgccaaggttgattagcagtgtctggcaagggcatggctaggagtggcctctgtgcttatgtttgctctcttcttagcacgtgggtcctggcccctttgccactcaccctcaggcttattgcttttgtcatttattctataggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctgggtgagtgcaaggaggagaaaccaggtgtgctaagagcctacagagagggcagctggccaggtattctgggctgtccccaagggagccaggggccagctatttcccgggtgttttctaccctgacctcataaaattagcttcactcattttatttttttaaaatttataggtgtaaaacaatgcattggatctctgtgggctgttgtggacagatcatcaaggcctattgttgagtgaaaaaaatgcaaaacagcaaacatacgtatttaagtataaatatgtgtataaatgatagaaaaggtctcgggggcatagacatcagattggcagtggtgattagttctcctgggagagacctagggccagagagtagacaaagtgacacatgttttaaataaggagaatatattggcattttgtataattaaaaattgataaaagtaggccaggcacagtggctcatgcctgtaattccagcactttgggaggccaaggcgggcggatcatctgaggtcaggagttcgagaccagcctggccaacatgtcgaaaccatgtctctactaaaaatacaaaaattagctgggtgtggtggcacacacctgtaatctcagctactcaggaggctgaggtaggagaatcgcttgaacctgggaggcagaggttgcagtgagccaagattgcgccattgcactccagcctgggggacagggcaagactccatctcaaaaaaaaaaaaaaaaatttaataaaagtacaagttacctatgcttattattggaaaatatagtcaatactgggacattgtaattttaaaaatcacctattatttcccttctcctttccctgaccccagtaatgactctaagcatttaggcattaatccttctgggtgattttctgtagattgatagaaagattgatagagacagggagatatcttggttttttaaccaaaattgggtcaggccatataaaccattcagaagtactgattttttctttgtgtgtcacgtgtgtgtgctgatttttgacagcactgtgaagatttcatccactcataagcaggccagctttttccatcagtggagtcccctgtacctgccccagagctgacgtgtgttttctctgttgtcagtttactgtctgctccctgggctgaatgaagccttgctctttggaacagtgtttctcagccaggatggggtaaatgagaatctttttgggttttttccttacactgcacctgaacccttgacacctgcttcccattccccatgagaaaccacagtcactcccatatgccgtatggggatggaggaagagttgaaaattctcatttcacttgttgagatggggtctcactgtgttgcccaggctggtctggaactcctgggctcaagcagttttccactttcccaccttgggctcccaaagtgctggggttacaggtgagagccactgtgcccagccaaaatcctcattttagagcagccctttttaacttcatcatatcttggaatcacccaggagttttttgtgatggtggtggtggttttttttaaccaatacagatggatgggctcctggctccgcccctctcttattgggagttggtagtggtggtaggagtttttgaaaggggttccttgggtgattctggggacacctcagttaaaagccactcctttggagcgtgcatctgaaaacaaccagccagagcacatggaacttgctttccaaggtgcacagggccacccagccagaccagaaatgtctcctgagaaccagctgcaacttgtgtatgtcagtagcttggggtggaagcagccaggtatgggggaacatgtctcagaccactccaactccctcagtgaacctggggcaggtcacttcatcctctgggcctcggagcagagacatgtttcctgactgagggctgccatgaggatccgacgacactggaggcaggcattaggggtgcgacacagagtgcattatgtagggaagggcttgttagttttggagctctgggagacatactatcttctaggttgcaaagatctaccatctttctttcagtgtccttttgctccctcctgatagtaataaacattgaactttttttttttttttaagaggcagggtcttactatgttgcccaggctggtcccaaattcctgggctcaagtgttcttctgccttagcctcccgagtagctgggaatataagcacataccactgcaccgtgctactacagtgaacacttattgggcacttacgtgtgccaggcactaagtgtgttcacatatgttagcactcttagaattcgccagcattccctggaagtaggtggtggtattcatccccattgtacagatctgaaaattaaagttcagaggtcaagtggctcaggttacacttgttggtgacactgaaaggattcagacccaggtttctcctagccccaaagtccaggctcttaacagctgttccatctcgattacaaagctctgaaatacctgggttctcaatgatgccatgacttggccatttgagtatatcattaatccattcaacacacatttacccagtacttaaccagtgcccgaagtttcctaacacacgcatgcccaattccatttcccagtcccttgagaatgtgacctgaggctcagcgagtgatttgtaaaggtgagctggccagaaaggctctgccttctcagtgtctcagaggaaagtggcccaggttcctgtacatccctgggaacaacctgcctcaccttccccttctgcccaggcaccgcctcgcatttacactgtcctattcctgatgattatcttttggaggagggaaatattttgggggttaacttaacactcttttgattttggttttatacaatggaaggtgaaacctaggcccttgtgcgattgagccagcattctctgtgtgtgtctgtgtgtctgtgtgtgtttgttttaagactacaattttttttttttttttttttgagacagggtctcactctgttatgcagcctggagtacagtggtgcgaccacagctcactgtttcttcaacctcctgggctcaagcgatcctcctgcctcagccttctgagtagctgggaccacaggtgtgcgccaccatgcctggctagtttttgtactttctgtagagttggggtttcgccatgttacctaggctggtctcaaactcctaggcacaagtgatctgcccaccttggcctcccaaagtactggggttacaggcataagcgcctgcacccaaccttaaaactactgttaattagcacttactacatgccaggtgctgtgctaaaaagtttacaccccttatttaactttacgttcctgacaaccgtaagaagaggcactgttgttatccctgttttaccaaggtgggaaacaggttcagggaggttaagtcacacggccagtaaatggcacagttgggactcaaacccaagtctgcctaaagccaatgaacagacttgggtgtggggttcagaccataaattcgtgtccatccatgttccaattccagtgactagtcgattttctgtgttctgttgtttataaagcaccaaagtccctctcacccacttgtgtttgcttgtttgcctgtggaacagagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagaggtgtgtgcgtggtctggggaaggagtccagattcagcctcccatggagaaaaaggaagagtttctgtcattgctgctggagaatgcacatgctctcttctagagcagcagccattggctgtcctcatcatgtgccaggcaccctgccaggcacggtatatatggcgtgccttttttttgagacagggtctctgttgctcaggctggaacgcagtggtatgatctcagctgactccagcctcgacctcccaggctcaagtgatccttccacctcagccttccaagtagctgggactacaggtgcgcaccaccatgcctggctaaatttttaaatttttgtagagatggagtctcactgtgttgcccaggctggtctcaaactcctgggctcatgtgatccaactgccttggcctctgaaagtgctgggattagaggcatgagcgactgcacccggccccagcctctctgttgttgtttttgttgtttttgtttttgtccagaacccaaagggaaaaaaacctcaagggggcagcccttcccttgagcagcagatgctggctcagtggccaggctctatgctgaggacacattcggaaacggcctgatacttgccgtccgaagcagaatttcaacttgagagaggcatgtccccttaagtgggtgaggggcattccagaatcttccaggctgggtggggtgggtacgtggaatttgaagacgcacattattacaatttttctatttgggaaatgggaaaagcacttcgtggaaattaccaaacatgaagtttgacagttcttgcttgggggaaatacatgtaagatgtagcgattcggacctttctggtgatcaaaagcagacccgtgttacacatggttggggagcaccgtctggcgggagaggccccggtgaacacacaatcctagtgtgcggtggtgaggcagcggtggagggagggagggcaggcgggggtcctagaaggggagccaggagggtctttgtgggcagctacggaaagtgtcacagtggaagcgacatttgataaggccttgagagatgggtagggatttctctgtgggataaggaggtgcacggctattgcaggcagaggggccagcctgtgctcagagcaggcccacagaaaagcctagcatgtgggcacaggaaggaggtgggagaaaggggttgacagcttgccaggtgcttctgggaagggctctggttgaatgacccagggatttaaatgaacttgatacctgttttctagttgtctgattcagcatgagttcctgatgttcaatagggatacatttggggtcaggaattctcccccagttgagaaaactggaccagatgcttggagtcaggcctgggcctggcccctggttcagtgctggcaccccactgccctgcgggagagtcacgtttcacaccctggtgtgtttcagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtaaccatggtccttacctggccagtgtccctcccgcacggcaggacagggacgtggcttctctcactgagacctcaccacctccctgtgaggtgagaggtgtcatagtggccattttaacatgaggaagctgagccccgagaggtcaaatggctggcccagggccacacagctagtgctggcagagtgggatttgaactcagagtctgagcttttctctcctgctctccaccacctctgctcacccccatcttggctctgttggtttcaagcgcccatggtatggtagaaagagctggagtccagatctagagggcagcaggttagatgaaccctcccacctctgcattgactcaggctaggacagtgttctcctctgtatggtaatgacagtgccctaggggtgattgtccagttttaccacatggttatgaaagaaactaagagtttgctgagaaatccacattagggggtgtgcccattagactagggcatctctcctcctacggggccgtctccacggagggcgtgtcacctctctgcgttcctattgaccacgtgagtcagtgaggcctgtccagacaggcttgaccacagaccatttctatcattaggagaatgttccttgagaaaccacccagtgcgcagaggttacgcagtttgtcccaggaccaggagttgtggatgaggcccccaaatgcagagctctgtcctcttcctgggcttgtttttgttttgttttgttttgttttctgagcttggtttttttgtttgtttgtttgtttgtttgtttgtttgttttttgagatggagtctcgctctgtcacccaggctggagtgcagtggtgtgatcttggctcactgcaacctctgcctccaggttcaagtgattttccacgggccaaaggactggccctgtctttcaaaaggtggagggtgactgtgtgtgtgcacttgcatgtgtgtgtgttcttatgctgcttctaaccatttctcccaccttcccctgaaggccagtcattccttctcagaacccttagggagagtagacctcccaccccaccccaccccaccacaccccacccatcatgtgtttctgagtcggaaaggactggagcccagtctcctttgaagactcaaatctgagccccctaaaaaacaaactgtgtagagcaggaggaagactcacatttgttgagagggccaggccctgggctaggtcagctgcctgagttaccttcccccgcctccatcactcacttcatcccaggcacgctgccacctgttggtccctgggaagggccagccagctctggtgtggttccagtgctgcacaagtggtgtgtctggaatgcaccccacacacacaccttgcccagctggctccccttgtccttcaggcaccaccaccccgccccagcccccagcaattcagcccatcgtactcttacagaaacacctggtttgtttttgtttttgtttttttaactatattatcatttattaaatgtaattaggtagctctggatccttggtctgttttttttttcttttattattattatactttaagttttagggtacatgtgcacaatgtgcaggttagttacatatgtatacatgtgccatgctggtgtgctgcacccattagctcatcatttagcattaggtatatctcctaatgctatccctcccctctccccccatcccaccacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtgttccatggtgtatatgtgccacattttcttaatccagtctatcattgttggacatttgggtgggttccaagtctttgctattgtgaatagtgctgcaataaacacacgtgtgcatgtgtctttatagcagcatgatttatagtcctttgggtatatacccagtaatgggatggctgggtcaaatggtatttctagttctacatccctgaggaatcgccacactgacttccacaatggttgaactagtttacagtcccaccaacagtgtaaaagtgttcctatttctccacatcctctccagcacctgttgagaaacacctgctttgaagtcacatattgcagtgtcatggatttgtttgtatttgaatactgatcgctttctgaccttcactttctccattagactctaagctccaagaagtcagggaccttgtctgttttgctccctactaggagcttagtcacaggcacatagcagttgctcaataaatgctgaatgaataagtgagtgtatcttgttggcaccattaagttagtagctaagagcttgggctccaagtcagcagatgtggtcctgacccagcagtgagtagcactgtgatctccaggatgctgtttgacccatccaagcctcagtttccgtttctgtaagaaacaggataattattataccttccctgtagggcacaattgggaggattatgaaccatttctcaatggtccatttgagaaagcatttagcacaatgtttggcacatgctaatcaatagtatgttaactgatgttaactcattattaatcatagtctcacagctaccatgtgagttgccaagtccgtaaaaatccttatttggcagatgaagaaagagactcagagcaggtaattgacttgctcagggctcacagcaagtaagtgattgaaccaggcccccaggcgctgtgaccccagacggcctattttgaggggagcacatcctatctcctgggcattacacaaagcacttgtgtattttttccatctcaatatcctcagtgagatagacactattatccctgttttatggatgagaaaacagggtttaaggtgaagcagttgctcacagatgcccagtgagtcagtgataggatgggctccaaaaagggctcactggctgggcacggtggctcacgcctgtaatcccagcactttgggaggctgaggtaggcagatcgcttcaggtcaggagttcgagatcagcctggccaacacagcaaaaacccatctctactaaaaatacaaacattagccaggcgtggtggcaggcgcctgtaatcccagctactcgggaggctgaggtaggagaatcgcttgaacccaggaggcagaggttgcagtgagctgagatcgtgccacagcactccagcctgggggacaagagcgaaactccatctcaaaaaaacaaaactaggctgactgcttactccataactctgccactgagccacatcattctcagaggtcagaaaaccacctttagcttctgctgtttcatgaggaagggaatctgcagaaaggaaacaaaagctgagagaaaagagtggggaagtggggttgatcattttgtcttgttccatactcatgtgttttgggtctgttcatttaaactgtttgtgagcccacacctggtccatggaaggcagtgaggccacgtgcttgggagagatccagacatggttgggacgagcctggcccctccaggggtctctggggctcctgggatttgaattcataatgatcgtgctttggatctacttgcagggccctgggaaagagtcacacctctgcccgttcttcttaaaggcaggcttggttcaggtgtggacgcttatgcagaggtctgttatagtggcagttgccacctgctgcttgtggacaccttgccatcattagacacacatgcagctagcctctgaggagggtgggggttccaattctccagggaaggataatgaggctcagagaggttagataacaggcccagagtcactcagctagtaagaggcaatgcaggggccaggtgcggtggctcatgcctgtaatcccagcactttgggaggccaaagcgggcgttcgagaccagcctgtccaatatggtgaaaccccgtctctactaaaaaatacaaaaattagctgggcgtgctggtgtgcacctgttgtcccagctgctcgggaggctgaggcaggagaattgcttgaacccgggagaaagtgagctgagattgcaccactgcactccagcctgggtgacagagtgagactccgtctcaaaaaaaaagaaaaaaaaagaggcaaagtaggaccacgggagtccaaagcccaggctgttttgactgcgccaggtgggcttcagagggaagggcgcacacttggcacgctccgtagctggagaggttcagagtggacttgttctttctgagctcaagggcccaagctcctatgccccttggcctgcccagcacagccccaggtgacccctccccagccccactcctcactgccacagtaaagatgaacatctgtgtcttcaggtggaccaaggaggatttggagctaattaacaagtgggccttccaaggggagagaatgattcacgggaacccctccggagtggacaatgctgtcagcacctggggtaggtgtggcctcaggtttattttattgttgttattttaaaaattcttattacaatggtaggtgcccaagagtctgtgctggtttgggaggaatcgaatcaatggattctggaaaaaatagcattttcctattttggggggaatggggagaaatcttggggccctgtctcacaccccctgaatcagaatctccgggggtggaactggggcctgggaagctgcagcttccacgagctccccaagagagttgtaggttcaggatgcagagccgttgccgtggagtttgcacaccatccaggtggcctcccctctggcaagaactcttgcttacagggcccagatgctgtgtcctgggccccaccttcaccatgtggcttgtcgggggaagctggacagtctggagggagggggacccaggaatccaaggcctggcaagagcttcctggtggggcttcggggaccttttgccctcctgcaccttttgtaactgaagctgggctgactcattacttagcctctttcctgaatggggcaaaatgaacccaacccaaagttcaacctctctcccaagtagcacagatatgttagcttttcccacagctctgacccactggtttttctctttaggaggagccctccgataccatcaagggaagatttcatccttaaagaggtaacctgggggtggagcagcacattcagccatggctgcattgatgtgtgcagggggcagagctctgcacctttgggaagtaccataggaggcaggtgtccctggctcttcatcccccaatgtggccctcacagtgcactagctgcaaggaagcaggggtggtggggaagacctgctctctccttctccccttcagctcttaaattgcagagatatcagaaagggaaagtcatgcatggctgtgcccgtagactctcagctgctcattcattcattcctgtatttgcttagtaaacaagaatccattacttcctgtgttcccgatgatgctgcactggggcgtaggaatggagagatgaagcttgggtacagtttccaaggactctcagtctgcttgtgggggtggggccagacacacacaaaagccgccacaggacaatgtgagagtcaccatgatggaggcacacagggcagaggcaggatggaagcgggagggaggcttgggaggggcttggagcagaagtgacatttggagactctcagcctgttttatgtttctgtgtccctcccgctggaatcattggaatcacaaacgtgcatgtgcgatttcagcattctctgttctgtttgcgatttcagcatcctctgttctgtttgcacccacggcagaattgttgggtgcctggaatgaaacgcatggcagaggggagccaggtgcctttttgactgttccctaagcccttgatcaagttgtggggtggtgtttgtcccagggcactttgccacctccatgggccttttcgcatcagtaagggtcctggggctctctcctctttactcagggcggtcttcatggatgagtggcaggtcctggcctgcagcccccaccagctgggccactccattagtggctcagtaacctggcctgccacagcgccacacctgggcccccggctagttctctgggatctttctgtcccagctcagtcatgcctccctttccaaggctgtacgtcagagttgtcagcattggcactattgagatttggggctgggttattctttgtggtggggctgccctgtgcattgtagccatccccagcccctacccactagatgccagtagcaccctcagcgtggcaatcaaaaacatctccagacattgcttagtgtcccttgggaggcagaatcacccttgccgccgacctttgcactccgcagaagccagtaggagcgtggaacagcttcctcgggttgctccagcagtcgtcaggagagcctcgggtgccgaggtgaagctggtctgccaccgccccggatccatgtggaaccagagctggatcatgtgggggagtctcaaatgcccgggccccggcctgtcttcaggagcccacggtctgatggggaaggcggtcactggaatcgtcagagagaagacacctgaagggttgtgaagctgctgtgggtgacagtgacaggcgtcttagatctggctgcgagcctggggaatcattcatggaagtggtggcatttcattccttcagtgtctcctgagagccacttgtggcctaagcactggactaggccctggagctagaaaactgatgaagacgtgggctgggcaccgagtgtacggtctactgggggcatcaggagatgaatgaggaggtttccaaggggggcgggcaggggaacggccaggggaatggccaggcgttgctggtgtgctgggcggaggcgctgggtccacaggcctaggtttgagtccagctctcccacttgccagctggtgccctcaggtgagtcacttctcccagacctccagctccttgtttacttagggggatcttgaacatacaatcagaagcggtggctctgaagtgcttacctgtttgctggccgagttcattcatcctttccacaagtatcattaagcacctactgcgtgctgagtactggggcctccgcagggaacaaaacaaagccccgcctccgtggaactcatactttgttgggagaggagaaaaaatcagttgtctgtgagagcatatcaggcagtcttaagcacctttaggaaacaaggcagggtcagaggctacaaagagaaggaggggtccgattggatgggggttcgggggctgctggtgaaggaacattgagcagaaacctgaataagtcacgccgctatggggcggggctggtccctggcagaggaagcgcggtgcaaaggtcctgagacgagcacgctgcctgccgtgtgacacagtagctgggaggtcagagtggctgagtggagtgagcagcctggggagcgaggagagaagaagaggctggggcagtggccaagcccggatcacaggagcgcttaccaggcttaccccctgcgtggtggccgctggatgggtatgagccctggatctggtggggctggtgacaggcctgtctgcagaggacttgtctaagaaagatgaagatgcaacacccaaactcctcccgcctggctagatgggagcatggagcaaaccaacctttgctgcctgctgtggggtgccacgggagcagatggcggcttcacagagaagctgggggccagactccacgttaatcccatggatggcttaaggagcttccccccaccaaccatgcgtggtgcctctctgtaaagaaaaaatgcattgtttgtgaagtggatcaagatgcggcctcccagaacgctgcccttttgaggaatggcttgtcttagaagggaagagaaaagccaaatagaatgttcatcttttgtaaagttaaaaaaaaaaaaaagccagcctccaaggctgagaatcgatattaatttcatgggcttatgggcagtgagataaagcaggtttctggcagccctttccagccctattggattttacaatcttgaactgtgaagacagcgaataaaggtatcaagggctctgcccgtctccagctgtctcgggccagagctcatccaaatcccccaccttccatcccagcctgcagccctctgaaaggcaggttggatggcaagaaatgtcagcttgagccctcgaagacggctcactacaaggacagttgggattgtggctttaggagggatttatgcagctcctctggggcaggtgaggaccacggggtcatgctagagagtcagctcaacgtggctgcctgggacacgtctatgtgccagagggcagccaaggggatgactgactctacatctggttttagaccagggctgctcgtccgggcaccattgaggtagggcaagaatgggctcagcgtgctggggaccatcctcctctgcaaccctgccctccctgcatttacgagcccgtgcgtggcactgcccgcaccagctagcctgggcatcttccctctgtgtgatccatttcagggcctgttgcttggtctttctaaaactccagcttcgtgggggtgacccacacaagtgaaccttcgccccctccttgtactctgctatagccactttgaatttctcactggatgactgtgccgggttccgccacctccaggctcacacaggctgctccaactgccagaaatcctcacccttctagctttgcttggtggcttcttacccttcctcagttctcagtgtccacgtcatgccagaaaaaccttctcggcccttctcccctatcccctctctggccccggccccaaggccacgctgtgcctagcatgttgtaggtcccagttgaagttgaatgaataaatgagtgaaaagccaagggagaatggccacccaaccagtgcctgggatggaggcgcagctgtggccagcagcagaagccccatgctcccccaatccagtgtcacctcttgtgcctcccttcttcctccgtatcagggtgggcggcttcccggactgctcccagtcctgtcccagctcctccatcttgagttcagtgtggacctgcctcctcttcaccctgcaggtcgccagctctccagatcctgctgaccaacaccaaagtccctcgcaataccagggcccttgtggctggcgtcagaaacaggctgctcaaggtgactcttgttcccttcttgggcaggtttcaggaaggccaggacacaattacatctggattttcgaggtctccctctggctgatgggttatagggggtgtggtgggtggtgggggcccttagggaggtggttttggcagaaaagaaggtaccgtccgtgcccgtagcctggccaggaaaatgacagtggtcgggctcgttagacacactgactttgcagctgggaaggcaaaaaaacaggctcagaagagaggtggtttccccagaggatgggcacgggctgtgtgaacacctcctccctccaccccactgctggggcagctgtcctgcatctgcctgcccccaggcctcaccagccgttccttctttttttctccagttcccagagatcgtggcccccctcctgacctcaatagatgccatctccctggagtgtgagcgcgtgctgggagagatgggggaagccccagccccggagcagtacctcgtgctggaagtaagagcctgtctgcaggaaccggggttactgagtccacaccactgtccaaggcagtggctctgcaatctggctgtgctcagaatcccccggaagctagcacatagaggtcaggacctgcctctggcctatgctctcagctgggcccaggtctgtgcgtgccatataagcgtatcttattttcaggcctcttcctgggtgattccgagtaattgggagagtgcaagggaggccagggcctggctcgtgctaagtgcaatggaaacaggtttgggtcacttctaaggagctctggcccacgtaggtagatggggatgtggctgatgcagagtgctctgtcggtgcaggggtgacttcttggtcactctcctgctattgctaacttcatgggtgcattcaacaactacttgtcaactgcctgctttgggtcagacagatcctaacattgttttttcatcattgcaaccccatccactgccatttgcataattctagtgtagaggttgtgacctggtactttgggtgtgatcaggcctgtgtgtgaatcccagctccacttctgctggacgtgtggcctcgctagagtgtcttaagaatgctcagattagacgggcgcagtggctcacctgtagtattagcactttgggaggccaaggcaggtggattgcttgagtccaggagttcgagaccaggctgggcaatgtggtgaaactctgtctctacaaaaaatacaaaagttagccagacatgacggtacatatcggtagtcccagctactcgagaggctgaggcaggaggatcacttgagcccaggaggtcaagtttgtagcctgggcgacagaatgagaccttgtctcacacacacacaaaaaatgcttggagtctcatgggtgacacgcaagcacaatgtctggtgtgctatgagcttagggaaccaaagagcccaggctccccctggacacagtccacctggcctggtgaatatgggctgttagccatctggctgcccttgcagaatgagaggatcgggtggcccctagctgccgtggctgtgcagcagccgtcagtgaagggacaggagaggggcgtgcggtctccatgtcaccacagtccctccccgcgccccgcactctgtagtcattgcctggtgtctcccggtcccccgtgggcattcgagtctgtagcccctgtgctgagtggaagctgccactaaagcaagccttttacaaatgattcttttcacttgatcctcacacccacctccctgtgaagtaggtgtcttatccctattttacagatgtaaaaactgaggcctgaagagagacttcccccaaggttatccagctagtgagtggccgagccaggggtccagccgacggactggtctgtccctttattcaacagatctgtcatgagcacctactatgtgccagggcagcgcctccatcgaattcctgtgtttcggccctcattccctcagtctttgtcttcctagctctcaattccttccacatagaaaggagggaacacagtccccccgagtaggaaatcaataatgatagaatactgcctaaaatacaccctgtcgagtccctggagaatgccacagaacagcacgttgattatacattgtgtgtatttttggctgtggcagccgctgaaatgtgcagctcagctcctggacagctttgcactcaaaccagcgaactgttctcctgtgtcacaacctgtcatctgatccttgacagattttggatcagaatgtgacaggtgtctggaacctgcctcggcaacgtgacacctggtgctcaggcgcagagagcggcccccagaagtcttctctcacatccagcccatcaggctggtgagaggcacccggggctgccaccaggccatcatgcctgtctgctcatttgtcaaaaatggtgagcttggcgcagagcgaggtatgaggcaggctgttggggagggccactccaaccctgcctgaccggccatccccatgcgggagagctaggtgggcctccgcagagatgcctcagtgattggcaactcctggtatacaggcaatccaggtgccccggaacagagcttcacacggaagtgaggaatgccagggggtgctctcagaggcagggtagacaggagcttcatgtcaggcagacccgccttccagtgccagcttggtacctactagctcagtgatcgtgggcaagtcacttcttctctgagcctctgtttccccttttgtaaagtggggatgatgctaacgtacccataaaaatactaacagcacatatctcgtgccaggcattgaacagaaaactcaccttgtttcgtctcagggcaaagaagcagattttttttttttttttttttttgagacagagtcatcttgctctgtcgcccaggctggagtgcagtggcacaatcttggctcattgcatcctcccaggttcaaatgatcctcgtgccgcagcctcctgagtagctgggattacaggcacacgccaacatacgtggctgatttttgtatatttagtagagatggggtttcgccatgttggccaggctggtctcaaactcctgacctcaagtgatccacccgcctcgacctcccaaagtgctgggattaaagacgtgagccaccacaccctgctgaggcagatactcttatgaccccggtttacaagcaggagacagacccagtgcagaagaccttgctcaaggacacacgaccaaaaaggggcagagcagagactcgaacacaggcctacttgactccaaatcccatggtttttacttcctgatggctgggaccgtggctgggcacccatccttagagccccagcacgttgtgggtgtttggtaaatgaaatctaactactgggtgcctgggcagtggaagctgtgaagttttattttttcatccacatgcatcttgttggatccttaaagagcaggaagtttatcctgcataactgaagaaacctagacaaacagctgtttccctgcttatggccttgctggagttacacctagttcttattctgaaaccagtccccaaggcagctgtagggaggcatgttatttgaaactttttctcttgcaaatggcagaaatccatttcaaccagacttttgtagaaagggaatgtattggctctcaactgagaagaccagaggtaaatggcttcaggtatagctcaatccaggggctgaaacaatgtgtcgggaatctgtccatctgccacgtaatatctgatcatgtggcaagataggtcatcttggcgacttgtgtctgaagttaattattttagcagctctagtgggaaggggcagaggaaaccctgggagggctgtgattggcccagcttggaccacatgcccatccctgatcagtcaccagtgccagaggcttctgtgaccagccctaggatatgtgctcactgctgtggtgaaggtatgctcagctctacccaagctccgtgagaaatgctgcagggcagaaggattcttttacaagtggagagggccagggtgccaggtaggcaaagccgttggctgtctccagccaacaactgtcagatggacgaggcaggctcaggggtgggcataggaccttggcctcaggcaggccaagtgggaacagatggaaccttctcccctaggagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccaggtatcccgggggtaggtgggccaggctgccagcctgggctcctaagaggggtccacctggagaattcccttgaaaggaaaaagagacctggaaacaggtctcagctccgctgtgtggccttgggcaagttagttaacctctggtctttgcttcctcattggtaaaataaggatgagagtatctagcttgcaagatcgttgcccagattcaagcaggaaagtgcacctagagagcctggtgcagggctgggctgtggctggggctcctgtcatcggggctgtccgcacaagcttgggaagtaaccagggcattgtcactctccacgtctgcctaaccttgccccacttgtacccttgatgtggtcaggatgcggttgattttgctacaaaacgaaagggtttccttcccgttggtttggggaaagaggaagaccgagtaatgggcttggcttaggaagctccctggtgcctgggggcctggcaaggggcttctgctagtgtttaaccacctgacacctacctctgccctcaggctcgctcctggcctacagtaggcactaaccggtcccacctgcctccatttccctctgtgctccttgtcccctccttccttccttctttctctttctgtctttatctcctcctctctgttcttcatccttcctttcccctctgctttgcactgagcccccttaggctccagacatcccctcacactccatgatggctcccaggcctcaggaggtggccacatcctcactccagccaaccccaactgttggttcctagttcagagcccatgacgatggtgggacttgacatttctggagtgtgcccgctgtgccaggtgttgtgccaggcactttacctgcgttatttcctttaagcctccctgagatctgcacggggagtcatcattagccccattcccagatgaggagactgagactgagagaggggaagtcacttgtctgaggccacacggccagtacaaggcaaggccaagtcctgtgacttgagagcccatgtttttaactcttgctccctaaacccctgggggtgcaaggctgggcattccagtgcacggaggggctgcaggtaaccttgggctttatggcctgttggctcaggtgggtcacagccaggaaggcacagcaggaaggcctgggcttttgccttgaatatgatgagcttctcccacggagcggagagttgtcaagggtgacctgccttccctccccgcagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaacagta

SEQ ID NO: 2606 - DNA, 23572 bp, Homo sapiens; identical to SEQ ID NO: 2605
  source 1..23572: mol_type = genomic DNA

SEQ ID NO: 2607 - DNA, 38622 bp, Homo sapiens
  source 1..38622: mol_type = genomic DNA
aaattcgcggtgggggcggagagcgcagggagaagtaagcccagtgcaggatcctgaggcccgtgtttgcaggaccagggccggccttccgattccccattcattccagaagcaccgaaccacgctgtgcccggatcccaagtgcagcggcacccagcgtgggcctggggttgccggttgacccggtcctcagcctggtagcagaggccaggccagtgccacaaggtcaggctccactgggccctgcccgcccaggagcctgtggtgtcaggcacctgaaggggtgggttgcccctccacacctgtgggtgtttctcgttaggtggaaggagagacttggaaaagaaaaagacacagagacaaagtatagagaaagaaataaggggacccagggaaccagcgttcagcatatggaggatcccgccagcctctgagttcccttagtatttattgatcatttgtgggtgtttctccgagagggggatgtgtcagggtcacaagacaatagtggggagagagtcagcagacaaacacgtgaacaaaggtctttgcatcatagacagggtaaagaatcaagtgctgtgcttttagatatgcatacacataaacgtctcaatgctttacaaagcagtattgctgcctgcatgtcccacctccagccttaaagtggtttttccctatctcagtagatggaacgtacaatcgggttttataccgagacattccattgcccagggacgggcaggagacagatgccttcctcttgtctcaactgcaagaggcatgccttcctcttatattaatcctcctcagcacagaccctttatgggtgtcggactgggggacggtcaggtctttcccttcccacgaggccgtatttcagactatcacatggggagaaaccttggacaatacctggctttcctaggcagaggtccctgcggccttccgcagtgtttgtgtccctgggtacttgagattagggcgtggtgatgactcttaaggagcatgctgccttcaagcatctgtttaacaaagcacatcttgcaccgcccttaatccatttaaccctgagtggacacagcacatgtttcagagagcatggggttgggggtaaggttatagattaacagcatcccaaggcagaagaatttttcttagtacagaacaaaatggagtctcctatgtctacttctttctacacagacacagtaacaatctgatctctcttgcttttccccacaggcacctaagtccacctgggcctggagcaggacaggttgcaaaagaaaatatctcgggacccccaaactccttatgctaagggaaacatcgagcctgggaactgagccatcaacgctgccattctttttcccaaacagaaccctgttgtcagaggtacacccagagcaactccacaccgggtgcatgccacagcaactccatcttaaataggagctggtaaaacgaggctgatacctactgggctgcattcccagacgggtaaggcattctaagtcacagggtgagataggaggtcagcacaaggtcataaaggtcataaagaccttgctcataaaacaggttgcaataaagaagctggttaaaactcaccacaaccaagatggccacgagagtgacctgtggttgtcctcatttttacactcccaccagcgcatgacagtttacaaatgccatggcaatgtcaggaagttaccctacatgtatgtctaaaacggggaggcatgaataatccaccccgtgtttagcatatcatcaagaataaccacaaaaatgggcaaccagcagccctcagggttgctctgtggagtagccattctcttactccttcacttcaggcaggggagatgaatttccctttgagcctgtggacagagggcagcctggcagagggacaggcatcaacaaagcctctgagtgtgacctgggtcctgagttcagggatggcaatggggtaactgagactggatcagaagttgcctggaagaagagagggccattatcagagtataagagtgtgaaacttatctggtaggaaaaaaaaaagagtaactgctgttcgtttaatagagcacacatcctctgcaattcaggtgggaggttgtgagcttcttaagtacagaagctgcctcttgatttcagcatagcgaggaggtgctgaagagcgcaggtttggagaatgatcacctggattggaaccatagctctaccaatatggaacccagctccttaggcctcggtcttctcatggagaacatggtgtgataatcctactcctctgggagggtggctgttaaggtgagtgattgcacacgagtccctctagctgatgttaccgagcggtccttgtttttagagctcccaagagggtggcgggccacttccaagatggcggcaagcctcttgttctctgacctggggttcttggcctcacagattccaaggaatggaatcttggggcatgtggtgagtgttctcattaggacgaacccaggcacttagacatgcgggaacaatggcgagcctttagcccgaatgggagcggcaatgggtgcctcgctggatcaggagcacagcggacacactgccggatccagaggggtggacatcagtggtgggtctgtgatggcggcaaacaacagcagacagcaaatggcagtggtggatggcaagcgaaagctcagctccagccataacaaacacggaccagaagagtgtgcagttgcaagatttaacagagtgaaaacagacgtcccatacaaagggagggaacccaaagggggttgccattgctgggtcgaatgcctgggtttctgtctcaatcactgtccctccccctgtgctctcaggcaatagatgattggctatttctttacttcctgtttttgcctaattagtattttagtgagctctctttactacctgattggtcgggtgtgagctaagttgcaagccctgtgtttaaaggtggatgtggtcaccttcccagctaggcttagggattcttagtcggcctgggacatccagctcgtcccgtctctcactgacacctaacacatcctacatgctcagtagacaggagctattattgtatgactgactgctgaattacaccccaaaacaaccacctatactccccaaggccctgccatatcatatgcatattagaggcaatgaagcaccaaaatctaaggccagggaaggactgcggtggacaagggaagtgcctagggcgttaaaacttaaggaggcattgcaccaactgggagtgagctgtgtgtgctgtgtttcctgggcagggcgcctcactgcccttccgagtcctgccctggctgaggttgtgcctctatctggttatcagttgcctgcagctctttctgattttgttcgtgaacaagggcccttagggaagcctcccgctgttggaaacagcagcagcatcacccagagtgaagtctctgttcacatgagtgccagctctgctcacacctaccctgcgttcccaaggcactgttcctgcttcagaaagcatcagcccagcctgctcacagtcccccaggatgtgctgttgcctgggttcttgactaggaagtaaaaggcccagaggggttgagtgtgtgtgtgtgtgtgtgtgtgtgtgtgtgtgtgttaaagtgaggtcattgctaattcctgggagaacttgtgttccccttggatgaaccccttggatgaagaaccccttggatggggttgcccagccctaggagtggatcctgcaaagcaaaatagatttcagcacagggagctggctggggggctcctccccctcttgtaggtgcagcagtattgaatttgattccatccaggtttcccctgaccccaggacctaaagctggggcaggttctgggccttgaggttggttgggggtgacccttcctaatcatggaagtctttagcgggggcttgtaagggactgtgagctgagctaaggagaatggaggtggggtgccaaccgctcccaaagggaaatgccatctcccactcacagccagttagccgagaatgggagctcccaaagggaggaccacccatgggtctgcttgactcagccctccccaacccctttcacctttgcagtaaaactctagccaaggaagacaaagagacctttggagaccaaaacagaacttttaattcgggccaacagcaggctcatgcccaaaatggctgccaaccccaacaaagaaagcagctagcttatatgtcgtttgagatgggaaaaacaaggtaggatacaggtttcagacaaagacagtaaattacttaacccgtgacaattctgaggaaactggcaattcagttatattgactagtcatcctccaagctggactagggttggaggctggggtcccgaggcaggtgataagcttttgagataagcttgcatctgcaacttgttacaatgctgggaggggctgcttaaaattttagcctatgtgttacttctaaatagcttatactaaatgttaactgttttcatgtgcgtccatgtgaagagaccaccaaacaggctttgtgtgagcaacatggctgtgtatttcacctgggtgcaggcgggctgagtccgaaaagagagtcagcgaagggagataggggtggggccgttttataggatttgggaaggtaatggaaaattacagtcaaagggggttgttctctggtgggcaggggtgaatctcacaaagtacattctcaagggtggggagaattacaaataaccttcttaagggtggggaagattacaaagtacattgatcagttagggtggggcaggaacaaatcacaatggtggaatgtcatcagttaaggctgtttttacttcttttgtggatcttcagttactttaggccatctggatgtatacctgcaagtcacaggggatgcgatggcctggcctgggatgcgatggcctggcctgacaactattacctatgttatgtttattattttaagctttattattactattttatttattttattttattttccttccacacacccgtttccaccctggagaggccagatgagccagactccagggaggcctagaagtgggcaaggggaaacgggaaaggaggaagatggtatgggtgtgcctggttaggggtgggagtgctggacggagttcgggacaagaggggctctgcagccattggcacacaatgcctgggagtccctgctggtgctgggatcatcccagtgagccctgggagggaactgaagacccccaattaccaatgcatctgttttcaaaaccgacggggggaaggacatgcctaggttcaaggatacgtgcaggcttggatgactccgggccattagggagcctccggagcaccttgatcctcagacgggcctgatgaaacgagcatctgattcagcaggcctgggttcgggcccgagaacctgcgtctcccgcgagttcccgcgaggcaagtgctgcaggtgcggggccaggagctaggtttcgtttctgcgcccggagccgccctcagcacagggtctgtgagtttcatttcttcgcggcgcggggcggggctgggcgcggggtgaaagaggcgaagcgagagcggaggccgcactccagcactgcgcagggaccggtgagtgtcgcttctgggggcagcgcccagtaaccgcgctaggagcgcggagaagggcattgggagagcggcgttcgtggcggagactagcgctccggagcacgggcacgacgggggcaccttctcggctgctagtaactaacaataataataatcataatcatagcaagggcgctgatgggcgggctcggagcacgcctgattctggttcccaccaggctgcccaggctcctgatgacgcatcagaaacatccccctaacccgcggccttcctgcaggagaggttgggaaggggtgggggacggggctcgggggaggtctccgagggactctagtaagcggggaagggcgccgggaaagtttcagatccacggctgcgcgggccacgagcccacccgaacgccgaccactgctttccgtcgacttctatttcctgggaacgcgcgaaagcaaacccaagtcagactgcggaggtcgctggggagggaaggttcaaggagttctcgccgatcctgctgaataaagggggttccgagctgggccgagatggggcatgcgcgggaagacccctgcccgctgttcccccccaccgccccagtggatgccatgcctggggcctccccggcgcgtggggctgacgcaccctcggggtccatcgtagttggccgggatcgtggagtgggtgcggtggacgaagggaggcaggacagtcccgggggtggcagaaggagcccgggcacagctgagacctgcgctcccatcccaccaacactcacagcaggtgctgccgagctgggcaattgggatggcccaagttatttggttaaattttaaatcacgtttgttactgggaagtagagtccagtgatgctaaccgcgcctctacctccaccaccggtgtcagtcccaaagggctcctaaaatggctgtgtcatctttcagccttggaccgcagttgccggccaggaatcccagtgtcacggtggacacgcctccctcgcgcccttgccgcccacctgctcacccagctcaggggctttggtaggtagcagtgcatttggtctaaagggcaagatgttctctcttttattcataacaaatttaaataccagcagggtttggggggaaaaacgctttcagaagaaaaggtgaatgtcagtcctgcaagagttagttttaaaactagactgaattggcacatgtatacctatgtaacaaacctgcacgttctgcacatgtaccccagaacttaaaagcttataaaaaaagaaaaaactagactggattatgttgggaaagtgtagcctcttccatcttaggcatttcctagaacgtaggcagtaggtggtccttattaggagttttgggagaggaagggggctgaatcctacctcccatccctgctcctctatggggtctgagctgaggaagcttcaccacaaggagagaaccccctgacaaccctggatgccacctttaccctcactgcaggaattctgtggccacactgcgaggagatcggttctgggtcggaggctacaggaagactcccactccctgaaatctggagtgaagaacgccgccatccagccaccattccaaggtaaggcagaaatgaagtgggccgttgggttctttcttttctttctttcttttttttgagacaaggtctcactctgtcgcccaggctggagtgcagtggcgccatctcagctcactgcaacccccgcctcccaggttcaagcgattctggtgcctcagtctcctgagtagctgggattacaggcacacatcaccacacctggctaatttgtatgtgtttagtagagacagcatttcaccatattggccaggctggtttcaaactcctggcctcaaatgatccacccgccttggcttcccaaagtactgggattacaggcacgagccactgcacccagtcaggttcattttagttgttatgttaaccaggtttcctgcacctgtgcgctaactttcactttcccaaaaggtttcagggtgacccagcaggcaatgagtgattctcaaattcaggatttattgtgagagattcacacacacaattgagcagacattcacagtacaatgattaaagggagtgatagggtaaggacccacagtggaggctctggaggccagcccactgacagccactccagggagtccagaagtcccgctctagtgctgggtggtggagggaaatctgttcctccagggacctcgtcctcggctgcccagctgccaaagtcaggaataagctttcagaaatctcactgccaagattccgaaaacgcttcagacattgctagtcccttgtcgcttttgcgatcctccacaggtgtgcgtgccactgggtccttattcactggggtctctggtggcattgggccacagcaagtgttccctcatccccttagtctaccacacacatgcttaccactttgaagaaaaacccctttactatgagcgaaagtgagaaacacgtatgtttattgtttctaaagaaagaaacttaatatgggcttaatgctacctagtgagtgcctccattttgagacattagggtcacaagtcattattatatatcatgggcacaaacctgccctgggcagggacggaaggaagcccctgcacaggggcagttgctcaggatgtgagaagagcctggtgcataaccccatccatgcccacctaacatctcaggctctgaccagtggggctgtgcagtagcgagtggatggagggctggaaccctgcagcctcctctccaaacacagggtgcagccaagacattttaggagcaatttgggatggagagctaggagtcgccacctcttggctcttccaaggccggaactggtgcctgcactcagttcagtttgaagactgcagctggatgccaagttccatggaggagtaagaaaccggtttgaactcccgagattgccctgcccctgaaatccaaactgatgttccgaatgatcagggaaaggtacaaacgtttatggtttacagacaaaacccataaggtttagctttcagagaatctcattttatgaagcaaattagggaagggaatctactcaccaagtcctgtttcagctgattgagtggaacctgtggtcatgtggtacaagtcctggtctcaatgatgctccttatctggctgcagaaaggccaactgaggcaaccatagcccagaagactggtactcctgagaggcagatgaagtggtggtctttgatatcgagcctgggatgccctgggcacatgaggtatttccaaaggcatgggagttttagggaataaattcccagattgtcagactccataagtaccgtttacaatggattaccttttataaccatcccaatcctacctgacaaaagaggtgggcagattacgaggtcaggaaattgagaccatcctggctaacactgtgagaccccatctctactaaataaatacaaaaaattagccgggtctggtggcgtgcacctgtagtcccagctacttgggagcctgaggcaggataatcgcttgaacccgggaggtggaggttgcagtgagccaagattgcgccactgctctccagcctggtgacaaagcgagactgtctcaaaaaaaaaaaaaaaaagaaagaaatacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagaggtaagttggtgcatgctattttctgtaacatttattttgagtcataggagaaagattttcagttacttttatccaagattattagacactgtaaaatttcatatttaggcacttgtcctacaacattttaaaaatgaatttcaaatacatacgtgtgtatttgtaatgcagacaagtataaggcagtcagttacatgctttcaagagtaaaatgaatgacatttcatttcccccatttgtgggagtaaaagaatgacaatatgaaattgatgatcaaaagaaagagcataaaagatttagagctcacgtgttttttaaactaaaggtttgggtatcaaattaccgtaatatttggattctcttggctacattggaaacagttctataacaattttatttttaaatgtaaagtttttgtttgttgttgtttttaagacggggtctcgctctgtcgcccaggctggagtgcagtggtgcgatctcggctcactgcaaccttcacctcccaggttcaagtgattctcctgcctcagcctcccaagtagctgggactacaaacacacaccaccacttccagctaatttttgtatatttagtagagatggggtttcactatgttggccaagctcgcttcgaactcctgacctcaggtgatccactcaccttggtctcccaaagtgctgggtgggatacaggcgtgagctactgtgcccagcctttaaatgtaaactttttaattgtattacaactgcatcagaagttgtatactttgcaactattcaaatttatactgaaaacgtttttgaagttcaacctaaaattatgacaggagatagttttagaaaatattttggggaacagaggcatattctattttttttttttgagacagagtcttgctctgttgcccagactggggtgcagtggcgtgatctcagctgactgcatcctctgcctgccaggttcaagcaattctttgcctcagcctcctgagtagttgggattacaggtgcccgccaccatgcctggctaatttttttgtatttttagtagagacaagttttaccatcttggccagggtggtattgaactcctgacctcatgatctacctgcctcagcctcccaaagtgctgagattacaggcgtgagccccggggcccggcctggagggatattcttgaagcgccttgagcagggaggcagcgtttgtctttatctgaccttggcttctttgggtcactctgtttctctttccgtgaataaaaagccagtgagcacacactgtgtcccaggcactcttctacgctctggggacatcaccatgaacaactagtcagagtccccacctccaggggccttccgttctggtggtgggtttggttccatggttgaatgcacccagctgcttatctgttcaataggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtaagttgctctctgaaagtcgctatccatgtgacatgagccatgcccattcgaggctgcccttttctacagcggtgctactgctgcccagatatgcctgctctctcgcctctcctgtgccaggacgcagatcctgaccctctacttgccagctgacaaccatgtatagactcgttgccttagctcaccgtgggtggaggtgctgctggggttggggacactggctgagctgtcgatgggttcagctcatctatactagaaggaactggcccaggccctgggttcaaggagcactaggtttgtttttcctgcccacatcatgattcagtctcaagctacaaaccctggggcatcattaagatattatctttgtagggaagccacgtggtgaattttttgcccagaatcaagacatatttttggtgggaaccaatcatggcccctggaatcagtccaacctcagttggtcccgacgctgacactctcagctgtgtgattgtgggtagttattcctcctgttataagcctggttttccatatctaaaatgagaataatggtctttgctttatatggctgagagcaaagtgcagggagtgtccaggtactcagagtgctcagtttcttattaccgtggatcactggtctgtttcaggctggctctgttttcctaggcaatgttaaacaatttttcaaacaatattcaaaaaacattgaagcgtttagaaaaatacagaggaccaccacctttccaccaccctgataccaccgtttacatttttctgcatttccgtccctggtgcgtctcttgtctggctgtaagagatgtaattatgtcagggtatggggcaggaggaactctcacccactcatacttgcgtgctttggaagcagcttggccttttccagtcaaggagaacagagtgtgtctcgtgatctggcagttccacttctggggatagactgtggttctcaaagtgtggcccccagcccagcccattagcatcacctgggaagttgactgaaatgcaaatgaccagcccctcctcccactcttagacctggtgaattggacactctggggcagggcccaccccctgtgctttaccaggctctccaggtgattctgctgtgtgctggagtttgaggaccatgtgtaaacccttgcacatccccctgggagccacatgcatagcagcactgtttataacagcaaaactcagaccctgtctacgtgcctgtcatggtggaatggatactgggagtgtggtatgttcatgtagcagaattctatacagtagtaaagaggaatgaactagagttccaggtatcaaaatggctgcatcaaatgaacaacgttgaaccaaagaatcaagttacaggaaatatacaaaatgattccacttacgtaaaattccccaacaggcagcaataggcaatataccattgtgggaaaaacatataggtggcaaaactataaagaaaagcaaggatgtgatgattgcaagcctcaggatagagggaccctctggaggtgaaggagttgacccagggaggtgtgtgcaatgtcctaagtactgggagtgtttgtgttcttaacccaagtggttggtacatgcatatttgctttattatgtttgacacacttttgtaaatagatagtataaataaatgaaaacaaacaaaaagttataaggtgaactaagaccgaggctaccaactgtattcatgcatttggtaaggctgtggttctttctcagtcagggcccattttgctccctggaacttgtggccaggtctagagacatcttggttgtcacaactcagggtgaatagtgaatagaggccaggtatttggctaaacctcctacaatgtgtagggtagcccctgcaacaaacaatcttctaaccccaaatatgaatagcttcttgtcctgttataaagaagctattctagtaaaaacgtctgtctatgatgaagcatgcacaaaaatagtcattagaaagaggtaaaagacaaaatgattttctcatattttcttcctgaacctcaatcagcccactttaggaaaattgcacccagctgctggtaggtaggcaggaccgagtgtgaagtctgctgctttctctgtttttatgcaagtacttcactattttgattactttagttttatagtaattatggaaattaggtaatgctagtcctctgactttgttcttctttttcaaagtcattttgactaagaatatttagatcatttctatttaatgtgactggtaatataattagatttgagaatatcatcttgctatttgttttctatttgtcccgtctgttcttcgttccccctttcgtctttttctgccttctcttggattattttttatgattccatcatgtctcctttgttgtcttattaagtataactcttggtgtttttagtatatatctttaacttaataagtcaaccttcaagtgatagtctgtcacttcatgtatagtgcgagaaccttagaatagtgtatttccatctctctgctctgagccttcatactatttctatcatgcatcttttacatacatcataaaccccacaatacattgttattattgatgttcaaacattcaattatcttttaaataaagatagcaaaggaatacaaaaaagtgtagtagttaccccttctagtatagactcctttgtatagatccagatttccattcagtatcattttccttctacctaaagaacttctttaacatttcctgtagtgcaggtctgctggtaatgaattagttaagcttttgaatggctaaaaaagtctttgttttgccttcatttttaaaagttatttttgctgggtatagaattctagattgatggtgtttttcagtactttaaaaatactgcttcactgtcttctcgcttgttattgcttctgataagattgacagcagatttctcatttgtgtccctctgctcacactgtatcattctctggctgctcctaacattttctctttattactggttttgagcaatttgaccctcttatggcttgatgatgtttatgtttgctgtgcttaatgtctgttgagtttctgggatctttgggtttatggttttcattaagtttgagggaattgtatgtattatttcttcaaatatttttttctgtctctcttccattctcttttggggattccagtaacctgtgtattagacttattgaagttggccgtctttaatggagtgtattggttcattctcacactgctataaagaactgcctgaaactaggtaatttataaagaaaagaggtttaattgactcacagtccacatggctggggaggcctcaggaaacttacaatcatggaggaaggcatctcttcacaaggtggcaggagagagaatgactgaaggaggaacttgccaaacacttataaaaccatcagacctcatgaaaactcactatcatgagaacagcatgggggaaacctcccccacaatccaattacctccacctggtctctcccttgacacgtagggattatggggattacaattcgagatgagatttgggtagggacacagaaccaaaccatatcatgagcatgatttgcaggccatgaagaattctccatttttgtttcctccaggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcggtaagaacttacattctgtgttagtctgctcaggctgccataacaaaataccacagacagggtggcttatacaacaaaagtttattttctcacagttctggagactggaagtccaaaatcagggtttagcttctcctgaggcctttctccatggcttgcagatggccacctcctcaccgctcccccatgcggccttccttccacacacaagcatctctgctgtctcttccccttcttcataagggcaccagtcatattggattggggcctaccctaatgacctcatttaaccttaattgcctctttaaaggccttatcttcaaatacagtcccattaggggttagggcttcaacataggaatttggagggaacaccatttcataacgctatctcattgcacatttttttcacataagtcatatgtaatctacagtttgaggagaatctgaataaacacatttgggtcccccagttcagaactatatcagtgaggtctcaaagagttcaggcctgggacgggtcttgcaatacagatcaggtgtggtaggaagaatatggaaggagtttacagtaggaggactgttgtaaggtggcctggtagcagcaggatgctttcctaatgggggtagagtgtgtatgctggggggataatggaagatgttcggatgagtttcgggggattcccaatgtggtctgccacctgagctgatggcagaacactgggatgaggcaggaagccaaaagtggtggctttcaagcgttagtaagcaaaaactcacctgggttacatactcagaatgcatgttcttgaggtcacccagacacagtgcgatgtccccgcatatcagagggtaagaccagaaagtttccagttttaaatgtctccccatatgattgtataaaagtttgagaaccatgggcctaaggcgctatgtaggtcttttaagagcaaagtggagcactgatgtgggcgtggcctcctagggatcgtgaccagatgcccgctggtgctgaaactgaagaaacttgtgaacgaagataagtggagaggcaaggtcagttaccaggactacgagattgagatttcggatgcttcagaggtagaaaaggaaattaataaaggtgagtaccccctgtttggatgcctggtcaagccttctgacatgcatggggtctgtttgtaactgttcatactcccacctccctgggcctgtgctgtcaggacacctttctcctgcacatcaggccacggttccttctacttcttttacctcattatgaccagcacgcttggatatcagcatctgatagcaatcatttatttctggccaggcacagtggcttgtgcctgtaatcccagctctttgggaggctgacacggggggattgcttgagcctaggagttcaagaccagccagggcaacatagtgagaccccgtctcttaaaaaaaaaaaattaaaatagctgggcagggtggcatgcacctgtggtcccagctattcaggaggctgaggtgggagagttgcttgagcctgggaagtcaaggctgcagtgagccgtgatcttgctacggcactctagcctgacaacagagtgagaccctgtctcaaaaacacatgtattgcttattatgtaagtatctagaataatgtgaattttaaaatgtccccacatatggatgatctgtcccttattcaagggcttccctacttagatctggcaggaagaggagccagatatgggggtgagggagctcctccccctgttcctttgtacaaggaactccacattgtggacaggatcgtcactgaaccccactcagaaccagcacccttttctaagaaagaggagtgactgtgtttgcataatcccagcttaggctaattcatggcaggcctccataaatgcaaaccacaaggatcaatttgaagtgtctgcaaggggaaatgacaccagcagtgtagacagggtagagtagctgacaaagaacagcctctgtgagatgcatggataacatcttcctatcgaccttcatgtttttctggcatgtcacatgtttaagtttcattcacactgggaaggtactgaagagacatgaactaatgcccagcagtaggaagggacgggtttagcatttgtaaagatggagcattaatcacatttgttgactgtttaaagaaagataaataatgttattgacaaaccgtgattttgaattagttgggattaggttggctgcttgcagcagaaaactcaaaataactgtgtgccttagcccttgctgtataacaaacccatcttaaaactaatggcttgaccacttttatttctcatgatttgatggaccagctgggcagttcttctctgggctagctgggctggggctgatggtccaggatggcccttggctggagtgaccgggccttctgtctgtgtggtctctcaccctccagaaggctaagctggacttatcaatgtgggtggaggggttcccagcagcaagagagggcaagacccgacatctaacacctttcggtctctcctgacgtggcactgtgtaacatccccttagccagagaaagtcacgtggccaagcccaatttcaagggaccgattttctctctctccatggaagtgacgaaggcaccctgtaaagtagcgtgcatacagggatggaagggaatgtggatgccattgtgccagcaagttgctgagacagcggtctaaacaatgtagaggctttctgtccctctcatataagtctgaaggcgggcagaccagagctgattggggattccaatgtcaggaaccaagatttattcttctcccatttcttcattgggtgtggcctctgtttccaaggcccccccgtgacttagtcagcaagtccgctttgaagccagctggaccatggcaaggggcatatctctgcctttgtaagcacactttctggaagttgcacataacattttcacatggcccattggccagaacccgatctcatgaccacatggcaggtacatggatattgggggaacaattagtggaccataaccactgatatttcctaagttctaaattgatatcaaacatcccaaaaaggcattctagatttagaaaagagtaaagtggtgttagccaacaatttgatgaaacaaattcatatcctaaaattcattaaggaggaaggagcaaaataaaatctcttaatgggatgttaacagccagtgcttatcttagctaaaataagcacatttccccatataattttccagtttatattttaggcatttccatatatttttatttgtttttattttgcttggttgctaatttcctactgacatcaatgagaaggatttaggaatgctaccaggaagaacttcttgcctccgcccagctttggactggtctaagtgggtgtcactcatggtgacgttctcacaaggtctctctacacacagtgctggccaacagcagggaaaatactgagttatcctttgagatctcttttatcccaatcacagaaaattgaatctgctccaaatatgcttttatccatgactcgcagagaggagaagatgctttcagagtattcaccatcatgagatccgtttatcctaagctctgtttgggtttgattttccctgtctcttttctagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataaggtcagacttcagacccattctgaccttggccgtggcgtggggatgggggagtggaggggtgggaggagaaagagggtactgtattagagtaaccgtgagtccagagctgagttttggagttagtatttggaggtgtgagtggggaatttagagagcccgttggtcacagtctgttctgtcaagttgaatggaagcttctttggagaaagtgaggccagtgggcacagttggaaatgtgttctgtgtatttgttttatgttttatgcaatgacttgtttttggttatatacattttgcagcatatctaaagtgctgtgtattaggaaggggtcttatgtgggaagagagcattaaaaataagtataatgggccacacacagtggctcagtcctataatcccagcactttgggaggctgaggcaggaggattccttgagcccaagagtttgacagaaacctgagcaacatagtgagacccccttctctataaaagaaaggttaaaaaattagccaggtatggtggcgtgcacctgtcagctactaggaggattgcttgaaccagggaggctgtgatgagccgtgattgtgccactgcactccagcctgggcaacagagcaagaatctgtctcaaaacaaaaaacaaaacaaaacaagcaagaaagaaataggtataatgatattttagtatcagtgaatctcactttacagattaaagatttaggggtgaagtggggttttttggccaccatttttcattgtgaccatcagatctgaggtcttaggggttaattatctgaaacttcatggttttccctgagcctatagctctgcttctgccacagataatttattttctcataattccagcttggtacctccagggttgtgtttgtgggttcatttctccaaagttacttcttttgggggaaatacccctgggactcttagggcctaaagcaagtgcaaggtcaggacttgtctcacctctcacttgcctttgccatactcacgagtcacctcctctcatttccttacagatcaagacactcatcaagaagtacatccagaggcaggagacaatcagcctggtggtggtccccagtaatgtggacatcgccaccacagaggctctcagcatggcccaggaggtggaccccgagggagacaggaccatcggtgagagtgggggagccccactgtgctcagtgagaatgggggagcccgcctgtgctcggtgagaatgggggagcccacctgtgctcggtgagaatgggggagcccgcctgtgctcggtgagaatgggggagcccgcctgtgctcggtggtctgccagtgggcaagcgtccctccagtctccatgggctttgctcagtggggacctgcctccactaagacctgctaagggagcaggtttggtgcccaccaaggccaagtgaaatgagctgcttttgactctcactggctaggttgccttgtaagccttatctacttgctcagaaaggcacagtgggctcggaagcaggtcaaactcaggaggcacatggtactcattaagaatgcatttgagatgggatgtccataactcaagggataaacaaaacgtggcgtgttctacagtggacccgggtgaaggagcttggggagagccacatgctgttctgggaggcatccctgccttcacgcggcttgtcgtggagttcttttctggagcggggctccactgcccccatggttctgcaggggctatggcctgtcctcaagcaaggatgggaggaaaccctgggaggccgggggcgtgagcagttgttcgttcacctctgcctcgtgactgagcacgttctctccccaaatacatctggctcgcaggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcaggtgcgcttgcctgggtttcatcatggatcagtccaagcccaggatgtcaggccttccaggggacagtggcagccgtcccacagatgtgtggagtgtgtgtgtgtgtgtgtgcgtgtgtgtgtgtgcgcgtgtgtgtgtgactatgcttgttccccaacaaggactatggaattcacctagaagaataggaaggggattacaaaatactgccaagaaaaaaaaaactaaaaaccaatcaaaatagggagagaacaatgtacaataatttacgtagcatggtgctggaaccatattttataaaaacataaatagaagagaataggaaaaaagtagaaagcccagaaatagacctagatatatatatttgacacatgataaatgcagcatttcaaatcaaatagtggactatatcagcttgagtatctattagtggtgttaggataattaatatttgggaaaaaactaaaatactgcccttacttatctcattataccaaaatagttaaagtttaaagttaaatattaagaggaagcaataagcatctcagaagaaaggtaggtgaatagtttataagatttttctatccctcctaccaaaagtgacattttttaaaaggaaaagactgacaaattggtaagatttaaaatgatgagactatgtagagttgtaaacattcttacattcagttctcccagaagcctacagagagccattactcagaattccaggaatatcaaatggaaacttacatcctgttctgcacattcacaattgccagaagatgagatgattcagtgtccattgatggatggatgcagaaagcaatgtggtctgtacaaaaacatggaatactttcagccttagaaaggaaagacattctgacacatgctacaacatggatgaagcttgggaacattctactaagtgaaagaacccagtcgtaagaggacggatactgtctgattccacttagctgaggtccctggagtagtcagattcatagagacagaaagaatgatgggcaccaggggctgggagagagagaatgggcaggtagtgtttaatggggccattgtttcagtttgggaatatgaaaagttctgaagacagacagtggtgatggttgcataatagtgtgaatgtacttaatgccactcaagtgtactcttaaagatggttaaatggtcaattttatatgtagtttaccacaatttagaaaaattgacagagaaactgaagcttaggtatgagtatactcacaaaaaggcacagaaactcatgcttcactgctgcctttatcctaaaatgtcctataaaatgtgggaaaccctgtaataactcactctgtgagcacaaatttggatcgagtgagaagatacttgacttccttcctccaggcagcccatggtttaagtttttatcttggacaagatatcttgtgtctcttctcctcagtgttctgctacccatttatctcaatatgcttcaatgtatttgtatgaagatatgtctgtatccattatgatcacctacacatattacacatagaagggggtatgtgttataaaaacatatctatacatgtctgtgtatttttgtgatgaccaagtctatagtcagacaccatgatacacatttattatatcagctggaagagctcattccatatcattgtggaaatatcctagattgctaaaattcagtcataatcctattcaatccagttctgagtatttgttgggtaccaactgcaagacattccatccagttgtaagcaactgaaatttgccttgactttccccaacagcaaaaaggcagacatgcgtgttctggctacatcaaggtggaaatcggtcctgtgttctcttctagggatctgctggaggaaggaaaggccacggttccctgcctggcagaaaaacttaccagcgagctcatcacacatatctgtgtaagcacgggcagagctgtgggttctctaaaaagaatactacgaccgcagagctgaaccttgctggcttcttaaacatcactgtacacacagatcttctgaggatcttgttaagatgcagtttcagattctgtgggtctggagtggggcctagaattctgcatttccagcaagcccccagacaatgtggatattccttttcaggggaccacagtcagggggaatgctgatagactatatctactgggccaaaataaaaattaaaatcttatgcacaagctactaactcttcctttctcattgacaaccactattataatgtcttagtcattctaatgaacatattttttaacttctaaaagctttgtaaaagctctctgtggttctttttaaaagtctgcctgaatatagtgtcttcctttttcaaattttcttttcttttcttttctttcttttttttttttttttttttttttttgagacagagtctcactctgttgcccaggctggagtgcagtggtgtgatctcagctcactgcaacctctgcctcctgggttcaagcaattctcctacctcagcctcctgagtagctgggattacaggtgcccaccaccatgcctggctaatttttgtatttttagtagagacagggtttcaccatgttgaccagactggcctttttcaaattttcaactcagcaccagagtgcaaggtcttccacgtggtccccaggaatgcgggtgcataacagggttgtttccagccgaccatgatgagtgcagagctctctggggtcccactgtatgcagaaagaggatgcttccttattagattccccacctcgagcaagcccatggggattgattttttgcctctgcaccaagtcaggttcataagttcccgttcgaattttcttacctagacagatgcccttgtggctgagccgggcttcattgctgccttctccttgagcccctgcctggccactgttactggggctggcctctgactacccctcactaacttgtgagtccaccgatacatttaaaggtgcagctttcacatgtcagctggcatttttagatgtttgccgtggaagggtgagccagcatatggcgtcaaccgtattgttaaaaacataagtctctgatcactttttattgattgcaagcaacataaaagttgttgaatctcaaattgctccaaatgccactttttcagaacctactagacaagtggatctctccagtctccctccagagagtttacctaatatgaccacagaggaactgctcccgggtcactctgccggggcctaggacccatgcacagtgggtgccacagtgctgctcatgaggctgctgtcgcaggagtggggaagggggaagacctgggcagaaaacagtgcccccagtgtgtgcccccctgcacctcccccgggtctggaaaagcttccttttagaggaagccaggaagtcaaatggcccacacaactcctctgcagagggaggcccgggacctccttttcattctctgttcatctttacacatttccattattttctctccattttcctcagaaatctctgcccctgttagaaaatcaaatcaaggagactcaccagagaataacagaggagctacaaaagtatggtgtcgacataccggaagacgaaaatgaaaaaatgttcttcctgatagatgtgagtgttgccagctgcatggagctggagaagcacatgtcatggtcaaaaaagggaccctgggccttatgcacttccttcttcactcccccaaggctgatccaaagacatctggcccgtagcactcaaagggtggacagggctgagggaggcagggcagggagtgcagatgtgggggtggagtcagcagcgagggatgctcaggctgcgttgtgcctactctgtcacgagcatcacccagatccctaaggcagtaaggggtgggataggattttctagtgccaaaacctcttctttcccctgatccacagtgtcccataagaaagcaaagaatgactccccaccctccacataggcacggcctccaaatgaccttgacacttggatttgaagtctatccacttatactgatgtttttcttcttgacagaaagttaatgcctttaatcaggacatcactgctctcatgcaaggagaggaaactgtaggggaggaagacattcggctgtttaccagactccgacacgagttccacaaatggagtacaataattgaaaacaattttcaagaaggtgagtgtcttagtcccttcttttgggctgctacaaccgaatacctgagactgggtcatttataaacagtagaaacttattgctcattgttctggaggtgagaaatctattcttaaggaatcaggaaatttggtgtctggtgagagcttgttctctgcttcaaagatggcaccttctagctgtgtcctctcatgggataagggacgaacaagcttcctcggacctcttttttacaggggtaccacaggcatacctcagagatattgtgggttcagttccagacaaaaagaatattgcaataatgcaagtcatataaacttcttggttcctggtgcataaacagttcatttatgccctactgcagtctattaagtatgtaatagcattaggcctaaaaaatatgtatgtaccttagtttaaaacaccttattgctaaaaaattgctggtacagaaacaaaaagtgagcatgtgctactggaaaaaaatggtgctgatttgcttgacatgggattgccacagactttcaatttgtaaaaaatacggtatcagtgaagtgcaataaaacaagatatgcctggaatgccattatgcgggcagagtgctcataacccaatccttcctaaaggtctcctctgttgataccatcacactggggattaagtttcaacataggaatttttaggggacaccaacatgtagaccatagcaatgagtcaataccgtggtaaacctgatacgttggcttaagacagagaagagtggggcagttggggaggatggtcaggataaggagctagtgacaactaaagccatgtttgctctcttctatatcactgaacccaaatgaccatccactgatgaattgataaaccaactggcttgtgtctgtgtgtagcggttggctttggctgtcataacaaagtaccacagacttgggggggcttaaacagtagaaatttattttcttacagttctggaggctggaagtccaagatcaagatgttggtggagctggttccttctaaggcctctctccttgccttgcagatggcctcttctcgttgggtcctcatgtggttgtccctcagtgtgtgtgtcctcatctcctcccacaaggacactaggcagatgggatgagggcccaccctagtgacctgatttcaatttaattacctctttgcctgtctccaaacacagtcagattctgagtttctgagggttaggacttcaacattggagtttgaagaggtcacaactcaagctcagcccgtaacaccaagtcctggaatatttccagccacagacaggcacagagtgctggtccacagcaccccatggatgaaccttgaaaatgtcatgctgagtgaaagaagccagccacaaaggccacacggtctatgattccattgatagaaaatggctagaacaggcaaacccaggcaggcagaaagcagaatagtggctgccaggggctggggagggaaaagtgggaagttatcactgatgggtgatggatgtggggtttgggagttatgtctggggatggtcgcacaactttgtgaatatactaaaattcactcacccatacacttttttttttctttttctttggagacagggtctcactctgttgcccaggctggggtgcagtggctcagtctcggctcactgcaccctctgcctcccagattcaagcgattctcctgcttcagcctccacctccctagtagctgggattataggcacctgtctaatttttgtatttttagtagagatggggtttcaccatgttggccaggctggtctcgacctcctgacctcaggtgatcactggcctcagcctcccagagtgttgggattacgggcgtgagccactgtgcctggcctgaaccatatatttttaacagagtgaatgttatactatgtaaatgacatctcaattagaaaaatccttatgggaaaatatttcctgactaaaaaaagtgttctagattaccactcaaaaaggaactcaaaccctctgaacttctgatggggctaactctctctagtgtggattgttgggagtacaaatcattccaaaagtttaaagaaaaatgcagcatcttacacagtgaacagtgctactgtatcacattcatacaagttgatgtgcctggtttactctgttatcccatttgacttgtaaacactttctacacatggcaatactttcgacacatgaatatgtgatgtattgttaattccagaaagtgttcatgctcatttctaatgggcatgcagttgagggcaaggagtgtattatggtacaatttctttggtaaaactaaaattggattcacaaaacttcatactcgagtacgtttttaagaaggggtcttggccgggcacggtggctcacgcctgtaatcccagcactttgggaggccgaggcaggtggatcatgaggtcaggaaattgagaccatcctggctaacacggtgaaaccccgtctctactaaaaatacaaaaaaattagccgggcgtggtggcgggtacctgtagtcccagctacttgggaggctgaggcagaagaatggcgtgaacccgggaggcagagcttgcagtgagctgagatcacgccactgcactccagcctgggtgacagagcgagactctgtcacaaacaaacaaatgaaaaaaaagggtcttactcgaagtttctgcgtatgtgggttcctggcatcgtacctggctctgcactccccttcctgagatgactaaggaaaattatcttcagatctggttttgtgtgtgtgtgtgtgtgtgtgtgtgtgtgtgtgtgtgtgtgtgtgtgtaatccctggatatttttagtttaccagttagatttgatttgataccactttttcttgccatttatattttcagaaaatttagaatggtattgtgtttagaaaaatgtgcaagattatttttgtaaaataatttagagggttttttttcctgctataggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacgggtgagtgctcagtttcacctctgagcattgatttctaaagaaaggaaaggttcgaaccaaagccagcaccaaacttcagcactttcctcctggggtgcatcccacaccaacgagcaaacctctcattctccagatgccaagttggtattcaacaattcaattcaattctgacactaactaccctcagtcagtgtggaccccatagcttaagggctcagttccacaacactggccccaactacaaatgccggtcacaagtcccagacctcctattcttctgatggactgtttataaatcaaggttcttgcgacccattcctcaggtcaaccaagaactctggaacacacttcactgacatttactggtctattagaaaggatttgataaggggcacaaatgaagctgttggagaggcacatagtaggggcctgaacacagaagcttctgtccccacggggttgggggcaccatcctcatggcacagagatgtggtcatcaaccagggagctcttggaacctcaccgcggagaaggttttatggaggcctcatcatgaaggcatgatggaggattgactcaatctccaggccctccctcctctgtggagctggaagttctaagtttctagccaaggcttggtctttctagtgcccggccccaatcctgaagctatgtaggggcccaccaggcatcatctcttcaaaacacgagatactcctaaggctggacattccaagagatgtaggggctctatgttaggaaatggggacaaagacaaaatatttatatttttcctatcacaccacacctcccccctgctccactgctatgctggcttcacactcaaaatcggctgtttatttgaaatctccgaggagtaaagccaatggttccataactgcacgtgtagatgtgtttggaaccttttggagtgctgtaggaatctaggtgtgtcacggataggtaggaaactagatcctactgtggatccactcccttcttgaaatgctttgctttcttggttttccaggtattaaatctctattcttcatcctctccttgactgacagtatccttactcacacttcagctgcctcatcttagcagtaattaataatcactcatggatccatgaactaaggagctggagatagcctcagaacagctcattcagaggtgtatttccagtaaaattgaccttttagccctgataatcatataccaaaacctgcaatcatgttgttttggtccattgtagactcttaactcattccagaggaaagtttataatacttagagccttatagtcataaaaatcaacatagatatacctatttctttttcagaaatgtatgacatggagatcaataagaggttttcaatcataaagatactataccttgtattacaataaaattctgtgaggaagtagaatagaaatgagtttcaaaaataaaagataaataatataaattttttaatctaagagcttgttcttgtatttttttcaaatggataatgtagacactcaaattccattgatatatttaagagtgatttgacttatattaagagttgtattataaaatattaatatttataatttaaaagaaattacattctttgcagctatttaggataaaaagtttaaatatcaaataaatgtatgccaggggtcatttgcttttaagattcttccagcaaattattaagcaaaaagagcatgccttgctttttcatggtaaagagaagaagggagcggggagaggggaaactttacttcataccatttgatcctcatatttttttgcatcttaagaagagaacaaatgatcctaccaatattgaactatttttctctctttgattagatatggtccggcttgctttcacagatgtttcgataaaaaattttgaagagttttttaacctccacagaaccgccaaggtaaaaccaaccatgtgttgtttaaaaaaaaaaaagaaaagaaattaagcttgacactagaaaatagatttcttggatgaggattatttcaactttattgtatacttttagaacagcaaataacatcactcactagtgcttcttctgatgttaccggtgatgtctggttaaaagcaataaaggagggagtgcttaaacgcacagaacaagagatccacagttagcggagaagattatcacatctaagggcaatggctccaaatccagaaactcactgaggaaactacatataaaaatagaatatttctggcccgagtgggcatgatgagcctgtaatcccagcactttgggaggctgaggccggtagatgacttaaagccaggagtttgagaccagcctggcccacatggcaaaaccccatctctactaaaaatacaaaaaagtagctggacgtggtggtgcatgcctgtaatcccagctacttgggaggctgacactttagaattgattgagcccaggaggtggaagttgcagtgagccaacattgcatcactgcactctagcctaggcgatggagcgagaccccgtctcaaaaaaaaaaaaaaaaacaaacaaaaaaactttccatccagagtgaggaaagagcctacaggaaatgagcctgggggacagactgggccaagagaccagacttagccactcttagaaataggtgtccccggcacagatgaggagcctggccccatgattcaccagctggaggccttgggatgtgccacttccagcctgtgcccctgactcctcattcataaaagaagactgataaggccttcctcagaaggttgagatggacgtggagtaagatgtttaggatgcacctgccactgtgcactgtgcctctcctcaaggcctggagggtccaggggtgaagtttctcctcctcaggttttggcaaccagtttctctaaaccccgggaacataaaacataattttctgacttaaacatggctttcctgctcatccctgtggattatctgatggatatgacaatcctcgccatcagatatagaagcccctaaaagagaaaggaaagaagctgagttacggggcctgaaagcaagcctgtgcaggtccccaggccccgggatgggggtccggcccatctgtggctcaagcctcctgggaagctctgaccctcagccagggctagaaacctgccttagatacaccagggcgcggcccagagggctgttccaggaaacgtgctgtttcactcacgttgggtaacctggtatttacggacttcttacctactttcctgtgactcaggaatttgtgtcttgagggaaactgtatttatttattttttactgtagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggtacgtcttcgcgtggttcaggatgccagcttccattctttccttttcttctgaacgcctctctctttagtcttgctctctctgtaggtgacgttggtcagctctgtcgtttacctccttgttagcctcctgtattagtccattttcatgctgctgataaagacatacctgagactgggcaatttacaaaagaaagaggtttaacggacttacagttccacatggctggggaggccttctaccatcacggcagaaggcaatgggcacttcttacctggcggcggtggcaagagagagaatgagagccaagtgaaaggggtttccccttatcaaaccatcagatctcatgagagttactcactaccatgagaacagtattggagaaactgcccccatgattcagttatctccccctgagtccctcccacaacaggtgggaattatgggagtacaattcaagatgagatttgggtggggacacagagccaaaccatatcgccttcgtagaagcagctcaacctcagacagagagatggtggcttagagccagtgacatctggttttgatggctgtctagctctggccaagttacttaacctctctgagcctcagctttctttgtaaaatggtgtctcctcatagattctagtgcatattccaggagacgagtgtggatgatgataatggattgctaatggaaaaaccaaactctgttaaaatatttgaaagaggtttattctgagccaaatatgagggaccatggctctgggaacagtctcaggaggtcctgaggaagtgtgcctgaggctgtcaggatgcagtttgattttatacatttcagagaggcaggaattgtaggtaaaatcataaatcaatacatgggaggtgtacttgccctccctaaagaggcaggacaccttgaaggagggggagcttaccggtcataggtgggttcagagattttctggttgacgattgcttgaaagagttaaactttgtctacaaacttgacatcaatagaaagaaatgcctgagttaaggcagtgttagaggccaaaggtatgtagatgaagactctgggtagcagccttcagagagaataaatggtaaatgtttcttttcaggccttagaggcagcaggctctcagttaatctctcctagattcagggaaggcctagaaggggagaggtctgactgcattaatggagattctctacaggtgcaaattccccccccacaaaacatggcagggccatttcaatctgttggtcctgttacagccgtttcaaaatatgtccacaaaatatatttttaggtaaaatatttgtatttcctttagggtctgcaatctgtcttgtgatgctataccagagtcgggttggaaagtaagccattttatactgagttcatggaaactcatccaaggagatttcatggtttgtggggtgtgtgtgacttaacccctgcctcacatgactttataatatggtatcttactactccagagtctttttggccaaccttatgatctcaatttcaacctaaactccaaaagggcctggcttctcttcctgttacggccaggaattcagattttcaggtttctctggggtccacttggccaagagggggtctgttgagttggctggaaggcataggattttatttctggtttacaacaatttccttagtgcagcattggaatgcaatggtagcagactaaatggaagctatcgcgtagacacatgctttggttgatactgcacgattcagttaacctgaagtacaatctaattcatcctagggaaggaggcagtgaacacagacacaactcaggtagagcccttgggatgtgtaaacacctgaggaggtaaagcaaattgtaatctctcggtttatcagatgtccccattgccttactatttggatgctttaaagcagggcctctcaaactccacccagcacagaggcctcctgggatcttgtggaaatgcagatgctgattgcaggtcaggatgaagctgagattctgcctttcttttttttttttttttgaaaccgagtctcactccattacccaggctggagtgcagtggcacaatctcagctcactgcaacctctacatcctgggttcaagcaattcacctgcctcagcctcccaagtagctgggattacaggcttaccttgccaccatgcctagctattttttctatttttagtagagatggacttttaccatgttggccaggctggtcttgaactcctgacctcaagtgatctgcctgcctcggcctcccaaagtgctgggattacaggcgtgagccaccatgcctggcctctgcatttctaacgggctctcaggggtcaccatactactggatagaggccacacttggaggagcaaggctctaaaccgagggtcaacatccattcctccagacactgggagctgcatgcacgtgagtgaagccagttaaggggaagacaggcatgcacatcagcttctcctgcagccaagctcacacctgtccgctgcttccactgcctcctagaatgaacagttaccttgagagtaggtgaggcatatacatgcacagaatccaaacaataggatgagtgacaatggcagaggagtctccgagccaagcagctccctggacagaagcagcccttctccgggttcatttctgtcctccgaggctgactcatgcactcaaaagctcccatgcatatacattttataatggtttttacacaaaggttagcagaggagtggacgtgctgctctgtaccctgcctcttttgctgtacctgggagattgttctgcctcagttctgatggggctgccttgttcttttcaatggctgctgagtatcccattttatggatgtggtatattgagccagctccctttaagcgaacagtttgtttgcagtcttttgctaatgcaggtgtgttgctgtgaataggtttgtttgtatatcatgtatctggaagcatcaattcctagaaatgagattcctggtatattaggattgtgcagggaaacagaaccacagatatatgtatgtaaagaagtatatttcagccaggcatggtggctcatgcctgtaatcccggcactctggaaggctgaggtgggtggatctcttgaggccaggagtttgagaccagcctggccaacatggcgaaacccggtctctactaaaaatacaaaaaaattagctgtgcatggtggcccatgcctatagtcccagctacttgggaagctgagatatgagaattgctcgaacctgggaggcagaggttgcagtgagccaagatcacaccactgcactccagcctgggtgacagagcgagactccatctcaaaacaaacaaacaaacaaaaaacaaaacaaaacaaaaaacagaaggaaagaaagaaatatatgtatatttcaaggaattggcttctgccattttgggagctggcaagtccaaaatcccagggcaggccagcaggaagagcaggccagaaattgcagcaggagctaaggctgagtccacaggcggaatttcttctttttagggaaacctcatttttcttcttaagaccctcaactgattggatgaggcccatccacatcattgagaatggtctccttcacttaaagtcagtgggttacacatgttacccacatctacagaatacctccgcagcaatacctagattcgtgtttgatggaatcactggggactcgagcctagccaagctaacacatgaaacacaccatcacagctggggaaaggatggcttattttagactgataaagatgacccagagaaggcctgctccatccacactggccgctttagtctgcactaaagttgttggttttttttgtttgtttggtttttttttggtgacagagtctcactctgtcgcccaggctggagtgcagtggcgcagtctcagctcactgcaacctctgcatcctgagatcaagcgattctcctgcctcagcctcctgagtagctgggactacaggcacgtgccaccacactcggctaatttttgttttttcagtagagacggggtttcaccatattggccaggctggtcttgaacgcctgaccatgtgatccatccgcctcagtctaccaaagtgctgggtttacaggcgtgagccaccacgcccggccttgttggggttttttgacagcctaataggtgaaaatgacatctcattacaatcttaattggcattctcttatgacaacaagctggtacatctttttgtgtgttgagggttatttctatttcttgctcagcaaacagttcatccaggaagagcttcttggtgagatagtagacctctgcgatttctgttgcagacgatctacattttgtcatttgctttgtcatttttgtctatggtggttttagactatgcgtaagttttctagagcagaaactcaagttggatttgggcctcagtggttattgccatactttaaaaggactttgtctccctgagatgataaatgaggtggacaatattttctttaagtaatttcttattttaactgttacatgatacctttggcccatttggagttctttgatgtcaagaatgaggcaggatccagatggcagcagaggtcccagtcccatcctggaagggtcgtctagttcccactggtactccacacgcccactcaggcactcacttcccctctgcgttgggtcttgtctgcaagactctcttatgttttaccatctagtgcagccagcacccccacatcaccctcactttttctttctttaaattgtgcagaaatattcatcatgtctattttgccatcttaaccatttgggggtacatagttcagtggcattaagtacattcatattgtgccagcatcaccagcagccatctccaggaccctatcaccttcccacactgaaactctgtccccattaaacacattccccattccccgcccctgaatccctgacagctaccatcctactgtctgtctctgtgaattcaactaacctaagtacctcataggagttgtgactggcttgtttcatgcagtatgatgtcctcatccaggtggtagcaagtgtcagagtttcacgcctatttatttattattatgagacagagtcttgctctgtcgcccagcctggagtacaatggcgcgatcccagctcactgcagcctccccctgcctgggttcaaacaattctcctgcctcagcctcccatggtgtgccgccacacctggctattttttgtatttttagtagagacgcggtttcaccacgttgaccaggctggtctggaaatgcagtttttgcactgtctgcctgcttacctttatagagcatattttgccctcttccatcagaattacccatttaatggtcaggaaaagctgctgggaatatgactcatagctgggacattctctgcactgtgcatagttcctctctgccaccaccatggaggagattgatgggtttgaaacccaggggaaggtcattgccctgcgagggtctccctcattgagaatctggatcccctcatgtgcacatggtgaggtcagagtcccctcctcacagtgtcccctccaccctcccgtgaactgttctttccttccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagaca

SEQ ID NO: 2608 - DNA, 33039 bp, Homo sapiens
  source 1..33039: mol_type = genomic DNA
tttcttcgcggcgcggggcggggctgggcgcggggtgaaagaggcgaagcgagagcggaggccgcactccagcactgcgcagggaccggtgagtgtcgcttctgggggcagcgcccagtaaccgcgctaggagcgcggagaagggcattgggagagcggcgttcgtggcggagactagcgctccggagcacgggcacgacgggggcaccttctcggctgctagtaactaacaataataataatcataatcatagcaagggcgctgatgggcgggctcggagcacgcctgattctggttcccaccaggctgcccaggctcctgatgacgcatcagaaacatccccctaacccgcggccttcctgcaggagaggttgggaaggggtgggggacggggctcgggggaggtctccgagggactctagtaagcggggaagggcgccgggaaagtttcagatccacggctgcgcgggccacgagcccacccgaacgccgaccactgctttccgtcgacttctatttcctgggaacgcgcgaaagcaaacccaagtcagactgcggaggtcgctggggagggaaggttcaaggagttctcgccgatcctgctgaataaagggggttccgagctgggccgagatggggcatgcgcgggaagacccctgcccgctgttcccccccaccgccccagtggatgccatgcctggggcctccccggcgcgtggggctgacgcaccctcggggtccatcgtagttggccgggatcgtggagtgggtgcggtggacgaagggaggcaggacagtcccgggggtggcagaaggagcccgggcacagctgagacctgcgctcccatcccaccaacactcacagcaggtgctgccgagctgggcaattgggatggcccaagttatttggttaaattttaaatcacgtttgttactgggaagtagagtccagtgatgctaaccgcgcctctacctccaccaccggtgtcagtcccaaagggctcctaaaatggctgtgtcatctttcagccttggaccgcagttgccggccaggaatcccagtgtcacggtggacacgcctccctcgcgcccttgccgcccacctgctcacccagctcaggggctttggtaggtagcagtgcatttggtctaaagggcaagatgttctctcttttattcataacaaatttaaataccagcagggtttggggggaaaaacgctttcagaagaaaaggtgaatgtcagtcctgcaagagttagttttaaaactagactgaattggcacatgtatacctatgtaacaaacctgcacgttctgcacatgtaccccagaacttaaaagcttataaaaaaagaaaaaactagactggattatgttgggaaagtgtagcctcttccatcttaggcatttcctagaacgtaggcagtaggtggtccttattaggagttttgggagaggaagggggctgaatcctacctcccatccctgctcctctatggggtctgagctgaggaagcttcaccacaaggagagaaccccctgacaaccctggatgccacctttaccctcactgcaggaattctgtggccacactgcgaggagatcggttctgggtcggaggctacaggaagactcccactccctgaaatctggagtgaagaacgccgccatccagccaccattccaaggtaaggcagaaatgaagtgggccgttgggttctttcttttctttctttcttttttttgagacaaggtctcactctgtcgcccaggctggagtgcagtggcgccatctcagctcactgcaacccccgcctcccaggttcaagcgattctggtgcctcagtctcctgagtagctgggattacaggcacacatcaccacacctggctaatttgtatgtgtttagtagagacagcatttcaccatattggccaggctggtttcaaactcctggcctcaaatgatccacccgccttggcttcccaaagtactgggattacaggcacgagccactgcacccagtcaggttcattttagttgttatgttaaccaggtttcctgcacctgtgcgctaactttcactttcccaaaaggtttcagggtgacccagcaggcaatgagtgattctcaaattcaggatttattgtgagagattcacacacacaattgagcagacattcacagtacaatgattaaagggagtgatagggtaaggacccacagtggaggctctggaggccagcccactgacagccactccagggagtccagaagtcccgctctagtgctgggtggtggagggaaatctgttcctccagggacctcgtcctcggctgcccagctgccaaagtcaggaataagctttcagaaatctcactgccaagattccgaaaacgcttcagacattgctagtcccttgtcgcttttgcgatcctccacaggtgtgcgtgccactgggtccttattcactggggtctctggtggcattgggccacagcaagtgttccctcatccccttagtctaccacacacatgcttaccactttgaagaaaaacccctttactatgagcgaaagtgagaaacacgtatgtttattgtttctaaagaaagaaacttaatatgggcttaatgctacctagtgagtgcctccattttgagacattagggtcacaagtcattattatatatcatgggcacaaacctgccctgggcagggacggaaggaagcccctgcacaggggcagttgctcaggatgtgagaagagcctggtgcataaccccatccatgcccacctaacatctcaggctctgaccagtggggctgtgcagtagcgagtggatggagggctggaaccctgcagcctcctctccaaacacagggtgcagccaagacattttaggagcaatttgggatggagagctaggagtcgccacctcttggctcttccaaggccggaactggtgcctgcactcagttcagtttgaagactgcagctggatgccaagttccatggaggagtaagaaaccggtttgaactcccgagattgccctgcccctgaaatccaaactgatgttccgaatgatcagggaaaggtacaaacgtttatggtttacagacaaaacccataaggtttagctttcagagaatctcattttatgaagcaaattagggaagggaatctactcaccaagtcctgtttcagctgattgagtggaacctgtggtcatgtggtacaagtcctggtctcaatgatgctccttatctggctgcagaaaggccaactgaggcaaccatagcccagaagactggtactcctgagaggcagatgaagtggtggtctttgatatcgagcctgggatgccctgggcacatgaggtatttccaaaggcatgggagttttagggaataaattcccagattgtcagactccataagtaccgtttacaatggattaccttttataaccatcccaatcctacctgacaaaagaggtgggcagattacgaggtcaggaaattgagaccatcctggctaacactgtgagaccccatctctactaaataaatacaaaaaattagccgggtctggtggcgtgcacctgtagtcccagctacttgggagcctgaggcaggataatcgcttgaacccgggaggtggaggttgcagtgagccaagattgcgccactgctctccagcctggtgacaaagcgagactgtctcaaaaaaaaaaaaaaaaagaaagaaatacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagaggtaagttggtgcatgctattttctgtaacatttattttgagtcataggagaaagattttcagttacttttatccaagattattagacactgtaaaatttcatatttaggcacttgtcctacaacattttaaaaatgaatttcaaatacatacgtgtgtatttgtaatgcagacaagtataaggcagtcagttacatgctttcaagagtaaaatgaatgacatttcatttcccccatttgtgggagtaaaagaatgacaatatgaaattgatgatcaaaagaaagagcataaaagatttagagctcacgtgttttttaaactaaaggtttgggtatcaaattaccgtaatatttggattctcttggctacattggaaacagttctataacaattttatttttaaatgtaaagtttttgtttgttgttgtttttaagacggggtctcgctctgtcgcccaggctggagtgcagtggtgcgatctcggctcactgcaaccttcacctcccaggttcaagtgattctcctgcctcagcctcccaagtagctgggactacaaacacacaccaccacttccagctaatttttgtatatttagtagagatggggtttcactatgttggccaagctcgcttcgaactcctgacctcaggtgatccactcaccttggtctcccaaagtgctgggtgggatacaggcgtgagctactgtgcccagcctttaaatgtaaactttttaattgtattacaactgcatcagaagttgtatactttgcaactattcaaatttatactgaaaacgtttttgaagttcaacctaaaattatgacaggagatagttttagaaaatattttggggaacagaggcatattctattttttttttttgagacagagtcttgctctgttgcccagactggggtgcagtggcgtgatctcagctgactgcatcctctgcctgccaggttcaagcaattctttgcctcagcctcctgagtagttgggattacaggtgcccgccaccatgcctggctaatttttttgtatttttagtagagacaagttttaccatcttggccagggtggtattgaactcctgacctcatgatctacctgcctcagcctcccaaagtgctgagattacaggcgtgagccccggggcccggcctggagggatattcttgaagcgccttgagcagggaggcagcgtttgtctttatctgaccttggcttctttgggtcactctgtttctctttccgtgaataaaaagccagtgagcacacactgtgtcccaggcactcttctacgctctggggacatcaccatgaacaactagtcagagtccccacctccaggggccttccgttctggtggtgggtttggttccatggttgaatgcacccagctgcttatctgttcaataggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtaagttgctctctgaaagtcgctatccatgtgacatgagccatgcccattcgaggctgcccttttctacagcggtgctactgctgcccagatatgcctgctctctcgcctctcctgtgccaggacgcagatcctgaccctctacttgccagctgacaaccatgtatagactcgttgccttagctcaccgtgggtggaggtgctgctggggttggggacactggctgagctgtcgatgggttcagctcatctatactagaaggaactggcccaggccctgggttcaaggagcactaggtttgtttttcctgcccacatcatgattcagtctcaagctacaaaccctggggcatcattaagatattatctttgtagggaagccacgtggtgaattttttgcccagaatcaagacatatttttggtgggaaccaatcatggcccctggaatcagtccaacctcagttggtcccgacgctgacactctcagctgtgtgattgtgggtagttattcctcctgttataagcctggttttccatatctaaaatgagaataatggtctttgctttatatggctgagagcaaagtgcagggagtgtccaggtactcagagtgctcagtttcttattaccgtggatcactggtctgtttcaggctggctctgttttcctaggcaatgttaaacaatttttcaaacaatattcaaaaaacattgaagcgtttagaaaaatacagaggaccaccacctttccaccaccctgataccaccgtttacatttttctgcatttccgtccctggtgcgtctcttgtctggctgtaagagatgtaattatgtcagggtatggggcaggaggaactctcacccactcatacttgcgtgctttggaagcagcttggccttttccagtcaaggagaacagagtgtgtctcgtgatctggcagttccacttctggggatagactgtggttctcaaagtgtggcccccagcccagcccattagcatcacctgggaagttgactgaaatgcaaatgaccagcccctcctcccactcttagacctggtgaattggacactctggggcagggcccaccccctgtgctttaccaggctctccaggtgattctgctgtgtgctggagtttgaggaccatgtgtaaacccttgcacatccccctgggagccacatgcatagcagcactgtttataacagcaaaactcagaccctgtctacgtgcctgtcatggtggaatggatactgggagtgtggtatgttcatgtagcagaattctatacagtagtaaagaggaatgaactagagttccaggtatcaaaatggctgcatcaaatgaacaacgttgaaccaaagaatcaagttacaggaaatatacaaaatgattccacttacgtaaaattccccaacaggcagcaataggcaatataccattgtgggaaaaacatataggtggcaaaactataaagaaaagcaaggatgtgatgattgcaagcctcaggatagagggaccctctggaggtgaaggagttgacccagggaggtgtgtgcaatgtcctaagtactgggagtgtttgtgttcttaacccaagtggttggtacatgcatatttgctttattatgtttgacacacttttgtaaatagatagtataaataaatgaaaacaaacaaaaagttataaggtgaactaagaccgaggctaccaactgtattcatgcatttggtaaggctgtggttctttctcagtcagggcccattttgctccctggaacttgtggccaggtctagagacatcttggttgtcacaactcagggtgaatagtgaatagaggccaggtatttggctaaacctcctacaatgtgtagggtagcccctgcaacaaacaatcttctaaccccaaatatgaatagcttcttgtcctgttataaagaagctattctagtaaaaacgtctgtctatgatgaagcatgcacaaaaatagtcattagaaagaggtaaaagacaaaatgattttctcatattttcttcctgaacctcaatcagcccactttaggaaaattgcacccagctgctggtaggtaggcaggaccgagtgtgaagtctgctgctttctctgtttttatgcaagtacttcactattttgattactttagttttatagtaattatggaaattaggtaatgctagtcctctgactttgttcttctttttcaaagtcattttgactaagaatatttagatcatttctatttaatgtgactggtaatataattagatttgagaatatcatcttgctatttgttttctatttgtcccgtctgttcttcgttccccctttcgtctttttctgccttctcttggattattttttatgattccatcatgtctcctttgttgtcttattaagtataactcttggtgtttttagtatatatctttaacttaataagtcaaccttcaagtgatagtctgtcacttcatgtatagtgcgagaaccttagaatagtgtatttccatctctctgctctgagccttcatactatttctatcatgcatcttttacatacatcataaaccccacaatacattgttattattgatgttcaaacattcaattatcttttaaataaagatagcaaaggaatacaaaaaagtgtagtagttaccccttctagtatagactcctttgtatagatccagatttccattcagtatcattttccttctacctaaagaacttctttaacatttcctgtagtgcaggtctgctggtaatgaattagttaagcttttgaatggctaaaaaagtctttgttttgccttcatttttaaaagttatttttgctgggtatagaattctagattgatggtgtttttcagtactttaaaaatactgcttcactgtcttctcgcttgttattgcttctgataagattgacagcagatttctcatttgtgtccctctgctcacactgtatcattctctggctgctcctaacattttctctttattactggttttgagcaatttgaccctcttatggcttgatgatgtttatgtttgctgtgcttaatgtctgttgagtttctgggatctttgggtttatggttttcattaagtttgagggaattgtatgtattatttcttcaaatatttttttctgtctctcttccattctcttttggggattccagtaacctgtgtattagacttattgaagttggccgtctttaatggagtgtattggttcattctcacactgctataaagaactgcctgaaactaggtaatttataaagaaaagaggtttaattgactcacagtccacatggctggggaggcctcaggaaacttacaatcatggaggaaggcatctcttcacaaggtggcaggagagagaatgactgaaggaggaacttgccaaacacttataaaaccatcagacctcatgaaaactcactatcatgagaacagcatgggggaaacctcccccacaatccaattacctccacctggtctctcccttgacacgtagggattatggggattacaattcgagatgagatttgggtagggacacagaaccaaaccatatcatgagcatgatttgcaggccatgaagaattctccatttttgtttcctccaggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcggtaagaacttacattctgtgttagtctgctcaggctgccataacaaaataccacagacagggtggcttatacaacaaaagtttattttctcacagttctggagactggaagtccaaaatcagggtttagcttctcctgaggcctttctccatggcttgcagatggccacctcctcaccgctcccccatgcggccttccttccacacacaagcatctctgctgtctcttccccttcttcataagggcaccagtcatattggattggggcctaccctaatgacctcatttaaccttaattgcctctttaaaggccttatcttcaaatacagtcccattaggggttagggcttcaacataggaatttggagggaacaccatttcataacgctatctcattgcacatttttttcacataagtcatatgtaatctacagtttgaggagaatctgaataaacacatttgggtcccccagttcagaactatatcagtgaggtctcaaagagttcaggcctgggacgggtcttgcaatacagatcaggtgtggtaggaagaatatggaaggagtttacagtaggaggactgttgtaaggtggcctggtagcagcaggatgctttcctaatgggggtagagtgtgtatgctggggggataatggaagatgttcggatgagtttcgggggattcccaatgtggtctgccacctgagctgatggcagaacactgggatgaggcaggaagccaaaagtggtggctttcaagcgttagtaagcaaaaactcacctgggttacatactcagaatgcatgttcttgaggtcacccagacacagtgcgatgtccccgcatatcagagggtaagaccagaaagtttccagttttaaatgtctccccatatgattgtataaaagtttgagaaccatgggcctaaggcgctatgtaggtcttttaagagcaaagtggagcactgatgtgggcgtggcctcctagggatcgtgaccagatgcccgctggtgctgaaactgaagaaacttgtgaacgaagataagtggagaggcaaggtcagttaccaggactacgagattgagatttcggatgcttcagaggtagaaaaggaaattaataaaggtgagtaccccctgtttggatgcctggtcaagccttctgacatgcatggggtctgtttgtaactgttcatactcccacctccctgggcctgtgctgtcaggacacctttctcctgcacatcaggccacggttccttctacttcttttacctcattatgaccagcacgcttggatatcagcatctgatagcaatcatttatttctggccaggcacagtggcttgtgcctgtaatcccagctctttgggaggctgacacggggggattgcttgagcctaggagttcaagaccagccagggcaacatagtgagaccccgtctcttaaaaaaaaaaaattaaaatagctgggcagggtggcatgcacctgtggtcccagctattcaggaggctgaggtgggagagttgcttgagcctgggaagtcaaggctgcagtgagccgtgatcttgctacggcactctagcctgacaacagagtgagaccctgtctcaaaaacacatgtattgcttattatgtaagtatctagaataatgtgaattttaaaatgtccccacatatggatgatctgtcccttattcaagggcttccctacttagatctggcaggaagaggagccagatatgggggtgagggagctcctccccctgttcctttgtacaaggaactccacattgtggacaggatcgtcactgaaccccactcagaaccagcacccttttctaagaaagaggagtgactgtgtttgcataatcccagcttaggctaattcatggcaggcctccataaatgcaaaccacaaggatcaatttgaagtgtctgcaaggggaaatgacaccagcagtgtagacagggtagagtagctgacaaagaacagcctctgtgagatgcatggataacatcttcctatcgaccttcatgtttttctggcatgtcacatgtttaagtttcattcacactgggaaggtactgaagagacatgaactaatgcccagcagtaggaagggacgggtttagcatttgtaaagatggagcattaatcacatttgttgactgtttaaagaaagataaataatgttattgacaaaccgtgattttgaattagttgggattaggttggctgcttgcagcagaaaactcaaaataactgtgtgccttagcccttgctgtataacaaacccatcttaaaactaatggcttgaccacttttatttctcatgatttgatggaccagctgggcagttcttctctgggctagctgggctggggctgatggtccaggatggcccttggctggagtgaccgggccttctgtctgtgtggtctctcaccctccagaaggctaagctggacttatcaatgtgggtggaggggttcccagcagcaagagagggcaagacccgacatctaacacctttcggtctctcctgacgtggcactgtgtaacatccccttagccagagaaagtcacgtggccaagcccaatttcaagggaccgattttctctctctccatggaagtgacgaaggcaccctgtaaagtagcgtgcatacagggatggaagggaatgtggatgccattgtgccagcaagttgctgagacagcggtctaaacaatgtagaggctttctgtccctctcatataagtctgaaggcgggcagaccagagctgattggggattccaatgtcaggaaccaagatttattcttctcccatttcttcattgggtgtggcctctgtttccaaggcccccccgtgacttagtcagcaagtccgctttgaagccagctggaccatggcaaggggcatatctctgcctttgtaagcacactttctggaagttgcacataacattttcacatggcccattggccagaacccgatctcatgaccacatggcaggtacatggatattgggggaacaattagtggaccataaccactgatatttcctaagttctaaattgatatcaaacatcccaaaaaggcattctagatttagaaaagagtaaagtggtgttagccaacaatttgatgaaacaaattcatatcctaaaattcattaaggaggaaggagcaaaataaaatctcttaatgggatgttaacagccagtgcttatcttagctaaaataagcacatttccccatataattttccagtttatattttaggcatttccatatatttttatttgtttttattttgcttggttgctaatttcctactgacatcaatgagaaggatttaggaatgctaccaggaagaacttcttgcctccgcccagctttggactggtctaagtgggtgtcactcatggtgacgttctcacaaggtctctctacacacagtgctggccaacagcagggaaaatactgagttatcctttgagatctcttttatcccaatcacagaaaattgaatctgctccaaatatgcttttatccatgactcgcagagaggagaagatgctttcagagtattcaccatcatgagatccgtttatcctaagctctgtttgggtttgattttccctgtctcttttctagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataaggtcagacttcagacccattctgaccttggccgtggcgtggggatgggggagtggaggggtgggaggagaaagagggtactgtattagagtaaccgtgagtccagagctgagttttggagttagtatttggaggtgtgagtggggaatttagagagcccgttggtcacagtctgttctgtcaagttgaatggaagcttctttggagaaagtgaggccagtgggcacagttggaaatgtgttctgtgtatttgttttatgttttatgcaatgacttgtttttggttatatacattttgcagcatatctaaagtgctgtgtattaggaaggggtcttatgtgggaagagagcattaaaaataagtataatgggccacacacagtggctcagtcctataatcccagcactttgggaggctgaggcaggaggattccttgagcccaagagtttgacagaaacctgagcaacatagtgagacccccttctctataaaagaaaggttaaaaaattagccaggtatggtggcgtgcacctgtcagctactaggaggattgcttgaaccagggaggctgtgatgagccgtgattgtgccactgcactccagcctgggcaacagagcaagaatctgtctcaaaacaaaaaacaaaacaaaacaagcaagaaagaaataggtataatgatattttagtatcagtgaatctcactttacagattaaagatttaggggtgaagtggggttttttggccaccatttttcattgtgaccatcagatctgaggtcttaggggttaattatctgaaacttcatggttttccctgagcctatagctctgcttctgccacagataatttattttctcataattccagcttggtacctccagggttgtgtttgtgggttcatttctccaaagttacttcttttgggggaaatacccctgggactcttagggcctaaagcaagtgcaaggtcaggacttgtctcacctctcacttgcctttgccatactcacgagtcacctcctctcatttccttacagatcaagacactcatcaagaagtacatccagaggcaggagacaatcagcctggtggtggtccccagtaatgtggacatcgccaccacagaggctctcagcatggcccaggaggtggaccccgagggagacaggaccatcggtgagagtgggggagccccactgtgctcagtgagaatgggggagcccgcctgtgctcggtgagaatgggggagcccacctgtgctcggtgagaatgggggagcccgcctgtgctcggtgagaatgggggagcccgcctgtgctcggtggtctgccagtgggcaagcgtccctccagtctccatgggctttgctcagtggggacctgcctccactaagacctgctaagggagcaggtttggtgcccaccaaggccaagtgaaatgagctgcttttgactctcactggctaggttgccttgtaagccttatctacttgctcagaaaggcacagtgggctcggaagcaggtcaaactcaggaggcacatggtactcattaagaatgcatttgagatgggatgtccataactcaagggataaacaaaacgtggcgtgttctacagtggacccgggtgaaggagcttggggagagccacatgctgttctgggaggcatccctgccttcacgcggcttgtcgtggagttcttttctggagcggggctccactgcccccatggttctgcaggggctatggcctgtcctcaagcaaggatgggaggaaaccctgggaggccgggggcgtgagcagttgttcgttcacctctgcctcgtgactgagcacgttctctccccaaatacatctggctcgcaggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcaggtgcgcttgcctgggtttcatcatggatcagtccaagcccaggatgtcaggccttccaggggacagtggcagccgtcccacagatgtgtggagtgtgtgtgtgtgtgtgtgcgtgtgtgtgtgtgcgcgtgtgtgtgtgactatgcttgttccccaacaaggactatggaattcacctagaagaataggaaggggattacaaaatactgccaagaaaaaaaaaactaaaaaccaatcaaaatagggagagaacaatgtacaataatttacgtagcatggtgctggaaccatattttataaaaacataaatagaagagaataggaaaaaagtagaaagcccagaaatagacctagatatatatatttgacacatgataaatgcagcatttcaaatcaaatagtggactatatcagcttgagtatctattagtggtgttaggataattaatatttgggaaaaaactaaaatactgcccttacttatctcattataccaaaatagttaaagtttaaagttaaatattaagaggaagcaataagcatctcagaagaaaggtaggtgaatagtttataagatttttctatccctcctaccaaaagtgacattttttaaaaggaaaagactgacaaattggtaagatttaaaatgatgagactatgtagagttgtaaacattcttacattcagttctcccagaagcctacagagagccattactcagaattccaggaatatcaaatggaaacttacatcctgttctgcacattcacaattgccagaagatgagatgattcagtgtccattgatggatggatgcagaaagcaatgtggtctgtacaaaaacatggaatactttcagccttagaaaggaaagacattctgacacatgctacaacatggatgaagcttgggaacattctactaagtgaaagaacccagtcgtaagaggacggatactgtctgattccacttagctgaggtccctggagtagtcagattcatagagacagaaagaatgatgggcaccaggggctgggagagagagaatgggcaggtagtgtttaatggggccattgtttcagtttgggaatatgaaaagttctgaagacagacagtggtgatggttgcataatagtgtgaatgtacttaatgccactcaagtgtactcttaaagatggttaaatggtcaattttatatgtagtttaccacaatttagaaaaattgacagagaaactgaagcttaggtatgagtatactcacaaaaaggcacagaaactcatgcttcactgctgcctttatcctaaaatgtcctataaaatgtgggaaaccctgtaataactcactctgtgagcacaaatttggatcgagtgagaagatacttgacttccttcctccaggcagcccatggtttaagtttttatcttggacaagatatcttgtgtctcttctcctcagtgttctgctacccatttatctcaatatgcttcaatgtatttgtatgaagatatgtctgtatccattatgatcacctacacatattacacatagaagggggtatgtgttataaaaacatatctatacatgtctgtgtatttttgtgatgaccaagtctatagtcagacaccatgatacacatttattatatcagctggaagagctcattccatatcattgtggaaatatcctagattgctaaaattcagtcataatcctattcaatccagttctgagtatttgttgggtaccaactgcaagacattccatccagttgtaagcaactgaaatttgccttgactttccccaacagcaaaaaggcagacatgcgtgttctggctacatcaaggtggaaatcggtcctgtgttctcttctagggatctgctggaggaaggaaaggccacggttccctgcctggcagaaaaacttaccagcgagctcatcacacatatctgtgtaagcacgggcagagctgtgggttctctaaaaagaatactacgaccgcagagctgaaccttgctggcttcttaaacatcactgtacacacagatcttctgaggatcttgttaagatgcagtttcagattctgtgggtctggagtggggcctagaattctgcatttccagcaagcccccagacaatgtggatattccttttcaggggaccacagtcagggggaatgctgatagactatatctactgggccaaaataaaaattaaaatcttatgcacaagctactaactcttcctttctcattgacaaccactattataatgtcttagtcattctaatgaacatattttttaacttctaaaagctttgtaaaagctctctgtggttctttttaaaagtctgcctgaatatagtgtcttcctttttcaaattttcttttcttttcttttctttcttttttttttttttttttttttttttgagacagagtctcactctgttgcccaggctggagtgcagtggtgtgatctcagctcactgcaacctctgcctcctgggttcaagcaattctcctacctcagcctcctgagtagctgggattacaggtgcccaccaccatgcctggctaatttttgtatttttagtagagacagggtttcaccatgttgaccagactggcctttttcaaattttcaactcagcaccagagtgcaaggtcttccacgtggtccccaggaatgcgggtgcataacagggttgtttccagccgaccatgatgagtgcagagctctctggggtcccactgtatgcagaaagaggatgcttccttattagattccccacctcgagcaagcccatggggattgattttttgcctctgcaccaagtcaggttcataagttcccgttcgaattttcttacctagacagatgcccttgtggctgagccgggcttcattgctgccttctccttgagcccctgcctggccactgttactggggctggcctctgactacccctcactaacttgtgagtccaccgatacatttaaaggtgcagctttcacatgtcagctggcatttttagatgtttgccgtggaagggtgagccagcatatggcgtcaaccgtattgttaaaaacataagtctctgatcactttttattgattgcaagcaacataaaagttgttgaatctcaaattgctccaaatgccactttttcagaacctactagacaagtggatctctccagtctccctccagagagtttacctaatatgaccacagaggaactgctcccgggtcactctgccggggcctaggacccatgcacagtgggtgccacagtgctgctcatgaggctgctgtcgcaggagtggggaagggggaagacctgggcagaaaacagtgcccccagtgtgtgcccccctgcacctcccccgggtctggaaaagcttccttttagaggaagccaggaagtcaaatggcccacacaactcctctgcagagggaggcccgggacctccttttcattctctgttcatctttacacatttccattattttctctccattttcctcagaaatctctgcccctgttagaaaatcaaatcaaggagactcaccagagaataacagaggagctacaaaagtatggtgtcgacataccggaagacgaaaatgaaaaaatgttcttcctgatagatgtgagtgttgccagctgcatggagctggagaagcacatgtcatggtcaaaaaagggaccctgggccttatgcacttccttcttcactcccccaaggctgatccaaagacatctggcccgtagcactcaaagggtggacagggctgagggaggcagggcagggagtgcagatgtgggggtggagtcagcagcgagggatgctcaggctgcgttgtgcctactctgtcacgagcatcacccagatccctaaggcagtaaggggtgggataggattttctagtgccaaaacctcttctttcccctgatccacagtgtcccataagaaagcaaagaatgactccccaccctccacataggcacggcctccaaatgaccttgacacttggatttgaagtctatccacttatactgatgtttttcttcttgacagaaagttaatgcctttaatcaggacatcactgctctcatgcaaggagaggaaactgtaggggaggaagacattcggctgtttaccagactccgacacgagttccacaaatggagtacaataattgaaaacaattttcaagaaggtgagtgtcttagtcccttcttttgggctgctacaaccgaatacctgagactgggtcatttataaacagtagaaacttattgctcattgttctggaggtgagaaatctattcttaaggaatcaggaaatttggtgtctggtgagagcttgttctctgcttcaaagatggcaccttctagctgtgtcctctcatgggataagggacgaacaagcttcctcggacctcttttttacaggggtaccacaggcatacctcagagatattgtgggttcagttccagacaaaaagaatattgcaataatgcaagtcatataaacttcttggttcctggtgcataaacagttcatttatgccctactgcagtctattaagtatgtaatagcattaggcctaaaaaatatgtatgtaccttagtttaaaacaccttattgctaaaaaattgctggtacagaaacaaaaagtgagcatgtgctactggaaaaaaatggtgctgatttgcttgacatgggattgccacagactttcaatttgtaaaaaatacggtatcagtgaagtgcaataaaacaagatatgcctggaatgccattatgcgggcagagtgctcataacccaatccttcctaaaggtctcctctgttgataccatcacactggggattaagtttcaacataggaatttttaggggacaccaacatgtagaccatagcaatgagtcaataccgtggtaaacctgatacgttggcttaagacagagaagagtggggcagttggggaggatggtcaggataaggagctagtgacaactaaagccatgtttgctctcttctatatcactgaacccaaatgaccatccactgatgaattgataaaccaactggcttgtgtctgtgtgtagcggttggctttggctgtcataacaaagtaccacagacttgggggggcttaaacagtagaaatttattttcttacagttctggaggctggaagtccaagatcaagatgttggtggagctggttccttctaaggcctctctccttgccttgcagatggcctcttctcgttgggtcctcatgtggttgtccctcagtgtgtgtgtcctcatctcctcccacaaggacactaggcagatgggatgagggcccaccctagtgacctgatttcaatttaattacctctttgcctgtctccaaacacagtcagattctgagtttctgagggttaggacttcaacattggagtttgaagaggtcacaactcaagctcagcccgtaacaccaagtcctggaatatttccagccacagacaggcacagagtgctggtccacagcaccccatggatgaaccttgaaaatgtcatgctgagtgaaagaagccagccacaaaggccacacggtctatgattccattgatagaaaatggctagaacaggcaaacccaggcaggcagaaagcagaatagtggctgccaggggctggggagggaaaagtgggaagttatcactgatgggtgatggatgtggggtttgggagttatgtctggggatggtcgcacaactttgtgaatatactaaaattcactcacccatacacttttttttttctttttctttggagacagggtctcactctgttgcccaggctggggtgcagtggctcagtctcggctcactgcaccctctgcctcccagattcaagcgattctcctgcttcagcctccacctccctagtagctgggattataggcacctgtctaatttttgtatttttagtagagatggggtttcaccatgttggccaggctggtctcgacctcctgacctcaggtgatcactggcctcagcctcccagagtgttgggattacgggcgtgagccactgtgcctggcctgaaccatatatttttaacagagtgaatgttatactatgtaaatgacatctcaattagaaaaatccttatgggaaaatatttcctgactaaaaaaagtgttctagattaccactcaaaaaggaactcaaaccctctgaacttctgatggggctaactctctctagtgtggattgttgggagtacaaatcattccaaaagtttaaagaaaaatgcagcatcttacacagtgaacagtgctactgtatcacattcatacaagttgatgtgcctggtttactctgttatcccatttgacttgtaaacactttctacacatggcaatactttcgacacatgaatatgtgatgtattgttaattccagaaagtgttcatgctcatttctaatgggcatgcagttgagggcaaggagtgtattatggtacaatttctttggtaaaactaaaattggattcacaaaacttcatactcgagtacgtttttaagaaggggtcttggccgggcacggtggctcacgcctgtaatcccagcactttgggaggccgaggcaggtggatcatgaggtcaggaaattgagaccatcctggctaacacggtgaaaccccgtctctactaaaaatacaaaaaaattagccgggcgtggtggcgggtacctgtagtcccagctacttgggaggctgaggcagaagaatggcgtgaacccgggaggcagagcttgcagtgagctgagatcacgccactgcactccagcctgggtgacagagcgagactctgtcacaaacaaacaaatgaaaaaaaagggtcttactcgaagtttctgcgtatgtgggttcctggcatcgtacctggctctgcactccccttcctgagatgactaaggaaaattatcttcagatctggttttgtgtgtgtgtgtgtgtgtgtgtgtgtgtgtgtgtgtgtgtgtgtgtgtaatccctggatatttttagtttaccagttagatttgatttgataccactttttcttgccatttatattttcagaaaatttagaatggtattgtgtttagaaaaatgtgcaagattatttttgtaaaataatttagagggttttttttcctgctataggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacgggtgagtgctcagtttcacctctgagcattgatttctaaagaaaggaaaggttcgaaccaaagccagcaccaaacttcagcactttcctcctggggtgcatcccacaccaacgagcaaacctctcattctccagatgccaagttggtattcaacaattcaattcaattctgacactaactaccctcagtcagtgtggaccccatagcttaagggctcagttccacaacactggccccaactacaaatgccggtcacaagtcccagacctcctattcttctgatggactgtttataaatcaaggttcttgcgacccattcctcaggtcaaccaagaactctggaacacacttcactgacatttactggtctattagaaaggatttgataaggggcacaaatgaagctgttggagaggcacatagtaggggcctgaacacagaagcttctgtccccacggggttgggggcaccatcctcatggcacagagatgtggtcatcaaccagggagctcttggaacctcaccgcggagaaggttttatggaggcctcatcatgaaggcatgatggaggattgactcaatctccaggccctccctcctctgtggagctggaagttctaagtttctagccaaggcttggtctttctagtgcccggccccaatcctgaagctatgtaggggcccaccaggcatcatctcttcaaaacacgagatactcctaaggctggacattccaagagatgtaggggctctatgttaggaaatggggacaaagacaaaatatttatatttttcctatcacaccacacctcccccctgctccactgctatgctggcttcacactcaaaatcggctgtttatttgaaatctccgaggagtaaagccaatggttccataactgcacgtgtagatgtgtttggaaccttttggagtgctgtaggaatctaggtgtgtcacggataggtaggaaactagatcctactgtggatccactcccttcttgaaatgctttgctttcttggttttccaggtattaaatctctattcttcatcctctccttgactgacagtatccttactcacacttcagctgcctcatcttagcagtaattaataatcactcatggatccatgaactaaggagctggagatagcctcagaacagctcattcagaggtgtatttccagtaaaattgaccttttagccctgataatcatataccaaaacctgcaatcatgttgttttggtccattgtagactcttaactcattccagaggaaagtttataatacttagagccttatagtcataaaaatcaacatagatatacctatttctttttcagaaatgtatgacatggagatcaataagaggttttcaatcataaagatactataccttgtattacaataaaattctgtgaggaagtagaatagaaatgagtttcaaaaataaaagataaataatataaattttttaatctaagagcttgttcttgtatttttttcaaatggataatgtagacactcaaattccattgatatatttaagagtgatttgacttatattaagagttgtattataaaatattaatatttataatttaaaagaaattacattctttgcagctatttaggataaaaagtttaaatatcaaataaatgtatgccaggggtcatttgcttttaagattcttccagcaaattattaagcaaaaagagcatgccttgctttttcatggtaaagagaagaagggagcggggagaggggaaactttacttcataccatttgatcctcatatttttttgcatcttaagaagagaacaaatgatcctaccaatattgaactatttttctctctttgattagatatggtccggcttgctttcacagatgtttcgataaaaaattttgaagagttttttaacctccacagaaccgccaaggtaaaaccaaccatgtgttgtttaaaaaaaaaaaagaaaagaaattaagcttgacactagaaaatagatttcttggatgaggattatttcaactttattgtatacttttagaacagcaaataacatcactcactagtgcttcttctgatgttaccggtgatgtctggttaaaagcaataaaggagggagtgcttaaacgcacagaacaagagatccacagttagcggagaagattatcacatctaagggcaatggctccaaatccagaaactcactgaggaaactacatataaaaatagaatatttctggcccgagtgggcatgatgagcctgtaatcccagcactttgggaggctgaggccggtagatgacttaaagccaggagtttgagaccagcctggcccacatggcaaaaccccatctctactaaaaatacaaaaaagtagctggacgtggtggtgcatgcctgtaatcccagctacttgggaggctgacactttagaattgattgagcccaggaggtggaagttgcagtgagccaacattgcatcactgcactctagcctaggcgatggagcgagaccccgtctcaaaaaaaaaaaaaaaaacaaacaaaaaaactttccatccagagtgaggaaagagcctacaggaaatgagcctgggggacagactgggccaagagaccagacttagccactcttagaaataggtgtccccggcacagatgaggagcctggccccatgattcaccagctggaggccttgggatgtgccacttccagcctgtgcccctgactcctcattcataaaagaagactgataaggccttcctcagaaggttgagatggacgtggagtaagatgtttaggatgcacctgccactgtgcactgtgcctctcctcaaggcctggagggtccaggggtgaagtttctcctcctcaggttttggcaaccagtttctctaaaccccgggaacataaaacataattttctgacttaaacatggctttcctgctcatccctgtggattatctgatggatatgacaatcctcgccatcagatatagaagcccctaaaagagaaaggaaagaagctgagttacggggcctgaaagcaagcctgtgcaggtccccaggccccgggatgggggtccggcccatctgtggctcaagcctcctgggaagctctgaccctcagccagggctagaaacctgccttagatacaccagggcgcggcccagagggctgttccaggaaacgtgctgtttcactcacgttgggtaacctggtatttacggacttcttacctactttcctgtgactcaggaatttgtgtcttgagggaaactgtatttatttattttttactgtagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggtacgtcttcgcgtggttcaggatgccagcttccattctttccttttcttctgaacgcctctctctttagtcttgctctctctgtaggtgacgttggtcagctctgtcgtttacctccttgttagcctcctgtattagtccattttcatgctgctgataaagacatacctgagactgggcaatttacaaaagaaagaggtttaacggacttacagttccacatggctggggaggccttctaccatcacggcagaaggcaatgggcacttcttacctggcggcggtggcaagagagagaatgagagccaagtgaaaggggtttccccttatcaaaccatcagatctcatgagagttactcactaccatgagaacagtattggagaaactgcccccatgattcagttatctccccctgagtccctcccacaacaggtgggaattatgggagtacaattcaagatgagatttgggtggggacacagagccaaaccatatcgccttcgtagaagcagctcaacctcagacagagagatggtggcttagagccagtgacatctggttttgatggctgtctagctctggccaagttacttaacctctctgagcctcagctttctttgtaaaatggtgtctcctcatagattctagtgcatattccaggagacgagtgtggatgatgataatggattgctaatggaaaaaccaaactctgttaaaatatttgaaagaggtttattctgagccaaatatgagggaccatggctctgggaacagtctcaggaggtcctgaggaagtgtgcctgaggctgtcaggatgcagtttgattttatacatttcagagaggcaggaattgtaggtaaaatcataaatcaatacatgggaggtgtacttgccctccctaaagaggcaggacaccttgaaggagggggagcttaccggtcataggtgggttcagagattttctggttgacgattgcttgaaagagttaaactttgtctacaaacttgacatcaatagaaagaaatgcctgagttaaggcagtgttagaggccaaaggtatgtagatgaagactctgggtagcagccttcagagagaataaatggtaaatgtttcttttcaggccttagaggcagcaggctctcagttaatctctcctagattcagggaaggcctagaaggggagaggtctgactgcattaatggagattctctacaggtgcaaattccccccccacaaaacatggcagggccatttcaatctgttggtcctgttacagccgtttcaaaatatgtccacaaaatatatttttaggtaaaatatttgtatttcctttagggtctgcaatctgtcttgtgatgctataccagagtcgggttggaaagtaagccattttatactgagttcatggaaactcatccaaggagatttcatggtttgtggggtgtgtgtgacttaacccctgcctcacatgactttataatatggtatcttactactccagagtctttttggccaaccttatgatctcaatttcaacctaaactccaaaagggcctggcttctcttcctgttacggccaggaattcagattttcaggtttctctggggtccacttggccaagagggggtctgttgagttggctggaaggcataggattttatttctggtttacaacaatttccttagtgcagcattggaatgcaatggtagcagactaaatggaagctatcgcgtagacacatgctttggttgatactgcacgattcagttaacctgaagtacaatctaattcatcctagggaaggaggcagtgaacacagacacaactcaggtagagcccttgggatgtgtaaacacctgaggaggtaaagcaaattgtaatctctcggtttatcagatgtccccattgccttactatttggatgctttaaagcagggcctctcaaactccacccagcacagaggcctcctgggatcttgtggaaatgcagatgctgattgcaggtcaggatgaagctgagattctgcctttcttttttttttttttttgaaaccgagtctcactccattacccaggctggagtgcagtggcacaatctcagctcactgcaacctctacatcctgggttcaagcaattcacctgcctcagcctcccaagtagctgggattacaggcttaccttgccaccatgcctagctattttttctatttttagtagagatggacttttaccatgttggccaggctggtcttgaactcctgacctcaagtgatctgcctgcctcggcctcccaaagtgctgggattacaggcgtgagccaccatgcctggcctctgcatttctaacgggctctcaggggtcaccatactactggatagaggccacacttggaggagcaaggctctaaaccgagggtcaacatccattcctccagacactgggagctgcatgcacgtgagtgaagccagttaaggggaagacaggcatgcacatcagcttctcctgcagccaagctcacacctgtccgctgcttccactgcctcctagaatgaacagttaccttgagagtaggtgaggcatatacatgcacagaatccaaacaataggatgagtgacaatggcagaggagtctccgagccaagcagctccctggacagaagcagcccttctccgggttcatttctgtcctccgaggctgactcatgcactcaaaagctcccatgcatatacattttataatggtttttacacaaaggttagcagaggagtggacgtgctgctctgtaccctgcctcttttgctgtacctgggagattgttctgcctcagttctgatggggctgccttgttcttttcaatggctgctgagtatcccattttatggatgtggtatattgagccagctccctttaagcgaacagtttgtttgcagtcttttgctaatgcaggtgtgttgctgtgaataggtttgtttgtatatcatgtatctggaagcatcaattcctagaaatgagattcctggtatattaggattgtgcagggaaacagaaccacagatatatgtatgtaaagaagtatatttcagccaggcatggtggctcatgcctgtaatcccggcactctggaaggctgaggtgggtggatctcttgaggccaggagtttgagaccagcctggccaacatggcgaaacccggtctctactaaaaatacaaaaaaattagctgtgcatggtggcccatgcctatagtcccagctacttgggaagctgagatatgagaattgctcgaacctgggaggcagaggttgcagtgagccaagatcacaccactgcactccagcctgggtgacagagcgagactccatctcaaaacaaacaaacaaacaaaaaacaaaacaaaacaaaaaacagaaggaaagaaagaaatatatgtatatttcaaggaattggcttctgccattttgggagctggcaagtccaaaatcccagggcaggccagcaggaagagcaggccagaaattgcagcaggagctaaggctgagtccacaggcggaatttcttctttttagggaaacctcatttttcttcttaagaccctcaactgattggatgaggcccatccacatcattgagaatggtctccttcacttaaagtcagtgggttacacatgttacccacatctacagaatacctccgcagcaatacctagattcgtgtttgatggaatcactggggactcgagcctagccaagctaacacatgaaacacaccatcacagctggggaaaggatggcttattttagactgataaagatgacccagagaaggcctgctccatccacactggccgctttagtctgcactaaagttgttggttttttttgtttgtttggtttttttttggtgacagagtctcactctgtcgcccaggctggagtgcagtggcgcagtctcagctcactgcaacctctgcatcctgagatcaagcgattctcctgcctcagcctcctgagtagctgggactacaggcacgtgccaccacactcggctaatttttgttttttcagtagagacggggtttcaccatattggccaggctggtcttgaacgcctgaccatgtgatccatccgcctcagtctaccaaagtgctgggtttacaggcgtgagccaccacgcccggccttgttggggttttttgacagcctaataggtgaaaatgacatctcattacaatcttaattggcattctcttatgacaacaagctggtacatctttttgtgtgttgagggttatttctatttcttgctcagcaaacagttcatccaggaagagcttcttggtgagatagtagacctctgcgatttctgttgcagacgatctacattttgtcatttgctttgtcatttttgtctatggtggttttagactatgcgtaagttttctagagcagaaactcaagttggatttgggcctcagtggttattgccatactttaaaaggactttgtctccctgagatgataaatgaggtggacaatattttctttaagtaatttcttattttaactgttacatgatacctttggcccatttggagttctttgatgtcaagaatgaggcaggatccagatggcagcagaggtcccagtcccatcctggaagggtcgtctagttcccactggtactccacacgcccactcaggcactcacttcccctctgcgttgggtcttgtctgcaagactctcttatgttttaccatctagtgcagccagcacccccacatcaccctcactttttctttctttaaattgtgcagaaatattcatcatgtctattttgccatcttaaccatttgggggtacatagttcagtggcattaagtacattcatattgtgccagcatcaccagcagccatctccaggaccctatcaccttcccacactgaaactctgtccccattaaacacattccccattccccgcccctgaatccctgacagctaccatcctactgtctgtctctgtgaattcaactaacctaagtacctcataggagttgtgactggcttgtttcatgcagtatgatgtcctcatccaggtggtagcaagtgtcagagtttcacgcctatttatttattattatgagacagagtcttgctctgtcgcccagcctggagtacaatggcgcgatcccagctcactgcagcctccccctgcctgggttcaaacaattctcctgcctcagcctcccatggtgtgccgccacacctggctattttttgtatttttagtagagacgcggtttcaccacgttgaccaggctggtctggaaatgcagtttttgcactgtctgcctgcttacctttatagagcatattttgccctcttccatcagaattacccatttaatggtcaggaaaagctgctgggaatatgactcatagctgggacattctctgcactgtgcatagttcctctctgccaccaccatggaggagattgatgggtttgaaacccaggggaaggtcattgccctgcgagggtctccctcattgagaatctggatcccctcatgtgcacatggtgaggtcagagtcccctcctcacagtgtcccctccaccctcccgtgaactgttctttccttccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagaca

SEQ ID NO: 2609 - DNA, 33164 bp, Homo sapiens
  source 1..33164: mol_type = genomic DNA
gttcgggcccgagaacctgcgtctcccgcgagttcccgcgaggcaagtgctgcaggtgcggggccaggagctaggtttcgtttctgcgcccggagccgccctcagcacagggtctgtgagtttcatttcttcgcggcgcggggcggggctgggcgcggggtgaaagaggcgaagcgagagcggaggccgcactccagcactgcgcagggaccggtgagtgtcgcttctgggggcagcgcccagtaaccgcgctaggagcgcggagaagggcattgggagagcggcgttcgtggcggagactagcgctccggagcacgggcacgacgggggcaccttctcggctgctagtaactaacaataataataatcataatcatagcaagggcgctgatgggcgggctcggagcacgcctgattctggttcccaccaggctgcccaggctcctgatgacgcatcagaaacatccccctaacccgcggccttcctgcaggagaggttgggaaggggtgggggacggggctcgggggaggtctccgagggactctagtaagcggggaagggcgccgggaaagtttcagatccacggctgcgcgggccacgagcccacccgaacgccgaccactgctttccgtcgacttctatttcctgggaacgcgcgaaagcaaacccaagtcagactgcggaggtcgctggggagggaaggttcaaggagttctcgccgatcctgctgaataaagggggttccgagctgggccgagatggggcatgcgcgggaagacccctgcccgctgttcccccccaccgccccagtggatgccatgcctggggcctccccggcgcgtggggctgacgcaccctcggggtccatcgtagttggccgggatcgtggagtgggtgcggtggacgaagggaggcaggacagtcccgggggtggcagaaggagcccgggcacagctgagacctgcgctcccatcccaccaacactcacagcaggtgctgccgagctgggcaattgggatggcccaagttatttggttaaattttaaatcacgtttgttactgggaagtagagtccagtgatgctaaccgcgcctctacctccaccaccggtgtcagtcccaaagggctcctaaaatggctgtgtcatctttcagccttggaccgcagttgccggccaggaatcccagtgtcacggtggacacgcctccctcgcgcccttgccgcccacctgctcacccagctcaggggctttggtaggtagcagtgcatttggtctaaagggcaagatgttctctcttttattcataacaaatttaaataccagcagggtttggggggaaaaacgctttcagaagaaaaggtgaatgtcagtcctgcaagagttagttttaaaactagactgaattggcacatgtatacctatgtaacaaacctgcacgttctgcacatgtaccccagaacttaaaagcttataaaaaaagaaaaaactagactggattatgttgggaaagtgtagcctcttccatcttaggcatttcctagaacgtaggcagtaggtggtccttattaggagttttgggagaggaagggggctgaatcctacctcccatccctgctcctctatggggtctgagctgaggaagcttcaccacaaggagagaaccccctgacaaccctggatgccacctttaccctcactgcaggaattctgtggccacactgcgaggagatcggttctgggtcggaggctacaggaagactcccactccctgaaatctggagtgaagaacgccgccatccagccaccattccaaggtaaggcagaaatgaagtgggccgttgggttctttcttttctttctttcttttttttgagacaaggtctcactctgtcgcccaggctggagtgcagtggcgccatctcagctcactgcaacccccgcctcccaggttcaagcgattctggtgcctcagtctcctgagtagctgggattacaggcacacatcaccacacctggctaatttgtatgtgtttagtagagacagcatttcaccatattggccaggctggtttcaaactcctggcctcaaatgatccacccgccttggcttcccaaagtactgggattacaggcacgagccactgcacccagtcaggttcattttagttgttatgttaaccaggtttcctgcacctgtgcgctaactttcactttcccaaaaggtttcagggtgacccagcaggcaatgagtgattctcaaattcaggatttattgtgagagattcacacacacaattgagcagacattcacagtacaatgattaaagggagtgatagggtaaggacccacagtggaggctctggaggccagcccactgacagccactccagggagtccagaagtcccgctctagtgctgggtggtggagggaaatctgttcctccagggacctcgtcctcggctgcccagctgccaaagtcaggaataagctttcagaaatctcactgccaagattccgaaaacgcttcagacattgctagtcccttgtcgcttttgcgatcctccacaggtgtgcgtgccactgggtccttattcactggggtctctggtggcattgggccacagcaagtgttccctcatccccttagtctaccacacacatgcttaccactttgaagaaaaacccctttactatgagcgaaagtgagaaacacgtatgtttattgtttctaaagaaagaaacttaatatgggcttaatgctacctagtgagtgcctccattttgagacattagggtcacaagtcattattatatatcatgggcacaaacctgccctgggcagggacggaaggaagcccctgcacaggggcagttgctcaggatgtgagaagagcctggtgcataaccccatccatgcccacctaacatctcaggctctgaccagtggggctgtgcagtagcgagtggatggagggctggaaccctgcagcctcctctccaaacacagggtgcagccaagacattttaggagcaatttgggatggagagctaggagtcgccacctcttggctcttccaaggccggaactggtgcctgcactcagttcagtttgaagactgcagctggatgccaagttccatggaggagtaagaaaccggtttgaactcccgagattgccctgcccctgaaatccaaactgatgttccgaatgatcagggaaaggtacaaacgtttatggtttacagacaaaacccataaggtttagctttcagagaatctcattttatgaagcaaattagggaagggaatctactcaccaagtcctgtttcagctgattgagtggaacctgtggtcatgtggtacaagtcctggtctcaatgatgctccttatctggctgcagaaaggccaactgaggcaaccatagcccagaagactggtactcctgagaggcagatgaagtggtggtctttgatatcgagcctgggatgccctgggcacatgaggtatttccaaaggcatgggagttttagggaataaattcccagattgtcagactccataagtaccgtttacaatggattaccttttataaccatcccaatcctacctgacaaaagaggtgggcagattacgaggtcaggaaattgagaccatcctggctaacactgtgagaccccatctctactaaataaatacaaaaaattagccgggtctggtggcgtgcacctgtagtcccagctacttgggagcctgaggcaggataatcgcttgaacccgggaggtggaggttgcagtgagccaagattgcgccactgctctccagcctggtgacaaagcgagactgtctcaaaaaaaaaaaaaaaaagaaagaaatacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagaggtaagttggtgcatgctattttctgtaacatttattttgagtcataggagaaagattttcagttacttttatccaagattattagacactgtaaaatttcatatttaggcacttgtcctacaacattttaaaaatgaatttcaaatacatacgtgtgtatttgtaatgcagacaagtataaggcagtcagttacatgctttcaagagtaaaatgaatgacatttcatttcccccatttgtgggagtaaaagaatgacaatatgaaattgatgatcaaaagaaagagcataaaagatttagagctcacgtgttttttaaactaaaggtttgggtatcaaattaccgtaatatttggattctcttggctacattggaaacagttctataacaattttatttttaaatgtaaagtttttgtttgttgttgtttttaagacggggtctcgctctgtcgcccaggctggagtgcagtggtgcgatctcggctcactgcaaccttcacctcccaggttcaagtgattctcctgcctcagcctcccaagtagctgggactacaaacacacaccaccacttccagctaatttttgtatatttagtagagatggggtttcactatgttggccaagctcgcttcgaactcctgacctcaggtgatccactcaccttggtctcccaaagtgctgggtgggatacaggcgtgagctactgtgcccagcctttaaatgtaaactttttaattgtattacaactgcatcagaagttgtatactttgcaactattcaaatttatactgaaaacgtttttgaagttcaacctaaaattatgacaggagatagttttagaaaatattttggggaacagaggcatattctattttttttttttgagacagagtcttgctctgttgcccagactggggtgcagtggcgtgatctcagctgactgcatcctctgcctgccaggttcaagcaattctttgcctcagcctcctgagtagttgggattacaggtgcccgccaccatgcctggctaatttttttgtatttttagtagagacaagttttaccatcttggccagggtggtattgaactcctgacctcatgatctacctgcctcagcctcccaaagtgctgagattacaggcgtgagccccggggcccggcctggagggatattcttgaagcgccttgagcagggaggcagcgtttgtctttatctgaccttggcttctttgggtcactctgtttctctttccgtgaataaaaagccagtgagcacacactgtgtcccaggcactcttctacgctctggggacatcaccatgaacaactagtcagagtccccacctccaggggccttccgttctggtggtgggtttggttccatggttgaatgcacccagctgcttatctgttcaataggcatctgctttattttaagcttactttgcaaagaaggaagatggttgtttccgaagtggacatcgcaaaagctgatccagctgctgcatcccaccctctattactgaatggagatgctactgtggcccagaaaaatccaggctcggtaagttgctctctgaaagtcgctatccatgtgacatgagccatgcccattcgaggctgcccttttctacagcggtgctactgctgcccagatatgcctgctctctcgcctctcctgtgccaggacgcagatcctgaccctctacttgccagctgacaaccatgtatagactcgttgccttagctcaccgtgggtggaggtgctgctggggttggggacactggctgagctgtcgatgggttcagctcatctatactagaaggaactggcccaggccctgggttcaaggagcactaggtttgtttttcctgcccacatcatgattcagtctcaagctacaaaccctggggcatcattaagatattatctttgtagggaagccacgtggtgaattttttgcccagaatcaagacatatttttggtgggaaccaatcatggcccctggaatcagtccaacctcagttggtcccgacgctgacactctcagctgtgtgattgtgggtagttattcctcctgttataagcctggttttccatatctaaaatgagaataatggtctttgctttatatggctgagagcaaagtgcagggagtgtccaggtactcagagtgctcagtttcttattaccgtggatcactggtctgtttcaggctggctctgttttcctaggcaatgttaaacaatttttcaaacaatattcaaaaaacattgaagcgtttagaaaaatacagaggaccaccacctttccaccaccctgataccaccgtttacatttttctgcatttccgtccctggtgcgtctcttgtctggctgtaagagatgtaattatgtcagggtatggggcaggaggaactctcacccactcatacttgcgtgctttggaagcagcttggccttttccagtcaaggagaacagagtgtgtctcgtgatctggcagttccacttctggggatagactgtggttctcaaagtgtggcccccagcccagcccattagcatcacctgggaagttgactgaaatgcaaatgaccagcccctcctcccactcttagacctggtgaattggacactctggggcagggcccaccccctgtgctttaccaggctctccaggtgattctgctgtgtgctggagtttgaggaccatgtgtaaacccttgcacatccccctgggagccacatgcatagcagcactgtttataacagcaaaactcagaccctgtctacgtgcctgtcatggtggaatggatactgggagtgtggtatgttcatgtagcagaattctatacagtagtaaagaggaatgaactagagttccaggtatcaaaatggctgcatcaaatgaacaacgttgaaccaaagaatcaagttacaggaaatatacaaaatgattccacttacgtaaaattccccaacaggcagcaataggcaatataccattgtgggaaaaacatataggtggcaaaactataaagaaaagcaaggatgtgatgattgcaagcctcaggatagagggaccctctggaggtgaaggagttgacccagggaggtgtgtgcaatgtcctaagtactgggagtgtttgtgttcttaacccaagtggttggtacatgcatatttgctttattatgtttgacacacttttgtaaatagatagtataaataaatgaaaacaaacaaaaagttataaggtgaactaagaccgaggctaccaactgtattcatgcatttggtaaggctgtggttctttctcagtcagggcccattttgctccctggaacttgtggccaggtctagagacatcttggttgtcacaactcagggtgaatagtgaatagaggccaggtatttggctaaacctcctacaatgtgtagggtagcccctgcaacaaacaatcttctaaccccaaatatgaatagcttcttgtcctgttataaagaagctattctagtaaaaacgtctgtctatgatgaagcatgcacaaaaatagtcattagaaagaggtaaaagacaaaatgattttctcatattttcttcctgaacctcaatcagcccactttaggaaaattgcacccagctgctggtaggtaggcaggaccgagtgtgaagtctgctgctttctctgtttttatgcaagtacttcactattttgattactttagttttatagtaattatggaaattaggtaatgctagtcctctgactttgttcttctttttcaaagtcattttgactaagaatatttagatcatttctatttaatgtgactggtaatataattagatttgagaatatcatcttgctatttgttttctatttgtcccgtctgttcttcgttccccctttcgtctttttctgccttctcttggattattttttatgattccatcatgtctcctttgttgtcttattaagtataactcttggtgtttttagtatatatctttaacttaataagtcaaccttcaagtgatagtctgtcacttcatgtatagtgcgagaaccttagaatagtgtatttccatctctctgctctgagccttcatactatttctatcatgcatcttttacatacatcataaaccccacaatacattgttattattgatgttcaaacattcaattatcttttaaataaagatagcaaaggaatacaaaaaagtgtagtagttaccccttctagtatagactcctttgtatagatccagatttccattcagtatcattttccttctacctaaagaacttctttaacatttcctgtagtgcaggtctgctggtaatgaattagttaagcttttgaatggctaaaaaagtctttgttttgccttcatttttaaaagttatttttgctgggtatagaattctagattgatggtgtttttcagtactttaaaaatactgcttcactgtcttctcgcttgttattgcttctgataagattgacagcagatttctcatttgtgtccctctgctcacactgtatcattctctggctgctcctaacattttctctttattactggttttgagcaatttgaccctcttatggcttgatgatgtttatgtttgctgtgcttaatgtctgttgagtttctgggatctttgggtttatggttttcattaagtttgagggaattgtatgtattatttcttcaaatatttttttctgtctctcttccattctcttttggggattccagtaacctgtgtattagacttattgaagttggccgtctttaatggagtgtattggttcattctcacactgctataaagaactgcctgaaactaggtaatttataaagaaaagaggtttaattgactcacagtccacatggctggggaggcctcaggaaacttacaatcatggaggaaggcatctcttcacaaggtggcaggagagagaatgactgaaggaggaacttgccaaacacttataaaaccatcagacctcatgaaaactcactatcatgagaacagcatgggggaaacctcccccacaatccaattacctccacctggtctctcccttgacacgtagggattatggggattacaattcgagatgagatttgggtagggacacagaaccaaaccatatcatgagcatgatttgcaggccatgaagaattctccatttttgtttcctccaggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcggtaagaacttacattctgtgttagtctgctcaggctgccataacaaaataccacagacagggtggcttatacaacaaaagtttattttctcacagttctggagactggaagtccaaaatcagggtttagcttctcctgaggcctttctccatggcttgcagatggccacctcctcaccgctcccccatgcggccttccttccacacacaagcatctctgctgtctcttccccttcttcataagggcaccagtcatattggattggggcctaccctaatgacctcatttaaccttaattgcctctttaaaggccttatcttcaaatacagtcccattaggggttagggcttcaacataggaatttggagggaacaccatttcataacgctatctcattgcacatttttttcacataagtcatatgtaatctacagtttgaggagaatctgaataaacacatttgggtcccccagttcagaactatatcagtgaggtctcaaagagttcaggcctgggacgggtcttgcaatacagatcaggtgtggtaggaagaatatggaaggagtttacagtaggaggactgttgtaaggtggcctggtagcagcaggatgctttcctaatgggggtagagtgtgtatgctggggggataatggaagatgttcggatgagtttcgggggattcccaatgtggtctgccacctgagctgatggcagaacactgggatgaggcaggaagccaaaagtggtggctttcaagcgttagtaagcaaaaactcacctgggttacatactcagaatgcatgttcttgaggtcacccagacacagtgcgatgtccccgcatatcagagggtaagaccagaaagtttccagttttaaatgtctccccatatgattgtataaaagtttgagaaccatgggcctaaggcgctatgtaggtcttttaagagcaaagtggagcactgatgtgggcgtggcctcctagggatcgtgaccagatgcccgctggtgctgaaactgaagaaacttgtgaacgaagataagtggagaggcaaggtcagttaccaggactacgagattgagatttcggatgcttcagaggtagaaaaggaaattaataaaggtgagtaccccctgtttggatgcctggtcaagccttctgacatgcatggggtctgtttgtaactgttcatactcccacctccctgggcctgtgctgtcaggacacctttctcctgcacatcaggccacggttccttctacttcttttacctcattatgaccagcacgcttggatatcagcatctgatagcaatcatttatttctggccaggcacagtggcttgtgcctgtaatcccagctctttgggaggctgacacggggggattgcttgagcctaggagttcaagaccagccagggcaacatagtgagaccccgtctcttaaaaaaaaaaaattaaaatagctgggcagggtggcatgcacctgtggtcccagctattcaggaggctgaggtgggagagttgcttgagcctgggaagtcaaggctgcagtgagccgtgatcttgctacggcactctagcctgacaacagagtgagaccctgtctcaaaaacacatgtattgcttattatgtaagtatctagaataatgtgaattttaaaatgtccccacatatggatgatctgtcccttattcaagggcttccctacttagatctggcaggaagaggagccagatatgggggtgagggagctcctccccctgttcctttgtacaaggaactccacattgtggacaggatcgtcactgaaccccactcagaaccagcacccttttctaagaaagaggagtgactgtgtttgcataatcccagcttaggctaattcatggcaggcctccataaatgcaaaccacaaggatcaatttgaagtgtctgcaaggggaaatgacaccagcagtgtagacagggtagagtagctgacaaagaacagcctctgtgagatgcatggataacatcttcctatcgaccttcatgtttttctggcatgtcacatgtttaagtttcattcacactgggaaggtactgaagagacatgaactaatgcccagcagtaggaagggacgggtttagcatttgtaaagatggagcattaatcacatttgttgactgtttaaagaaagataaataatgttattgacaaaccgtgattttgaattagttgggattaggttggctgcttgcagcagaaaactcaaaataactgtgtgccttagcccttgctgtataacaaacccatcttaaaactaatggcttgaccacttttatttctcatgatttgatggaccagctgggcagttcttctctgggctagctgggctggggctgatggtccaggatggcccttggctggagtgaccgggccttctgtctgtgtggtctctcaccctccagaaggctaagctggacttatcaatgtgggtggaggggttcccagcagcaagagagggcaagacccgacatctaacacctttcggtctctcctgacgtggcactgtgtaacatccccttagccagagaaagtcacgtggccaagcccaatttcaagggaccgattttctctctctccatggaagtgacgaaggcaccctgtaaagtagcgtgcatacagggatggaagggaatgtggatgccattgtgccagcaagttgctgagacagcggtctaaacaatgtagaggctttctgtccctctcatataagtctgaaggcgggcagaccagagctgattggggattccaatgtcaggaaccaagatttattcttctcccatttcttcattgggtgtggcctctgtttccaaggcccccccgtgacttagtcagcaagtccgctttgaagccagctggaccatggcaaggggcatatctctgcctttgtaagcacactttctggaagttgcacataacattttcacatggcccattggccagaacccgatctcatgaccacatggcaggtacatggatattgggggaacaattagtggaccataaccactgatatttcctaagttctaaattgatatcaaacatcccaaaaaggcattctagatttagaaaagagtaaagtggtgttagccaacaatttgatgaaacaaattcatatcctaaaattcattaaggaggaaggagcaaaataaaatctcttaatgggatgttaacagccagtgcttatcttagctaaaataagcacatttccccatataattttccagtttatattttaggcatttccatatatttttatttgtttttattttgcttggttgctaatttcctactgacatcaatgagaaggatttaggaatgctaccaggaagaacttcttgcctccgcccagctttggactggtctaagtgggtgtcactcatggtgacgttctcacaaggtctctctacacacagtgctggccaacagcagggaaaatactgagttatcctttgagatctcttttatcccaatcacagaaaattgaatctgctccaaatatgcttttatccatgactcgcagagaggagaagatgctttcagagtattcaccatcatgagatccgtttatcctaagctctgtttgggtttgattttccctgtctcttttctagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataaggtcagacttcagacccattctgaccttggccgtggcgtggggatgggggagtggaggggtgggaggagaaagagggtactgtattagagtaaccgtgagtccagagctgagttttggagttagtatttggaggtgtgagtggggaatttagagagcccgttggtcacagtctgttctgtcaagttgaatggaagcttctttggagaaagtgaggccagtgggcacagttggaaatgtgttctgtgtatttgttttatgttttatgcaatgacttgtttttggttatatacattttgcagcatatctaaagtgctgtgtattaggaaggggtcttatgtgggaagagagcattaaaaataagtataatgggccacacacagtggctcagtcctataatcccagcactttgggaggctgaggcaggaggattccttgagcccaagagtttgacagaaacctgagcaacatagtgagacccccttctctataaaagaaaggttaaaaaattagccaggtatggtggcgtgcacctgtcagctactaggaggattgcttgaaccagggaggctgtgatgagccgtgattgtgccactgcactccagcctgggcaacagagcaagaatctgtctcaaaacaaaaaacaaaacaaaacaagcaagaaagaaataggtataatgatattttagtatcagtgaatctcactttacagattaaagatttaggggtgaagtggggttttttggccaccatttttcattgtgaccatcagatctgaggtcttaggggttaattatctgaaacttcatggttttccctgagcctatagctctgcttctgccacagataatttattttctcataattccagcttggtacctccagggttgtgtttgtgggttcatttctccaaagttacttcttttgggggaaatacccctgggactcttagggcctaaagcaagtgcaaggtcaggacttgtctcacctctcacttgcctttgccatactcacgagtcacctcctctcatttccttacagatcaagacactcatcaagaagtacatccagaggcaggagacaatcagcctggtggtggtccccagtaatgtggacatcgccaccacagaggctctcagcatggcccaggaggtggaccccgagggagacaggaccatcggtgagagtgggggagccccactgtgctcagtgagaatgggggagcccgcctgtgctcggtgagaatgggggagcccacctgtgctcggtgagaatgggggagcccgcctgtgctcggtgagaatgggggagcccgcctgtgctcggtggtctgccagtgggcaagcgtccctccagtctccatgggctttgctcagtggggacctgcctccactaagacctgctaagggagcaggtttggtgcccaccaaggccaagtgaaatgagctgcttttgactctcactggctaggttgccttgtaagccttatctacttgctcagaaaggcacagtgggctcggaagcaggtcaaactcaggaggcacatggtactcattaagaatgcatttgagatgggatgtccataactcaagggataaacaaaacgtggcgtgttctacagtggacccgggtgaaggagcttggggagagccacatgctgttctgggaggcatccctgccttcacgcggcttgtcgtggagttcttttctggagcggggctccactgcccccatggttctgcaggggctatggcctgtcctcaagcaaggatgggaggaaaccctgggaggccgggggcgtgagcagttgttcgttcacctctgcctcgtgactgagcacgttctctccccaaatacatctggctcgcaggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcaggtgcgcttgcctgggtttcatcatggatcagtccaagcccaggatgtcaggccttccaggggacagtggcagccgtcccacagatgtgtggagtgtgtgtgtgtgtgtgtgcgtgtgtgtgtgtgcgcgtgtgtgtgtgactatgcttgttccccaacaaggactatggaattcacctagaagaataggaaggggattacaaaatactgccaagaaaaaaaaaactaaaaaccaatcaaaatagggagagaacaatgtacaataatttacgtagcatggtgctggaaccatattttataaaaacataaatagaagagaataggaaaaaagtagaaagcccagaaatagacctagatatatatatttgacacatgataaatgcagcatttcaaatcaaatagtggactatatcagcttgagtatctattagtggtgttaggataattaatatttgggaaaaaactaaaatactgcccttacttatctcattataccaaaatagttaaagtttaaagttaaatattaagaggaagcaataagcatctcagaagaaaggtaggtgaatagtttataagatttttctatccctcctaccaaaagtgacattttttaaaaggaaaagactgacaaattggtaagatttaaaatgatgagactatgtagagttgtaaacattcttacattcagttctcccagaagcctacagagagccattactcagaattccaggaatatcaaatggaaacttacatcctgttctgcacattcacaattgccagaagatgagatgattcagtgtccattgatggatggatgcagaaagcaatgtggtctgtacaaaaacatggaatactttcagccttagaaaggaaagacattctgacacatgctacaacatggatgaagcttgggaacattctactaagtgaaagaacccagtcgtaagaggacggatactgtctgattccacttagctgaggtccctggagtagtcagattcatagagacagaaagaatgatgggcaccaggggctgggagagagagaatgggcaggtagtgtttaatggggccattgtttcagtttgggaatatgaaaagttctgaagacagacagtggtgatggttgcataatagtgtgaatgtacttaatgccactcaagtgtactcttaaagatggttaaatggtcaattttatatgtagtttaccacaatttagaaaaattgacagagaaactgaagcttaggtatgagtatactcacaaaaaggcacagaaactcatgcttcactgctgcctttatcctaaaatgtcctataaaatgtgggaaaccctgtaataactcactctgtgagcacaaatttggatcgagtgagaagatacttgacttccttcctccaggcagcccatggtttaagtttttatcttggacaagatatcttgtgtctcttctcctcagtgttctgctacccatttatctcaatatgcttcaatgtatttgtatgaagatatgtctgtatccattatgatcacctacacatattacacatagaagggggtatgtgttataaaaacatatctatacatgtctgtgtatttttgtgatgaccaagtctatagtcagacaccatgatacacatttattatatcagctggaagagctcattccatatcattgtggaaatatcctagattgctaaaattcagtcataatcctattcaatccagttctgagtatttgttgggtaccaactgcaagacattccatccagttgtaagcaactgaaatttgccttgactttccccaacagcaaaaaggcagacatgcgtgttctggctacatcaaggtggaaatcggtcctgtgttctcttctagggatctgctggaggaaggaaaggccacggttccctgcctggcagaaaaacttaccagcgagctcatcacacatatctgtgtaagcacgggcagagctgtgggttctctaaaaagaatactacgaccgcagagctgaaccttgctggcttcttaaacatcactgtacacacagatcttctgaggatcttgttaagatgcagtttcagattctgtgggtctggagtggggcctagaattctgcatttccagcaagcccccagacaatgtggatattccttttcaggggaccacagtcagggggaatgctgatagactatatctactgggccaaaataaaaattaaaatcttatgcacaagctactaactcttcctttctcattgacaaccactattataatgtcttagtcattctaatgaacatattttttaacttctaaaagctttgtaaaagctctctgtggttctttttaaaagtctgcctgaatatagtgtcttcctttttcaaattttcttttcttttcttttctttcttttttttttttttttttttttttttgagacagagtctcactctgttgcccaggctggagtgcagtggtgtgatctcagctcactgcaacctctgcctcctgggttcaagcaattctcctacctcagcctcctgagtagctgggattacaggtgcccaccaccatgcctggctaatttttgtatttttagtagagacagggtttcaccatgttgaccagactggcctttttcaaattttcaactcagcaccagagtgcaaggtcttccacgtggtccccaggaatgcgggtgcataacagggttgtttccagccgaccatgatgagtgcagagctctctggggtcccactgtatgcagaaagaggatgcttccttattagattccccacctcgagcaagcccatggggattgattttttgcctctgcaccaagtcaggttcataagttcccgttcgaattttcttacctagacagatgcccttgtggctgagccgggcttcattgctgccttctccttgagcccctgcctggccactgttactggggctggcctctgactacccctcactaacttgtgagtccaccgatacatttaaaggtgcagctttcacatgtcagctggcatttttagatgtttgccgtggaagggtgagccagcatatggcgtcaaccgtattgttaaaaacataagtctctgatcactttttattgattgcaagcaacataaaagttgttgaatctcaaattgctccaaatgccactttttcagaacctactagacaagtggatctctccagtctccctccagagagtttacctaatatgaccacagaggaactgctcccgggtcactctgccggggcctaggacccatgcacagtgggtgccacagtgctgctcatgaggctgctgtcgcaggagtggggaagggggaagacctgggcagaaaacagtgcccccagtgtgtgcccccctgcacctcccccgggtctggaaaagcttccttttagaggaagccaggaagtcaaatggcccacacaactcctctgcagagggaggcccgggacctccttttcattctctgttcatctttacacatttccattattttctctccattttcctcagaaatctctgcccctgttagaaaatcaaatcaaggagactcaccagagaataacagaggagctacaaaagtatggtgtcgacataccggaagacgaaaatgaaaaaatgttcttcctgatagatgtgagtgttgccagctgcatggagctggagaagcacatgtcatggtcaaaaaagggaccctgggccttatgcacttccttcttcactcccccaaggctgatccaaagacatctggcccgtagcactcaaagggtggacagggctgagggaggcagggcagggagtgcagatgtgggggtggagtcagcagcgagggatgctcaggctgcgttgtgcctactctgtcacgagcatcacccagatccctaaggcagtaaggggtgggataggattttctagtgccaaaacctcttctttcccctgatccacagtgtcccataagaaagcaaagaatgactccccaccctccacataggcacggcctccaaatgaccttgacacttggatttgaagtctatccacttatactgatgtttttcttcttgacagaaagttaatgcctttaatcaggacatcactgctctcatgcaaggagaggaaactgtaggggaggaagacattcggctgtttaccagactccgacacgagttccacaaatggagtacaataattgaaaacaattttcaagaaggtgagtgtcttagtcccttcttttgggctgctacaaccgaatacctgagactgggtcatttataaacagtagaaacttattgctcattgttctggaggtgagaaatctattcttaaggaatcaggaaatttggtgtctggtgagagcttgttctctgcttcaaagatggcaccttctagctgtgtcctctcatgggataagggacgaacaagcttcctcggacctcttttttacaggggtaccacaggcatacctcagagatattgtgggttcagttccagacaaaaagaatattgcaataatgcaagtcatataaacttcttggttcctggtgcataaacagttcatttatgccctactgcagtctattaagtatgtaatagcattaggcctaaaaaatatgtatgtaccttagtttaaaacaccttattgctaaaaaattgctggtacagaaacaaaaagtgagcatgtgctactggaaaaaaatggtgctgatttgcttgacatgggattgccacagactttcaatttgtaaaaaatacggtatcagtgaagtgcaataaaacaagatatgcctggaatgccattatgcgggcagagtgctcataacccaatccttcctaaaggtctcctctgttgataccatcacactggggattaagtttcaacataggaatttttaggggacaccaacatgtagaccatagcaatgagtcaataccgtggtaaacctgatacgttggcttaagacagagaagagtggggcagttggggaggatggtcaggataaggagctagtgacaactaaagccatgtttgctctcttctatatcactgaacccaaatgaccatccactgatgaattgataaaccaactggcttgtgtctgtgtgtagcggttggctttggctgtcataacaaagtaccacagacttgggggggcttaaacagtagaaatttattttcttacagttctggaggctggaagtccaagatcaagatgttggtggagctggttccttctaaggcctctctccttgccttgcagatggcctcttctcgttgggtcctcatgtggttgtccctcagtgtgtgtgtcctcatctcctcccacaaggacactaggcagatgggatgagggcccaccctagtgacctgatttcaatttaattacctctttgcctgtctccaaacacagtcagattctgagtttctgagggttaggacttcaacattggagtttgaagaggtcacaactcaagctcagcccgtaacaccaagtcctggaatatttccagccacagacaggcacagagtgctggtccacagcaccccatggatgaaccttgaaaatgtcatgctgagtgaaagaagccagccacaaaggccacacggtctatgattccattgatagaaaatggctagaacaggcaaacccaggcaggcagaaagcagaatagtggctgccaggggctggggagggaaaagtgggaagttatcactgatgggtgatggatgtggggtttgggagttatgtctggggatggtcgcacaactttgtgaatatactaaaattcactcacccatacacttttttttttctttttctttggagacagggtctcactctgttgcccaggctggggtgcagtggctcagtctcggctcactgcaccctctgcctcccagattcaagcgattctcctgcttcagcctccacctccctagtagctgggattataggcacctgtctaatttttgtatttttagtagagatggggtttcaccatgttggccaggctggtctcgacctcctgacctcaggtgatcactggcctcagcctcccagagtgttgggattacgggcgtgagccactgtgcctggcctgaaccatatatttttaacagagtgaatgttatactatgtaaatgacatctcaattagaaaaatccttatgggaaaatatttcctgactaaaaaaagtgttctagattaccactcaaaaaggaactcaaaccctctgaacttctgatggggctaactctctctagtgtggattgttgggagtacaaatcattccaaaagtttaaagaaaaatgcagcatcttacacagtgaacagtgctactgtatcacattcatacaagttgatgtgcctggtttactctgttatcccatttgacttgtaaacactttctacacatggcaatactttcgacacatgaatatgtgatgtattgttaattccagaaagtgttcatgctcatttctaatgggcatgcagttgagggcaaggagtgtattatggtacaatttctttggtaaaactaaaattggattcacaaaacttcatactcgagtacgtttttaagaaggggtcttggccgggcacggtggctcacgcctgtaatcccagcactttgggaggccgaggcaggtggatcatgaggtcaggaaattgagaccatcctggctaacacggtgaaaccccgtctctactaaaaatacaaaaaaattagccgggcgtggtggcgggtacctgtagtcccagctacttgggaggctgaggcagaagaatggcgtgaacccgggaggcagagcttgcagtgagctgagatcacgccactgcactccagcctgggtgacagagcgagactctgtcacaaacaaacaaatgaaaaaaaagggtcttactcgaagtttctgcgtatgtgggttcctggcatcgtacctggctctgcactccccttcctgagatgactaaggaaaattatcttcagatctggttttgtgtgtgtgtgtgtgtgtgtgtgtgtgtgtgtgtgtgtgtgtgtgtgtaatccctggatatttttagtttaccagttagatttgatttgataccactttttcttgccatttatattttcagaaaatttagaatggtattgtgtttagaaaaatgtgcaagattatttttgtaaaataatttagagggttttttttcctgctataggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacgggtgagtgctcagtttcacctctgagcattgatttctaaagaaaggaaaggttcgaaccaaagccagcaccaaacttcagcactttcctcctggggtgcatcccacaccaacgagcaaacctctcattctccagatgccaagttggtattcaacaattcaattcaattctgacactaactaccctcagtcagtgtggaccccatagcttaagggctcagttccacaacactggccccaactacaaatgccggtcacaagtcccagacctcctattcttctgatggactgtttataaatcaaggttcttgcgacccattcctcaggtcaaccaagaactctggaacacacttcactgacatttactggtctattagaaaggatttgataaggggcacaaatgaagctgttggagaggcacatagtaggggcctgaacacagaagcttctgtccccacggggttgggggcaccatcctcatggcacagagatgtggtcatcaaccagggagctcttggaacctcaccgcggagaaggttttatggaggcctcatcatgaaggcatgatggaggattgactcaatctccaggccctccctcctctgtggagctggaagttctaagtttctagccaaggcttggtctttctagtgcccggccccaatcctgaagctatgtaggggcccaccaggcatcatctcttcaaaacacgagatactcctaaggctggacattccaagagatgtaggggctctatgttaggaaatggggacaaagacaaaatatttatatttttcctatcacaccacacctcccccctgctccactgctatgctggcttcacactcaaaatcggctgtttatttgaaatctccgaggagtaaagccaatggttccataactgcacgtgtagatgtgtttggaaccttttggagtgctgtaggaatctaggtgtgtcacggataggtaggaaactagatcctactgtggatccactcccttcttgaaatgctttgctttcttggttttccaggtattaaatctctattcttcatcctctccttgactgacagtatccttactcacacttcagctgcctcatcttagcagtaattaataatcactcatggatccatgaactaaggagctggagatagcctcagaacagctcattcagaggtgtatttccagtaaaattgaccttttagccctgataatcatataccaaaacctgcaatcatgttgttttggtccattgtagactcttaactcattccagaggaaagtttataatacttagagccttatagtcataaaaatcaacatagatatacctatttctttttcagaaatgtatgacatggagatcaataagaggttttcaatcataaagatactataccttgtattacaataaaattctgtgaggaagtagaatagaaatgagtttcaaaaataaaagataaataatataaattttttaatctaagagcttgttcttgtatttttttcaaatggataatgtagacactcaaattccattgatatatttaagagtgatttgacttatattaagagttgtattataaaatattaatatttataatttaaaagaaattacattctttgcagctatttaggataaaaagtttaaatatcaaataaatgtatgccaggggtcatttgcttttaagattcttccagcaaattattaagcaaaaagagcatgccttgctttttcatggtaaagagaagaagggagcggggagaggggaaactttacttcataccatttgatcctcatatttttttgcatcttaagaagagaacaaatgatcctaccaatattgaactatttttctctctttgattagatatggtccggcttgctttcacagatgtttcgataaaaaattttgaagagttttttaacctccacagaaccgccaaggtaaaaccaaccatgtgttgtttaaaaaaaaaaaagaaaagaaattaagcttgacactagaaaatagatttcttggatgaggattatttcaactttattgtatacttttagaacagcaaataacatcactcactagtgcttcttctgatgttaccggtgatgtctggttaaaagcaataaaggagggagtgcttaaacgcacagaacaagagatccacagttagcggagaagattatcacatctaagggcaatggctccaaatccagaaactcactgaggaaactacatataaaaatagaatatttctggcccgagtgggcatgatgagcctgtaatcccagcactttgggaggctgaggccggtagatgacttaaagccaggagtttgagaccagcctggcccacatggcaaaaccccatctctactaaaaatacaaaaaagtagctggacgtggtggtgcatgcctgtaatcccagctacttgggaggctgacactttagaattgattgagcccaggaggtggaagttgcagtgagccaacattgcatcactgcactctagcctaggcgatggagcgagaccccgtctcaaaaaaaaaaaaaaaaacaaacaaaaaaactttccatccagagtgaggaaagagcctacaggaaatgagcctgggggacagactgggccaagagaccagacttagccactcttagaaataggtgtccccggcacagatgaggagcctggccccatgattcaccagctggaggccttgggatgtgccacttccagcctgtgcccctgactcctcattcataaaagaagactgataaggccttcctcagaaggttgagatggacgtggagtaagatgtttaggatgcacctgccactgtgcactgtgcctctcctcaaggcctggagggtccaggggtgaagtttctcctcctcaggttttggcaaccagtttctctaaaccccgggaacataaaacataattttctgacttaaacatggctttcctgctcatccctgtggattatctgatggatatgacaatcctcgccatcagatatagaagcccctaaaagagaaaggaaagaagctgagttacggggcctgaaagcaagcctgtgcaggtccccaggccccgggatgggggtccggcccatctgtggctcaagcctcctgggaagctctgaccctcagccagggctagaaacctgccttagatacaccagggcgcggcccagagggctgttccaggaaacgtgctgtttcactcacgttgggtaacctggtatttacggacttcttacctactttcctgtgactcaggaatttgtgtcttgagggaaactgtatttatttattttttactgtagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggtacgtcttcgcgtggttcaggatgccagcttccattctttccttttcttctgaacgcctctctctttagtcttgctctctctgtaggtgacgttggtcagctctgtcgtttacctccttgttagcctcctgtattagtccattttcatgctgctgataaagacatacctgagactgggcaatttacaaaagaaagaggtttaacggacttacagttccacatggctggggaggccttctaccatcacggcagaaggcaatgggcacttcttacctggcggcggtggcaagagagagaatgagagccaagtgaaaggggtttccccttatcaaaccatcagatctcatgagagttactcactaccatgagaacagtattggagaaactgcccccatgattcagttatctccccctgagtccctcccacaacaggtgggaattatgggagtacaattcaagatgagatttgggtggggacacagagccaaaccatatcgccttcgtagaagcagctcaacctcagacagagagatggtggcttagagccagtgacatctggttttgatggctgtctagctctggccaagttacttaacctctctgagcctcagctttctttgtaaaatggtgtctcctcatagattctagtgcatattccaggagacgagtgtggatgatgataatggattgctaatggaaaaaccaaactctgttaaaatatttgaaagaggtttattctgagccaaatatgagggaccatggctctgggaacagtctcaggaggtcctgaggaagtgtgcctgaggctgtcaggatgcagtttgattttatacatttcagagaggcaggaattgtaggtaaaatcataaatcaatacatgggaggtgtacttgccctccctaaagaggcaggacaccttgaaggagggggagcttaccggtcataggtgggttcagagattttctggttgacgattgcttgaaagagttaaactttgtctacaaacttgacatcaatagaaagaaatgcctgagttaaggcagtgttagaggccaaaggtatgtagatgaagactctgggtagcagccttcagagagaataaatggtaaatgtttcttttcaggccttagaggcagcaggctctcagttaatctctcctagattcagggaaggcctagaaggggagaggtctgactgcattaatggagattctctacaggtgcaaattccccccccacaaaacatggcagggccatttcaatctgttggtcctgttacagccgtttcaaaatatgtccacaaaatatatttttaggtaaaatatttgtatttcctttagggtctgcaatctgtcttgtgatgctataccagagtcgggttggaaagtaagccattttatactgagttcatggaaactcatccaaggagatttcatggtttgtggggtgtgtgtgacttaacccctgcctcacatgactttataatatggtatcttactactccagagtctttttggccaaccttatgatctcaatttcaacctaaactccaaaagggcctggcttctcttcctgttacggccaggaattcagattttcaggtttctctggggtccacttggccaagagggggtctgttgagttggctggaaggcataggattttatttctggtttacaacaatttccttagtgcagcattggaatgcaatggtagcagactaaatggaagctatcgcgtagacacatgctttggttgatactgcacgattcagttaacctgaagtacaatctaattcatcctagggaaggaggcagtgaacacagacacaactcaggtagagcccttgggatgtgtaaacacctgaggaggtaaagcaaattgtaatctctcggtttatcagatgtccccattgccttactatttggatgctttaaagcagggcctctcaaactccacccagcacagaggcctcctgggatcttgtggaaatgcagatgctgattgcaggtcaggatgaagctgagattctgcctttcttttttttttttttttgaaaccgagtctcactccattacccaggctggagtgcagtggcacaatctcagctcactgcaacctctacatcctgggttcaagcaattcacctgcctcagcctcccaagtagctgggattacaggcttaccttgccaccatgcctagctattttttctatttttagtagagatggacttttaccatgttggccaggctggtcttgaactcctgacctcaagtgatctgcctgcctcggcctcccaaagtgctgggattacaggcgtgagccaccatgcctggcctctgcatttctaacgggctctcaggggtcaccatactactggatagaggccacacttggaggagcaaggctctaaaccgagggtcaacatccattcctccagacactgggagctgcatgcacgtgagtgaagccagttaaggggaagacaggcatgcacatcagcttctcctgcagccaagctcacacctgtccgctgcttccactgcctcctagaatgaacagttaccttgagagtaggtgaggcatatacatgcacagaatccaaacaataggatgagtgacaatggcagaggagtctccgagccaagcagctccctggacagaagcagcccttctccgggttcatttctgtcctccgaggctgactcatgcactcaaaagctcccatgcatatacattttataatggtttttacacaaaggttagcagaggagtggacgtgctgctctgtaccctgcctcttttgctgtacctgggagattgttctgcctcagttctgatggggctgccttgttcttttcaatggctgctgagtatcccattttatggatgtggtatattgagccagctccctttaagcgaacagtttgtttgcagtcttttgctaatgcaggtgtgttgctgtgaataggtttgtttgtatatcatgtatctggaagcatcaattcctagaaatgagattcctggtatattaggattgtgcagggaaacagaaccacagatatatgtatgtaaagaagtatatttcagccaggcatggtggctcatgcctgtaatcccggcactctggaaggctgaggtgggtggatctcttgaggccaggagtttgagaccagcctggccaacatggcgaaacccggtctctactaaaaatacaaaaaaattagctgtgcatggtggcccatgcctatagtcccagctacttgggaagctgagatatgagaattgctcgaacctgggaggcagaggttgcagtgagccaagatcacaccactgcactccagcctgggtgacagagcgagactccatctcaaaacaaacaaacaaacaaaaaacaaaacaaaacaaaaaacagaaggaaagaaagaaatatatgtatatttcaaggaattggcttctgccattttgggagctggcaagtccaaaatcccagggcaggccagcaggaagagcaggccagaaattgcagcaggagctaaggctgagtccacaggcggaatttcttctttttagggaaacctcatttttcttcttaagaccctcaactgattggatgaggcccatccacatcattgagaatggtctccttcacttaaagtcagtgggttacacatgttacccacatctacagaatacctccgcagcaatacctagattcgtgtttgatggaatcactggggactcgagcctagccaagctaacacatgaaacacaccatcacagctggggaaaggatggcttattttagactgataaagatgacccagagaaggcctgctccatccacactggccgctttagtctgcactaaagttgttggttttttttgtttgtttggtttttttttggtgacagagtctcactctgtcgcccaggctggagtgcagtggcgcagtctcagctcactgcaacctctgcatcctgagatcaagcgattctcctgcctcagcctcctgagtagctgggactacaggcacgtgccaccacactcggctaatttttgttttttcagtagagacggggtttcaccatattggccaggctggtcttgaacgcctgaccatgtgatccatccgcctcagtctaccaaagtgctgggtttacaggcgtgagccaccacgcccggccttgttggggttttttgacagcctaataggtgaaaatgacatctcattacaatcttaattggcattctcttatgacaacaagctggtacatctttttgtgtgttgagggttatttctatttcttgctcagcaaacagttcatccaggaagagcttcttggtgagatagtagacctctgcgatttctgttgcagacgatctacattttgtcatttgctttgtcatttttgtctatggtggttttagactatgcgtaagttttctagagcagaaactcaagttggatttgggcctcagtggttattgccatactttaaaaggactttgtctccctgagatgataaatgaggtggacaatattttctttaagtaatttcttattttaactgttacatgatacctttggcccatttggagttctttgatgtcaagaatgaggcaggatccagatggcagcagaggtcccagtcccatcctggaagggtcgtctagttcccactggtactccacacgcccactcaggcactcacttcccctctgcgttgggtcttgtctgcaagactctcttatgttttaccatctagtgcagccagcacccccacatcaccctcactttttctttctttaaattgtgcagaaatattcatcatgtctattttgccatcttaaccatttgggggtacatagttcagtggcattaagtacattcatattgtgccagcatcaccagcagccatctccaggaccctatcaccttcccacactgaaactctgtccccattaaacacattccccattccccgcccctgaatccctgacagctaccatcctactgtctgtctctgtgaattcaactaacctaagtacctcataggagttgtgactggcttgtttcatgcagtatgatgtcctcatccaggtggtagcaagtgtcagagtttcacgcctatttatttattattatgagacagagtcttgctctgtcgcccagcctggagtacaatggcgcgatcccagctcactgcagcctccccctgcctgggttcaaacaattctcctgcctcagcctcccatggtgtgccgccacacctggctattttttgtatttttagtagagacgcggtttcaccacgttgaccaggctggtctggaaatgcagtttttgcactgtctgcctgcttacctttatagagcatattttgccctcttccatcagaattacccatttaatggtcaggaaaagctgctgggaatatgactcatagctgggacattctctgcactgtgcatagttcctctctgccaccaccatggaggagattgatgggtttgaaacccaggggaaggtcattgccctgcgagggtctccctcattgagaatctggatcccctcatgtgcacatggtgaggtcagagtcccctcctcacagtgtcccctccaccctcccgtgaactgttctttccttccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagaca

SEQ ID NO: 2610 - DNA, 46920 bp, Homo sapiens
  source 1..46920: mol_type = genomic DNA
aagagatgatttctccatcctgaacgtgcagcggtaagagcggggccggtgcagggagggctgctttgtgtctgatgcacagcagatgcgtgtttaaaaaatatttcctgagtaacgtgacatctgcttggtgaatgtggcttgtgctgggaggcaggagccacaaagataagattctggtgtgaggagcagaaagggcccatgttgccaccagcccacagtagccttgtgcacagacaaagaggctctggaggggaagtggctggccctggggacagggtggcctccatcctgatctggccaaaagtcgggtggacgcaaaggggtggtttttaggacagctttgctcagcgtcctacaaagtctgggggttgagtaaggagctttgtgcccgaaaagtcgtctcggagggtttcaagtgttccttcttttgtggtatttgtgatgctctgacgtaaccttagtgacggtgatatgctgggaaattggctctcatggggcggggcagggcagagggtggtgcctgatttctagcctttgccgattctcttccgttctcatggtgtgaatgctcccaccgtggccagttcccagccagtaggggccaactccagcactctggaccactgcaccctggatcgcctgcactctgggggctgaagtccattttataattgatatagagcggaaaggagacatggtggtattgatgacgcagtttttttttcttttttttttttttttttttttttttgagagaagttctcgttctgttccccaggctggagtgcagtggcgtgatcatggctcactgcagtctcaagctcccgggctcaagggatcctcccacctcagcctcccaagtagctgggactacaggtgtgcaccaccacacctggttaattttatttctttttgtagagacaggggctctctatgttgcccaggctggtctcaaactcactggctcaagaagtccttacgcctcaacctcccaaagcactgggattacaggcgtaagccaccccattcggctttgatgacaccttttgaacactgttctttctcattttgtgtttagaatgttgtctctagctgtttaaaaagatcaggattccaagctatctttcctcgcaccctctcctccgtttactctgctctacttcccagccccgcgccaacccctgaagcacttttgactcccttcggatgtacaatttttttttctttttcttttttgagacagggtcttcctgctctgtttcccaggctggagtgcaatggtaccatcatagctcactgcagccttaaacttccgggctcaagtgatcctcctgcctcggcctcccaatgcattgggattacaggtgtgagtccctgcgtctggccaggatgtatgtgagctttatttaggtttagcccctgccctagaatgcaagctcccccagagatctttgtctgcctgactcgatatgtatctcaaggacttagtgctcaatatatatctttgagtgggtgaaaaacaagcggtcttaaaaagaaaggaggtgagcccggggagataaggtcgcattcagtgccagtgcttggtcagccatgaccctgcaccatgcgagtgacattgggactggagcaaagggacacagcagagtggcccctggtgcccaggacccggcagagctctcggactggttgcaagccagcaatagtggctatgcccgtgtgggagacgcagcttgccttagacttcagcgggaaccaccatgtccggcacagccatttccatccttcccaggggtgcttacgtgatcctggcagtctcagtcaaacttccaaactcagcagggaatgtgtgtgcttgtcctccaatctcaacaccctgggatgcagtgtcaggtgcaggtcagagacagcagtggagacccgattcccagccctgggctggggcccccacaaggcctccagcatctccccatggcccagtttcctcatctgcaggacaggctctcttgagaatttggggggatgatagacccaaaagcattctggagccagaggcttctgccttcgtcgggggcatcagggagtgtcagtcatgaattcaccatgacttctgaccacctctgcctggactccctcacctcagtgctgcctaagctgggtaaccaccagcttcctgggccttcaccccgcagggccttcctctccagtgatgcgcctggaaagagggatttctctttgcaaaggtctctggaattgccaagttatggctttaagcatatgtagggaaactccctcccctttgcacttttggagtttttttccagccctcaatagaaatcaatacagtgaccaggctgcccttttcaccacactctcaggctcctgaggaccctggtggaagatggactaagcacatcctgggcatcggggacaggcaccggctcctcaagcgtggacagggacagggatggggcggggcagcgctgcaggaggtggggcctgggctgattttcttgctgtactactttcagtcactacgtacctgttatgggttgaactaggctccctgtattagtcagagttctctagagggacagaactaatggaatataaaaaaataaatatatacatatatatggaagtttactaagtatgaatttacaggatcacaaggtccacaataagcaatctgcagcctgaggagcaaggggagccagtgtgagtcccaaaacctgaagaacttggagtccaatgttcgagggcaggaagcatccagcacaggagaaagctgtaggctgggaggctaaaccagtctctcttttcacatttttcagcctgctttatattctagctttgctgacagctgattagatggtgcccacctagactgaaggtggatctgcctttccaagccactgactcaaatgttaatctcctttggcaacacctcacagacacacccaggatcagtactttgcatccttcaacccaatcaagttgacactcagtattaaccatcacacccctcaaatgtatatgttcaaatcctaacctcagaacctctgaatgtgaccttagttggaaatagggtctttgcagatgtaattaaagacgaggttgttttccagtagggtgggccctaatccaatatgactggtatccttataaaacaggaaaatttgtttgtttgtttgtttgtttgtttgtttaacttctattttaggttcaggggtccatgtgcaggtttgttacatgggtagattgtgtcatgggagtttagtgcacacattatttcatcactcgggtaataagcgtagtagccaatggatagctttttgctcctctccttcctcccaccctctacccttgagtaggctcaggtgtctcttgttctcttctttgtggccatgtgtgtttaatgtttagctcccactaataattgagaacatgtggtatttggttttctgttactagattagtttgcttaggattatggcctccagttccatccatgttcctgcaaaggacatgatctcattctttttgatggttgcatagtattccatagtgtatatgtaccacgcttttttatccagtctaccattgatggccatttaggttgattctatgtctttgctattgtaacggtgctgccatgaacattcgtctgcatgtgtctttgcggtagaatgatttctattcctttgggtacatacgctgtaatgggattgctgggtcgaatggtaatcctgtttaagttctttgaggagtcaccagactgctttccacatggctgaactaattcgcactcccaccagcagtgcagaagtgttccccaaaaggggacatttggacacagacacgcagaagcccactcctgcctcctcactcagcctggatttgtctcagtcgccctcgcttgcctctcacacgtgtgcaccctcacactgcttcagcatctgccggtcctccggcctttgctcttagagcagagattctcaacctttctccatttgggcttccctgagtggttccgtagttcatttatggtgcccgccacccaaaataaattcctggcagttctatttactaattaggtaggtccaaacaactcagtaatagtaggctgggtggtgtccaacagctgccttcgtgtatcactgggaaatcttaaagatcccacagtggcctgtgagtttgctgaaataccccaggtgcacagtttggggaacatagtcttatagatttgatgaattccctttttgcacctgtatatcactcacggggctgatctatgactggtgtgctagtccatttgtgtcacgatagaggtaaacctgagactgagtaacttacaaagaaaagaggtttagccgggcacagtggctcacgcctgtaatcccaacactttgggaggccaagtcgggtggatcacctgaggtcaggagttggagaccagcctgaccaacatggagaaacctcatctctactaaaaatacaagattagctgggcgtggtggtgcatgcttgtaatcccagctactagggcaggcagaggtccttctcagatgctttgggtcctgccattgaaagggaagaagagaagtcccttccctgggagagcctcagtgatccctgcacaagaccagccgtcttcctccgccccatattgttcagccctggcaccctgtgttgtgcgtggagtcccttgttttcctctatcttatcaggaaccagttctaggttcctaacctggtctgaccccggcaccctgtcctgttacacaagaaacccggatgctgatatatatatgtcccaacattgcccttccagagcctctccagctgtgactcactgttgacatggcaacccccaccccctggactcctcgctcaacccacaaagactatctcttgcgtactctgctctgaggtgttttaaaaagcgccaccataaacctgtaacacaagaatgaaacccagcaagaatcaggggacaggaaccaaggaacatgacatcacgtgagaactaagggccgctctgattgaccatagcatttggctctcagcctcccacggccaaggctaagggaggataggacaattgtctctctcactcttgaacaagagggagctcctggattcaccgggagagtaaatttgactagcttggacttctgcaaggtaatttgttgtgactgcatattaaggagactaatcttaacataatcttaacataatttctttatattaaggagattaaataaatccatggatatgttcttgagtgaaatttttttttttttaaagcagagaccttttccacgggatcacattttcttttgacactcctgggaggcaggcaggaccatgttaagtggctgtttttcagtgaatgattctacggggaaacctgaataagatggtaatgttataggaaagtgtctgatgcagaacccggcaatggctaaaactggaagatgcaaagcagcctgctagtgtgggagctgcaataaaccaaatcccttttttttctcagtcagaaggagggactttccaagcttgatcctctaagaaaaaaggatcccctcctattttcttaccgattttcaattcatccagaatgcatgcttcttagtcttcagactcctggcctggtcaccgcttgaaaatatttggcagccccctggtttaacagcagcctcgaagttgacagcaactccaaatcctgcggctcagcagtacagagccagctggcctcacctctcctctgggtccactgcatcttatcaaggccttgctgtccttccttggatccgtcacccccgacctggccctcagtagctccctcctggattctgacctcaccctgttcctcatctttgtcttaactcttaacttggctgtctgctgcaccctgacagccaccttgtcttctcttttctcctcttctctcaccagctgtcttcttggtttttcagttcccctctctcaagacctgcactttctcttcaagtcaaggtccacagctcccatgctctgcatttatactgggctgcggaagctcccacgtggggaccaagccctggagaggaacccacagtgcagcggctcctgaaagcagaggcctgcacccctaagcctcttaagccccccactttcattccctcctgcctctgtgcatagcccaagtcccacctgtccatgtgtcacccggctcttccgtgtcgtctccgtgagcctgcaggggcacccagccagccgacaggctcccgagacagtccactcacacagacacactgtagccatttctgaagattgtgcaggggagacagatggttcaccaggcacacaccagacaacccgaaacctacattccttactcaacaggcccgtgtcagaaaatcctccctaaactgcaatggggagggggactgagggaattctcatcccctacatgtcaccccacggctcactcctgcctccgaccttcacacatgttcacccctgcaacttttcacccctttattttgcagagcaatctgtgcccagctcctgtcctctcaaacttaatcagctcatgatacgcttagcaagacctgcccttcatgaaaatgagggtgagggtgagggtggcgacagttttaaatatgttttaaaaggaacatgaaatgaagaatattgggcttcacaaaaggaaccctcctttcccttgttctttcttcccatggagaggaagaagttgaggctgagttatcacctcccatcagcactcggttttgttcctggacccctgacttcgtcaccaagggcagctggctccagctctcagcctttgaaggatattgtggctaggggttcagagtcccaggctccctcccagacagatgggtggagtgaggccacctgagatctcacttgctagggtgggtgccaccaggcccaccgagctgctgggtcctggccaagccctcctgtaccccctgagaaagtctccgtagggctaggagctgtttgtgccaactttagatggactcatctctcagtgatcccataaaattgctgcctagcccttctggtttcaaggatttcacatcagaaaacgttttacgaacccagggctagttctgaaaacaggaagtgctttcagcccccatgggaggaggggggtgcaggaggcctgtggacctggacctctgggagccaggctggagaacaggagctgaaggctgagcggcggcggggccattcacacaaccatggtctttcctcccagtgaggagggaccccaggtggggctgctgagctcaggagccgctggctctgctggaagatccgcccctctgaggctgcgcggggaggatgcaagactgggcaagagctcattaggaaacgctgagacagagggtcctagtgaagattccactgcagagagggcagtccaggtcatcacagggtgacatctggggatgaggctggccggggcacggggcaggtttttgagcccggcagtgtaagcagtctctgtcccaagggaggaaagccgctgagagctgctgggccagcaggtgggagtgctgggctggcctcagggtttctggaaggggtattcccgagaagtgaggtgctgctctgggactctggtgcccctggggccttcctgcagggcgctctcagcagccaccttcggtagaagccagggccaccctgcatgggggatgatgccgcatccagcacagagccttgcgatcagtcactctcctccctccacaatagcggggacctccctgcccgccgcacccctgccccccgcccccgcccccgctcccgccccgccgtggctgtgcagcaagcaggggacagtcccatcagcaaagtcggggaacttccaggaagcccgcgtccccctcagcctgcctttagccagaaaagattccaagctctgctctctactttggaaagccagtgtttgcatgtggagattgttttgctagactcgacgagggtagcaaagcaacaggaagtgttccccagagctccgcccacgacttgcgtggcccaaagctggatggtcgtccgtcccaccatggcgggtgggtaaaggttcttttcctgggctgtgtcattccacccagagcaagggataagcctgtgatagccgtaaatccggaaccactaccaaggtgaaagaccttcaagttaattgttggaacctgcggctctaacacttccagcaaagctacttctgtgaaagctgtgacgagcagaggaaatgggacaggagaggagctgaatcctgagattgtatcgctaggagcccccaaagtacgatgacggtcctcgggccagcatgggggtgcattggcaccatgtaaggaaaggggccctcccgtggcaccgttggagtggggcggtgtggggttgttcggagagaaaagtttcccatgagctctgtttcagcaaacggcgatgaccacttccgtggcaactaaacagtcttgccttcctgcacgtggacatttttcttcatgcatatttctcttgcaaatggttctattgtttgtataacagtatttcatgagcggagaagagttggaagcaaaaatctgttcatgagaaatgtaagtatgtggtaacattgccttcagtgaaattgagagcagatctaaagggatgtgaaaagcatcagggtgctcatataggaggcaggatcatttcccccagaccgcggccatgcgggttgtgttttatggtaggagtgattatggcagcctatgtgtgtctgggcataagaatacttattctatggatcttaaggtaattatgtgttggaattatgtgttggaaaatgtatggcgtggaattcagtaggggaatgctcacgatttgtgtggttcctggagttggaaatgggtggcagatccagcaagaggcaagatttccaaatggactgctgagtcattcttagggtgggctaggagaaaatgtgttttggtctgaaggagggaggaagaagacaaaaacaagtaaattagaaaacgtggttgcaggattgaaatctgatcctgaaaaagagagaatagccatgagtataatgtttaaaaatacacacaaagaaatccactgtggtgggagtcacaagaagttcaatcattatctggtctcgtcatctcgagtgaagctgtccactcccaaagccgactgcttggtccatagctcttagtttttgcatctggaggcttttgtggttagtgttggtttgaggtcatttgagctgatccattggtctgggtttgttgcctgtttctactgactcttgagtacttgggtcaacaccttggatcttgactgccctggcatttgctaggaggacctgaaatggctccttccaaagaggtctgaaaagtttttgccttgaggtctcttccagcggacccacaccaggctggaggtcagaaaagtctggccggcatttcctctggctggcatttcctttgggcacgagacttggtgtgtgaggctaatccttgacaatgcttaactgcgtacatgaaatggagcagagccaggccttgctggagttactcctggtcatgtacagcatctggttatgatctcatggggtgctggactaagtgagcactcagagacggtcacgccaatagcctattatatcctcgacctaggagttaaggagtaatcttctgcttactccttaagcagctccttaaggagctgaggcagataaattgggtgtggcaagcggggtgtctgccaggcccaggagccccggctgtcaccagtgcatgatgtgactttgggtgagccacatcttctgcttacagatagaggccaagaccgcacggccaataaagctggtggcaaaactcaaagcccagagagatggagggttttttatagttagggaatttcagcttcagtgtgtgattgattttgtattttgcgaacaccgagggtgattcagacagtgaagtgtctgtgttagaagaaggaccctccaggacagtaagtctataatcttttgataggaagataggtattgtccatgctgagaatagaaagtctagcaagaggtagacttgctatcatgaacccatggctctgaatcctgtctcacctttacagtcttgcctgggttatattggttgcagatgagataggactctaccacttcctgggccaattccagaaaatttcctgaccaatatgcattgcatgtaaaacttaatttaccttttccatgatgcaaacaattatggagtaatttagctaggaaggctcatggcactcaaggacaggtgttctgagatgaccagattccatctttattaagaaactatttttgagattgccaatattacttgtcagaagtttgcatcgattattatgagtcaattataaatggatccaattttctttctgaaagtttggtggatagatgtcagttactattttagaactcttaatatagtatttaaagctatttttttttaacatgaagtcagtaaggacatcgcccttgacttctggcatggcttctcaactaaaagcttctactttagtatctcatacctcctttggatattgggtagcttctaataagttactgatcccttactcatttttgatgtgaacaatcacagatatcataaatcctctgtgcttccgtagcatccccaaatcataagcagctccaaatgcccatcttatctattcttggtataaatgcttactgttttatctcttaaaataatgtgacttgaagtcaggactacagcttagccactgggaaatagctcacatgaagagatagaacattttgatgggtgcatggcagtttcctacgcaggaaatgctttcgccatttttattgttttttcctccacagcctttattaagctcctactgtatgccaggtactttgggctgcaggtacagctgtgaaaaaaaacaggtaaaaatccctgcccccctggggccttattgcagctggggagacaggaaacaggcagaatccatcaggaaagatatcgtgcagatggtgggaatgcagcttttgactgttgcctcccccatcagatccttagcaccaaaaaaggtggcagtgtctcccggctgggtgtccagagcctggcacacagcaggcactcaatgaatgtttacagagtggatgaagactcacattgactcaggaactgcagctcagagagagcaaggaacccaaccaggggagccatggagctgaggcagataaattgggtgtggcaaggggggtgtctgccaggcccaggagccccggctgtcaccaatgcatgatgtgactttgggtgagccacaccctctctgtgccttgttgggagtaggcactggagagcaggggtgggagcggtcattaggatgaggtgtcctggaagcccacccctgccagggccctccaggctgcaggcagtctccagcccgaggccctttggagttgtgtggctccccctccagctgctctgtccacagatcttcctgctctccccaactcccctctgcccttcagccccacagccagccattagctgacttgttgaccatgacttcaaagcatccagaatccagtcggctctcaccaccctctttgccattgtttccaaaagggtgttgcccctgggtttgtcttttggagccccccaggagaagggaggacttcaaagacagaaagagagctaggcaccaaacctcaagcaggccttgctttcccagactctcaaacttaaaaaaaaaaaaaaaaaaaaagccagacagagacaggcaggtgtcctcccagccgggcctcgatggctgtactgcacccccctcctaaacagcaggcgggaaccagccctgggacaggctccacacactcactgagcaccgcctcctgcacagcgcagtccctgctctcagcctgagcaggcgcagcagccctgccctcccaagaaaggggatggtgagaagcctagtgtcccctccacagagaccagcgccacacatgacagccacacatgacagtgttggtaccagcactcagtctttgagccacaagtgcttataagatgtaagtaatagtacggaaccctcccacatcctcaggaggaacggtcagccccattttctagatgtgaaaactgacacccagagagatttcagcacatgctctgggtccccgggtcccatgcacagcccttgtgctggacggccccaaccctactttctaattctttatcctaaacccggactgtgggcctcatcttagggagatggtgctgccacctgcctctggaggacactctgccttggcctagtcctgccctgcccctcgccgagtggagcctccacagaggcttgtgcatggctttgggatcccgggcggcaggagtagggtctgggctggtgagcagggacggggaaggccccgacagcagaccccatgaggatgactgggctccatcctacgtggaccttctaacgagccacatggaagcatgtccatctgagaggtgggagaaggaggaagttgtccccagttgtcccacctcaggatgggaggttgccccaggggctagcttcccacttctccaggctgccatgctgaaagccggcaggtgtcgcaggtagcagatgtggcaggttgctcgagggagaaactctggacgcatgagattcagttgtacagagcctgagtcctgtggcctggcccaactgtcccaaagccccagcactctggctgtgtgtaaaccttacctcttcttcatgcccttcctggtccatggctgtgtcctttattgtacctggtctccttatcttcaagggtgcccatcacaccactctccagctcagaaccctccaaaggcctccctcacacccacacacaatgcaagacctctgcccacatcttgcaagcctttttcctccctctttttcaccagtcacactgaccatcttcctattccctgagctcattccgacctcaggacctttgcacatgcatttcctctgcgggagaggctggtccccacttcctccaagccttgctcctctgcccattcccaggcacaccctccagtgggcacccaagttaccctcaccccagaatctcaagcccaccacctgtctttctccagacactcccttgtcacctggagcctggttggttggtatatttgttttggcatttccctgctaggatggtgtgccaggagtgagggcttggtctgacttgatcaccacaataaccacgtggtggaaagtgcctggcacattcagagtcgtacccttgtatgagtctgctcaggctgccatggcaaaagaccacagactgggtggcttagacaacacacattggttctctcacagccctggaggctggaagtcccagatcaaggtgtcggcagagctggttccttctggaggccccagggggaatctgtgctctcctcccagctcctggtggctgtggcagaggccttggcattccctggcctgggctgcagcactgcagtctctgcctctgtcttcacaggcccttctccctgtgtgtctccaggtcccaaatctccctctgcctgtctctgataaggacacctgtgatgagatttagggcccattctaaatccaggatgatctcatctcaaaatcttcaccttaattatatctgcaaagagtctttttccaaaaaaaaagtcatgttcccaggttccaggtgaacataaattttggggggactgtggggacaccattcagcctcctagatccacattactactagaggaaagggggatacagtgtgatccagagtgtggggggctcctgcccggagcacaggcccagctctgagtcctggcttaggcgtcattggccctcccggatgtcagtttcttgaccctgaaaatccagataagggccaaatgcataggcttgttgtgaagcttaaatgtatgtctcagcatggtgctgccctcatctgagtgcaggccacagcctgagaactggggcccaacacctgcttctcccacactcccctggtgcctggccaagcccgggtgtgaggccaggtctggcttccagcaggcccaggaggtgctgcctgtcatctctgcacacctaatggttctcctgcctggtgctgagccacagagacctgatgccatagatgacacagaccatcagaagtgacaaaggagactgggtgtggtggctcacgactgtattcccagcactttgggatgctgaggcggacggattgcttgagctcaggagtttgagaccagcctgagcaacatggcaaaaaacccatctctataaaaaatacacacacacaaaaaaaactagctgggcatggtggtgcatgcctctagtcccaactactcggtaagctgaggcagggggactgcttgagtccagggaggttgaggctgcagtgagtcctgattgcaccactacactcccccactgggtgacagagtgagaccctgtctcaacaacaacaacaacaactacaagtagcaaaggaacattgagactctactgggaatgtggagtccactgccccccgttccccaagcccgggccggtagaaatccacttgtgctctgtggctgccaagagcccctcctgcagacaggggccctgcactggacccctggtctctgcatctgtgtgtagggggtaggttgtagggtggggtgaggaggggttggcaaaagtgccaactcagggaggacttctggtgacctgtgggccgctctccctcttgtgtctttgcagagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggtaagcccggtggagggacgttcagaaagggtgcattctggctgccggtgcagagggctgtcatgtaagcccaccacaataatagaaccagccagtctgctcctccagcacagctgatgtctccagctctcctggtcatgcccaacaagtaccaggaacatacatagactctcctgcagcaacgggctgctgcgacgtgggtctggggcttctgtgtgcgggggtccccttcctggagcttttctttcagcctcccctgcagccatcacattgccagcccacccacttgccaccctccccagctctgcagctccccaacccagaacctctcctccctctggctggagtctctgcctcttggaacttcttcctggctcagtgctcccagcccctccccaggaggcacaccctgcacacctgcagccaaatcctcccagcatctgcccctgtgaggcctcaataggaacagaacagaagggcccctgaaagcagcagcacccctccatccaccttctcacctcctgtctgcaacccaacctaacatcatagccgcacaaactctgccacacatctccatgacaccagggaccctatcaggggtcaaggcagtggcatctgttctgccttctccaggggcccgagaacaacctgtacagccagtacgagcagaaggtgcgcccctgcattgacctcatcgactccctgcgggctctgggtgtggagcaggacctggccctgccagccatcgccgtcatcggggaccagagctcgggcaagagctctgtgctggaggcactgtcaggagtcgcgcttcccagaggcagcggtaagttcaacggaccaccttccctccgcagcaagcagcgccacctgtaagccacaaagcttccccaggcaccaagaggttttagagacaggctgctgggtgagagagctgggaaagacaggacgctgggagagaggccgctgagagagacaggccactgggagagacaggccgctgggagacaggcctctgggagacaggctgctgggagagacacgttgctgggagagacaggtcactgggagagacagaccattgggagagacaggctgctgggagggacaggccattgggagacaggctgctgggagagacagatcactgggagagacaggccgctgggagagacaggccactgggagggccctaggagggcagcttctcaggcctggtggcagggggctggattccccatacatgtttaaatagctttcactgcccgtgtgtcagtcaggtgcagggaccttgccacctcttcctagtggtctttgtaagaatgtagaagcatttctttgataagttgataagttttaggtgacaggcgaagccttcttaaagaattgtctcaatgttttgaaaacctcttatttaggatcatgatatgagacaccttttccttgaacaaaaacttttaaaagtctgtttagagtgaagaagctgttgtacattcataatttaataaaataattataaaggaaaatgataaaggcggtaccctcagagtgggtactggagagtgtttagaaaggagtttttaggtaagcagggcatagggaagccagcaagaagggggtgggacaggaaggggagcagcttccagaacccaagaaggagcagcatgcaggggccctggcaggtgcagcggcagcagagagcgcccagctccttctcctccctggctcccctctcctgccactgctgcttacttctcaacccaaccagaatgctggggtggccgggaggcatctgatggtttctccaaggttgcccagagcaaggtggggctgctggagggctgcccggaccctgcacagccccctgcaacaaccgcaaagccacagtgagcctgggagagtgcccctcccctggcctccctgctgccacctgcagcctggtcctttacccagcgtgtcccgtaagatggccatcagcctgggcacaaggcaggagagagtaagggtgtgggatggccagtccttctccgtgctctgggttcagcatttggggcagtgagactacggggtggagagtctgaatgccagagggcaggcacgggaccctgggcgagtcccatagttggaagacgggacaatacctccctatagggcacgggacaaaggtcgcgggttctcagggcttcacggcaggagcgtgagggcccccaccccaaggaactcagcaccgctcccacctttcctgggttcagtagcatcggaggatcctgcctcaaagggcactatcaggattccccttgctcctccttcgggatgtccggcttctcctccaggctttcaccaccttcttcccactccttgagaggggttccatggcccctggatgggtctcactgctccacattcccgccatcccccaccccccacactaaccagggctgcccaccgggacaattacagggcctggggcagacacctgacatgctgactccagctgcagaaagacggggagcctggacatgtaccggagccccagcatctgcctccatcacttccagggcagtgtggtgggggctatggctgtggtgaggactgtggctatagccacttgctcatgtccatcggagctcagggtgcttactccggcagcgaacacttcccaaggatagcagcacctcccagggccctgtgcccctttgcatctgctcagtccagaccccctcacctactaccaggccccagggagagccagaaagtgcagacgaggcctttggggacagcagggcaggttctgggagcgaagggcccagtgccacttctttaaaaggaaactgaggatatttggggaacctctcgctcaggaatcgtaaccaggtgtccgctggtgctgaaactgaaaaagcagccctgtgaggcatgggccggaaggatcagctaccggaacaccgagctagagcttcaggaccctggccaggtggagaaagagatacacaaaggtgggcccacgtcattctgaggttcggatctggcagccgctcctctcacttcctcggttccttctcctcttcctcaagtcacccccacagtgaccactcagctcctagccccatgtgctcccacatggggctgaacccattgctgtcacctccaccatccctccaggtccttgtccaggtcccctctcatcgagtcatcccatgccgaggaccctctggtggcttcccttagcagcctgcagcccacgtggctggccttacctgtcctctcccgctccccgccagcccaggctttctctactccacagggtactcgccctctcttccttccaggtttctccccttcacctgcccaatccctactcgatctttggatctcaggtcacctgcgccccctttggaaatgctgctgcaggacccctggtcccaccccaggtgtcacaaccatggcttgtcttcctgaagttcagctctaaccctggccagccaccttgtggccacctttcctcccagcaccccctccaaatgcagacccctctcacccagctgtggaacaagtttcccaatgcttgttcttggccatggctgatcagaaaaggctcagttgctcctggagtccacacccttctcccccgaggggccctagtggttacgtcccttggagtgcacagccctgcctgccccaggcactggagcctctcaacctccctaaaggcttctcccctatcctgcctgcacagcctgtcctggactcagccaggatagatggaaaaacaatcctgaatgtactaagactccctgcagggaggaactaagtccaaggaaggccttttgcattactggatagcaaactcagtgtctgagcgggggccctttagacgaccctgtgggctcagccctttcccacagaacccctgtctgcctggatcaaatggctttctggaggaatcccttcccaaatagagaggtcttcactccaatttccgtgttcacccctctaaaacagaagctgctggataccctcaattagcaagtttcctaacttcaaattgcaaaaggtctgcaccccagctgtgcccaccacagctactgtggtgctcccaggacatcttgcaatgttcgttgacatctgtctggagtctcaccagctgtgagctctgtggggcagggccaggagagctgtctctagcagaccaacagcacaccatatgtgcaggcttggtcaaagttttgggtaagaatgaatagtgagggccaggcgcggtggctcaagcctgtaatcccagcactttgggaggccgaggcaggcggatcacgaggttaggagatcaagaccatcctggctaacatggtgaaaccccgtctcttctaaaaatacaaaaaattagccgggcgcagtggcaggcacctgtagtcccagctacttaggaggctgaggcaggagaatggcatgaacccgaaaggcagagctttcagtgagccgagatcgtgccactgcactccagcctgggcgacagagcgagactctgtctcaaaaaaaaaaaaaaaaaaaaaaagaatgaatagcgagcaaacccaagacaagacatctttagaatagcatcttggaaccccctccactgctggtgggaatgtaagttggtgcaaccactttggaaaaccatctggcaatcttcactaaagcagttggcaggaggccatacttccttaccttgtggacttctccatagctacttagtgtccctgtgacatggcagccagcttcccctagggctagtcatccaaaaggaatcaaggaggaagccatgatgcatttaggaactagtcacacaccatcacctccactgcatgtattcattagaaacaagcccctatgtccagccaatagactgggtgcttttggagggaggaatgttgaaggatttgtggacatattttaaaaccaccacagcactcactggaaaatgctaaaaagcaggaagaaagagaacagaacccatccgcagtcccatagctaacataccagaatcttttcttctcgtcttttggaaagtgtaggtctgtgcacctacatattaaacagccatcttggtggcttctgagatccctctgcaggcttctctgaaatgttttctaaacaccagggacctactgaagctctcataccctggaaaggagcagtcattaccttcaggaactgcttcctcacagggatcattaatgagggctctgggtttctcccctcctggcctccatagcccagaacgtcatggccgggaatggccggggcatcagccatgagctcatcagcctggagatcacctcccctgaggttccagacctgaccatcattgaccttcccggcatcaccagggtggctgtggacaaccagccccgagacatcggactgcaggtgagcccttctggaatttgggattgggctctgctgaagtgggggaagggtcagaggtccccagggtcctggtgtacctcctggagcctttacactgagggatgaggatggagtctcaggtaagacctgcccaggtgggggcctcatgcccaggttctgacttgggcttgacaagtcacagaaaaaagagagttggactccaggggactggcaggcatttgggatagtgtacgccctgcccagtcattcaggactgtgaacccggtgtgatcagttgtgatcagttgtgctgatagtcaaaagcgggcagaaatttggatttttacatgaaatctgtccattttggcaatattttaaaaaatgaatgttacataagtcataacatggactgtggtcctggtctgggcaggagaggcacaggggtgagggagggcgaccgggcaataaggacacacatcagccaacagcagggctgtggcttctctgccaacaacctacccatctaaacatgaggccaggcacggtggcgcatgcctgtaatcccaacactttgggaggccaaggcaggaggatcacttgaggccagaagttctagaccagcacgggcaacatagtgagaccctgtctctgcaaaatataaacaaaattagccgggtgcagtggtacatgcctggggttccagctacttgggaggctgaggtgctaggaccacccaagcccaggaggtcaaggctgcagtgagccatggttgtgccactgcactccagcctgagtgacagagagagactctgtctcaaaaataaataaataaataaacctgaggttgcctgaaaacatagtcctcgctcaggtgcctgaatcaaatgtggtccaggaaaacttgtgcataccctgtttgggttaggccagtccccggaccagccctgtcatgctttggcaagccagctcatgtggaaatgaaggagacagagtcgatgccagggcaggggaaggctggggagatgaggccctcctttgctagaactgaggccactttcctggcttcttccattttgtgggagacagtggcagtgttgacaacccaaccacaaccaaattaaggggtggcagccctaagagcctcctgggtggggtcttcactagctctgctgtttggggcaaaatcttggttagtgatcttcctcaacatccaaatcgccattctctgtctctctaagagcagggaaattagctcgtatcacttgctgagttaagtgatgaattccatatttcttagccctcctaggagggtggctgattcatccatcaagttatgggatttcctagagactgcaaaagatccttgggtggtgatatggtttggttctgtgtccccacccaaatctcatctcaaattgtaatccccacgtgtcaagggagggaccaggtgggaggtgataggatcatgggggtgttttctcccatgccgttctcgtgattgagggagttctcatgagagctggtggctttaaagtgtggcactttcttgttctcgcacacattccctcctgccgccttgtgaagaaggtgcctgcacccccttggccctcccccatgattgtaagtttcctgaggtctcctagccatgcttcctgttaagcccgtggaactgcgagtcagttaaacctctttcctttataattacccagtctcaggtagtgttctttatagctgtgtgagaacggactaatacaggtgggatcagaacatgcagcttcctcctgccacttcatcctctcctctatggaggatacacatgatttggtctgagacagtttgatctcaaacagtttcatcaaaagcaagttggttgagacggcaaaatttttccgttgttgtaaatattgggggaaataagtgtgcggtctctctaagcttttcatttatgtttcagatttctaaagggctttgtttctctacattcttttacttctaattatcagctcataattacagccacgtgccctatgggactggttaatccctaacagtgagttatgatgcacgttgtacagtgtgctcagttaccaagccttgacctggtgaccaaaaagaattctatctgaaagggtggcagtatacgaaaacactgccaagtgaacaagtgttttataaaaattaattaggttccagctacttgggaggctgaggcttgaacctgggaggcagaggttgcagtgagccaagatcgtgccactggactccagcctgggccacagagtgagattctgtctcaaaaaaaaaaaaaaagaattaaaaaactaattaggaataaaatgccctaccttaagtttcttttgtttctttaattcttgcttaaatcattacaaagggattttgttattgaaattgtcaagatagaacaggaagaataaatgttattttatgccccatccctgttaacatggagtatataaacctgcaagtggccttctgtgagtgtgagtgtgagtgtgtgtctccttacctgtctcactgtcttatcatccatgtgtttactggagtagcacttctaatttctttcaagaatttttcctttgtattcaacacttagctaacgggttggcacaagcagcttagcttttggcctttacatgcctttctcactaaactcaatcatttctagcttttaatttaaagtaagaaacatgcaacttttccttttagttgaaggaaggccactgatggtttggctgtgtccccacccaaatctcatcttgaattgtagctcccataatccccacgtgtcgtgggagggacctggtgggaggtaattgaatcatgtgggcaggtctttcccgtgctgttctcttactagtgaatatgtctcatgagatctaatggttttatgaagggcagttcccctgcacacgctctcttgactgctgctatgtaagatgtgcctttgctcctcccttccatcatgcttctgaggcctccccagccatgtggaactgtgagtccattagacctctttttctgtacaaatttcgctgtctctggtatgtctttatgagcagtgtgagaacagactaatgcagccactctatttagaggccactatagagctattaattggcctaattttaatattgtggtgcctcagggaatagagagagggagagaggctggggagccgtcataacacaggcaacatttattaagttatctatcttatatgggcctgctccatagcaccccaaaacaattataataaaaacatccaaaattgataatcacacatcaccataacagatagaataataatgaaaaagttggaaatagcacaaaaattaccagacacagaggcagaaagtgaatatatgctgttgcgaaaagtggcaccaataggcttggtcaactcagagctgccacaaacctttgatttgttaaaaaaaatacaaataaagataagggctgggcacagtggctcacacctgtaatcccagcactttgagaggccgaggcgggtagatcacctgaggtcaggagtttgtgcctgtaatcccaggaggctgaggcaggagaatcactcgaacccgggaggcggagcttgcagtgagctgagatcacgccactgcactacagcctgggcaacagagtaatactccatctcaaaaaaaaaaaaaaaaaaaaaaaaaaaaaacaaatctgcaaagcacaataaagcgaagcacaataaaaggaggtttgcccgtgcacactctctccacatctgagccttctcaggtataagtgctgccttcaagagagaaaaaaatttatgttttcttagagcaaactgcatgagagaacagggtcacaggagtttagaggagcaatgaaaactgtcattgtggctgtgagaggctgggagtgtgaaagagtagggagtaagaactgttatggcagagggaaaattcggatcaagaccagtctgggaatccatcccgaaacatctccttctccatcaccttcccaccctccttggccccctgtagtctgtcctagacctctctcctgcagatcggggcctccaggtcccacaggctccctggagccccagggtcctgccctacccaacctggctgaggcctccaggtggcctgtctgagcaccaggaagccattgctgggaattcctcgattctttgacattgtcctccacgttcctgggcttgtgaaggaacatcctcctccatgttcctggaacttcagcctttgcttggctcaggagcctgaactccccaggatgtccaggagtgtccgaaggagagaatacagtcacaggttcttagtttctgtttctggttgggccagtaaagccccttcctcatcccacttttccacttactactaaagacagaaaccaaaaaccatggcttcaggctgctaaaaacctaaaacaaaacagaacaacaacaacaacaaaataaggcaggttggacaagcttagtcatagagtcaaagcttcctgcacgcaatcgtgtgcctttctggagtcccaccacgctttcccttcgtatttttgtgtctcttctcagattcttcattgtctttgatttccaaaggcactgccaaggtcagactgctggtcatgtgcaccctgtgttcctcccctcccggtcttcctgagaagtcatggaaatcttagctcctccagcaagaacacatgtgtctttcatttgaaagattcatgcctctcctccatgtgaaagccgattaatgctcataaggaagggggtgggctctattcttggccgatttgtctccccagactgtccctgtgaaaggtctttctgtattcacggcctcattgtacgactccactttcccggcaacaagtgcttggcagtgttcacccaccaaatgtgttagttttcaactgcaattgatcactttctccttcttgaaagtcttcttcgctggcatctgggcacattgaccctggttctttctctccctcctgttggtctctccttaagtgaattgttcctcacttccctgacctccaaatgttgcaatgccctagagatccattcttcccattgaaaactctccctgctatgtccctgaactacagcccagtctcatgactgtaaataccacttcagcgattcctaaatcattatttcaagcccagctctctcccctgaaatccaggctcctatctccagctgccgattcaccagtgccctttgagcatctaatcggtacacaaactcagtgggtccaagcaacacccgatcttccccccagtatctgctggccccatagacatccccgtctcagacagtggcacctccaccctcccagtggctcaggccatgaccactggggtcagccctcccttttctcctcctctcacacgacacgtccagtccacctacaaagcctgctggctctgcttcaaataacacacccaggcccacgtctcctcccacttccaccagcaccctcacctaagctgctgctatcctgaacctgggttaccgcctctgctggcctcctgctgggtttctctgcctctgcccttcccggcagcacccatcccaagaatgtttcccacacagctcttgtgttttaaggcacaagtcagatgctatcatccttaaagttccccagcggctcccatgtcaatcagtgtaaaattccaaggtcccatgtgatccaatccccctacttcatggaccacatttcctgtcactgcgccttggcccctcgctccaccctaccacatccgggttctgcggcccttggtccctctggctcacttttgcctggactcttgcgtgtgcatgcacgcttcccactgcccggtgctctgcccgcatggctctccgcagagggcatccttcattcctcgcgggtttctgctgcaaggctgccctacctgggctgccttgcctgacatactgttccccgtgcctggctctttcaattccacttgccctccctgatatgtctccattgtgtttattgcctgtctcccctcctgggctgtaaggctctgggggcgtatgctcaatgccgagtctctgaaccccaggatgggccccacacctggtgggcactgctaatgtttgctgcatgcacataacgtgctctttatggtcaccccctctccaggcaaactgttccggggagcattttcactctctgatatcctacatgaatgcacatgagtgagtgtgcattaaatacggtgattcccagcccagagcttttgtacccccaggggacactggcaatgtcaggacatctttttgcttgtcataactcaggtaaggggtagggtttgctagtggtttggatgctaccggtatccagtgggtaaaggccacagagtctgctggacagcttacaatgcctaggatggccaccatggcagagtcatccttctgaattgtcaacagtgctggaaggagagctggagaaccctgggctgtgtggtctgtttgcctgcagacatcagcaggacagccccatgggtgtagcaaagggaataagcacacaagcaagaagagagttttcaactaaaggacgatcaacgttaaaacttgttcagaagtatagcatctattattcaatgattagtaaagcagaaaataaagtcaaaaaaaaaaaaacttgttcagaaaggttgcttaaggccaggtgctgtggctcatgcctgtaatcccagcactttgggaggccgaggtgagcagattacttgcggccaggagttcaagaccaacctgggcaaggtagcaagaccctgtctctacaaaaataaaaaattaaaaaattaaccaggcatggtggtgcatgcctgtggtcccagctactcgggaggctgaagtgggaaaaacacttgagtccaggagtttaagattggggtgagccgtgattgtaccactgcactccagcctgggcagcagagcaagaccatgtctcagtaagtacatacatacatacatacatacgtacatacatacatacatacataaaaattaagattgcttataactttagccagttaagttttctcctggccgaggcttcattgggcctgtttgtatttgatgattttatttgactccagtgctcaatttcttctgtgttgtcagctcgggctaatgggacacagaatggctcatttttggctgtgcagttttctgtcttctgtgcacaacttaaaataattatatggggcactgtctgagcacaactatatgtaaattgtgccaaaatataaggaactatgtcccaaggtgccagctttttccttgtctgtttgtgttgttgttgagaaaaataatattaaaagttggcattttaaggcatatgttgcctacatctccattttgcctacacagtctaataaattttattagatttctcttatttgattgaactagaccccttccaagaacaaatcgcaggtaaaaagtcactaatattagaaagaaacacgtggagatattctccatgggaagcatctgaggtccctgcctctggggaactgtgtggggagcaggcattgctcgctgagcacctgctgcctgggctccgtgctggactctgcatggggacaccaggacagagaagatgtcaccgctggccgcaaaggcatctctggacttctgagtcagatacaacatacgcacaagtcactctaatagaaggcaggatctccaaggcatctcgggtgagatctagaggggagggaggggttgtacttggttgcaggaatcagggggtcttcaggaaagaagacatgccagccgtgggctttgaaggacaagtgggaggtcatcagagaccagggcagggccgccggggcaggcattcccaggacggggctcggcctagcaaagcccagagtcacactgtgggacaatgttgcctttgcgccatcatgcctgcctgcctggccgtgctgctgagtgaccagaagtgagacgtgtgctctttctttgtgcgattctttggcatcagatcaaggctctcatcaagaagtacatccagaggcagcagacgatcaacttggtggtggttccctgtaacgtggacattgccaccacggaggcgctgagcatggcccatgaggtggacccggaaggggacaggaccatcggtaagaggaaagaaccaagtggccgggtgcggtggctcaagcctgtaatcccagcactttgggaggccaagacgggcggatcacgaggtcaggagattgagaacatcctggctaatccggtgaaacctcgtctccactaaaaatacaaaaaaattagtcgggcatggtggctggtgcctgtagtcccagctacttgggaggctgaggcaggagaatggcgtgaacccgggaggcggagcttgcagtgagccgagatcatgccactgcactccagcttgggcgacagagcaagactccatctcaaaaaaaaaaaaaagaaccaagcttccagggcatccagggcatgggaagggagggagggatgccgcacttctttggaagatcctggaacgtatcatatgccagtgtgtcctgcgctgaatacaagtgctattgttcttgttccttaggaatggcttattgaggactgaagtaggtaatatcaactgcccagtagatggacctgagcatgtcaacaaagttaacactgaagaaaagaaaggaaagaaaaaaagttttctaaaaaaaaggatctatttgaatattaacatctccaaggaaacttagtactactttttaatagtcagttttctggtcctctcatcgccataaactcagataatcaacagttatcaataaatattagctttttttttttttttgagacagagtttcactctatcccccagactgaagtgcagtggcatgatctaggctcactgtaacctctgcctcctggattcaattctcctgcctcagcctcccaagtagctgagactacatgcacatgccatcacgcctggctaattttgtattttcagtagagacggggtttcactgtgttggccaggcaggtgtcaaactcccaatctcaggtgatccacccgcctcagcctcccaaagtgctgggattacaggtgtgaaccacagctcccagccagctattattattataaattcagtcaatcaatagtcatgggatatacatgttctgctcttagtatagcccaaaacaatattgtaaaataaatgcacattttctttttcttttttttttttttaacttgggatattttattttattgttaacttttgttttaggttcaggggtacatgtgcaggatgtgcaggtttgttacataggtaaacttgtatcatgggggtttgttgtacagatgatttcatcacccaggtatcaagcctagtacctattatttattttttctgatcctctccctcctccaccttctgacagatcctagtgtctgttattcccctctacgtgttcatgtgttctcatcctttagctcccacttataagtgagaacatgtggcatttggttttctgttcctgggttagtttactaaggataatggcctccagatccatcccacagaaatgcaaattttctatgcattctaggtcaagtatagaaatagagaaaagtgtgctaggcttaagagaaacagacccatgttcatagcagcattatccacaatagcccaaaggtgggagcagcccaggtgtttacagatggttggatggataaataaaacgtggcatatacgtaaaacaatattatttagcctcaaaaaggagggaaattctgaagcacacaacaacatgagtgaacttcaacgacattatgctaagtgaaattccagtaagaaaaggactaacactgggtgattctaccttatttgaggtccctagggtagtcggactcatacagacaaagtagaatggtggttgcccaagactggagggtggggaagtgggaaattgttgttcaatgggtgaagagctttagtttgggaagatgaaaaagttctggagatggacggtggtgatggttacacaacaatgtaaatgtacttaattacgcgaactataaactggctaaaataggaaaattcactttacgtacactttattaccatttttgtaaagaaattttttttaaaaaaacaaggtagctaaagacagagcaggggggagcatcctatttttatgagttgaattattcccttgcagacttgagttacgtgtattttacaattcttttaaaaaggaaattgaggccgggcatgttgactcatgcctgcaatcccagcactttggggggccaaggcgggcggatcacctgaggtcaggagttcgagaccaccctggccaacacggtgaaaccccatctctactaaaaatacaaaaaattagccgggtgtggtggcacaggcctgtaatcccagctacttgggaggctgaggcacgagaatcgcttgaacctgagacgaagtttgcagtgagccgagattgcaccactgcactccagcctggtgacagagtgagattctgtctcaaaaaagcaaaaaaaaaaaaaaaaaaaaagaaagaaagaaaagaaaaaaaaaagaaaattgaatgactacacaatacttccaaaggatgagaatagagcaaatttgattataatataacagtggcttagagaatatcaagtttcaaaaagaacagtgggtcgatattttcaggccctcactaagctggttccccacctgtccattgctatggatgttatctactcccttggcttcagccgagctcctgtgccctcttaagacagagactgctcctgtcgaggtcacccacaccctctgcactgaggagcacatggtcacgtctctgtccttgcctctcctttctcagcagcagtcaccccagttgcccactccctccttcctgaacctccctccttcctgaaactccctccttcctccaccattctctctctctcgggtcgcttccgtcactggccagctggaagtcacattcttagactccttgtctccatgcctcttcaattctcaggcctctaagtatggaaaacttggttctgggctctccttctatcaacgcatcatcacattaagtgatcttatccggctgtggtttgtaatcccatctacatgccagtgactcccaaatctgtatctctaaccctgaccttgcttaactggacaactccgtttggctgtctggccaatgtctccagttaaacgtgaccagaacagaactcttggtttcgtactccatcctgattcacctcctctccaaggcttccccacctcattcacagaacccatccgcccacccagttctaaagccaaatcaaagagtcccacttgagtcctccctccccttgcctccaagtctaatgtatctgaagtcctggtgactctgcctccaaaacgggtgccaaatccatccactgctctccatccccactgtcactgcctagaccaagccaccatggtctcctgcctggtctgctcaaacattctcctgctgttcgagcactcaccttgcccatggcagtgccctctccactggcctccagacatgtcaatcgggtcatgcccctctctgtttacattctctcctgctgccatctcacatgcatataaaccccggactcctttatctagaaagcagagccccaggtgacctggccctgcctgcctctctgatctcagttccaccgctctctgccttgctcatgaccctccaatacggctctgccatccctgctccctctcaaccagggtctggagtgctccttctccctccccactaggctgactcctcccttccttcagatgtcagtccaaatgttgccttctgagagcggacctccctgtccacccaacttgagactacatcacgcaccgctgcccacggtcatttgccagcacgtcactttatgttaattctctgcatagcccttatcaatatccattcttctttatttctcgtatattactagattaatttatctggaaagagaggttcaagaatagtagaccagatagccagacttacccacaaattaaaacgaaggacaaaatagcggaagataaggccaggcacggtggctcatgcctgtaatcccaacactttgggaggctgaggtgggtggatcatgaggtcgggagtttgagaccagcctggccaacatggtgaaacctcatctctactaaaaatacaaaaattagctgggcgtggtagcacatgcctgtagtccccgctactcaggaggctgaggcaggagaatcgcttgaaccggggaggcggaggttgaagtgagccactgcactccagcctgggcaacagagcgagactccatctcaaaaaagaaagagagagagagagagagagaaaggaaggaaggaagcaaggaaagaaggaaggaaggaaggaaggaaagaaggaagaaagaaaagtgcttttcaacatacacaaacaagaaatgcagtggcaatttgacactcaagcaacataaacaaaaaagagcacttggaattcaaagttttcaatccagtgcaagcaggaaggagtggggacagaggagggggagaggaaagtgggaaggaggagatcagaggaggtgcccacaagagggagcggagtgagtctgttcaggagacactagagagggactcccctcagtagggaacaaggcatttcttggaaacatggtgcatggagccagtccattctaaccatgcatgctgccttagtgctgggcacccagtaggcatccacgaaatatttgttaagtcaactatccaggacactgaatgaactgagtgagagggtgagatagcgagccaatagaaatgcaaagaagaggggcaatgagggaatgaggatggaatgaggcactggaggatcaagactgcagaagaccttgttggccaaaaaaggagcccatagtccagtaggagtcaaacctgtttgaggggatcactgacctttccatttcccttctttaaccatctcacaggtatcctgaccaaaccagatctaatggacaggggcactgagaaaagcgtcatgaatgtggtgcggaacctcacgtaccccctcaagaagggctacatgattgtgaagtgccggggccagcaggagatcacaaacaggctgagcttggcagaggcaaccaagaaagaaattacattctttcaaacacatccatatttcaggtgagactcttcaggaaagctctggaattagactccatgaaagccagcccatctgcaagagttggcccagatcatgaccaaagtgtatgcacaaattacacaaggtagtataacctagcctcacctgatttttgtgctagatttcttggcttatttagacaaattattgtttcttagattccaatgatggtgctgattaaaaactggaatgtgtcatgacataaagcgtagaactctttggtttcccaaaatgttttcacttcctttctgatttgagtccttatattaagagatacataaggcaggtgaagtttctcccatttccatggataagaataatgaggtcaaacaaatagtgaatgggaacaggactgaacacagagcacctaacttccagaaacccgtgtgtaccaccgtaaacggcacacaggaaaacctgctcgatggaactctccgtgtttttagagcctccagtgcccacagtcatttgccagaatatcacttgtttttattaaatagaaacttaataataactggctttattaaatagaaattatcctatagagactctgtagtttgtaggacgctgggattgttcccattgaatggagcacttttccccttcattctggaacttgttgttcctgaatgatccaggagcacagaggtcactcctgcttgaaggagagctaatgggaaaactgaatttgggccgagtaggtctacggcttgctgactatgtgatcttacaatatgggccaccttctcggaattttgcctttcccatcttctccaggggatcctactactgcctcacaagattgtggttaggattacgtaacacgacatacacaaaggtcttgagcgccaacagccagcactcagtaaacaccacccggttccttctttcttcctctctgctcctgctctgagtggatgaaacatactgtttccaatagcactggaggacatgaggagaagaaaactctcctccttgagctgggagaagatttcaaaataatcaggcccatggttctccatgctgagtgagcagcagactctctggagagttccttaaaattgtgctagctctgtcctgctctgccctgaggccgggggaggtgcccaagacttcctgcttctaacaggttcctcctggttgaggctaatgttgccagtccagggacctccctttgcaaaccgcttctcaaggtctttgggaaatctgaaatccttgcatgcctgcttgctgggagccgtcccttgcagtaagaggcactggcagtgctggggaataatcctgtgtgcttcatcctaaattcctgctattggcaaacatgctgcagccacgctgcctgctgtgtggctgcagcaagcaaatgcagcaagctgcttaacctttctgtgtctcagcctttcttgctctaaagtgggttgttaaatgactaaatgtgttaatatttataaagcccttagattggtgcctggcacttagtaagcaccatatatacttttgtgatgagaaataaaatactaatctgggcaactcacttaatctccatgaggctgggtttgttttcctgtagctaagatgacctacctcatgagtttgtggggatgatagaaagggaggagggaaggaagcttcctggcccacagttgcctgggtgcaggctggtggcaagtgtctttcttatgcaccacttggcttttctgatggcacgtgttgccccggggagctgggctcacctaccacgcacaaagtccggtactagcaagatggtacacaagtccttcctgaatgcatgaatgtctgtctcatttcagagttctcctggaggaggggtcagccacggttccccgactggcagaaagacttaccactgaactcatcatgcatatccaagtgagccacgtgggttgggtgacaagtcatcaatacagcatgcccaagtcactctcttggtctggagttggctaagatgccccactgatctgtccaaacaagcaaacaagtaccctctgaacactgtctcactcactgtcacaggctcactggaagaacttccaaattggggaagcaacaagtacatagtattaaaacaaatgtttgaattggtcaacaggggggaaaaagaagagaaggaaacagtttagcaatataaaaaggagtgaccactgagagagcaagttttcttttttcaatatgttgttaatacttcctggtataaaaaatttttcttgccaggcatggtggctcatgcctgtaatcccagcactttgggaggctaaagccagtggatcacctgaggtcaagaattcgagaccagcctgaccaacatggagaaattccatctctactaaaaatacaaaattagctgggcatggtggcacatgcctgtaatcccagctactggggaggctgaggcaggagaatcgcttgaacccggaaggtggaggttgtggtgagccaagatcgtgccattgcactccagcctgggcaacaacagcaaaattccatctaaaaaaaaaaaatttcttctagcctcaaacttctaagaaataattggtttgtaagaaataagtccatttttatggattctcaaaagcagacaactacagacaagggcctcatgacatcatcgattatagaaaaactttggtttggcggttattgagaaatcgaatatttttagtgcttgcctaaaccttcacaaatgaggccaagcaacatgggaagatttaaatgtacccttagagcaaagatgattccagatcctaggacttggcccatgctaaattgtatatcagacaaaagcaatgacttacttgagccaggaagcacatactcaaagaaaatttggtttgaaggagccagtggttctccaactttaaggcacacaagaattacctggaaagtttgttacaattagattccaccagtcaaggtggcctacacatgtaatcccagcactttgggaggctggggcaggtgggtcaaaaattccagatcttcctggatgctttaaagggctcctactcatataccaaagaaatcagttggccaatctcttaagccgcagtttgattgtttgcaattgttttgtttagaaatcgctcccgttgttagaaggacaaataagggagagccaccagaaggcgaccgaggagctgcggcgttgcggggctgacatccccagccaggaggccgacaagatgttctttctaattgaggtgaggatttccgcaggactccacgtgacactgcatccttccctggtggccctgcagctgcccttccccttcttcacccatgagatgaggtgggcgggtggacatctccttgcaacgccggtcccagttctttcatatgatttccgcaaagactattgactttatatcattttcagaaaatcaagatgtttaatcaggacatcgaaaagttagtagaaggagaagaagttgtaagggagaatgagacccgtttatacaacaaaatcagagaggattttaaaaactgggtaggcatacttgcaactaatacccaaaaaggtaagttctgggcagggctccctgcaaaacagggtggtatttacccagaccagaggctatgtccagcacatgataagtgtgccaagagtggaacacgtccatccaagaccgtggaacccttggtaatcagcaactgtctctcaacgaacaaaacccagaaatatggggcatcgacctcagcaactcaacacagggcaattccactgcctctgatgtcctcgtgtcttgattttgttttgttttgttgagacagggtctccctctgttgcctaggctggagtgtagtggcgcaatcatgactcactgcagcctcaacctcccaggctcaagtgatcctcccacctcagcctcctgagtagttgggaccacaggcatgaaccaccatacccagataatttttgtacttttttgtagagataggttttcaccaccattgctcaggctgctcttgaactcctaggctaaagcaatccacctgcctcagcctcccaaagtgctgggattatagatgtgagccactgtgcctggccttgcttcttggttttgaggctaaatggcattccatgcccacctgaggaattcgcagagcagcccagggtacctcagggctgctatcctgagtgcctggagggaagcctgtgcccaaagcaggggtccagatgactctgggggccagccccacatgaaggctctccagccactgttgaattgagtgcacagctgccagctggccatggtgcctgttgtggacacaccaggcacggagccttcattagtagcagctaaacatcagcttggtagaaaaagtgacctgggatacttatttattttggtggcattgagacagagctcagcatgggtgccaggggaccaggggaggggggaatccacatgaaatcgtttaccatctccccctctggaaggtctggggtgtgatgatctggttttagcaataagtaaagactagatgaagtagcagttttttaactgctaaaatgtgcccagatcacccaaacaattccactcatcccaatcccccttctctttgcccctaattcaagatcagagagattcttggtttgacaagagcctgctggcttcacctggcaaagttctgattcccatgtgctccagcccaggttccagtagggcatgtgtgtgtgtatgtgtgtgtccattttcacacagctataaaaaactacctgagactgggtaatttataaagaaaggaggtttaatggactcacagttccacatggctagggagacctcagaaaacttaacaatcatagcagaaagcaaaggagaagcaagcaccttctttccaaggtggcaggagaaagagcaaggaagagctgccaaacactttatttatttatttattttgagacggagtttcactcttgttgcccaggctggagagcagtggtgtgatctcggctcactgcaacctcagcctcccaggttcaagcaattctcctgcctcagtcttccaagtagctgggattacagttgtgtgccaccacacccagctgatttttgtacttttagtagagatggggttttgccacgttgaccaggctggtctcgaactcctgacctcaggtgatctgccctcctctgcctcccaaaatgctgggattacaggcatgagccactgctcccagcccctaaacacttttaaactatcagatcctgtgagaactcacttaccatcatgagagcagcatgagaaaaaccacccccatgacctaatcacctcccaccaggttgctctcttgacacatggggattacaatttgagatgagatttggatggggacacagagccaaacacaatttgagatgagatttggttggggacacagagccaaacacaatttgagatgagatttggttggggacacagagccaaaccatctcattgtgtgtgtgctgttgtgtttttgttctggcacttggagaaaacagcactgtttacctccgtggaaagatccctccaacggtaaactgtggctgtatgcttgggaggtaaggggtacaagattaagtttccatattcatttaactgatcagatttttgtgtttagttttgtttttgtttttcagagacaggctcttgccgtcacccaggctggagcacagtggtgtgatcattcccagatagctgggactaaaggcacataccaccatgcctggctcatcttttttttatttttgtagagacaggatcttgttatgttgcccaggctggtctcggactcctggcctcaagtgatcctcccaccttgacctcccaaagtgatgatattacaggtgtgagccaccacacctagtttctaatcaggtttttttttttttcctaccagttagaaacaatagcttctctcttggggtgatgactttcaattgaaacacattttcatagaataagatttttttcccccaaaagtcagtatttcttaaactcctgttattagaccatgaatatttttctcattgtgaacaaaactccactttgcaacattgcctctgcgtacagtggggagcaagactttataaaactgttgctagctttacgacgtctgcagaattagcagaattcaccatggaggtctgtttgatgttgcagttaaaaatattatccacgaagaagttgaaaaatatgaaaagcagtatcgaggcaaggagcttctgggatttgtcaactacaagacatttgagatcatcgtgcatcagtacatccagcagctggtggagcccgcccttagcatgctccagaaagccatgggtgaggactttcaagcaggactcccaaaccatcactctcataccttccatagaccccagtgccttggagggagagattggaatggagttaccaaaccagcctgcagacacgctcactggtgtgctagattgctactctgtgtggtctgtgagccagcagcactggcaaggcctgagagctggtcagagctaccgattctgcccttctgcctgagaactcgtactgaggtttccaggagatggggaagcacactgagtgccataggcgttccatcgctgtccttcaaacacgtggaggaggcggggaagatggtttctcttgtctttggggggcaggcagagggtgcacatgcacttcatctgtatcacacgcagccaccaacacagccgcgtaaggcagcggtccccagtctttatggcaccagagactgctttcatggaagacaatttttccacagaccagtgaggggtaagaaggatggctccaggatgagtcaactgcattgcatttattgtgccctttatttctattattattacattgtaatatataatgaaataattacacagctcaccaaaatatagaatcctcattatggtgggagccctcagcttgtcttcctgcaactagactgtcccatctagcggtgatgggagacagtgacagatcgtcaggcattagattctcataaggaacacgcaacctagatccctcgcacgtgcagctcacaacagggtttgtgctcctgtgagaatctagtgccaccgcagatctgaaaagaggtggggctcaggcagcagtgctcactagctcactgcacacctcctgccggacacggactggaactggtccagcctgggagttggggacccctgatgtaaggaatagtcagaggctaacatgcacacaggcacgggaaatggacaggacctgcccaggctgcatgagggctggattgtgtggccctggaatgatgtcccaccctctcctatcgcggtttgcaggtctagggaactcagtctcctggaatgggtcagtgtatcatcagtcatcctccctgtgtctttaaccagttttatttctgcttgcattttactgatgttttcttcttcttctcctttttgctttttttggtcagaaattatccagcaagctttcattaacgtggccaaaaaacattttggcgaatttttcaaccttaaccaaactgttcaggtaagcacccagagttcacttgctagtcacctggaccactggctgtttaaccttgagagaagttggatattcactgtcatttggaaccatgaggccagggatgtaatggcaggctggcgaggctggcagggctggcggggctggtggagctggtgactccaggagcacctgcctgcctggcttctgctcaggaggcggcttcactccccaggagaaatgaaatgcggcccgtgccctgccatctgttctgcacgaccttacgcaggatgtggggctccaccgagaactggctggtaggctgaatctttttcaagcataaagcacagcattgtttactagtcctactcccaaatttgtatgtttgactcaaagatgttgccgtagctctgtgggtttctacttagcaactcttcccccgagttaccttcagcaaaggcaagagagggcatgtggcacttgggctgtagataaaattcctcttctgcccaggcctgggctggtggattgaaatctcattccatagtgcaggcaagcaagaaggacaattttcgtcatttttccgtcatataaattaatttcttctttcaccctttttgcctgttagtgaaaattaaatcccagttctgactcccgcccactttctcaggggctgtgtctgagtcccgggtgcctgctcatggggtgggtgacctgcctggtccccagtcaccaagatgtccattgtccttcccgggccttggtccccttggtccctgagctcctgcccagccccgccgggacacaggaagcactcggctgcaggcccaactgctctgggccatgggaactctggcatccaccaagggccttcacctcttttgtgctgcccttggatagacacagccttgcagcagctcccggctcctcaccagggactgcggggctctccaaggccatgacctgcacactgccctcagccacaacagagcctggggggctcgctgcctcctgtgtcacaaatcttgaggagtgcggcacaggccacttctgctcccagagggtctactgtcctttgttgtgtagaccgaaagtgactgaggcagatctgcctcgatccgagatttattttgcccaggtcgaggatgtacgtgggaaaaagaaatacaagttccagtgctatctgtgacctgtgcttttcctaagagggtttaggggaacttcagtatttaaaaaggaaagagcgagcaggtggggaagaaagaaggaaggagggtaggcaatgaggcaatgaggcagaggtcaccctcgtgtaaggctctgaccagcactcagtgaatctatgtgttaaatgtgaaaagaaaggcgtggagagaaagtcaatcatgcattcatctcgcgctcagtaaatctacattttacatcggataaagtgcacatgtgaaatcacagcttctgtttgggaacaaaagaaaggcagttaactttccctttagtatagtaagtttggggtcccaagaatctatttttctttcacagttgtcacatatactcaaaaaaaaaaaaaaaaaagaaaaagaaaaaaaaaagagaaagaacaaacaaaccagcacctgtgaaacttcacctctgaaactcactctctcactctcaagccactgcttctgccttcagttttaaaaagtctatttgaagctcaaaagcctaggccaggtgtggtggctcacgcctgtaatcctagcactttgggaggccgaggcgggcagatcccttaaggtcaggagttcgagaccagcctggccaacccggtgaaacccttgtctctactaaaaatacaaaaattagccagaaatcacttgaacctgggaggcggaggttgcagtcagtcgagattgtgccactgcactgcagcctgggtaacaaagagagactccatctcaaaaagaaaaaaaaaaaagaaaaagaaactcaaagccaggacatgacagtcttagttcaagcttctatcacaaagtcccacagactggatgtgtcttattaacaataaaaatttgtttctcatggttctggaggctgggagcctgagatcagtgtgtcggcatggtcaggtggcagtgagggctctctttcaggttgcggatggccaccaccttcttgtgtatcctcacacggtggaaagagcgctctctggggttgctttataagggcctcagtcacattcatgaggctctaccctcatgactaattgcctcccacttcccaataccattaccttcctactttggtttcaacatgtaaattggggggcaggggacacaaatgttcagtccatggcagtgaccctgtgaccccccttctctgctacatcacctctttctttcctttttttttttttttttttttgagatggagtctcactctgtcacccaggctgaagtgcaatggcgccatctcggctcactgcaacatctgcctcctaggttcaagtgattctcctgcctcagcctcccaagtagctgggattacaagcacctgccaccacacctggctaatttgtgtatttttagtgagatgggggttcgtcatgttggccaagctggtctcaaactcctgacctcaggtgacccacctgcctcagcctcccaaagtgctgggattacaggaatgagccatcgcacccggcctttttgagacggagtttcgctcttgtcgtccagactggagtgcaatggcatgatagctcactgcaacctctgcctcccaggttcaagccattctcctgcctcagcctcccaagtagctgggattgcaggcgtgtgccaccacgcccagctaattttgtatttttagtagagatgaggtttcacgatgttggccaggttggtctcgagctcctgacctcaagtgatccaccctccttggcctcccaaagtgctgggattataggcatgagccaccatgcccagccaacctctttcttccttgactgcatgggtgatgtaggagtcctgggattcctgggaaacaggtatatcacactattatcccagtgttcgtcagcactggaaccattctagcagaagtagcaccccaggaatgactgacaccgtcccaacagcatggactaagcctgttcctgttgaaggagcagaaagctggtggtgtaggagggactggggatggccagagaggaagaaagggcaggagagaaggtatgtcgcaagtggggagtgaggaaaccgggttcataaggacagaaagggcgaagtgggactttctaaaaatcatcatttcaagtctcaggacttctttgactatggattcgttttatttctgagttcaacataatagtacttccaaatttgtttaagccaacaggaaagaagaaaaagaagtaatgtgtttgtcttttttatctaaccagagcacgattgaagacataaaagtgaaacacacagcaaaggcagaaaacatgatccaacttcagttcagaatggagcagatggttttttgtcaagatcagatttacagtgttgttctgaagaaagtccgagaagagatttttaaccctctggggacgccttcacagaatatgaagttgaactctcattttcccagtaatgagtcttcggtttcctcctttactgaaataggcatccacctgaatgcctacttcttggtgagttcccggcggggcaggagccgtgctctctgaaatttgcagagctgagtaggggctatgctaacctagagaggctttgctgagggaaggagggagggaccactacaatgtattaagcccttctgtattatgataaactacttatatattttctcatttataattttacatgaaccctatgaaggcacttttaattaatttgcccacaatcaatttttaaagtggtagagcgtgtactcaaaattaattctgaccccaaaattccttatatttcttatgcggtccatgaattacaaaattactatgatcagaatacagcaaaatacaacaaacgtcaacgattgtgactataaactagctttccttggtgttcagaaggcactaacatgccacacttgccagccccacaagataggaatgaaatttcctttccctagattttgtgacccagtgaactttttggcctctgactgtctatccaatatgcaagtatcactgttcccaggaagaaaaaatagcttttaaactgcaaagacacccacctcccgaagccctttctcaatcagaatagagtggtttcccagccatgggcacctggctgccaggcatactggctatgcctatgaagaaggaatgaggggaggattcgaaacggccctggtgcatacccagaagggagccaggggagtcctgggctgggggagtttctccagcagggaggagctgtggggatgcccagaggtgatatgggcttgctagcctaccagggggcttcttagtgctagaggggatgcctggaagtaaagaggggtcagcgcaaatagaaccttcacggggcttgatgctgaccaccggagtggaggtgggcgagaccaccagggcttcgccaggcaaccatgtgcgcatccaggaactccatgccttctctctgcaaccacaggccttgggctgagaccactccagcaaacccttctttctccctcttccaggaaaccagcaaacgtctcgccaaccagatcccatttataattcagtattttatgctccgagagaatggtgactccttgcagaaagccatgatgcagatactacaggaaaaaaatcgctattcctggctgcttcaagagcagagtgagaccgctaccaagagaagaatccttaaggagagaatttaccggctcactcaggcgcgacacgcactctgtcaattctccagcaaagagatccactgaagggcggcgatgcctgtggttgttttcttgtgcgtactcattcattctaaggggagtcggtgcaggatgccgcttctgctttggggccaaactcttctgtcactatcagtgtccatctctactgtactccctcagcatcagagcatgcatcaggggtccacacaggctcagctctctccaccacccagctcttccctgaccttcacgaagggatggctctccagtccttgggtcccgtagcacacagttacagtgtcctaagatactgctatcattcttcgctaatttgtatttgtattcccttccccctacaagattatgagaccccagagggggaaggtctgggtcaaattcttcttttgtatgtccagtctcctgcacagcacctgcagcattgtaactgcttaataaatgacatctcactgaacgaatgagtgctgtgtaagtgatggagatacctgaggctattgctcaagcccaggccttggacatttagtgactgttagccggtccctttcagatccagtggccatgccccctgcttcccatggttcactgtcattgtgtttcccagcctctccactcccccgccagaaaggagcctgagtgattctcttttcttcttgtttccctgattatgatgagcttccattgttctgttaagtcttgaagaggaatttaataaagcaaagaaactttttaaaaacgt

SEQ ID NO: 2611 - DNA, 45337 bp, Homo sapiens
  source 1..45337: mol_type = genomic DNA
tcactttattttcaaaattttatttttatggaattttcagcatgtttaaacttaatttttagaacaaaatccaaaagcttaaaatcagatatcttataatgtgtcacaattaagtatggagagttctgtcatttttgaggaaaatctttcataattcttaaaatgcaggtatttacaacatttttaaatacagacatatacaacatggcatatttaaatgtacaaaatagttgaaattacattttatcacagaacattccaaaattcaaactaatttttaaaagtccacaaacactgatagcatttggaaaaaaatagcaacaagtttatcaataaccatgccatatgtttagtaactaacttacttatacacaacacataatttacatgtcaaatccacaaatctaaaagatatatgactaatctatttaactcacgctagaatctaaatactattttataattcataggtttaaatacatgtttcacagtaatctatgaaacaggaatataaactatgaaaacatatttaactgacttcttaagagacgaggaaatgtcaaaaatagcaaatcaggcatttttttcccctgaaattaaagttcttatgaataccttcataaacaccaaaggaagaaaataaaaacaactcagatactacaacttaatttttaccttctcaaacttctgtttagagctcttggcataatcacagctcccctgggatatttttattttttcctgatttagtggaggcaactatttattccctcccttgttccaggaaaaatgtaaggtggcttagaagatagactcagaatatactagaaagtataattataggttaaataaaaaagaaaatagagaaagcagaatttgggggaatagcacatgaagccatttaagaaaaggtcaggaaatatatcctaaagtatattacattattctcccacagtgattttctggaaatattgcaaaatacattaatttgtaagaaaactaatattaaagtactggtaaactagagatgctgatcaaatttgttaaattatttatttaccctgatgaagcagatgattataaaaatgtgtgtgcttttctttgtgcttggataaaagaagttttcctaaataccatatattggtagagtataggtgaaaaaaaaaataaaatttgggcacccttactgaatttctactgagaattccatcaactgctgtctgctgacttgcgactggatggcttcaactcaggtgctcatgtgttacatggctgttttgtgagcacaaaacagagcaacatcaattccagggcatcctgactattggttcctccagctcacctcatcaggacccaggaagagaaatgggaggaaggtaatgcagaggagacctgctcaggttggcatgttgaagccacagtctcctctgttgggttgagagctgcagaggttctgactgtgcttacagtctgcatgtcacagacctcaaccccactcctaggggcagggaaggaatggtatggacagaagactgggagcagcattaaatagcttcatggaaacatgcatggtctgtccatctctattttacaggcctagctttcaacaaataatagaaagaagggtcttgtatttatatgctgagaagtaagaatgcagggagtgatgatgaaggaaagggtttgtgggaaatggagaggaaagaaaggtagtaggatgtttccctttcaagtgtggcacgagtttcaaaactacagattagggactgaccaaaacaaaaatatctgaagactaaaacaaaccactgcctcctatcttttttgaggatgaatggtcccaagtaatccttgtgagttttcgttaggttgggaaggaagtaagttcaagtctatagatctataaccgtggaaactgcagtgctcctggatggagtggcaaaggcttctccaaggactgtggtggtgggagaaggggacagaataatgactgctatttttccaatgatgcccttcagaatacaggcaatgccaacttatccattaggcacagtacctaaggcccacagttttttagaagcccacaaaaatgttttaattttttttagcctcataagaaaaaactgaacttctaaacaaaatgttttaatctaaaatattaatacattcatttcatacagatacaattgtaaaatatcacttttaattttgtatggaagaaggggtctaagatggcaaaactatctagggcccacaagaatcataatgcagctctgaatacagggtcaaacaaactgtaactgaagcaatgtaacttgaactggaaactgaagataatttaaaaggattagagaagaatggtcaaggctaaaataatggagatggagagtctgagcttactgatcctgttccactggtttttcttttcttgaatgttactttggaattagattaagtctaatactggggaagcgctagtgtcgatttccattagccaagccagaaaaaaaaaaaaattaggtcattattttatagtcattgtgcaataacaaagacagaatcaggatgaagacacctgcatgtctttaagtcctttagtcctttctccacttctgtaaacattattaaaggcaggtgttcctttgagactctgcctcctgaacttcctgtatcataggccccctcagttctagacttcctctgtgcttctacaaggccctggctccattatcctcggtagtagcccaaggctggtagtgccagcaatgtgggtacctgtggttgcaaaattgttttaagaatatgacaaaagaaaaaggaagcagggaaaatgatggaggaagagagaaagaagtaaccaagtttaacatactaaaattatactgtcaaaaaaatggggaaggatttatatactaattgtgtttttttaaatagtagcactgagatatttgtacttcacacttctctgtattttaaaatatactttacaagacaaatgtactctatagtcagaaaatactaagtattattttgaaaactgtgctctcaaggccccaaactcttgacaagtatcatccttgagatcctcgcaatatggcttagattagcaaatatggttaaacattggcacacagggcaaggagactcagatttgagagcagaacttttaacaatttccattactttccatcacccaaattcatcagtattatagggaaatgtcaatcaagaaagctagtataaaacactttttagtatttgttccccaatatatcatgaggaaacaggtcaaaaggaagatgagtacaaaggaatcaatcactgcctttcacagaatcacgcaacttcggagcttggaagggaatactaagccataaaattcaggcccttgatttactggtgaggagcatggggtccaggttatgtgttttgattaaggtcacacagcaaagttggtaacagagttagggtaagagctcaggtttcctgacttttggtatagttcctcttacactctcagccctcaaactaattgttttataagctatacttcactgtttatcctaagtgcacacagagaaatggaaaaatactacccttttttttttaaatgtatgttaatttggaaactgtattaactcaaaatataaacttcacaagagtagtccaacgattagaatgaacaataaaattttagttctggaaggacattaagaagttaagttagacttcagttacacaagaattaaggctcagggaaagtaaactgtatctccccaaatcacaaagttgagacaagaaccaggtcacctaaagctgactcactgcttcttccaatactccttattcttcattggctattgattacaaacaaagcaaaatatagaatcaatctgatttagatataaggaaacgttagtaagaatgtttggtgaatagctataaatcaattctctgactactaagaaataaactaaaatctactgaatttcaataaatgaggcagcattgactgcttattttattttaaaattggcttaaatgcagatcataattctgagttttggtgtcatttgaagatgacgtaaagcttaacaaatgtaaaacaaaattctaatgtttaaaattctctagatcaagggttggagaataatagccaacagcctatgttttatgaggcctgtgagttaacaatggtttttatcattttaaagggctgtaaaacacacacacacacacacacacacacacacacacacaaagaagaatgtctcatagacatcatatgtggcctgaaaagccaaaattatttacaaactggccctttacattaaaaaagttcactgacctccattatagattcagaaagcatatgaaactgggctgaatatgtaacatgtcctgaaaggcttgttttaaaaattaaatctctgatttattccagctttattatcatttgcctctttctcctagtagtaggcagtagaaaaaaagtttgagttatgattacctatgttccagttaaatgaggttttatcacacctactaatgtaagtggactcacaattgaagctaattattttatgtgtgtaaaattggttaaaaattttcagatagctgagaaaatggcatatcttatgatactactgctatacaatgaaatggaagatagtatctatgattagaaactggtaatttagttctctcctttgggtttttcctgtttttaagattttcttgtcatgcctctcctggtctcctgttagatttattaatcagtagttctaaaccatattaattatctcagtgaccacccatccatatctcatttatagccataaacaaatctcagcagaatatatggaaagaatggaagtgcttttaaatgaaataggagataccacaatggaacataaatgactagttcagggaagaaatgacttagagacatagtccaaatcccaagctgaacacaacagtaaagccgaccaggttgcttagtttcacagcctacagcattgctcagtaaaggactagaacaccgtggtggaccctggtttgcagaacactctgataatcactatatgaaaacaaatttgtatctcttccttttcacatgatttatgtggcaaagtttggattttgtgaaatagagaaaaaataccaaagctgtgccaatgttaactacaatcacttcaagtttataactttgaaagtaagatctactgtgtcaagattaaaatgtcttaactttaaaataatcacattaacaattcctttgtacagttctcttcggttactccattctcttggttgcttttataattggaaaggaacaaattttctatttcagtcaagaattcttcagccataaagcaattggtcactttgctcagagtcttcctcatacactccaaaagctagttgaaaagaaaagttttatatttaaatacagaaaaagtatgagggtttgcattactatcactatttcgtccctttccagacctcacatttcctaatgctcaaatgagaaacactctccttaaaaatggttgaagattaacttgtgtttaatagtcacagagctggaatgtaggaaattgctgctgaggaacactcagcttagtacttttatgattttacataaggagacaaacctgagattgtttatgtgatgctttctacttcggacgtatttgcgacttttctccatttgtagttacacttacaaagcaaaataatcctgagtatacacacacacaaaaatctaggtacataaaaacataggattctgcatttcaaaatgaggatgctagctggagtctatttccttggaaatgtgcacatactttttcaacaacacacaaaaaactggatataacagaaaggagtaaaacatattaaaaagaaacttaatgtttaaattttctatccccaattgctatttaaaaagacaaatgttgcagatctactagccttcaatcattacagaagcaaaacctagacgtgaactgacagaattcaaaactcttatttcctattagaaagttaaataaaatgactatttaaatttaattgttagatttataccatcattcttaaaaatgaccaattgttaaggctaaaatggaaacatggcactttcaaatttaataaaataagaaaaatgttctccattgtgtataataataatctgctaaaatcagccaacactgacaaatttattctaaaatagaattttttctatgtgcaagcttgggcaacaaaaaacgttactaattatctcctagaaattaattttccaaaggaaaaagtaataaaagaaatatacagaaaattatccacaaagtattaggcatcatgggaaaacacattgagatgaatagcttcagaatctgtgaacaatggaaccaattaaaatgaagacagcttactttctgcaaacaagtcaggtcagaatcccggcgaaagattttatccatggggacgctgctgtaggaagaaatatgaaaacaaactggtgaaacgaatactataaactaatcagtttcataataaactatcacggatgccatacatcacaattttatatttaacttgggttttctctgaaacataatttaatgagcaacactgcagatgtgcaaccatctcaaaccacagtacatacctatgggagagcctgtatttttctattatccatcttgtcttttcaaatactaatccccactgaggttcttctaacatctgctgtacttcaaatttgtaaggtaagcctagaaaagcataaagaagcacattgtcatcaactatttcttaactctccaatctccttttaattatacttaaaattcccttcggtgtttttacagccatagctttgcagatcagctgaacagcactttaaacatagtgggcattcattaaatatttattgcccgattgtacttggtccactaagcatattaatgccaagctattaataataataatgagtaaaagtgccatttacatgacaattctacgcatggcactatgatgggatgatcacgtaatttatcacctaaaccaagagactttttgaatgaaagaaggtactattaataattatgcctgaaccgcaggtttaaagtgggattatcctagacaaactaagacatattgccatcctagtgataattaaaaatatatatatatacaggttattaagcttacaacaatgctgtaagttattgttttttttttaacaggtgagaaaactgaagctgagatacattaaaaatcatatttaggctagcaaagtggcaggacacagatgttaaaacccagcaggtttgcctcacttctgagcccaaactcattccacctccctagaagagctaatctaagactagacaagaggataggatgaactctggggaggcagcaactgctttgagtcaaagttgttatactaaactctggaggaaagaaagaagcccaaggggtgaacatcatatattcatctagaaaggaaaaaataccaaacgatgagttatcttagcaatttttcacatatccttcaagacccccatgcaaatgcatctatagcatttttttaaaagctcagctgattcactagcaaaggctgataccatcatagtaacacttataatgcatactatgtgccacctaaaacttaatgtgaaatcacttaaatgaagtagctgccattattcaccccccccttttttttttttcgatgaggacactacgtcatagaaaggttaacctgctcatgatcagatataaaaggcattggcaggatttgaacccaggcagtcaggctcgagagttctgcttttaacttatacataatactgcctcaactgggtttctaccatggtaaggaataaataaaatgccagcaaatcagaaggcatggaaaaaaaaaaggggaaaaatacaattatttcctcacaatgaaataaagcatagcttaaatgtcaatatgctctaaaaaggcattttttcaggtgtttggaaggaaaggggacagcaagcctgatgatgatgactgatcttttttatttaattgctcaattttcctcttctccaaaaacttaagaagagtgacacactatagtacacggggtattaagcaaactccttatggtgataacagtcatttacttgacatgctttgattacttactaaacatggataccatctatataatgataaccacccactgaaaacctattatttgctaaacactttacatatattactgacacaccttacaaccatatacctactgtaagcaaggtagtaattttttctcattttacagatgtagcaaaggagaatgagggagtagactgcccaaggtaaaataagcaataaatgtcagagctgggatctgaatccagtagagtgactcctactctcaatgaaagttgaagatgaaaataaagagaggtaaataatgcattttcaatctatgctgatgcaaaaacatgaaaacatacacacaaattatatacaggtctatttggtatttttaagaatattttttaagttaaaaaaggtacttttaaagtcaataagtttcttttatagagaatatttttatccactaaaatatcagaagaaaactgatcactaaatatatttcctgcctgtcacaagtaaagaaaacattaaaccattagagatattgtaaagatatgacctgagttaaaagtactgtagcacaaggtatcccatggcttctagaaaaccttaattcttgcaccagaggatttctaagggcaaagcaaaagacctaggattaagatctaatacgcagtgttaagcatggacaagtcatttacaagacagctctgtccaatggtagctcatgggagcatcatggatagttccctctaatgctttcaagtagttctttcccatctgggctagtttattcacatacatgtgctgatctgtactttgctaaatactccagggatactcttctacaaatctccagagttcactctccattctgctttctgttctcttggggctctgtctcacaaactcagctgtcttggtctccttatctccatcaccttaattgagtcggcctggctctgggtgggtttctccttcttgtgccatatctgaaaaccctcttaagcagtaagctagggtaatgtggggctcttttcatttgtttcccatctcttagcaatcgtattcctttgctgctaaatgttgtgtttaaataccattattttacatattttgtccagttttttggtagtttcagacaagttctttttacttcattttggccagagtagaattccatgaactaaattttaaatttcatgtaattctaatcaacttacatttaaagtcacacgtactgctattgtactggatagcatcagaattgaggttcattaccaaaacctagcagtctgtgagattataaaatcaagtcagatgatgatttaaagatggtttaaaaatgatttaaagagaacaagttaattgcgattctttttataaaactgtactgagctaaagaataatatgtattatgtgctatgctcaaaatggacattccagactaaaagctaataccaatattattaattcagtaaaaacccatagtgttgaccacctcctagatgcaaagcaatttattaggtgctacttgagaaaaaagacaaataagacacagtccctgctctttgggcatacaatttattaggacttgctaaatagataaattgcattaaaagacaaagtgaccatgaaggcaggaataaagtgttgcagatacataaagaataaagcaactaatagtaaataacatgggggcagtgctggtaaatctacatcaaatatagggcatccaagagagatcattaagaatgaagagaaattaattattaaacaaatattcatttagtatctactttatgccaggcctcatgctagaaacaggatagaaaaaatgggtacaatacagtatttattctcaaagagctcataatctaatggggaagagtacaatgtggggtaactgtagtggcagtgtccaggggacctgacctatagcagtggtagtaatgacagaataaatatcctagagttatttagcctactgtttcctctgattatttgctttctagccacactcccttccttttcctagtctgctatactaactccctatccgcccagaaatgtttggactacaagtggacataaacctcaggggaatcaagtcagatgatggtctatgccaaccaaattctttcctgagatagaatgggaacaaagagagatacaaattgagttagtcattgttaaccctaaaccgggaggtgacagagagctggtggtcattttttttttcatttgcatgccatcacagagaaagccagtctgcatttataaaaaaattttcatgagaacagagactgttttgtttactgcaacatctccagtgcctagcatacacactgcctggccataacttttctccatatttcaatccttttgcccagtggccatggtaacaaaagtggggacttgaatatagcaggagattaagaaacggaagagggtggctgcactagggtggcacccaaataatgattccctagttgagggcacaaactcttgcattaaataattttaaacagttgcaaatcttttgatttgtatgagtcaaagaaataagagtagaaagaggataaagttatttttgttgaaaacttacgataagagccatctgggctaatttcctcacttataaccaggcaggtaatctgagaatatggtaagggattatttcgattatagggactaacaatcatcccaatgaactttgcacctcctctggagaagtaactctacaatgacaagaaaaatataattagtttcaactatataaattcaaaagccaatatttatccatactaacattttaaacatctaatggggaaaagcaggaacaaaaaggtgcattaaaaagttcacatctggcccggcacagtggcccacgcctgtaatcccagcactttgggagactgaggcaggcggactgcttgaggtcaggtcagcctgatcaggcttgagaccagcctggccaacatggtgaaaccccgtctctaccaaaaataaaaaaattagccaggtgtagtggcacgtgcctgtaaccccagctactcaggaggctgaggcagcagaatcccttaaacctgggagacagaggttgcagtgagtcgagatcccaccactgcactctagcctgggtgacagagtaagactatgtctctaaaaaaaaaaaaagttcacatccaaactgcaactaaatcaaatgccttagatattcatctcacacggtacatttttcaggcaaaaatgtgttcaaccaaatccaaaatgacccttaaaaatataaaatggcctacacaatctgtatttgccatgaatatatttactaattgtattcaccaccctacatctgtaattcttatcaatacagtaataatttacaaataccctacagcaaacccagtcacatatcaagtgtaaaatcccagaataaaactttttcttcagctataaaaaatacattatgtttcttattacttcagttgtatctagtccctgtcctagttgttcccatcaatttttaaaggctctgggagtatttaccagtgatacattcatggcttgtttgtacttaataaaataactgactttctaaatgtttacataaacaattatcaatcttgcaatcagaaaaaaaaatgcatgttcttttaaaacccccagtatatgtattttttttcttttttttttttttggctgggtgtggtggctcatgcctataatcccagcacttttggaggccgaggcgggccaatcacctgaggtcaggagtttgagaccagcctggctaacatggtgaaaccctgtttctactcaaactacaaaaaattagctaggcgtggtggtgcacgcctgtaatcccagctacttgggaggctgaggcaggagaatcacttgaacctaagaggcagaggttgcagtgagccaagatcgtgccattgcactccagcttgggcaacaagagcgaaactctgtctcaaaaaaaaaataataataaaaataaataaaaataaacaaacaaaatccccagtataaagaatattagaaatgtaatatgaaaaatgtttaaagtttatctatttaaaagggagcattgagggggtgtgcaaccatttacagaatataaatatacatgtaatacctggtatttagcttgtgtgtcaatatctcgtaaggaaggattaggatcaaaagcaggatgagaatgataccatccaataacactgaagcctctaacagccaaggtttctgaggcctgtgtttgtgatacaggatccatctcacactgtagtcctgtactcagactgttacatggttctgctgcacagacctataaacgattgatcctcaaatgattatactaaaatcctgttaattctattactctaatgttataattctttcaaagatacggaaacttttcaaggccaagacttttatttaacaataccacagttgcctttaacttgcaaatgacttaaactccaaaagtctgattatatgctaggaacttagcatgcatttttctactcaaacaaggtcataataatggttagttttccaggtcagcccacataatacctgtacaaaggtattctttcaatgactcctgttacttatgacaataatttcaacagaatgatgcatacaaactttcaactaaagtgttagtacctgtttctggcctcttagaagttgtagctttttactaataaaggtaatgaggacccaaggcctggcaatgttctctcggtggtaaaaagaaacaggcgctaggcatatagaatgttaagtcacttctgggaatatataacttgctacatttgcatattctcatatatatcataggtaaagtctgtattttaattatattaactgaattctataaaaatatttggtatggtagtaggactaaataactaaaacatttttttaaaagagagaacttacttcaactactttatcaacttctgagtatcttcctcctaacagaccaatcacttctgccatagaaacatgagcatgctaaaagaaatacaagacagacttagcccaaacgcacaaacccacctgacaaagtaacaaaactcacttatcataagaaagtcatttgtaagtatagccatcatgcttttataaaataaagtagcataggagaggaactagatgctaggatcagtgcacagaaactaagatttcaggtctatcttcactgctggctgagaagctttcaaccaaacacttaaaaattctcagactctacttttgcaattacaaaatgaagataccatttactctccctactcaagggaggtattatgtaaggatacaaagtaaaaatcactctaaatccttctacacaaagacatcacaaacacaaaaactgttggaggtatcggtagtttagtaaaaacaaaaaaaccctccaaattacaggagttgtgctttgtttcagtgatctaaaaagtggcagacacatatattagaaacttaaaatagggttaatgatggtaaacagtctgcaaaaactcacattaatttattttctctaaaatatggaaacatgcaattgtttggcttttctccaaaagaaaagacttatttttagattccttgtaaaagaggacagttaagatccaaaatacacgtcttccatactctgtcttacgcctgcaataaaaatacacaagagtagaaatcagaataactaagtaaacacaatagattatccttaccaaatccattattaaaagtgcttctgaagccactttcacctgaaatggctcctgaaatataaaaaacaaaacaaaacgggggagcataaaaatagagatttttgttttccccacctggaatgcccaccctgttctcctttatccaccccaccaagttctcagcactaaccaaagctcagcacaaactagacttttaaaacattatgatttaaaattccagcagggagaaattctctctcattttcagtctttttatacatatgccttgcacatacggaaaaagagtaagcatttcctgtttgacggggaagcggggattgtctactgtcattcattaatgcataaatagtacctgcttttcttcactaaaaaaattacaaggtatcagttggaagggatcaaacgagctgaaaaagaaaaaaaattttcaatacaatctcaacaagattaggaaaataacatttatttgtaaatctgaaagtgtatatcaataatctaaacccaaattctgtctaaatgagagagttttgtaggaaattccataaaccctttcgaaagaagcactgttcttttagatttaacaagaacaaaaaaaaaacccaggaactttgagataaagttgctctgttgtcttaatttcctttaacactcaaagaggacactataaactatcagacatatgtcccacactaaaagcagatttcaaaaagtccaatgaaaatataattaactgtcatgagacccaaaaaaaggttcaagaaagatggaagtttatcaaaaacacttgtcagttcaataatgtgcccactatagaataggaacttaaaacattttttgaatgaatgaatgacaaacagttctggtaaagatattaatgtattactcctatcataaactcttcaagtgaaaaagtggccaggtgcagtggctcacatctgtaattccaacacttcaggaggccgaggtgggcagaccccttgagcctaggagtttgagaccagcctggataacatggtgaaaccccacccctacaaaagaatttcaaaactagctgagcgtggtggcgtgtgcctgtagtcccagccactcgggaggctgaggtgggaggatcacttaagcccaggaggtggaggctgcagtgagccatgatttcaccactctactactccactccagcctgggtgacagagtgagaccctgtctccaaaaaaaaaaaaaaaaaaaaaaaaaacaaaaaagtgaaaaagtaaaaagaggtgaaaaagagagaacctaagcaaggtcaaaagcacacataaatctcagaaatgtcagtaaagaattgaggcttgagaactatattaagaacaataaaaaggttttttaggctatcttcagggaaagaaaaacacacaggaatacattcgcattaacacaactggaagagagcagggcaattccatttccattcaaccatagatggttagcttcaagagaacattttgttttgcttaataatgtatcccaagtgatcagaaccgtgcctgacatatacagtacacattcaaagatacttgttgaataaagaaagacctttaaattagaaagtgtttaatcaacacaaaaagaaactgaaggccaagatagatgagaaaatagcacagaaagaacatcctggagtacttaagaaccacggatatggaaccgctgtcagtgtttgttgaggaactgcagagaatgggaaagttgctgaaggactagaaatagacaattattgagcttgtttcacaatacaaaaaagcagactgcagaaaaggaggaactagatgttgaacagtagtaaaattctagaaaaaattatgaaacagctgatttgtgatccttaaccaagtgaagaggtgactaagtaaaataatgagttcatgaaaagtcatgataagtagaccttattgtagacactattgataggaataatctgttagaaactaaagacttaaatatattttatctgaaattaaacaagacatccgatatgattatccttctgtataagatgaagatatatgcgttaattgtggtaatctatatagctgattgaagaatgaatgtcttcgttgtttaaatatatacaatgaggtttacatttattcaattaaacattgcaatcagtgagtaatggcaggaaaggcaagcttattgaaatgttaatgatacagtgctacaaaggctaaaatgagaaaagtggatctggattcaaaaagatcctgaagaccttgaacaatgacttgaaaatcacaataaatataagtctcacatttagagtcagaaaatcaattatctggatactggatgaggagtcctagcttatggaggactattttttacatagtttatctaattcagtctcacgacaactgtgtaagttttatttttactttagagaggtaatatatactgtaatgattaggggtatgaactcttaagcttaacacttgggtttaaaatcaacagctccactacttgacagcgtgagcaagttattaaacctctctatgcctctcagtttcctcatctataaaatgggagtgagaacattaactaatgcacagggttgtcatgaagactatatgagctaataaatataaagtgcttaaaatacagctaacagtgttatttaaattattgtttaataaatgagaacctaaggattacccgaggacatttatcaggcaaaaatatgatctagtggcattcctggatatcttcttttaaaaggtacactgacaaaactacagtctattcaatggggcatctgcaggaagagggaatagaaaatcggaacatttaacttatttggtgacccttaattttaaaaggctcaaattttagattacacatgcattagaaaacaacaaaccatgcaacaacttgctaacaattagtaccacccaaagaaaacccagtcatttcatgaaggttcctgtccatagcgtctagagttgaatgaccaacctgtcctaaacagggcccctttacaacatatgttggatcatatgttcaatgaatctgaacaaatttaaaatgtttgttcaaggtcttccaaattcataatcagtgaaacaaaaaaaatctaaaaaattgtagcagtatttttttaaacttaatgtgaacaatataatgcagctattgaatattttttcatatattatctagccatttgtgataaatgtttaaaaaccacatttatataacactacacctttttgttggtcttggcacttttaaagatttaacaggtctgcctttttcctcttctcttctttttgccaactcctcagcagagagatgctaaaacaaaatgccaattgattaaggagtccatcatctactaagaggcagaataaaaatagtcctttaaaatcaaattgaagggcatgtgaggacaagagagactaaattgatatagatgggcttcctttttgctaccaacatgtagaaagactggacagtatttttaaaaaattgtttcaaaagacacggccatcccaaactgaaaatttactccttctcttgatttgcccatttcaatcaatggtaccagtcacccaggttcaaaaacgtcagaatcacctgagtcttttatttcccatttctacttaccatattctactgtgttgagttttctttcacaactgagagacagtgcagagtaatgattaagaacagattctggatctagaatgtctggcccagttatttactagcttggtgaccctaggcaaattctaaagctttcatgcttcagttacctcatctttaaaaatgggaacaataaaattaataataaaaagtaaacaataataccactgtcatggtattattgtgaagactgagttaatgtttataaaatactgacattgtctgacacacagtaagccctttataagtgtttataaaataaagtaaatctctattccatttctacgaccaacttacaccctagtccaaatgaactatgcaccttttccagaatatatctagtattttcccatgtctccagctttgttccctcagcctaaagtgtattcatctccattttgagattcttctgcagatccttcagatcagattataccccacatactctacgaaacctgccctgatcacagcctttgggagaaacttacaattcttgggaccaaccttattgaacttaccataggttttgtctttcctattagaaatacaagccccttatgggaaggatgaattactaattactgtgcctagaatagtactcaggtgagaagttgagggcagggaatgcggaggaggaaagagaactcaagtttgagtactttgtgcatgcaaggcttactgaatacctagtactagcatctttatatagtctatctcgtttctttcttacaacaatactttgagggaggtattattattattcacaattcgtaagttaaaaaagcatgagattctgtgagattaagtagttgcttaaagtaacaaagccagtacgtacacattcacacattctatccattctactgcactagctgttacaaaaaatatatatatttagaacacatgtgtgtctaatgtctaatgcttagaacaatattttaattggtatatcagaacctcttccaataaatgtttaatgaaacgaattgggcataccaacttcttgacacccttatcttgagttagagacaagaatacagagacagagaatccaagttctgaaatgagttaaactcctagttaactgcaccaccaatgccttctactttggtgtttactggtgacttccagacaaattaacatgggaatgaacacatacatgttaatgtatgaaacaagtacaatacatatgacattaagatgtacaaatatatatttaaaaaccagttttcatggatgagccatttgaaaggtcaaagttacctcaaacgtttgtccttctaagtcctttgcatcacaccagtttccccatgggtctcggaccctacgtctccttgtacgctgcgatgagattaaagtaaagcaaaaggtagcaagattaatatggagaaatcatagcacattaatacacaaaatgaaaacaataattatctaaaagtcaattaatctatcaatttaaatagtataacctctggcaatgactgactaaactttattaatttatgttcaatagttagcactctagttacaaatataataaatcagtgatggcgaggtaagggcaggagcaccagtagcaggtgggcagggtgtgggctgggtgttggcaccagagggctatttaaaaaataagatcagtaatgattttctgtattttgctagcatttcttcttagcttttatatttcctttcatcatgtaggagctaaaacactatgacaaaattttgggttttttttgagacggagtctcactgtgtcgcccaggctggagtgcagtggcgtgatctttgcttactgcaacctcccacctcccggttcgagtgattctcctgcctcagactcccgagtaggaacaaaaatatttttaagatcaaaaagaaccatcaagaaaatggcttccttttcaaccacttgtggtagaaaatctgcaagaacacacagcaagaggtataatattgaaaactagaagcaaaataattattatttccagctttagaaaggaggtggcctagttgatcaaataatgagaaattacaaagttggttgactacattattaaaatccagttttgcaaacctcaatagtgaggcctttaaaatggaccagttgccaaaggatagtgtatgactagcaccatatccagcaactctaattgataacatctttaagatagtaaatctagatagaaatggtttatagcctaaatactctgagaaaaacagctattttagcacctatactttctttttcatatcttatttattactaatttaatccattagtaaaactaacaggatcatattatgactctgccttataaagagtgttggatcggctgcacacggtggctcacgcctgtaatcccagcacttcgggaggccaaggcgggcggatcatgaggtcaggagatcgagaccatcctggctaacaaggtgaaaccctgtctctactaaaaatacaaaaaaaattagcttggtgtgatggcgggcacctgtagtcccagctactcgggaggctgaggcatgagaatggtgtgaacccgggagatggagcttgcagtgagccgagatggcaccaccatactctagcctgggtgacacagcgagactctgtctcaaaaaaaaaaaaaaaagaaaaaaaaagtgttggatcacatttttatttgtttttttttcccctcgagatgtttctttttctcctagtaggtcactttatttttaaagtatgatttacgaattttaaaatattataaaactgactccaagaataaaaaaaaagtctagttattccaaaaaggtgattcttaaggttaagaattttaaaagaaaaatcaatgagagaaaaaaaaactgaactatatatttttaaaagacacattagatttataaattaaaacgaagcatcccaagaccactttaggaaaacattatgcttctgcatcaagtttgctagtacattttaagggtttttaggtttgtttttgcctcagaaagcaacatgaaattgaatgaaacccagaaaagcgaattgctaaggtgaaacacaagaggaaacatgtttttctactaaatggtcatttattaaacagctcaaggtaagtacgtaaaccacactaaacagagtaagcagcaatgtggagagatcactgagagagatgactgcttaccatagactgcagacgctgggcaagttggtatgcttctactgcatcttttctgtctctgattcgtactttgtcaactgtttgtggcctattatacacagcctgttctattggaattcaggaaagataaaaccatctattattttgtgaaactcatttgttaaacagtaagacacatgtacactgactatagtggggcttctatgactcttatttcacgatcatacatttgatgtgctactgagcacccctcaaattaaaagtaatgctgttattataagaaaatcttaataaatggaatatttagaaaatgggtagtttgctaactttggcagtctaatacagaaaacatgatttaatttttcttttggtggctgaggaagcaaaaatcctttagttttcctgaaaagctagtctcaatattcaaggctttgggaaaacaaagacactgaaatgaaggacagattcccgggcaaactaaattctatctagctcaatataaaagaaaatcatatctgacagaaaatcttcttgttagttgtctccctttcatagacaaacacagaatatactcttcttaaaccatgggttacaaggttttatgtaccttatcactttgtagctatgaatggttgtgtcattttaattcaataaaagagtagaggtcaggcgcggtggctcacgcctgtgatcccagcactttaggaggctgaggcgggcaaatcacgaggtcaggagttcgagaccagcctggccaatatggtgaaacccgtctctactaatcatacaaaaattagccaggtgtggtggcatgcgcctgtagtcccagctactctggagaccgaagcaaaagaatcgcttgaacccgggaggcggaagttgcagtgagcagagatcacaccactgcacttcagcctgggcaacagagcgagaaaaaaaaaaaaaaaaagagtagaatatattttaaaatatgtatattcattaactttaaatttgaaaaaaactaaggtacaattgtcttccacaaaaaatattttgacgcttttatcacatgtaagtgtagaggctcacaaattatttcctttatttaaacattgctaggtagtatttctagcatgaatacagtatttgcaaattaaatgggctattattagacttttcataaaataattttacttttatctgctaaagaactgtattcttaaattatttctattacttagattgaatattttacctttaaagttacactctcaattttcagtgtaggtcaaatgaaaacacagtttaaccaacagtaaaatcttaataaaacatttattaaataatgttacagcacctctgaattctatatacctataactacttgaattctaaccatcatagaaatgaataagtgctgtaaggataaaaaatgtcgagtaaaagatgttgttgggtttttatttttaccacatccaaaattgattgctcctatcaattcgaggtatgtatgaatccgtccaatacaattaacatctccacagttcttcaggccaggacgtactgaggtcttatttaagtattttggtttgcatatctccctaattaagagacagaagtacaattattttggataaataaaaacgtgaaaaaagatttctggggaaaactttcaatatttgaaatatctctaaattttaacccctttcaatgtataaatgtgtaataaatacaatactaatacataatacccatgtactttttttctgaaataaaatatccttaaatgatacaataacttattagcataattttttacaagcaatatttcttccccaatgttaaattcatagattccagttatcccaggaccttgaattcagaaatttatgtacagacacaaattgaatctttaaatacaaagagcagtttgataatatatagaaaagatttagtattagacgtttccaatttgtaatatattacttagattcatctactcttattttgcttaacagtgtctttcaattatcagctatcttacaaatgcttaaacattttatatttgtttttaattatgatgacaacaaatattaagtgcttactctcagtggaaaacagaaacagacgttataagggattccaaaggggaaatcaagaaactcccaaagattatgaaagaaataagaggtttatataataaaacacgtatttattgaatatacttaatgtaccttgctagatggtacaacataaaattcgagtaataaagaacttagtagaaactaattactgaatgcttaagccagattattgtgctgagttacacatccttaatctttacaactatacaaggtagattttattaatattattctcattttggaaatgaggaagcaagggggtcagagtaaagcacttacttaaggaagggacataatcaggattcaagtatagatattataaatttaggtattcagatatctcatataacatgggtatttctcattcgatcattattttattccatgaatatattgttctaagcactagagatacacagataatgtaaaatttctaaccttacagatcttacattctaatgggagggactgtcaataatcaatgaaccatatatattacactttcaggtagcaatagtgctaagtaagaaggtcaaggggatagagtgggacaaacaggcatagactactttagatagatagggtgcttaggctaggcctcactaagcagaatagagggtaaaaataatttgtgatgtgggagggtaccacaccttccatagaaacgttgagatttcagtgtgtcttgcaagaaaatgaaacaaaattgtacaaatgaaagcaataaagcaggcaagagtatggctaccaagaaaccaaaggagtctgaaaaaactagactgagctaactgaagactactcaaagtaaaaggctttaaacagaactcagtaatctagcacagtgctgaacaaatggtaaggactctaaaaatatgttcatggaataatgattcatgttcgatcttttccccctaacaaataagagtaccttctatattctgagcattgtttaagaactagattcaacaacaaacaaaacagataaaaatctgccctcatgttgcctgcattatcatgggggttgaggggagaagagacagtaaacaaataaaaatgtaattatttgtggtagtaataagttctataaagaaaataaaatacagggcaagagaatgaaagggaggagatatgtgagatattttagataagcctctaatttccctcgaccagatttcaatgagacaagaaagcaacacttgacaaaatatgggggaagaacatccaaagcagagtgaaaagtcagggtcaaggccatgagttggaagtgtgaaaataatgagtcaagactgcagactccaatatctcctttacctagtgtgacctggaaaagttttttatcctctgtgaacctcatttttcttatctataaagtgagaacgaggttgtcaaaaggattggagatgatttaagtacagtacatggtattcgggaggcattcagtaatggtactggttactattttaataaaaatattcccctaaccagggaatcaactgcatctgcttttatgaaaagaatctttatctataaacaaatctggcaggcttctttttatttcaaaactttaactcttctatttttttttaacaccacctccagtgcctaaccactcactctcttctatttctgaacaaatgtgagttcctgttcaaaacaatttttgctttcacaatgttctgctaaatcaccataatgaaatagcaatacctaaccagtttcatgaaccaaggcaaatgacttaggaaactattgccatgtaatttatagtacctatataaattaatctgcctcatttggaattcaaaattcaaagtaacaaatatagaatttgattaaagtaacaagaatatagtgatcattcatatggacatttttaagagacaggatcttgctctgttgcccaggctagtgtacagtggcatgatcccacctcactgcagcttcaaactcctgggctcaagtgattctcctgcttcagtctcctgagtagctacaactacaggcacacaacaccgcgcctaagttttaaaaaaattttttgtagggacagggtcttgctatgttgcccaaactagtctcgaactcctggcctcaagtaatcctcttgtctcagcctccaaaagcacggggatgaaaattgtgagtcagccgggcgtggtggctcacacctgtaatcccagaactttgggtggccgaggtgagtggattacctgaggtcaggagttctagaccagcctggccaatgtggtgaaacccagtctctactaaaaatacaaaaattagccgggcgtggtggcacgcacctgtagtcccagctgcatgggagctgaggcagaagaatcacttgaacctgggagacagaggttgcagtgagctgagatcatgccaaggcactccagcctgggagaaagagtgagactctgtctcaaaaaaaaaaaaaaaaaaaaaaaggttgtgagccactactcctgaccaatatggacatttttgagttagttatgatttcaaggtccttaaattttggccattcaccctcttatttccaaaaacaaaagtagataccaatagaaatctaatttaactagtctttgtcattagtgtgaattaggccatgtagaataaaagagtgatttacagacacatgaagactgaagtccttcatgtgtcagtgactggttgtataatccaaggcaggtccctaaacctctcctgatctcagaatcattctttatcaaataaacataataccatctgcattattttacaggattgttttaaaaaatcaagtaagatgatgtagcaaagctctttaacaactataaagcactatgtaaagtcaggagttgttccttgcaagtattctttactatgatgccaacctaacccacatgttgtactttcagcacctccaccatctgtaagataactcaagaacaaacctcctcctttaagaatacagccatctttaaaaaccaaagacttatattgtgtgggtaaaatgaaggttaccgatttattatagcaagttgttttcctttggtaacccttctaggttacagcaggaagttaacaatagcaataggacaggaaggctttccatacaaaagagaacaaaggacaaagcagaacccctgctcaaggaactaggaagctctctgtaaagatggccctatacaatttgatagcttctgaaacagaattagcaattatgatttttaaaaataatttttttttttttttgagatgaagtctcgctctgtcgcccaggctggagtgcagtggcacgatctcggctcactgcaacctctgcctcccaggttcaagagattctcctgcctcagcatcctgagtagctgggattacagacacctgccacaatgcccagctaatatatatatatagttatttttagaagggacagggtttcaccacgtgggccaggctggtctcaaactcctgacctcaaatgatctgcctgcctcagcctcccaaagtgctgggattacaggcatgagccactgtgcccagccagcaattataaatgtttaatgatggtttaattaagctgttttaaaaaattcaaattaggctagtaaggtgggaaattttggggtttgttccctaagcttcattaaataattcaaataaacggtactgacaatctagagaataagcttcatctatcagaaaactgtatcctgataaaactggatgaagaaattaatagcacattattgtcacaagttcaaagttaaaagcatttaagatcactatttagaagtgtttctgcaatctggccacatttaatactactgctgtcatcaaatttttctatctttgtactcaaagtacatgataaaccggaaagaattatttcccttttcccgtgcagtggtgttctctctatatcttcctaacgctgtcctaggagactgcttcataaagcaatcgtctatcccttttattccaggcccacaatctaatgaataggcaaaaagatgggttatgagagttataggtgataatgtttaccaaagctttttttcattacaagaaatcttaaatcttccctactgtagtgatctctagatttactagcaaaattctaaattctgtataggcctaattaaaatacttcagaatatcacgttttaaaacaacatctataatgtaattctttcttaccattgatccaaaatataatttctaattttcaaatagcgttctggtgttttagcttggcgcccctcaaaaaactcaggaattgcttgtttttcttcttcttgaatgatatttctatctatttctatttcctgttctggtggcttaagctcttcttcctcatggctttcctctaccatttggcaagaatgaaaaagcatttcattatcattcaaatttttctgaatttcacaaggctctggagaaggcaactgcctggcatcaactattattccccttccatcatgcttgttgcagtttttaatcaattcattaaatttctggtcatttaattcaattgattttttgtcaccattgctctgtttctcagtccacagtgtaatttctgagcttgaaagtgtttcatcttgcttttcattttgaagacagcccctggaagacttagaaaagagagcttcctggctgtcagaagtaatgaattctccttgattggtttcatgcattttactattaggaaagtctaacaagagatcactgctagaattcttctggggtgtttgagaagacaactcgtccacctcatctgtgatgtctacttcttcatcatcagataacttttcaatttttacagcattcaagttgggatcagcacgtccccttaaacatgatggtgtccatgcctttgtccctttatcttcatttttaacttgaagattatggccggtcttctgatttggtgtttctttatccagaccgcatttgaccttattaaaaatcaaaataaaatccccataatattaagatttaaaaatttaatcactggtacacacaaaaaaggataaatatacagtgttattaaactgaatacatgtaaatggtacattatacctctaatgcgcttttcttttttttcttttcttttttttttttttgagacggagtctcgctctgtcacccaggctggagtgcagtggcgcaatcccaggccactgcaagctccagctcccgggttcatgccattctcctgcctcagcctcccgaatagctgggactacaggcgcctgccaccgtgcccggctaattttttgtatttttagtagagatggggtttcaccatgttagccaggatggtctcgatctcctgaccttgtgatgcacctgcctcggcctcccaaagtgctgggattacaggcaatgtgtttttctttaaagggtttataataactgcattttagacaagattgggcacgttcatggtggtaggaccatagactacaactgcatttcaaatgtaaaggatcaccatttaaaatttctataaatatataactaattcatgggtctggtgatttttattaatcaaataatcatgacctatatttactacttatttttcaatattaagttgaaaacagcagcctggctcagatcaactgtatggaataaaccaacaactatcatactaaggtatcgtacaatatattgaaatatttttaaaggcttctcagactatgtgatactgtagctgattatttcttataatgctaaaataatccttaatctatctgacatcttcactgagtacattaaaactacctttcatttaaataagggacaacagaaaacaaactgtcttttgcaggcttatttaatgagcttatattatagagattatattttaatgtgatacttgagaaaaaaagagagattatattaagccataaaagtatctcccatacctgctactacagacataaatatctggtaatgtaacaacaacaaaaaaagataatgaaagtgaatgagcaaatataacatgaaataaaatccttacctacgaagtttttaaaaagtcttataaatgactaacatacataagagatatgacagctctcagaaacaggttatttatagatcctgtatcacacagaattccaggattaaatatttgaggttaactggcttactatgtagagaataaaagggtagcaggagggaaagagatttggacatattgcctgaaacagcttttaacatccctgctatttattttaagtatcctgtctataattttaaaaattcagatgaaattttgcattgatttcataatatactagtctctgttacaatatgaaaaatgtatccttctaccccaggtctttgagtaaaactggcactccaagatacatagcatgtatcttggaagcctaagagtaagaataaccaagttaagctttattctgttctgaggtattaactaaaccctggtgagctgccttgaaaatgcttctgtttggttgaaagatggagcatacaatcgatgtatgatgaatccattccattagttaccacctatgtctagacaacaccgaaacaaatcttacctacagggtagaactcattatctacatgaagagataatatcaaatttcactcaagacacttaccaattttatataattatgttcctaggcttcaaagaggatatattaaaaaattctaggccgggcacggtggctcacgcctgtaatcccagcactttgggaggccgaggcgggtggatcacgaggtcaggagatccagaccatcctggctgacacggtgaaaccccgtctctactaaaaatacaaaaaattggccaggtgtggtggcgggcacctgtagtcccagctactcaggaggctgaggcaggagaatggcgtgaacctgggaggccgagcttgcagtgagccgagatcgcaccactgcactccagcctgggcgacagagcaagactctgtctcaaaaaaaaaaaaaaagaaaaaaaaaaaattctaaatatcaaaacgacatggttgcatatagcacaaattacttgaaagattaagaaaccagatcacaattaaacctttcttaacactgcagtttattaaagtttcagacaatttttcataacaattgtaaaaatttcatagctatttaacagatttcagagtcaggatagcatttacctcctgtaagctctaataattcttaaaagtttctacaacacaaatattttaaaaggaaaagttattttctagaggaaacaataagataagatctctaaggttttctctttgaaatacaatttgctttatagtatatttttgagcaattactattttgtccatttaactttataaaattaaatagagtaacatgatacctatttaatggcaatactcaaaacactgaagatatcctctgaggttttgtatagtactatgtgggtataaaatactttaaaaacttttaccagtaagactttaatgcctgaattaaagaaatacttctgcttagttttttctaaatattatcattattaaccaggatactgatattctgcttaccttatttttaaaatactgtcttgcataactcttcacttgtaaaacagtgcggcttccaattagctttgaaattttggtccatcttcggccaaatttagcctgtattattaaaatgggaaaaaaaattgcttttgatgaatttacttaagaatagtccaagccactaccacattaaaaaaaaaaaaacttaaaaaaaaatacatctttattttctgaagcacacaataaagtcttctatatagactatgctcttaaaatcaaagcctacattcattcttttggaatctgaactactgaaaactgatggaaatgatttagaaactcctttttaaaaagaatagctatctaaatgaagatattgcctaactgaatgaattcatattgtaagttataatgttccatatctaaaataactttttaaaataaataagtgcctgaaaggggtacaggttacattttccatttatacgatcaactgaacatgttctgtgctaatttcaacactttttttaactcagattccctattttgcaatatccattatgtatctcacagcagagacttttactctatcagatatcacagtgaactgacctaaaagactaaatcgattaaatcacaaatgaggaagtcctgcaacaaatgtcttctttgttaagatgttataagccccaagttctaactacccgtttcattactcatcagagtttctcttgcatatgtatatgctgcacacatcaacaaactctggttttctcctgttaatgtcgttgtcagtttttatttcatttttgagacagggtctcactctgttacccaggctgagtacagtggtgtgatcacggctcatgcagcctcaacctcctaggcttaagcaatcctcccacctcagccttcccagtagctgggactacaggtacgcaccactttgccgggctaattttttattttttgtagagatggggtctcactatgttgcctaccctccaactaatgccttctgacacctcccacatccaggtgtcaaaggctgtgcacgtcataacactgaagctgtggagggaaaaaaaaaaatgacaacttgagggagctcctgtgtgttctcaagcacagaaaggaacacataatttgacagctaaaagggactgttaggtatcaagtctaactataatttaatacgtaaatcctctctgcaatatccccaacataagatattctctacttcctaaggtagctaaataattctatatttttagaattcttaaaactatgaaaaaaacaaaaaactagccacaacttaggaaaagttttgtcagatttacaggccaggcagtcatgccttacggtagcaaatcattttcaaagatctcacccaagtgataaaccttaatttaagtaaatttctgatactcattagaaaatatgacatatggacaatttcttaaactcaaagtgcttctgaaaattattagtaaatataaattaattatttaagattgctcttaacacctagctgagatcaacttgatgaaaaactacttatctttattgtgggatgaagacaaatagataacattggtaggtagcatggagcatttgtggagacaggacagatctggattaagatatgattagtagaagagtagggacttgggcactagaaaaattggggaaagaacacgaacaagaggagcaaagaagccaggcacagtggcacatgtatgtggtcctagctactcaggagactgaggcaaggggatcacctgaactcaggagttcaaagcctgggcagcataacgagaccttgtttcttaaaaaaaaaaaaagaagataaaaaaaggagcaaagaaaatattcaccagtttcaaaatagagcaaagggagagtcccatgcccaaaaaagggaaggaaaaaagcctttcttcatcaatcagtaccacccaagtccctactcccaagcctgagagaattcagtctgtaagcaaactttatcaatggtttaaaaaaaagctgaaaatacaactaataattccatgcttgttgtgtaggaaaacattccaagtttaaaatctcccttaatgtaaatagacagaggtctacatatctctatataaataaatacatatttacttatatatggacaaatatctctggaagaaaacacaaagaagacactggttaccccgggcgaagcgaactgaaggctaagatgagagtgagaagacttaataccctataactttaggaaccttttgaattttaaaccatgcaaatgtagtccccataagtaccaccaacataaaaaataacaacccaaaaatgaaccttaaattcaatctatttgcagatgtaagcatatatgttagtacaaactgcaccatgttgtaagctccctgctattttgcagacctttgtcgaagtgaaacatttcacaggggttcaggccatgagaagtatcctgcctaaccacctgactacaagacaaacaaaggcccaactaaagaaatatccctatcctatcttgcttgacaaaggtccaaaaaacacctgaacaccacaacgacatcccgccggaacaagggccagaactgcctcatcatgggaacatcttatcaatgtcctgctgggcagcaagccatactgcccagacctcttctgccgatacctataaattgccccaggctataagcagcagcgggctctggcattaggttggtctcccacttctgtaggttttatgctggacataaagcctgcatttgctgctgagctgccctccttctgcgtgtgtgtgtgtgtctttctttaaccctcacctcctctttaagacctaacattatgtatctggtctttgataaggggcaaaacaccaaagttgttaggaatcttaaataaatgattaattaaagttagatcatataaatgataatcatacaacacactgaaatatcaatataaaaaaaaaatcaccagtataggaacaagtcttgaagagataaaaacctcaagatcatttatatatttatataagaatatcatacagtatacagatctcatggtgttgactaaaatacaaacacaaacattttattctcatcatctgtagaaatgttaatgatacttcaattagcatacataaattttatatatacaaatattctatatatgtaatgtataaatatacataatttcaaaattacttagaacattactaggtatcatgcaccttaaaggaaaagatataaactaatcttgatagtaaaaaaattaaaaaaaaatcctaagtatttttttttaaagtttcttcatattaaggggtattttcagaattagaaaccagaatacgtatcttttccattatgcaacttgtgaacatttaaatagatttcagtgtaatagacattcacgcaaaaaaaaaatgtttctggtcttcatttagagtcgctgaaatatttagacagtgtatacaatgccaaattatctgaataaaaactcagctgatcaccccaacagtttcaaatatacaagtttttattttatttcaaaaaaaaaaagagattactaaataattttgccttttaatccaggtagttggtgtcatgtatacagatatacctcaatttcttggattttgataataccacaagaacgtgaaaactacagatctaaatctattttagtattttagtaccttagatctaagttaaaaggaattctcttgcactacactataaacatcattactctaactacagaagaactaaaggtgttaaaactgtaattaaaaagaaaattcaggtctctataaattaatttaaccttataactttaccaatatttgcttctagaattattttactaaaaatttaaaattgctctatttaccagcccttgttcaaacagctctttttcttctatcgtccactttactgagtaactggctggttttgtaggagagtgtaccctgaggggaaaaaaaggaattgcaaaaaaaatttctgaaatggaacattccatatttatgtaactaaaggttatagatagccatgggctaaattcaatactttgagtctaggaattaaaaataaacaaacaaacaaaacaagaaggctacagcctctacctgggggcagagatttaccctgtcacgtgtctctagctcaggatgatgggagccccaaaagacataatccttgggtctgagtgagggtaacactaaaagacatcaaaggaagtcaatgtgataacaaacaaataggctcccttagactggatacaaagcagcaggtgttaatacattcccaaatcctgaaaggcatgtaagagtttaaattggttccacaaatactatctctttagttctttcatgtaaatccatgtaaatatttagaaaagaagtcaaaaactacagcattgtatttattgcttttaaaattcattatctcaaggaattaaaaataaaactgatgaagctcactaatttaagcaacccattaatccttttgttaacttcatttcattgtttattcagcaaaatacaaaagcaaaaggctgctcagtactcaacctcttgggcaattgcaaatacgtaaaccaccctttaaaggaccataaacttccaaagtcataaatgctaaataatgttttttcaattatagggaaaggatatttttaaaatagttaatttctccagataatttttgaaagccacaaatccaaatgaaaattttgttgaaaataagtgaaaattaactgacagagtaaaagaaatcaagtcaattccaatatatcacataacagcttctcaaaatttccccataaacccctggacaaccatatttttcacaatctgaaagaattgcctacatagggccatgaaagaaattctggcaagtaaataacaccataaaattatacttgtgccactccaacatctttattaaaaaaactgtttttatatctactttaaggtcaagagggcttttccacaggccaactataattaaaaaaaaattattccataatttttaactaatgaaaacagatttataaatataaaatataagtacatacatgatttttgctgttttctgcagactgcatcacatgaaaaaagaaaataaggaagcgtgtgaggtttctaaaactacaatccagacttttagaaatattataaattgattttacctcttcatgtattttttatcatcttccttttgatcaagccagactttttccggttgtgattttttagataaataatatctgtgtaactatcaaggaaactttttaaacaatattacagtcatgtaatttttacattacttatacaaaacgtgtgctacataaatgttattaatagttcccttgtcttcccaattagaagtgactacaagaaacagcctccatgtttaaatcaagcttgtccaatcctctgcctgcaggctacatgtggcccaggacggcttcaaatgtggcccaacacaaattcgtaaactttcttaaaacaccatgagattattttgtgatttttttttttttttttggctcatcagctatcattagtgtattttatgtggggcccaagaaaattcttcttccagtgtggcccagggaagccaaaagactggacaccctggtttaaatattttcttccaaaacatatggagaatgtaataggtaaacttggttggttgtccaaggcaattcgggaataattttccacatttctaaagccaacagagaagaatccaaggatcttctctaccttaataaaaattgcaaacatttagatcaaatctaccagagaacttccctcttaaagttattagaactagcctgatgaggccaggcgcggtggctcacacctgtaatcccagcactttggaaggccgaggcaggcggatcacaaggttaggagatcgagaccatcctggctaacacggtgaaaccccatctctactaaaaaacagaaaaaattagccaggcgtggtggcgggcgcctgtagtcccagctactcagaaggctgaggcaggagaatggagtgaacctggaaggcggagcttgcagtgagccaagtttgagccactgcactccagcctgggcgacagagcgagactccgtctcaaaaaaaaaaaacaaaaacaaaaaactagcctgatgaagtactttaagattagcctgagatattcttcacttaacaagtatttattggctatctactgcatatgtcaggtactatgctaggtatagatgctgagaacaaagatactctcattatttgtttccatatctagaagtgaaccactgactacttaagtgttttatctagacagtggccaccaaccacatgtgcatcgctggtttctgaccagtggaaacactatttgcatgaactaggatgtactctaagtataaaacacagtggattttggccgggcgcagtggctcacacctgtaatcccagcactttgggaggccgaagcaggtagatcccgaggtcaggagttcaagaccagcctggccaacatggtgaaaccccatctctactaaagatacaaaaaatcagccaggtgtggtggtgtgcgcccataatcccagctactcaggaggctgaggcaggagaatcgcttgaaccagggaggcagaggttgcagtgagccaagatcgcaccattgcactccagcctgggtgacaaggcgagattccgtctcaaaaaacaaacaaaacaaaacacagtggatttcaaagacttagtacaaaaatgtaaaattatctcattaatgtttttatcttgattaaatgttaaaatgagaatattttaaatattttaggttatataatatatagttaaaattaatttcctttgtgttaaatgaggatatcggaaaattttaaattatatgtgactttctctgaatagcaataatctaggctataactgcaatgtctggggagaattagagaataagaaagcctaaatggggttaacctatgataattaaaggtacagagacactctaaaatcaacatggcaataagtggaaatagtgggaacagagaaattctggcttagtaaggagaaatccataaaatgaagatgaaggagattaataaaccactacttattagactatgactagctatctttataaatcataaaatcagaaatcatttcattcaatcctctccttttacatgtacgaaaactgagctataaataaggatccacaaatgtagggaaaacatcttcattctatagtatttgttttgtgctttttatttagattcctcccacgtaacacctgtaaattatgaagtgagaagaacttttacatgttccaactctgtgcccttggaaaattaacatctctgggtttcagcttatataacttaaaaatgcaagcttggacttaaggttcaaaatgacttaaatattctatcatttctactcaatattcagatatcataaacagttggctagtgacagaaactcaaaatatgcaatcagatctcagatgttacagtaaaacagaacctgaggaagaaaatgctgctttttgcatacataggtaacatgaaattatataatagcagtctggtgctgtataaaatccatctagtaaacagtggcctcttgtaaattttgcatttatagatttttttcaccctgaaacctgtactttcctcataatcattaaaggatactcttcttccaacaacattttctcaataacagctctgttctcttcactgatggtgttatccaaggtccaaggctattaaaaaagagaatatatttgtctttttatttattgctttttgaaattatcttctgttttggtaaagaaaaatacatgttataatgattataaatgacagtcaccatttactgagcacacagacatatttttgattaccacagtaacattgagataggcattaatactttacagaagcaaccacagcactactagcattttaagtggaagagcagagactttacacctgagtctgttggattcccaggctcatgctcctgcccaggatgaggtaataatcgccattcaaaaaaggaatcatttgttaggcatcagacactctgtcagacacttaacctctttccaaaactcaccactaactctcctttttcctcagttacaatctccatgatcctactcattttcaacgctccaagttaagtattttcagctcatatctcttcttcaagctctaggccataatacccaacagcccatccgagatttctacttggatatctaattggcttctagaacttaacatatctaaaacagaactcaccatcacttatctccacctgcttctccctctgcattcccaactctacgaaaggcactattactcactaagttattccatgtagaaattcaggaatcattgtggattctttccttttcctttgatgcccatatccaatctatcaaccagttctacctccaaaatataattcaaatctatctactctatctcttctgctactacctcaggccaagtcccaatcatcaaatcttgcttccattaccgtgaatgtttcctaactggtccctttaactccactcttacttccctccaatctttaccacagtacccaaaattaattttataaaaataaatttgctaatctctattaaatctatatgaaatgtttcaatgatgtcccagttcctttaaaacaaaatgtaaaccctttagcataatccgactcataagtcctgcatgacagaactctagcctgcctctccaaccttgccacatgctgccactccttcctttcccaccatattctagacactggccttcaaccagagcttctgtagttgctgttccttctgcctataattttattttaactgttcacatatctaccctttttcccatcattttcaacttaaatctcacctcctctgagattccctcactgacaatttaatctaaactaggtttcccactctggtactctcattcagcatcttgcttatttccttcaaaatctattattagtttgtctacctgtttattacttaactccctcttagaaaataaacttcttgagagcaggaacacgtctgtcttcattgtagtcgtattctccaagcctgacctactgactggcaccgagtaagtactcaataagtaactactacatggccgggcgcggtggctcacgcctgtaatcccaccactttgggaggctgaggcgggcggatcacgaggtcaagagatcaaggtcagcttggccaacatggtgaaaccccgcctctatgaaaaatacaaaaattagctgggcggggtggcacacgcctgtagtcccagctactcgggagactgaggcaggagaatcacttgaatgtgggaggcagaggttgcagtgagccgagatcacgaaactgcagttcagcctggcgacaaagagactgcatctcaaaaaaaaaaaaagtaactactacatgaagaaataagccctgtgacaatcccattttttttttctctttgagaccgggtctcattctgttgcccaggttggagagcagtggcacaatcagagctcactgcaatctcaaactcctgggctcaaggaattctcctgccttggcttctcaaagcactgggattataggcaggagccaccttgcccacctaccacttttttaggtgtaaagaaactgaagttcacaaatttgagaagtggtagagcaaagacctgtacctaaatctagctggctccaaacctgtttctcaacaggccatttttcaatgtcaaaagaaagaggtttctatttttaaagtaaaaaaaaattctaaatttctaaaaaagaaaaatattatatctgtgatagttgagaactagcactaagtttaaaaaaaaaaaaagaagaagcactctaggcaataaataacagcttaatgcacctgatatttttataaaatacttacaataaggccattctctgttctccaagatgaatcaagatagtgatctttttgtaaaactgatgctgtattttcaccacttctgtaataattaagaaaatgagtatataagtgaaaatcatattagttaatgaatgtaacttacacagcacagaatccagcaggtagtaagggaactaagcaaatacttagttcccttctccccttaacaaacagatttaacattgtggaaatgcctgctctacctctttggcctgtgaaacacgtggtagtgctaagctaccccatctcaattgtgaaacatcaagtctgactgctcacttcttttggttctcgagaataaacaatctcatgaggaaaacaataccccaaagcagcaatcacaacatgctctgtgacttgaaccaacaatgcagtttcagctgattagtaccagtacccatgtgtatacaggaattcaactttgtgattaaaccttttagctgtatctaaattataaaaaccaccatcaatagcaccacctataaaatgaaagaaaaaaaaaaaactagatgagagaaccaaaacagaaaatactcaaagaaggacagtacagtgaatagataagaaaaatgtggttttaataacaactcatataatttaaaaaattaatttgatttggacgcttttcaatgtccatgggagatcaaactttttaaattatctcactcgtttcattaagctcctaagagctctttaaagttacattgtttaccccatatttgaaaaggctgagtaagttttggggggctcaatccatgatataaatttaatattttgcttcgttattgactttttctagaccttgtctagtgataagaattttccatctctaagactgcaaaaacctttcaacaggcttataaatctgaatctttaattaggcagtagttataataaattgtggggctaatgaactattctctaaaagcaatcatttctctcaactgttgatggtaaatagatttaatcttaaatgtcaactatgatctggaagaggctaccaggaagggtaaataaaggattctgagacttttatcagctcaaagaaacctttgctcaagtaactaggtctgccaagagttcagaaaatagaaccactatcatttcaaattcactgtagaaatctttttattcctcaataagaagaatcagcaacactcatactctggtagctacttctggatctctacctgaatctccataggtaccacatattagcatgtttaaagcttgaaatcacctttcctcccaaatctgctactcttctattgttcaccatctcactcagtggcaccaccatctccgtagttatccaagccagaaatccaagcctgaccattttcttcacaacccccatttaatctgccctaattctgctgtttctcccattttccaaatccagtccttccagtattttcatactacctctgaggtcctgtagtttccaatcttatataattttcctggataaatgtaaaagataaagctgacaaaccattcacctcccctcctttatctttctccacccatctccatctgacatatatataggattgctgtctatgttatctaacaagaatgttctatgagagcacagacttggttttgatacactgttgtatatcagtgcatggcatgtagaaggtactcaataaaaatttgttggactaaatgaacaaggtaggtagggcgtggatcactcagatctctggtagttaaagaatgaggattttatcaaaaaaccaactggggagtgaagagaataatatgatcagatctggatataagaaagattactctgacttcagactagaacagaatggggccaaggagacgaggagcagttaagagggagagattttaaaaatactagagaaaggtgacaataacttatagctacaggacaatgtgaacaggaagaagtgaatacagttgagaagatatttagacagaatcaacagccctaaataactgatagggtagaggagtagaaggagggaggtaaggaatgatgaagtttaggtctgtgctttgggtgactgggtgtgtgtaggtgccatttactaaactagggtacagtgaagagatctggtggggaaaatttataaggtgaaactgaggtgcttgtgagacatccaggtacagatagattcagagaactggataaatggatctgtcacttaagagagagatctgggttggtaacagattcgggaaacatcagctggcaggtcaaaaatggtttaacactggtaaaatttcatatggttcaacctaacaaagagaagttgaagtcttaagagggacagtgtggtcagtgaatcaaagtccaatgagaaaactccttgcaacactaggagtaaagaacataagaaaaggagaatgagacagaatggtagaagtagaagagaaaccaaaaaaaaatttttttttttttttgagatggcgttttgctcttgttgcccaggctagagggcaatggcgcgatctcggctcactgcaaccttcacctcccagggtcaagcaattctcctgcctcagcctccctagtagctgcaattacaggcaggtgccaccatgcctggctaagtttgtatttttagtagagacggggtttctccatgttggtcaggctgatctcgaactcccaacctcaggtgatccgcccgccttggcctcccaaagtgctgggattacaggcatgagccaccgcacccagccaacccaaaagtttcaataccatcttctaactttgacatctagcacttaccaagtgcttaaaagtgtctattaaattaattctcaacggtttcacagatgctataatatcaactgtaactacatacttcagagagtaccatcacactaaattccatacggttggagctccaacaccactggacactatttatcagactatatatatatatatatattttttttttttttttgagacagagtctcgctctgttgcccaggctggagtgcggtggcgtgatctccgctcactgcaagctctgcctcccgggttcacgccattctcctgcctcagcctcccaagtacctgggactacaggcgcccaccaccacgcccagctaattttttgtatttttagtagagatggggtttcaccgtgttagccaggatggtctcgatctcctgacctcgtgatctgcccgcctcggtctcccaaagtgctgggattacaggcgtgagccaccatgcctggcccagaatataatattaatgatactccttggggttgtataagacaataattgtaaccatcatcaggaaccaataacctttgtaatcctgcttgttaccacaagtgccaccagtagacctaggcctcaactaaaataggaagaaagagaaaaggggaaaaatgaaacacaatcagaaagataaatctatggaagaagcatacagccaatgccctcaggtgaccaatcttcagtgtttccaaggccagctcatttctttctagactgcagataagtatccctgccaacctatttcattaacttgttgcgaaaagtaaattaaatcaaacatgcaaaagcacttggtcaagatttaaacactaaatgaatgtcaacaagtattgttattaagggctccctactcatctgcaaagctttgagggacaatgaccatatgagtttaatcacccctcacgtctttatagggctttagagttcatgatacacttctaaacacactatcttagtgcctcaagcgctgggttagtacttctcccctgttcacagaggccctaatattaggctgaactacatgaagttgccgctttatagaacaaaaatggtctaaatattggcaatttcatatggttcaagctaatacagttctaaggaaattgtacataattataaacaacatagctggctgactttagaactcaggctttctgattcctggctagtctaggactcttcatgactaaaaggagactcatttttgattcagaaagcaaggagtcaaaggaggttctgtgtcaaatcacactgggctgtttgttctgctggaacaggtattttaaaaaatgtgatcccttactggattctcacagtactgtccccgagggtaacaggatggtaaagaatacattcagagggcacctaccgtatgctaaagcatatctcataatcatttcatttgatcctcccaattacatatcatgactcccagtttaaatatgagcagtctgaggctcagacaagttaagtgtcttgcccaaggtcacattgctattaactggtagggcgagcaaatgcagaaggaaaacccagaactgtccaactctaaaacctggcccatttaagtcaacctgcttctcgggaagttttacaactatccccatgtggaagaagggatgaaacgactcgcccaaggtcacacggctagcaagccatagaacaagagtccctgacctcaggtctcgtccgtagccgctcttgttctagttactgtcgatgagatcctgaaaaggagggaacggaagaaggaatctaaatgtaaatcaaacgcaatgtggtaggcgaaatcggtgccctcacagcatccggcaaaaggtgaaagcgacccaggagtacctgagctccaggtaaccgccctgcccgctgggcttgggacaagccggcgggcgaggtgcctcccaggccaacaagagaccctggcccaggggacagtcttctgttcccttttcccttgccggacctgcagctttcccagggcccgctccttcaatccactcccctctccgccccagagagacccggtctctaagcctcaccctggctgtgcccccgccgccgctaccacgtccccttcgatatccacatccgcctcttcagccgccatgatgggacctgaccccgtccgtc

SEQ ID NO: 2612 - DNA, 394441 bp, Homo sapiens
  source 1..394441: mol_type = genomic DNA
cttgctcatcgtttccatacagttttatttgcaatttgttggaaccatggagaacaatcggcagatacacatgttgcttctgggaacagcattcaactccagatgctttttctgctaaggagcagggccacaggtggccctcacacccagtgctgtgctgcgcggagggctgtactgaaggttctgaaggcctggtgagtccccctcacggccagaaggagagacccggcttcggcttcatggccggcctcccgcaggtgtctgcccagctcctctgcatcccagcgcccttgctggaggctagccaagaggtggtcaacaatacgtggatagaagggagtggagacacacttcaccagcagcttggcatccaggagcagggaaagaagttcttggtcacaattggaatcattcaccttcaagaaataagacaggcacagcgtgagggggtgtttgctttgttcgcctcccccttggatccctcgctctccactgggctgccttcatcatcattcatgccctggcctgggtttaaaagcgtgtgtgggtcacgagcacctctgaggtaggtcacagattgggatgacagacggggctcctcttaacataagaagacacaagaaccccactgcaatcatcactacagcttccagatactgggtgccagaaactattcaacactgtaccagcatctcttcaccaaggccttctgattcaaccccgtgactggcacttttacctcccaattgacagaaaaggaaactgaggtgtagcaactttgcttaacattgtaaccagttgtagagccagattgtaaatttgggtcaatcttgacatcaaagtctgtgctcttaacaaccacatttactgtttcatttgtactttcactgtgatccacattctttaatgctgtatctttcttgaatataaatacacatgaaaaaaatttttttggaacaagaaaaccttttttgtactccattgagagaagagtatgtccctcaagcccactgatacgagtaagataaccaacagtggggttttaaactatttttgcttcagcctctaggaagctcagtaccaaccttgccttttaaaaaacggtttcataggttctttcagtttgcgtattctctttctccctggtcttgtcttctaaatatatgtattattttcaatatttttttaaagaatcaagtccacactgatcatattatcaaaattcggagcttctcacttacattggggtatcataaaacagattcctgacaggcttttcttaacgttactgtgcctttttaataatttggattgtaggactctcagaaataatgtcaaagccaattaactaacgtttagaccaactatattatgcaactgtacacaatgtgctcttcctgcatgttctgtgacaaggaagaaaggctattgaagatgcgaaggtcaactgtgtctacttgtctactgactgtgagaattaaagcaagagaagtactgagaataaaatcctgcccactatcggatagcgtgaatctttcctactacccacaggggtcattcaaaacccaatgtaaacatcacctccaatgccatcttcttgctgacattttctttaactctcttggccaatacttgggagtatgaccaaggattcctccttcctccatactcccaagatgcctgagatctgcctcttcatgctgtatgataagtaattttattttatttatttcttttttgagatggagttttactcttgttgcccaggctagagtgcagtggtgcaatctcggctcactgcaacctcctcctcttgggttcaagcggttctcctgcctcatcctcccaagtaactgggattacaggtgcatggcaccacgcctggctaattttttgtatttattagagatggtgtttcaccatgttggtcaggctggtctcgaactcctgacctcaggtgatccactcactttggcctcccaaagggctgggattacaggcgtggccaccgtgcccggcctgtatgatagtaatttgtatgtctgtctcccttaccgactgggaaattcttgaaggcacagaagttttatcacttttacatttcagctccccatttcattaacatttgttaaatggctgagtgaacctacattatgaaactttgtcacatttttgtaaactgcacaagtacacgataaagaccctacctctcagagagactgaatagaactagactccagaacagaagaccctctctgcaaaccctcagtgtcttttctccggcctcccaattcatgaacacttgtacagcccacctttgaccccacctttgacccaaaacacttaggttgaactccaggaatttacctttgtttttgtttttaggagctagatgacagaaaaagccaccggttcaatggacttgcttttgtgctggaaggggcacggagctttgacttctcctcgctggggctgcctgtgagttctgaatgccttctttccatcccacttctctccctgtctcttcatgcctagcaaacaagagtctcaaccccacagagctcctgccctcagcagcacggtgtctacgtgccagaaccctgagaggcccttgaagtcttcagacatcccttcaagacagttctcacctcctctgacagaggcaggttcagtgaggtcaagtgtgatacagttgctccatggtggagtggcctagaagcccgtgtctcggcctagtttacttgtttattgtttgtttccctccagaacacaagttcctatggagcagagatcttgtctcttctgttcacccctgtatccccatgtccagaatgggtggtcacatgctaggagctgagcaagatttgtggaatgaatacccaagtgaatgaatcactccaaagctcacattctttcagtctgtgtggctgcctccagccacgtgcatgcacatgctaatgcgtgcacacacacagggcatctgagttactgtatgtgttatcttggttcatccttcaaaacaaagaatccccctgcctaaccctgcaggacagaacagtgtgtgccaggatgctacaggcacatgtttgataagatgcacagataaaaggctcagaatctgaacactgcagggcaatactttctttgttgccctgaatacgtcttctaggctgggacacctttattattctttcagtttactcactaaccctcccctctgggagcccgacagtctcctagagaggtagtgatggattcttccagcctgaggaagagacaggggttctgttaacgcctgcggccgctgctgctctcattcccttcatagtttgtgtttctatccagtgcaaccaaatccttcccgtgtttctggctggatatacccagcttttcagaagctgctctcattctggcagggagggcaaggggtggggaagggcagggtaggctgtcttttctccaaaagcctgctgcttgccttcttggctgagaatgcctaaggctaaagacacggaaatgaaatgcatgcttccttccccttggccccggcccactcagaggttccctaaagaacgataaaggtctgcgtttgctgacctgcattgagcttgggcagtgagcagggaaaggttgggaggaattttgggtttggcttcagataaaatcaagtgctggaaacgcagggtgggtgactttatcttatttcctttctctgacattctacctgggcctggctctttgcaagaaatacagaatggccagagtatactttaagattgtcagctgcacggaaaatactgcatagataatttttctgtgtgtatttgggaacaaaatagaaaatgaaagaagaaagaaagagatggcctttgtaatgacccattccaacaagtacattttaaagagtcgtctgaggttcagagaaggaacaggtcatagacagccaagatgttcctttctacatatcagggcaccaaggccagacagaatccttcccatcagcacagccgagtgctgggtgtcctgtcccaaagcactctccaacactgtgacatcagcacactgctgagttgctggattaatttgttaagcctcaagttgtctttgttttttcttgtttttgactaaaatttgtactaaacatactaaaactttagtactatctgccacagaagcttggtactctctgaccatgcattattcattctaacctactttttctttttaagataaaaataaaaaagtggaaatagttggaaaaaaacatgccaccttcttgctgacattttgtttaactctcttggccaagctgattcctccttcctccatactcccaaggcacctgaggtctggctcttcaggctgtgtgacggtaatttgtatgtcatccatgtttgggtcaccacaagagaattatttcaccctcctttcctctccagtaactgtccatgtgcatagatttttttcccacaattaatcgtatgatatttgtattctatttttctcattatatgctaagaatttttaaattgttttttacatagttttcagtcttaaaaattttaatggctgcaaaatagttgttataagttatttgacttctataaatatttcagccattttaagttgtctgatattactgaaacactaccatgaatgtttttttgcacatactttcttcttcatcgaaattatcggcataggacaagttaccaggggaggtatcactgcagtgttacgggctgaactgtgtcccgcacaaattcgtatgtcgaagcccttaccctcagtacctcacaatgtgactttatttacagacagggactttaaagaggcaatgaaggtaaaatgaggtcatcaggatggactccgatataaccggtgtccttacaagaagagaagacaggacacgcacacaaagcaagggtcagccatgtgaggacagtgagaaggcggccgtcgacacgccaaggagagaggcctgggaagaaaccaaccttacaccttgacatcagacttctggtctccaaaactgtaggaaaataaatttctcttgtttaagtcacttagtctgtggtactttgttagggtaatatgagcaaattaatacatcaggcaaagtatctgaaacatttttttggttctaaatatgaatgtaagcacaaccacataatgatgtcaactgtgccagcttacagcggtgacatcagcatgggaatgcatcagtgtcacatcacgaacttctcagctttaggtgttaatattttgataggaaaaaatcacttgctaatttaggagatatgtaatggtacctcaaggttgctttcatttgaatttatttgcaagaatgaatttttccataaatttcctatcatttttattttttgttgtgggaagaatcaatcattcactcatttaggagagttataacagcttcccactctttcacatgtgaaggattctctgtataactgaaatcttaaccctgatttttgttatcatgaacattctaacctattgtttacagttctgtttcggttgttttttgttgtatagaagttttacactttcatattgtcaggaaaggatctactcctttatgacttgttttattgctttaaaactcagaacttacaattcctcaaaggaactgatatgttatttttatattttctgacttttaacaacatttgacttttaaattgatcagaaattgactttggtatatggtctgtggaaaatcacacagccctgccagtgggttgactggtgcttaaggggcatgagaaagaaaatatattctgtcatttttggatgcggtttggatgtgagaaataaatatgagacaagtccagagaattagttgacttaattcccctgatcaaataactttgaattacagtgagagatagtctggtgctatgaaaagaagacaggcttttgggttagagacaaatttccaatcctggttctgtcactaaacaactgtgtgaccttgttcaggacgatctctctgagctccagtttccacatcagaaatacacactgtctgtaagggttgggaataatacaagcttttaagtgcccagcacaatgccaagtgcagagtccaggttcagtaaatagctgatgttaatacaggcaaacaaatcatgagaaaaggattttctagaaagggaagggcttatatatatcagaagatgagtaaaatgcttgctatctctgtcagagattgttttttgtgtgtcagcaattaatttttgagaataaatgatactttacagatcttgggaaagaaatctattaaagcacaaagcactgctgtcttccaagccattaaaatgttatctgcttaattcctcttccaacaataggtaatgaaccttctctgatttaaaatctttgattttatggatctatatcaagctaagagtaattacaataatgaggaaagctgaaattccagaagcataatgcatgcagccctcatttcatttgctttcaagattatttaatactatttcactgtttactttagggaaacatatttgtcttgttctcatatatactattactaataaaagttattaaaatatcaaccacaagggtagaaaaataaaaggacaacgtaagtatacgcttgagaaaaacacatacagataatttttgtattctgtatttacttgaatatgatatgcagtttccattttctcagcataccatcagtttcactcctggcatggcacttaatggaatactacttctgaaaccaaaactatgacaaatcatctgctcacgatctcacaacgagacggagacaatctttgaaaatccaagcttgatcacctctgcaaccaaacccacatgctggatttgagggccctgatctggctagttccacacgctgtacctacctccttgctaccttcgttaattcttcgtgttattatttcacatgtcaatctctccatgagattattcatttaagcacagggataataatattttatcgcatctttacaagcgtcttacctattcttcacttcatacacagtgccaggctgtgcacaatgcatgcttgatatgtctgttcataccaagtaaattaaccaaccactagtgctgtttaggaatcccaggctgacctgcagagtgagctgcctattgctggacgcatccagacaggaggtacaagtcagatctctgtatgttcaggttaaaacgatagaaataaatagacatacccacaactttgaaacctggacagagttaaaggggaccaaagacaggaaggtttcttggttttgtataaatatgtcgattcacacatgcgtttctgaaaatctttatggttctccccccagcttggacactggccactgtaaataatgctagaaggttctggtgccttcatggcaagattacaggggataggaatcacatttatcaaatatgtgaaggactgtcactggaagaaggacattagtgatctgagaaaatccccagggcaggactaaggtcaatgtgttgaagataaaggggtataggtttcatttaggaggtgctctcgtgtcataatctcacccaaaatggcccagagccccctgcagtgttcagctggagcctgggagagtaagtgggcttaaaaaggaagcacagctaggcgagttgttggggtaggtctgctctagtgttttgcagagctaatattatatgcctcaaggtgctttcaacaacttcattcctctgtagaaataacccttttccaatataataaagccttcctacttaggttaaaagcagaagcatggtggggtatagactttgaatgttaggtctggtgtttacatttcagctttggctgcttactagctgtgtgacccctgagcctcatgttctcatctgtgaaaccaaaataataatatcttctcatacaatcattaacaaaaaaagagaatgtacctattatagtacttggcaaagaggtgggatttgcaagatggtaattattgtcatcaaggagaaacccttaattaggtaccggaggtcctaaacactttttattttttatttatttatttttttgagacggagtctcactgcaggctggagtgcagtggcgcgatctcagctcactgcagctccacctcccgggtccacaccattctcctgcctcagactcccgagtagctgggactacaggcacccaccaccacaactggctaattttttgtatttttagtggagacggggtttcaccgtgttagccaggatggtctcgatctcctgacctcatgatccaccctcctcggcctcccaaactgctggattacaggtgtgagccaccgtgcccggccaacacttcttttataaccccatgaattactattttaatagacagcacagtccaggacaacccctgggatgaggggttgcatagaggcattgagcagtaccaaagaggaggaagcaatgaagagcaggagccgttacaaatcgggaattacaaaatgggaattttcagcatacaaagccgttataaatacgtatctgcttactttgatgaaacaagtcaagaggcttccatccaaacagaaaatattccagagatgcgagtcaaacacatcagcagcattgcccatcttagagagaatacggttttgaaagtgagctctcaattttactgagagtgatggagaaggtaatccagaagtctataccatgcagggttttaattgttcatcatcaatacaatctcaaggaaggactttccatttctggcccaggaaagaggctgttggccatttataaaaggttacacgcaccagaggtctgcaatttcggaaaagcttagagaaagaaatgagtactactgctagaggaaaagtcagtacaatctctggcatcagcacttaagcatcatccttttaactgtaaacacctataaagctgtcagtatcttataatgaatagcaaaataatacatgctatcagcaaacaagtgggggtgtttttaaacttggatctgcacaccatgcaggagagactgctatcaacggagtgcctctgccagatgtttttcttttaatgtcaataggagctactgtcaacaaccaataaggggaaaactgaagttattgatgaactcaagcgccctgctaatggacacggtgaatagcaaaataaaagcaacaaaaagaaagcaaaagttttctatttttcattgcaataccaaggatgacttaaaaacagctagacgtgagtcgggccaaaatgcccactgaaactcttcccttagaaaagtgtaacacaaccctttaatggtgttggaagagcaatgattaattacagtgatttcatattttatttatgtagcattttaaaatgatacaattacagagaacagattagcagttgccaggggttgttcaggaggtggggaggaagaaggtggctgtggctataaaggacagtatgagagatccttgtgtctggtaccttgactgcagttagtggtcacacgaagttacaggtgacaatgtcacatggagacacacacacacacacacacacatacactcaagagtgtctgcaaaactcataaaatctgtataatgttgacagattgaatcaatgtcagcaaccgggtcataatattacaggtaagtatcccttatccaaaaagcttgagctcagaagtgtcagttttttcagattttggaatatttgcattatacttacttgttgagtattcctaatcagaaaatctgaagtctggaatctgaaatgttctaatgagcattttcctttgaatgtcatgttggtgttcaaaagtgttgaatttgaggccattttggatttctggattagaggtgttcaacctgtatactctagtcatgaaagatgtcacactggggggaactgggtgaagaatgtgagagaccttgctatatcatttcttacaactgaacgtgaatttaaaattatctcaaaaagttaaaaaaatgtttttaaaatggaaaactctgtaaaaccttagcctctggggactgcaaaaggtctttttgtgggacacatttttagggcacagatgggctagcctaatgtgagcattcaacttaatgcagagatgttacagttcagtctcattaccgaatttctaaaaggaaggatctgaatggtaggcaagtgactcatcttagcaatttatacctgtggctttgattcttggatctgaagggcacagacgtttcgtgcgctatcatcacaaccacaggcaaactactcacagtctgcagagcagtttcaaaaccacaggcttagcaccatgcagcacatctaacgtgcagatcaaagtgttacggaagtaaatcagtgccatattaaagggacttgggcactgcagtgttaccatttagtcatttagtttcttattttgatagttactgtgtaggtatgtgggggaaatgctgctgtgtgggtagtaagattagtcagcagttagggaccgcctgtgctagttgcagttctgacagatgcatttgagataaagaatctttaaaatgaaaactgatacactctgcccatggaatccaggactgtatcaagagagctccatttatgatgaatatggaaaggcactgtataatacatcactgttttattctcaaagaggcccatggcaaatttttgtgagaatgcctaacacagtgtacgagggtggggaggaaaaaaaatgcactgagaatatgcagaagttttctcttcttaccaatttcttggatttataagaaaaaactggctaagaaaaaaactcattataattctgtttcatataaattctccaagttattcaactttcatttcagcatagataggtgggagggctacggaaaggcaagtccccttgattccctacttcagtcaaggtcccaaagaggccttcgttctgattaattattggtgatcaggtacggtattcacaaaacccttgcagaagcttttacattattttaaaaacacatctaaatgaataaaggcatttgattttctcattttattcataatgattatttccaaatacaattatattctgctttctgtaactatttacagaattttctgtatcctttgtcattaagaaaactttatatcagtgatgtcttttcatcaacctcttcactgtcttgagtagcaagcatatacctctgctctagattctccttccttctctggtccctagaagatatcctgccacatttttgtttaaaaaaatagcatgcatgtgtatatatacatatatatgtatatatacaatgtaaaattacatatgtgtgcatgtatgtgtatgtgtatagtgtacatactcaaacagacatacatacacttcaaatgaaagaatgatctccacacaaaagggcttcagtaaggatcatacaacatgagttcgttaaaacacaaccctaagctatctaatcctaaagtggaaaattttaaatgagaagagaaagtttcttcctaatcataataacaaggcaacaggccttgagggagaaatctcaagttgactccagtacattactcttcaagacaagaaggttgccagaggaaatcagagtttgagatttcagatggtgccagtaaacactacttaaacccactgtcttacctttaattagtggataacctaacacacacatccacagatggaaaacctgtgcaatgatgggagttccctagacccaaatttcaagtagcaagaggactgctagttgatggctgctttgatcttcttaaggagactaacatcctgcttctgtagaaaactgtcttcttatttggatttgtattctgagcaccaaaaacactgaatctggttcacgggaagagcttagtaagtgtttgtaaaataaacatacactgctgggacaaaacaggaacagctattgtggtcagagaatactatagatatagtagtcttcaattaaccacggtgttatttatgagaatgaaagtgctaattcattcctttgaaacattaaaaaaaaaaaaagaaagaaagtaaattcaactgggcataccgtagtgactgccgtgatttgctccagtgccatctcgtgcagatgctcatctcggctctcgaggagaagtttcagagatggaagcaggagggactggttaagcagcagcagacacagctccttcacaccctgaaaccacagagcaggggtgagcgagaactccacgacgtacttctcaccggcacggttctggctggatcattccacccctttttctgtggtagcgtgtgtgtgtgtgtgtaaagccacatatggtaccgcactggatatactgaatatgggcgttggtacctgcttcacttggttcacagtaaactgtgtacagatttccaagctatcagatattcatcgacaatattgctttttaatggctttgtaatgctcattgtacagatatagtggtataatttattttcctaaactctcacagccctaatttcctcataagtaaaatgtatgtatttatagctcctttgcaggttttgtgttttgtgtgtgtgtgtgtgtgagagagagagagtttgtattgatgaacgcagcatacaacgctcagcatatagtggaggctgaattataataaaaagtattatcaattgctaatattgttaacaacctctagttgtcattcactgaaacaaaggaaatcagcaaataaaatattttaaaatgtatctatcattttaatgtcaaaatgaattgactccttaatatacttaagacagtctatcttcacgaaaactatctgtgttgcagaaaaatgaaaatgtgtttggatccccacaggtgtatctgaattttattctcagccctgtattttaccaactgaacctgtggtcacagagcaggctttcgtataaggtaacaaatgataatcctttacaacaaaagcataaaacaataagaataagatttgcaatctgttttgccctgctgagctgtgttgccatttaggtcctgactttagctgtaacataaagaagagaacactttggaccaaaaaccagacgatgaatgactccattacactaaagcaagggttgctctaaagaactgatgatcattgctatccacgggattgatttttctctcgtgccattcagacagcagatcggagaagaaaaactcaaatttactatattttcaaaattgctttacattattatagagcatcaataaaataagaatgacacaagtaagctcgcatttaaactcaggataaagttctcttgggaattctgcacattatagttttagctttcacccagcatgtctgctcttgaaatctgcaaggccctcacgtttcagagtagaaggctgtgctacacaaacctgtgtgacaatgatcaataccagcagggtagcagtttgtaaaacacattcctcatacatcgggaattctaattcaaaaaagtacggtgtatgcctgaaagaacacgtgacacagagcagtctcaccaagcatctggggcaaagaaacaggcagacttttcatccgggatgccgaaacctgcagaagattatttgggagcatgaaacaagctcctgagcatggcactctggcctggctggccgcatcctgtggcctcttcctcctcctctcgggtcatggcagtgctccccacctaagcattccacacaaagtgatgtgcggggccccttctgacacaacacacacattctgtatctgcactgcccaataccgcagccacaaggcacaagctacatttgaggtggggctagtgcaaccgaggaactgcatttttaattttacttaaagggtttaataagccacatggggccagcggctaccatattaggcagtatggctgctgggtgctggactctcacacctccaggtgtttgcacatagtgtaacttttgctctttctctgtctgattaaccgtctacttgctctttaagtctcagtttaaaaatgcacagaaaaactatacttcctccgcaaaagcacccttaaatgtcccaggttagcactcaatgttctaaatgtactgtataaatatttcccaccttatcttttatcttgtattatggtagtcattcatcggtctacctgccttgcttttgggcaagaatattgttccttctctgtattctaaacttgcttggtacatgccatacctaaaactccttgtatataattccctctctgaacacacatttgctcactcaaaaagttatcagtgatgagtaaacatgcattttcaaggatttatgatatttagacatagcatgacacttggctgaccttggctttcatgacaaattttatggaataacctgtgtgtccctctgagcaagcataatggatagatggcacacagagaggcaaggatatccaagaagggaggaacccactttaggtgagccactgactacttttcatctcttagctaccagtgattggccaaatacttactctatctttaagtgctaaatcctctactatgtttgtttgctactttccccctgtgttgcaagagaacgtttattaagagatttacaaagggatttggggaactgcaagaaaggtcgaagcagcagagaaaagccacaaaacacgtcatttgacaggccttcgcagttcaaacctgtcagaccatgaggacagaacgaacaagagatgccttggatggagaggactaggtgggcccaggcttagagccaggccacagacctggatgtttcttttcccagtggactatgatttatgagatgcactggggcactgttcccattgtctgacagtcatgagagaagcaggaccagttcacaaatatgccttctgtcctcacacaactctcctactgtccctggagtatctagcatcaaaaggtgttgcagggcctacagcaggaactaggggcacaaggtatgcagggattggtgatgcagagaccgaggggcttatcacatgccccaggcattgcatgggggctgcaaggcagcttgcagtccttgccctccagcaggcctagaatgggctgagctcccattgctgttgcctggatgtccagaagcccctggcactgctggttctgcagccccaggttgatcacaatcttggccagctgggcctccacactggccaccaggcactgtacctgggccaactgggcactgcagcggctttggttttgtgttctccagagcctctcaggttgtgctgggcctgctgctcgacctccagggcactagccgtgcctcttggactgtgatctctaccagcaaggcagctgctctgagctgaacatcaagtgtttgttatatactttgctttgaaatgcatcatctcatttaatttctcctcaaatcctttgagaaaggtgtgatctcagccctactaatcagatggggaaagcagaggtaaaatggttaaataacttgagtgttattgcataacttgactgattctaaaaatcaagctcttgacattagcaaaagtggctcaaccctgatagagaacaatcacattgacttttagaagctgggaattattaaggctcactcatgagctgggtgacttaatcccatacaatagaccccaagcatcggtgactaacccatgtttcgtctcagcgaaatcctggaccttcagggtcagtcacaaatagcgggacctcggaattttacatctataaatgccaacaaactgtttatgccaatttcttattctacctattcccaagtcttgagagggctttatatactgccatggatacaagctgagaaggatacataacttttgagactgtggtacacaggacctgtgagaaagtcactcatcctgctggtaatattttccatcaggaaaaccatcatggccataagtaagcaagtcccaggagcaacagcaggagtcacgaaggcattctgaggagtcgtgaatttttttaaaagtctgtaagcatgggagcttagtgaaaaacgggaaatggagatgaagaaaaaggtgagtactcttaagtactctgacataaacaattaggcacacacgtttcctaaatcatggagtacgacaaccaaaggtattgaatttaggaaaaaaaaaatcataagtaacagataattttaccaccacagtgatataaaacattgtagaactctgaaattaaactcgtcaacttccaagtgtagtaaaataaacttaaaaagatactgccactttttaatagtaatgttccttcctctgtaacactttcaattcacatttgagcacatttagccatcagtaaaaacagtacataccatttgcaaatagcctctaatcacagcagcctcaggaaaacataatctataaatgtgcccaattgagagacagaaactgaggcagcttaaggaaaacgatggaaagtcacggtgacaacagaactctttgaataattatcttttgtttcatcaaattaaagaaacatgataacgacctactttgcaacgggatttaacccagtaccttgtctctcatcccgagagaattacacatttatgaaaggtagtgaattatgtgctatggatgaagcagtacacatacagcctcagctcattctccttagagaatagacagaactagcattttctcatccagcttaacctcttctttcacagaccagaaaacaaagatccagagagtttggggcttttctcatgttcacacagatgtggcccattctggaagagaaacagtacagcttcgagcattactagagttctttctgttctactatgtatgatgttccctgcccttaaggtgctcctagtcttaataaagagcagacgcagtacatcccttcccatggagtgtgtgaggagtgctctaaccgatgtgtgctttaggtgctgtgctatcttttctgacctcttaaaaaacacttagcaatcactgaccagatgattctgagatcaaatgagacccctgcaaataaacttaatgtattactctatttgtcaaagtacctccccctggctgtagacacttactaggaagctgaatcatcacagctaaatcagaacttttcatttaaccaccaagtcattttccgataggaaacagaaagcacagcttcttacacattcatcagtaaaaagaacacgctattcttctatgtatgtaaaatgtaaatggaatgctgacgagaatattactgccatggacacagatatgtctaggacttattcccaggcggctaaaagatagtacatatcaagtggtccctataggtcgttttggccccagggactggttttgtggatgaaaattattccatggactatggaatagtccaccccatggaggggatagttttgggatgattcaagcacattagatttattgggcactttatttctattagtattacactgtaatatctaatgaaataattatacaactcaccataatatagaatcagtgggaaccctgagcttgttttcctgcaactagatggtcccaccgaggggcgatgggctacagtgacgcatcatcataaggaataaggagtgcacaacccagatccctcgcatgtgtagttcacaatagagcttgtgctcctataagaatcttgtgccaccactgatacgacaggaggtggaactgagacagtaatgtaaatgatgggagcagctgtaaatacagatgaagcttcactcatcgccagccactcacctcctgcagtgcagtctggtacctgacaggccatggactgatagcagtcctcggcctggggtttggggaagcctgatacacataactgttactgagccttgattagctagctggtgagatgatgtcagggtcaaggatgcagtggccatgtcatagccaacttacattccttgccttgcaaaagttacagtaaaaccaaaccgataagagtattttaaagaacaaataaacttcttcagacaatgacagagatcctaacaaccttatatcttaaatactgatcatctagatgctaaattctataggccattcttgaaggaagtattgaaaaaggaaaactgacagtaacatttatacaattgtatgagagacattcaatattcatgtatctcccaaaggtagtaggaatggctcctctggaaggattcctttctcaagctttcaagcacagagacttgatttgaagatcagacccaccattcactgcctgaagaagcaggagcaagaccattgacctcaaaccctccaatccatcagctgtcaagtggagataaatgaatctccttacagaaggtggtgaaggttaaaggaggcaatatagatgaaagcccaagagtgttagcaaatgttggttatcaccattaccacctcctgttaggcagtaacaggagaccttaaacaatgctttcctaacctagattcgacagaactgacagcagaacactgctggtctttggtcctgatctaataatgcttgatcttagcttatattcaagcaaaggtgaatctcatgttatttacatgttgcttactttggtggggataatgaagtgcactgagtccccatactacacagtgggctgaatcctgccctgggtatcacagacatgatatagccatggttccccctctccaggagcccacaatatagcagagcagatcacgggttcataagtggctgatacaagcagaccttggtccacagcccaaatcacactttactagagtaaggggaggtaatttttggtgctggtactttattttgtagaataattgtgtcattctggtagttggaagacttctttaaatggataaaatatttcaaaaatcaataaaaaaaatccaagccctcattcagaaaacaattcattaaatgtgcattcatgagaatattttccttgagtgattacaataaggatttaaaggatcatatttacaaatttattttcaagtttatctcctacatagtaggaatgcaaaatcaatttaatgccattatccaaatgcttaaatttaagacatgtaaattattcaaataatataccgctgaggtgggatccacagcagggagctgaaattaatatgtgcttactttagaatgttctccctctttctctccatacatacatatatatatacacacacacacacacacacacacatatgtgtatgtatgtgtgtatatatatatatacacttatgtatgtgtgtctgtgtgtgtgtatatatatgcatatatatataaaatatatatgtatataataaatgtctctgtgacagtcaaaatggcatcaaatagagaacaaaggtcaaaaaggaggtgcctgagttttgaccatacttcgcagagaaagaatattgtgattatgcaatctcgttacaatgatgtcaaaaagcatgtaaaattcaaagtggttggttatctgctgagaagagtgctaaagtttactattactttaccaactggcctagttcagacagataatgcctgagctaccatggccacttggaacataaacttgagtttgacaaaaaagggcatccagaagaaactgaaaactgggttatattctggaacttgtacaggaaacgctggcccccacaaaaagaaagcagcctcaaagcatcctttcagcactgcttttcttcatctgatccatcagaaattatggcctttaccagtaattacttaagctaaatgttcctcaaatccagtctctgggattgcttacaataaagagttctgataagcaaaggccactccttaggaaagcactcaaaatatccactcacctctgcaggcagcatctgcttggtgttatacaaagagcgacacattttcaaaacttcattccccaatccttccttgttctccatcgtacatctggttagcatcactgtagctagtctcacccatggattattggttatgctggtgtttatggagaaaaatacaaggcactggaaatgactaaagttatcataattgtgataaattttaaaacaagtgaaatgcttacggtaaattacaatcagaatctaggtgacgtgctgcttcaagtcaaccttgtagaaaagataacaccttaaggagaaaaagcagcttcctgtggtatcagcaagcagcccagcagcacggaggtagtaagtgcattgaaacagcacaggctttgtgaagccagacagactcgggcccaaattctgactatttgggtcctcagagaagttatttaatacttttgcctagttgtatggttctggggaagtcacacccttctgggcctcagtttttttcactgtgaaaaggtatttaatgacttttttttccttgaagagttgccttaatgaatgatgtatgtaattgtgaagaatcagtgttaatagcaatcacacattactatttactacataaatactgcctcttgttgatattattactattattatcattgttattgttattgtaatggggtcagggcaggactaagttacaatcagggtattgcatagcagaggtcagctggggagcataggttgaggaagccacagacaagcagtatgaagatcatactttgggcttcacgttgtttccttgtattggaaacataaaagcataaaaaagtttgccgtttctttcccttgtcttgactgacactaccctgtgtttcatagaaacatcaaaatttccatttctattgacaagttaatggtaaattcatttcatggcccaggagcagggtactgattttacttacattaagaaaaaattactatttatgaagagtctgttggttcattagcacagcactacattctagacattgaacaaccagggatggtcttgcccttgaaagaattttattccttgggccctgaaaagaatttcaagtgcaacagtaacaaggggacgagcccttggcaaagcctttgtgtctcagctcaaactgacaatctgtgcgaacaaagaacactgcttacttcaaggtacacacagttctgtgagagtgtctggtgtgctgaggagtcttcctacactcaaggacttcccctcttttctcctcttgcaaagtctgaactcagctctcctgggtttttctctacagtttttctcattgtaggagaaatgctgcttggccagcatggtgaaccaatgggcaacgaggctttggtaacaaattatcaagatatgtttttcaccagccagcagtgatacactggatgaaaacaatgaatcttccttaagtacaaactcagtatttttccatgcattttcctacaaggaactaaagctaaaaaaccaaagttggtactagtaaattatagtcatgtggatcaaacaaatgtcttaagttgtaacctttttgtgttgatgggcaacataccatcattgtcacactatcctccctctcttccacccccactccttttttggtgatttatttattcaattggattgtctaaaaggaaaaaatattcaaaagtacttctgagcacctgtttgtaaagtatcccatcacacattctccagaatatttgatttatgccctggttatctcttaggcagaggagacatgaatgataggaggggagggggtgagcagactgggaaatgctttgttctgattctaatgatttaataaagcagttttataagactcaggttagtaatttacaaattccatttcatatgtggctacaaaagaatacaactttaaaaattaagatttttgggtttacaaatgcactaaatgttttaaatgcaataaatgttttaagtaaagctgattttggttcttgagaataagtgaatgattttaaatggtcagtgttctaaaagtaaaagaaactgtaaactaaagttaatctcttagaggtgtcatattttgaattgggaaatgagggttaagaagaaatctacaattcaactctaataattaatttccttacaaaagtatggcattagtggcaatctgatcagtgggctccacacctgtctcacatagtctcacccaggagtgtgttcagaacagattcccaggtcccagtatggagagatggactccacaagttgagcacaggacccaggaccctgctttgaacaagcaccccaggctccgaaggcacccacaccaagatcactggtggcaaacacaagtgcactgtgaactaaaggtgttatgatgtgagagcctgcactgtggatttcaaatagtgaaggtaaaaacctgttcttaaaaacaagtcagcatgccatcgctgccacaaaggtagagatctaagaaacatttcttttctttctgaaaacacttggttaaaaaaataccacaaagtgaaagcaccattctccttggtttgctttggaaattactaacagtctcatggaatcttttccagatatttgttggcagtcctaactgctcacaggatataggactttattttcagaaaagcatccttctttaacctcagacacgtggagatgttcactggcctgtgggggcagtatgtcagctgagcatggggagagcaagatcagtcctgagccaaacaggcacttgcgacaagggcattggtgctcatatcatttgccaatgagaagccacagctcatgagacccagtccatgagctcagaggaaatctgaccacttcttccaaaggaaaggggtatgttccatggctgataccaccaggactggataagtaccccacgcagctacgggtggcagctgcaactcagtgtgacagaggaaacaacaggggctgtgaaggtagccagcagttggttagaattctgtctcctccacttattagccgtgtgaagcctgaagttgtttaactcctgagcctcaattccttcatgtataaaatcagataacatcaccttcccttgtaggtgtgttgtgtgagtgactgataatatatgtaaattgcacataacattgtgttctcaataagtagaaattattcatttattccatttggattctcaagttggcactgtaagccgtgtcaagacagtcaagaaatttcctggtgaaaatactgaaactacattgtttttgttgacatcataaatcagatattatcaagcattgtctgatacttttgaataaaatattagagtttaggggcaaggagaaacggaaagacattgcaatatttcaaaaacaattttaaattcctctaaaggcaaatactgactacgcacacacatataattattctttcattggctctttggaaggtgctacatttttagggctaaagtccaaacaaaagaactctaattacgctaattttatgttaatacttacacatattcacttttcataggtggccaagcttgcaaaagtaaaaccaagtgctgaaattcagcctcgtggtgactagattccaggagttccatgaatagacagtagcggttctcttcattctcaatgtcagctatgtctacctggaagaagaaatacacacttaaagctggtggcaaaggctactgaattggtttatagaataattctactttattttaattaaacttttttttaaaatgttttacaatgtgttaagattcaacatcagaaaaacaaccacctcaaaagctctaagccttactcaatgtcagattatgttaaaattgtttagaactacaatcagaggaaggttctaattaactttaacaaagtaaattcaaacaagcagacttccacagaactggcttgttggcatttaatacacgttaagagactgaattgctttatttgaaattgtaatatttcaccatcctcaacattaggtgaattttttaaagtttaagttatcccaacatgaaatcctaattttcattagaaatgaaatcctaatcttcatgttgtctagaaaatgtctctaatgtgaaatgattttactaaagtgtatctgtcatagaacttttttgctataaatcaaaatagaataaaatatcctttatttatacctccatttcgaatgaaaaagtagtctctgccaaatacaaaacacccatttttcctttcattgaataactaaacgatttttcttttacattgaggcagtcctaaaacaaatcacatctccaatgtctctgtggatgaaaatgtatgctattttaggttaaaaaacagttttaagcataaaaataagccaaagtctggttctctcattttctagcctcagcatagattgtttatatttaggtacacagacattcatgatgatgagttcataatgatttgggtacagacattcagatgatgataccttgaaaggataatgagaatgaatggttacctgtatacatgctacattgtctgcactaatgcatatttccaaaacatttactttaatggtcattctggctctgatcccaagaagccatccgaaaaagtcacaccatgaattctgcattttacaaaagttgctatgtactatgaaattatcactaattgctatgggaagccttgttcacacagtgacccaccagatccttcaaaacctgccttaaaagcccatgtcgttcttctatggaataatagcccacagccattttgtagcttttttgaaataatttcacaatacagtcagtcagtttacccttacagcagttttgtgtggaggacagcacaggtattagtaatctcactttacagatgaggaaacaggccaaccatcccggtggcacgactagcaagtgacagagccaaaatatcactataatcagatcaggatgttctgaaactagaagattcaataagctacataagcttttgataatagagttggaccttgagttgggagtttggcaatgttgccttgcctatttataaagaaacttaaaaaaccaaaaacaaaaactcaagacatccatccatccgtaattctccgacctcaccaccttcaacctgtctccagcctcagggtccctttgaggtcccttgcatacgtaaaatcatgcacactcccatctcaggcattctgatctgtttcctctgccagataccctctccaccagatatctgagtgactcactccctcctttcaagtttctcaaatgtcacctatcagtcaaggccttgttcaactgccttacttacaggagcactgctccatacctgtccatctccttcaccctgtttcattttccttcttagcacttacaactatgtgacatgctatatatttacttgttgcctttcttcttccgtaagaaatgtaagattgcctttcttgttccataagaaatgttagctccttgaaagaagaggctattttttttttttttttgtccactggtctatctcaactccttaaaataatacctgctatagagtatatgcacagtaagtacttattgagtgaattaactagtgaatggacatacatatgaatgaatgagtgaatgaatgaatttgtcacttataaaataatttagtataaattatattaaatacaaatggagttgccataaatttgtggctggtttcattattagagattaatgtaagatttaaaaagaaaatgatattgccaaaagaaaaattactattaaattaaaaatcaggacaaaagacggcaggtttgctaacattacaactacacaaatgatactttgtgactgttaagtgatttcactaaggtcactctgggcatcatatctgaaaaatgggttccaaaaatgttgaaatctcagaagttttgctagccttttcttcctgcaggataatctctgtctacatgagagtttatatgcaggaaaggtttgtgcttaagaagtatctaaaatccattgtaagaagtgtttccaatgttcctagcagtgtcaatattccaactactataattaaatgcagcatagttagtaacaagtagtttctcctttttatcaaatgtacactttatatgggttattttctgtatgtgatgcactgtatgaataggaagagattaacaataaaagaatcatgttttcaataccatctaaatttattcctgaacttttcagaaactgtaatatacattttgaggaaataaactatatcataagggaagaaaagagaacagaaactataagttaaacctttatatttgtttttataatagtgtgcaaataatagttcccatgtttaaaatgtatttgataaattatttttgtatagcacctttctcacatgtagtctttttaagagtatgtctttgtcagaaaatgttttcttctaatgtccactaatcattccaatttttagtaacttacttttcagagccttgacccccatattttaactaaaaatgtgaaaaatacagtaacttacatacttatccatttgtgcatgcttgcatactccatcatatcaaagcgtttcaagtcaagttactcagctcttaagaatgcaattttaaatttgctaccactgtagctgcaagctttaccttctatgagagaagaaaattggcctaaaaatggacttcagcacatatttttaaaacatgataaagaaatacttggtttgataattgttatataccttcaaatacaacaagtgctcatctaagattgtgcccaaatattaaaatatctaaaaaacgaatgttaatattatcttctttattacatcctttaagattttttgcaataaattctggtgaattttgaatttttgagaagaaaatgggcctaaaattagacttgagcatatacttttaaaacataataaagaatatacttggttggataatcatgatatactttgatatataacaagtgcgaatccaagatttgtgtccacaaattcaaaaattcaaaatgaatttttgtgtaaagaaaaataaaaggtaaacttatgtaaagggctcccagtctgaacaacatggcttatccacttctctctgctcctctgcaaagcacaactataaactataggagtcataaaagagacagtgaagggaaaattctgaagagtggtaaaaagaaagtacactagcctggagttgcaagcctaaagaacatggtattcagatatcttctgtctctccagccaaaaaaaaaatcaaaataaaagaagcccacccagacctagtatttcccaattctggacctagaaacagaccagagctcaagcagacccatttgcagtcagaatcccacaagaaaaggagaaagagcgtgaagctaaaagatattataagacatatctaaaaacttccaaaatttggtagaagacacaaacccacacattcaagaagctaaattattcccaaacaggacaaacacaaagaaattcatgccaagttacaccataatttgaaacttgaaaagtaggtagaaaaagaaaaattttgaaagcagacagaacaacgttacctataggagaacattaatgtgaataataatggatttattatccaaaatcatggaggccagaaggaagtgtcgcattttttcaaatgctgaaagaaaagaacggttaactacaaattctttatctggcaaagctattcttcaggaaaaaaagaaaatgaaaacattctcagacaaagacaaattaaaagaacctgccactaatagccctcatcttaaatactggctaaacaaagttcttctttcttaaagaaaatgataaaagaaggaactatgaagtatcagaaggaagaacaaaaagagcaaaaatatgggtaaatacaatagactgttcttttccacatacatgttctaaatcatatttgatgatcagaacaaaagttgtaaaccatatgacattcaagacaataatatttaaaagtggggaaggtaaagggactgacccaaatatggaggtgagatttccatattacatgccaaggctaagatatccactcctaccactcttgttcagcaccatactgaacgatctagccactacaataatgcaagaaaaagaaataacagagacataaattggaaagaaaaaataaaattctatctacagataaattgtctatatagaaaattcaaagaaatcacacacaataaaacaaaccctaaaactaagaaacgagtcaggaatgtcataggatacaagatcaacatataaaaatcaatcacattgttatataacaataaatatgtgaaaaccaaaaataaacatgtattatttataatagctccaaagaaaataaattatttacatgtatagaatctgctatggtttgaatgtcccttccaaaattcatgttgaaatttaattgccactgtgataggattaagagatgagatatttaagaggtgattgggtcacgagagtgatgctctgaatggattaaggctcagctagggcctgcgttagttttactgggaatgggttcctgataaaaaggaagagttccaccttgccctctcttgctgggtaaacaaagtcactcacaaagggttatatacatactgtctgattccatttatgtaatatttttgatatgacactctgaaatgggggaaagattaatggttgtcaggggttagggatggggtggatgtgattataaaagggatccttgtgttgttggaactattcagtatctttgttagagtgggtagctaggcagacatgagcagggtaggagaggaaacagactccactcccttgacaccaggaatgttaggtgaccatcaggtgatggtcaagtggttgttaaaatgtctctctaaaataattggttgcagcagatatcagggaaaggcagtctcccaatagacagaaaactcctgaagctggtgatcagcagcttcctgattggatctcaggagttgggtgagtgggctcaagcatgtacactaagaggcaaaatggtggagtttaactggtatatgaacatcctgtaggaacactacactggtaagaaaagaatggctcaagtgagcatgcgtacaactctagtaaacacactgcgcacacagccccttccaagggctggcatgccatggagcatgtggacagctcatgccaaagaaaactcaaaggagaggagacacaaaaccccagaagcatgccaatgtgtaaatccccaagtcaaaggtcagacagggcacttgaatctctcaagttgcctgcttggccttcttccaaatgtactttcgttcctttcattcttgctctaaaacctgttaatatactctcactcacactcaaaaatttgcctcgggctctctctgccttacatcctttggatgagttctttacttcaagaaggcaagaactgagttgctacaaagccatatggatttgccattgctaacatcttgactatggtgctggttatatgaacctatacaggtataaaactgcatagcactaaatacacacaaagacacacaaatgagtacaagtaaaacttgaaaattctgaataaaaccagcaaattgtatccatgtcaatatcccggttggatattatactgtagttttgcaaaatgttaccattaggggaaactaggcaaagtgcaccagaaattgctctgtattatttcttacaactggatatgaatctataattatctcaataaaaatctaaattttgaaaaggaggatgaaaatgaatgcaatcagaacaaacttcacagaggaaaatgcttatacaaacaaaatgcagaaaacaaactaaatcatgatgtaaaaataaagatgaataagcagaatacaatttgaggggaaaaatccctatacatgatgtgacataatttgtataaagcatgcagcagaaaaatggctacatatatatttaatataatgtttacacttggatgacagatctgttggtgattatcacttctacctgccttttggtacttttcttggtttaacatgcattgttttcataattggaggtttctgtttgttcgtttaaagaaagaaacatacacaagaaccacaggaaattggcatgcctgtttaacagatgggtctgtatttggtgacttatccttcctttattaaaccataaaatcactttataaatgatcagttatggcaaaaagaaaacaaagatacaacaccacacaaaatgaaataaaaaatagggcttttcaaatctactgaccactaaggatccattccctgacttcaacataaagataaaattaagaaagcttgctgataccttaggggtgcagtagaaagcaaactaagtttgaattgtagtcaacagtgttataaacaggtctcaatgctatatataagagccgtctcaatgctatgtataagagccgtcacaatttagtggctattaggtaggactgtacagaggcttcctcagtaatgaagtgaagcataaacatatattttgcatagccaaagtcatacaatcctagtttttcattccaaccctcatctgctcactaccccttgccacttattacaatacctatgtaacctggtgcaaacagtctagcctaggtctgagtttctttatctgtaatttgtgctgatgacgtctacttcatagggttatattcattcaattccacaaacactaactgagcatctacttttttttactagagatacagtgattggagagatgaccattcaatttgtgagaattaagcaagacaaagcctgagaaattagacagacgatcctcaactaataagtttatgtcttccagtcctacgaggagttctgtctcatgccacacaccatggaaagggaaattctagccctctcttgttactctcagcttcagttctaaacatcttgccccaatctactccttgtaatggtacttcctcccattactatgtttctaacctgtaacttgtccatttgcctatgttgacctactttgatattaaggacttaatgtgttcctctgcctacatttgaattacccccatctcaaacatccctctcaattcaactcagcttctggaatcaaaaagtcaaatgctctccatgttcccttttagttttgctgaaactgcaaactgttttgcatatgattatgcaaatgcagatatgattcaaaagagggtctttttccatgagaagtagattatggacattggcagtctggacaaatcagttgtcttcatatattgtgagacatataaaaatgaacacacacaaagtagacatttttattcttttcatttagatggtcatataaaaccacaggaagaaagtgtcagttgctctgcaagcatagttaacttggatatttaagaaaaggccttagctctacagtaaatatttggcaaatgaatgctcatttatatatttagtttcacacaaatatttaaggtatgcatatatcatattttatgatctccactttaatacacaagtacctgactcaggtggtagttagaaggcttttattgtaacacattcaatctgataaaggtcttaagagacatacggtttatagtgctataagaagtgagaagttaactcgagatcaggaaggggacaaggtggcacacgagaaaggatctgagggaagagtagcatttggacatgtagaggtaagggaaaaaagagaagactgggtagagatgaggggagtcaacagagggatgctgagtagtagtttgtggctcatgaaggtgaactgtggttgaagcggtaaataaagtgtgctggggccagaacatgaggacaactacatgcttgggaacattgtgtatgttccaaaggttgaaaatactgatgccagttcctctgagttttagctataattaaatcctagtggtcagcagggaatatggagcaaaacaaatgattaatatacatttcttgcaaaatagcacaatacaaatgataattttgtctacttactttccgaaagacatctttggcccaatgtatgtgcatactatagctaatattgctcattaagagttagaaaaattggccgggcgcggtggctcacgcctgtaatcccagcactttgggaggccgaggcgggtggatcatgaggtccggagattgagaccatcctggttaacatggggaaaccccgtctctactaaaaacacaaaaaattagccgggcattggtgacaggtgcctgcagtcccagctactcgggaggctgaggcaggagaaaggcgtgaacccatgaggcagagcttgcagtgagctgagattgtgccactgcactccagcctgggcgacagagtaagactccatctcaaaaaaaaaaaaaaaaaaagagttagaaaaattaaccttaagttgaagaaacaactacgtcataaatctaacaaattatctgaaaaaaattagagaaggaaatattgccctaagatcacaaatcacaaaagatgaagcaaatgggtctcagaggcttactgaagttgtgagaacatgtgattagtatgaatattacagaaatttgaattcgccaaaatacttgaaaataaggcacgtggcttagcatggatgtggacctagaaaagaatcaaattctctctttgctagaaagtagtatagtacctataaaatacatatgttccaagcatctaaatatatttcataaagtatgaggagtacagagatctcatgtaagtctccagatagttacaatgggaaattactatagaatatattttaatttgaaaattacaggtagttatcaaatgcttcaacatatctcactacaggaattataaatgataataggtaaatttgattaatacatggctttcaaaaagtgatgataaagtcaaaataatacagaaaaatgtttattatggagacatttactgacctttttaagacttgattttttcctcttccataggacagagataacaaatacttatatgatgattgtgaatactaaataagataatgggaataaagtagctggcaaagattggtgcatagtaggcacacaggaaatgataggtattacattatcaaccacataatgtaccaaacattaaaaacagaaagctggatttttttttttttttttttttttgagacagggtcttactccgttacccaggctggagtgcagtggcatgaatcagggctcactgtagcctgaacctcctgggctcaagtgaccctcccacctcagcctcctaagcagttgagaccacaggcacatgccactatgcctggctaatttttttattgtagagatggggtctccccatgttgctcaggctggtcttgaactcctgggatcaagtaatcctcctgccttggtctcccagagttataagcatgagccactgtgcctggccaaaagctggatatttgttatgattacttctactgagaattatgtctatagactagacaggacaggaaaagaagacagacaaatatgtctgttttgggaaaataaaattgtaggttgattttcatctctttttaaaatctcatttacttgtgcaataaatatggtatttcaaatgactcttaagcatgccttccacagattagtgaaaataaacaaaataaactatttttttttactacattttcttttactttgtccttttgcccagtgaacaagaaagtaacatatacctcttttaacatccccaccccttccacagtgagtgtcaaacaaaatcctggaggtgaaaacgtcaaatagtttacaggcacctgtaatagttagtgttatttcatactgacacaactaacaaaacatcctaggattataaagaacaaaattcaaatgtgactcaaacataagaatatttttttcccttttgtctctgaaagcactgtttctctcctcattgaattaggtgacttttgcccttgttgtgtatgtcaatttgtcatatagctgcagccttcttatcagacacagagtcactgtccttgaaaaagtgaactaagtcacctattatcagtagaagacagtcttaacctcaaatttctctatggctcctggaagtgaacacaaatatcttaaattagggtacttttgaaatatgcatcttcctacaggtattgacagttgcttattttatctttagaaatttacaaatatgatgtagttattaatacatttaaaagtactttataaatagacaagatttacaaatatgaagagaattattcctggcagtagagacagtaaccaccatattctttttaagaaatgttttttactactattttattgctccaggtaactcacagaatagtaatcaccatactcttatcttccataagaactggtaagctgttagcctgctcctaagagactcatataatgacacttgatttgaagttgcaaaataactgtgcaatacctttcatgaacacaataaagtcatattgagatgtcgttgtatgcaaggcttcaaaaaacagaatgaacaaaaatcctcagcttcaacagatatacagaaatatcaaaaggtgacagagttaacctctagcaataccagacctctgcctgttaaagccacttctttgataaggtttcaggtggccaataatgcctgttgtgtctactggattgaattaatatctctgtggaagggaattttgagaagaccaaaaccagtcataagctgttgactaccaacattccccaccaatctaagcagttcttagaccagtgcttggcacacagcaagtatttaataaacaatattatgactgttatttttattaattatagtctgaattattgctattagataagaaaatataaatatgatatgttctatttttgttcatttctggatatttatggattttattaaatagaaaatatcaaagtatggaaaatcatcaaagtttaaacattaaaagtaagggtgctattttctgcttattctcccttttctatggaactaaaaaacagatgcagatatggcgacaattttctaaatacttgaccttgcacagctcatataaggcaaaatgttttgctgagacagtctgaaggttcaaacaattgtccctagctcatgcaagggtgagaagatctcctgcacagaaagagtgtcctgaccaggaagaaagagatgagaaattgaactctttcccacttttgcttctaggtctggtgatcagcaaaaacttttagctctgcttcttttcaaaggaagagtaggaaaatgagtgcctgtttataaactgcttaagaataaatggttttcaattgccacagaaagtctctcctagggcactgcaaacaccccttgggatggggagaaacccaatgaaagaacaggaatgtaggctcccaagcagcctacacatccgtgggtacagaaacatatctaaacacacagaatccaacaactgcaattcagaaccatgctttacagcaccctacttattttattatacctgtaaacatagaaattacacaataaaacatgctgtaatcactccccataagtgctgctgtcacttcgatatgtaatacatatttttacatgactaaatatattttatgaaacacttaaaaacatgtaaggggaaatattttgtgttaaaataagaagaggaaagattttgccttataaattttttctctaagacaaataatcaatcatatagtgccatgtgaccccctataaatacgtgtgtttgtttgtttatttatttatttatttatttatttatttatttagagatggagtttcgctcttgttgcccaggctggagtgcaatggcacgatcttggctcactgcaacctccgcctcctgggttcaagtgattctactgcctcagcctcccgagtagctgggattacaggcacctgttaccacgctgggctaattttgcatttttagtagagacgtgtttctccatgttagtcaggctgctctcaaactcccgacctcaggtaatctgcttgcctcagcctcccaaagtgctgggattacaggcctgagccactgcacccggccatgtgtgtttattttaaacagctgctattgaaactaaggccatactttgctttgagttaaatttgatgaagttttaatagaataattcatacagctgaaaattttctcgctgtagtgtatcattcagactcagatttgaatattggccctgtcacttaatagctgtgtgattacataaaaatacctctcttagcctcagtgctttcatatgtaaaaataaggtaataatacctaactagcaatatcagattactttgagaataatatagtatagcataacatataacataatataccatacagacatacacatacacctttacatgtgtctaacactgagttaacactgagcatctatggtagctactagtatggatagttcatagttatatatcattctgtcatactttagcattgagatattacacaaatttcttaaccactttgagtctatttccttatgtgatgaatggagtgatgagatcacctatgttacagggctgttacaacgtttagatgaaatgatacacatatgaagcctaatgttaagtccatggaaggccctcaaaacatggagcatgtagtatcttcacagcttaagggaaaagagatttctgttgtacttctagagttttaactttgatgttaagttttattccagttagaaattatgcagggagactttagggtaacagaagaaactggcaaccaatgaattatgtctacctatattttctccaaatataaaatagaatgacaagaacaaataaaactacacaaaacccacacattcagcacaattatagaccaagcatgtccatacttcaaaataccataaggaaaatggaaaaaaagcactaaatcccagagaatgatctcatattccatgttaatatttcacatattcaaaaaagaatacctgaaatcagtaatagggcaaaacatataaaaagaaaaaaatgaacctaactactaataagtgaataagataatcatactgaaggtggcatgtctgtgtgtgtgtgtctgtgtctgtgtgtgtgtgtgtgtgcttgtgtgtgtgtgtgtgtgtgtgtgtgtgtgtgtgtgagtggggaggaggagggaattaagtgactttgaaaaacataaaccagataagccaggtgcagtggctcatgtctataatgcatccagcactttgggaggttggggcagcaggactgcttgaacccaggagtttgagtccagcctgagcaacatagtgagaccccatctctacgaaaaatatacagttagccgggcatagtggtgcatgcctgcggtctcagtgacttggaaggctgaggtaagaggatccttgagccaggaggatggggctgcagcgagccacaattggtcaactgcactccagcctgggcaacagggtgagaccctttcaaaaaagaaaaatagaaaaagaaaaagaaaagaagtatcagtactcttacttgaagtctaaacataaaaagagctctcaaaaatattgtactctacccagtaatttcaaaattcatatgtactccaggattgagcaaatatataaatatattatggataatgaacctaagtttcttattgacagagagaggagtttacaaataagaaaagggagaaggctagaataaactctgtgagactgggctggcattagaagtagcaataaagaattataaatcatgctgctataaagacacatgcacacgtatgtttttgcggcactattcacaatagcaaagactaggaaccaacccaaatgtctaccaatgatagactggattaagaaaatgtggcacatatacaccatggaatactatacagccataaaaaaggatgagttcatgtcctttgtagggacatggatgaagctagaaactatcattctgagcaaactatcgcatggacagaaaaccaaacaccgcgtgttctcactcataggtgggaattgaacaatgagaacacttggacacagggtggggaacatcatacactggggcctgtcatgcagttgggggaagggggagggatagcattaggagatatacctaatgtaaatgatgaattaacaggtgtagcacaccaacatggcacaggtatacatatgtaacaaacctgcacattgtgcatatgtatcctagaacttaaactataataataaaaaataaaaaaattaaaaaaagaagtagcaatatgaaattacagaataagatataaatagaataaaacaataagttaaaaagccagggaatgaagttaagctgtagagtttttattaattttcattttgcttgtttctttgtttatgcaaacaatgttaacattataagcttaaaacaatgagttataacacagaatttgtaagatgcatggataacctcaaatcaaaaaacatacaacagatacacaaaaataaaatgcaagaaattaactcataccacaagagaaaatcaccttcactaaacggaagacaggaaagaagaaaagaaggaagagaagacaacaacacaaaagaaacaacaacaacaacaaaaacagcaggagtaagtccttacttatcaataataaccttgaatgaaatggactaaattcgccaatcaaaagacatagagtggttgaataaattaaaaaaaaaaccagacccaatgatctgttgccagaaacatgcttcacctataaagacaacatacgctcaaaataaagggggaaaaaaaagagatattccatgccaatggaaaccaggaaagagcaggagttggattggctctgtgtccccactcaaatcgcatctcgaattataatccccacattttaggggaatggcctggtgggaggtgactgagtcatgggggtggacttcccctttgctgttcttgtcatagagttctcacgagatctggttgtttgataagtgtctggcaccttccaccccctctctctcctgctgccttctgaagatcttgcttctcctttaccttctgtcatgattataagtttccgccatgtggaactgtgaatcaattaaacttcttttctttataaattacacagtctcaggtaggtctttatagcagtgtgaaaaaggactaatatagaaaatcagtaccgagatagtggggcactgatataaagatacctgaaaatgtggaagcaccattggaactgggtaatgggtagaggttggaacagtttgggttcagaagaaaacaggaagatgtgggaagtatgaaacttcctagagactttaatggttttgaccaaaatgctgatagtgatatggacaatgaaatccgggctgaggtggtctcagatggagatgaggaagttattgggaactggaataaaggtcactcttgctatgctttagagatctgtggaactctgagcttgaaaatgataatttagggaatctggcagaaatttacaagcagtaagtgtccaagatgtgacctggttttttctgaaagtgtacactcatatgcacaaagacagagatggtctgatattggaacttagtttaaaagggaaacagagcacaaaagtttggaaaatttgcagcctgaccatgtggtagaaaaaaaaaaacactatctgaggagaaattcaagccagctgcagaaacttgcataagtaaagagaagtcaaacattaatagccaagactatggggaaaatgtctccagggcatgtcagagatcttcatgggagcccctccaatcacaggcccagaggccctaggagggaaaaatggttccatgggccaggcccagggcgccactgctctatgcagccttggacatggtgccctgcattccagccactcaggctccagctgtggctaaaaggggcaaacacagagctcaggccattgcttcagagagtgcaagccaagccccaagacttggtggcttctacatgatgctgggcctgcaggtgtacagaagacacaagttgagttttgggagcctttacctagatttcagaggatgtatggaaatccctggaggtccaggaaaacgtctgctacagggttgcagccctcatggagaacctctactagggcaatgcagaggggaaatgtggggttggagcccccacacagagtcaccactggggcactgcctctagtggagctttgagaagagggtcaccatcctccagaccccagaatggtagattcacctacagcttgcactgtgcacctgaaaaagccataggcaatcaacgccagcctgagaaagcagtcatggaggctgtaccctgcagagccacagaagcagagctgcccatggcttgggagcctacatcttgcatgaccgagccctggatatgagacatggagtcaaagaagatgaatttggagctttaaaatttaatgactgccctgttgggtttcaaacttgcatggggcctgtagctcctttgttttggtcaatttctcccacttggaatgagggcatttacccaatgtctgtactcccattgtatcttggaactaactaatttgtgattttacaggctcgtaagtgaaaacaactcgtcttgtctcagtctcaatgagactctgagcttgtgcttttcagttaaggctggaatgagttaagactttgggggactactgggaaggcatattggttttgaaaagtgaaagggataagagatttgggagaggctgggatggaattatatggtttggctctgtgtccccacccaaattgcaactcaaattgtaatccccatgtgttggaagagtggcttgatgggaggtgactgaatcatgggggtggacttcccccttgctgttcttgtgatagagttctcatgagatctggttgtttgataagtgtctggtgcttccccccttctctctcctgccaccttttgaagaaggtgcttgctcttcatttgctgtcatggttgtaagtttcctggggcctcccaagccatgcagaactgtgagttaattaaacctcttttctttataaattactcagtctcaggtagttctttacagccgtgtgaaaatggactaacatagtaactaacacaaaattgatttcaagacaaaaactataagaagaaacaaagaaggtcactatataatgataaaaaggtcaattcagcaagaggatataacagttgtaaatatatatgcacccaatgcttgagcacccagatatatataaagcaaatgttattagagctaaagaaagagataggccttgtattagtccattttcactctgctgataaagacatacccatgactgaataatttataacgaaaaagaggtttaatggactcagttccatgtggctgggaaggcctcacaatcatagtggaaggcaaaaggcatgtcttacatggcagcaggcaagagagaaggaaaaaccaagtggaaggggaaatcccttataaaaacaccagatcttatgagatttattcactaccacgagaacagtatgggggaaagtgcccccgtgattcaattatcttccactgggtccctcccacaacatgtggtaattatgggaactataattcaagatgagatttggttggggacatagccaaaccatatcaggccccaatacataatagctggagacttcaacacccgactttcagcatcggacagattgcccagacagaaaatcaacgaagaaacattggatttaatcggtactatggatcaaatggatcaaatagatatttacagaatatttcccccaacagctggagaatatacttcttttcctcagcacatggatcattctcaaggacagactatattataggtcacaaaacaagtcttaaaacattaaaaaaatggaaatattatcaagcagtggcccaatgaagaaatgaagaaggaaactgaaaaatttcttgaaacaaatgataatggaaacataacataccgaaacctataggttactgtaaaagcaggactaagaaagaagtttatagctataagtggctacatcaaaaaaggaaaagaaaaacttcaaataacctaacaatgcatcttaaagagctagaaaagcaagagcaaatcaaatataaaattagtaggaaaaaggatataatgaagatcagagcagaaataaacgaattggaaatgaagaaaacaacataaaagatcactaaaacaaatcattgggctttttttaaaagataaaactgacaaatctttagacagattaacttaaaaacaaaaagtgagagaaaacccaaataaaaccaaagatgaaaaaggagacatttcaaccaatactgcagaaactcaaaggaccattagtggctactttaagcaactatatgccagtaagttggaaaatctagaggaaatggataaattcctagacacatgcaacctaccaagagtgaaccatgaagaaatctaaaacctgaacagaccaataacaggtaatgagacagaagccataagtctcccagtaaagaaaaatctgggactggatagcttcactgcagaattctaccaaatatttaaagaagaataataccaatcctattccaactattccaaacaatagaggaggaggaaatgcttccaaactaattctaaaagcccagtattaccctgatactaaacccagacaaagacacattaaaaaaataaaactacaggccaatatcattgataaataaatactgttaaaatgttcctactacccaaagcaatgtacagatttaatgcaatttctctcaaaatatcaatgacattctttaaagaaatacaaaaaacaatcctaaactttatatgaagttacaaagacctagaatagccaaagctctgatgaccaaaaacaacaaaactggaggaatcatattacctgacttcatattatactatggagctatagtaagcaaaatagcagggtagtagtatcaaaagatacacaaacatcagtggaacagaatagagaacccaaagataaatccaagcatctacagtaaacccatttttgacaaaggtgccaagaacaaacattggagaaaggacagcctcttcaataaatgctgctaggaaaactggatatccatatgcaaaagaataaaactagacctctatctctcaccatatataaaaatcaaatcaaaatggattaaagacttaactctaagacctcaaactatgaaattagtaaaaggaaacattgaggaaactctccagaacactggactggacaaagatttcttgagtaataccccacaagcacaggcaaccaaagcaaaaaagggacaaatggaatcacatcaagttaaaaacttctgcacaacaaaggaaacaatcaacaaagtgaagagacaacacacagaatgggaaaaaatatttgcaaactactcatctgacaagggattaaaaaccagaatatataaggagttcaaacaactatagaaaaaaaataattatctggttaaaaaatgggcgaaaatctgaatagacatttctcaaaagaagacatataaatggcaaatgggtacatgaaaaggtgctcaacatcactgattatcagagaaatgcaaatcaaaactacaatgagatatcatctcaccccagttaaactggcttatatccaaaagacaggcaataaacaatgcggacaagaatatggagaaaaaggaatcctcatgcactattggttggaatgtaaattagtacaaaaactatggagaagagtttggaagttcctcacaaaactaaaaatagagctaccatatgatccagcaatctctttgttgggtatataccccaaagaaaagaaatcagtgtatcaaagagatagctgcactcccatgtctattgcaacactgttcacaacagccacaatttggaagctacctaagtgtccattaacagatgaatggataaagaaaatgtggtacatatatacaatggagtactattcagccataaaaagaatgagatcctgagatctgcaacaacacagatggaactggaggtcataatgttaagtgaaataagccaggcacggaaagacaaacttcacatgttttcacttatttgtgggagccaaatattaaaagtattgaactcatgcagatagagaatagaaggatggtaatcagaagctgggaagggtagtgagggtgttacaggggaagtggatgattaataggtagaaaaaaagagttagaataaataagacttagtatctgctaacacaacaggatgactatagtaaaaaataatttaattgtacatataaaaattactaaaagtataacttagattgtttgtaacacaaaggataaatgcttgaggtggtacatgccccatttatcttgatgtgatttttatgcactgcatgcctgtatcaagatatctcatgtaacccaaaaatatatacacctactatgtacccacaaaaattaaaaaaataaaaagataaaaaataaagaaatgcaatgtgcaacctatattagatgtggacactagtgggacaacgaacagtatttgaattatgtgtaaattggatgacagtatcgaaacaatgtagctttgttatcttagatgttaatatttaatgaatctgagtaaaaagtatacagaatactttgcataatttatgcaacttttttgtaaatctcaaatttccaaatgaaaagttatccccagttattctatctcctctaccagtgcccaacattcacatacttttatttttcgtgacaattttttttccttttccttcaacgtttttctcgcttatccgtaggaggattgaagagaagatattgttgtgcaacatgttaactaaagatcatcactgctgagatcattacacctctaagcagaaggcacttggacatgattagcccaactgagacttgacctgaacctgggaaaagagtacccagagatggtgttagagcagacctcatccagtgacatctgctaaactcaagtttacttcctaggaagtggtcactgttaactaggacacattaaggccatgaagaaaggatgcttgtgtgaaggggataaacagagcgtccctatatctccacttccaccttccaaaaagcattcttcagaattaaaacatactaatgacttccctgaaattagtgtcatttgccacaaaactggattctcctcctgcatgtgctaataagttcagcagcaccacttcctccttgtaacttaggcaaaaatcagaggcaaaataagttcttttctaagcccccatatctaagcagacaccaagtccatggatactaacactttacactttcttttctaccctcttgtttgttcgcagctagtaccaacttcagggccagtacaggcaataagaccactgcttttgtcttccaactggcatccctccagccagacctctccagtccactgttcatgcagaggccagagggcttctccctaaacatagatctgttcatgttgcttctcgggccacacccttccgtgttgcctgagcagcacagaagtcaaacctgagcatgatactcgcggctctccaggatctgatctgcttccttccactttcttcttttggtggctgttgtcttcataccatacaccagctgggctgaactcagtttcagtatcacctcttcaagagcagtgagcctttcctcactgcttccagacacagtggctgcacgccctcctttgacccctgtgtactgtgcagacttttatcacagtacctgatatgtttggctgtgtccccacccaaatctcatcttgaattgtagttcccataatccccacgtgtagtggaagggaactggtgggaggtaactgaagcatggggggagtttcccctatgctattctcgtgatagtaagttctcacaagatctgatggttttataggaagcctccttcgcttggctttcattcttctctttcctgttgccatgtgaagaaggacctgtttgcttccccttctgccatgattataagtttcctgaggcctccccagccctgcagaattgtgagtcaaacctctttcctttataaactatccagttgcgggcagctctttatagcagcgtgagaacaaactaatacggtatctaaacctttagggtatctacttctttgttgatagatctatgttctccactggtgtagaggtccttcaccaattaggtccatttattgggaccagaattagagctttataggtattagcctatttaattcttacaacaattgtattgtgttattatttccattttttagacaaggaaattgaggttatgagagatttactaacttttccaagctcacagagctagggactggtggctaaaaagtccaaacattttactatcaattgccttgtctatttttctgtccctagagtgtagcacagtgcatgtcaaatgacatatgcttgaagaatatttggtgaatattccacacatattgccctgttcaaacaacagttaataggcatggcatttttcaatattttaattaagcagcagttaacatatatagtaccatgtatcgagacgtgacaaatgtaaaagatgaagcaatgttttctattctgtcaaacccctgatttctcatctctaatcaaatttaatccatgtaaagtcatagtgggaagaggaaaagactatgctttatgtagtccaatgctattcaaatatcagtgccatatatttccctggaaaataggaagaagtgtagtacaaggccaagaatataggttttagaaccagacagaactggtttgagttccatgtatcaccttaaattggtcatgtgacctcatttaaaacagagaggatggtaaccactttgcaagacagttttaaagattagcgtgcacatagtacacattccagggttccttctttggcccccagtgatgccaacagcgagagggcaaatatttaaagcaaggaacacattgttcataaagagaaactctcaacatctccaaatatttgcaggaccaattaaaacggatgttctgtcaactttaatcattttaggaaaaaagacacaaggagctatatccaaacatttcaaatctcttgctcatattgggacaaacatgctgtgacatgagaagcaactggctggtcagaaatcattgtcagcaaactatggcaaactaataaaaataaaataaaagcaccaggccactctataaggaaatcttcccattattccaagcaaatcattttgcttgcatgtcagggggaagtggcatggtctaatccttcatcattaatggcaagaacatcagactgaaagtcaggagtcctgccctgccattttaagggtgaccttggacaaatttttaaagatttgatattcatttattcaacaaatatttattgtttgtgagatccctcttctcatggaatttatatcctaatggaagaagaaagagttcatataataaatagacaaacataaggataggcaggaaaaagtcagcagacactggtgagtgatttgtggagaattaagacagcaataaaatagacagtgactgaggtggttaatttaggctgtatagtcactttagaaaaggaaacatttaagctaaaatatgaggaaggcagttatcctttctggacttctgtatccttttctataaagtatgactgctgaactggggatgcttttgaaagtctcttctagttctaggaatctgtgatttcatggctaggttatattatatgatatggatgtgtgcacatatatttttaacttcaaatatcctaaatttggttaagtaaatcatgacagtgagtcttagctttgaagacatttaaggtaacagtaaattacttgtaaggatctaaatgtagcttggcatactggacttttgtggctgttctctgagctctgagagggaagggcacattttactaatattttggaaatatagtcaaactggtttctgaaaagaagggttaatatgtccctgaacatttcaaagtaggcaaaatacatgcatttgtaatgaggttagattgtcttaaactaattcttttggtgatcgcctacaaccacaaattcagacatactgaaattttaaaaggtaaaactaagccacatgttcttttttacataaaaatgggaaaaaagtttgaggtgacatggtatgggatttttttctaaaggaattaaccatattttgccccatatttttcatgcaccagttagctagaaaattacaaaagctgaaaaactcagataaaccgtactatgaggattaacacaacacattcatcccctctcccctgcccccatgtccctctctttttccctcccaccccaagctggggcatatttctggaatggaaataaaagcctctcaaactgttgaaaaatgaaggcctctgaatttttaattctgttaactaatcattagaaaactaaaaattactgtctctccgagaaccagtgaggtagcaagaaccagagactctgtgtttaattttgcaggagctggctggtttcccagcaacacactgatttgtggggccactactttgggcacctcgaggataattaaatattaagtctctctctgatgtatgcaaagtctgcctaagagggttggcagccacagtgaaagtagcagtcacacattttttggtaactgaacattgcaatatcattatctattcttatccttactctgtaagaacttgtctctatccttaatatcacccaaagttatctctgagaatgaagaaggggatagagagaaaatgaaaaaaacaagagctcatacagtcaatacttggggatcttctaggtgtttgggatatggagatgaagagtggagtttaatgtgtgtgagagaaatgatgaggggagcacaacatcctctatctcctctagttgaagcttccattttatacaccaagcagccaagcacacagatgaagaatcttcccccaaattctaaaactagtggtagagggaggatggtcacacacacaagtatctgcccactagtgccctgatctttctactactctagtgaaaggtaagacaatttttgaaaaacaataatttaagagacaatttaaactatgggcatagttttgtaacattccagaagttgttggtgtttccattctaaacacaatacttctgcattcactcaccaagtaacaagaggttatttacaattataagtcattttcccccatcaaatgcacctgtccttcaaaatagatttcaatcagtaatgccagacagacatctttactttctaaaggaggagggggacactcactgatttacttcttggagaagactctagatgagtagcatcattaagccagtgtggctttcttatttgtactaccaaatattcaacaaatctgtatcattacctaccaagaacagggaaaatgctcttacataaggggaaagcagagaggcgagaaaacaaaaagagtgagggggatatgagatgacttgtattagagtcattcagagactcttgggagagatttcctagggggccggaaaaagtttgcaccaccacagaagaaatattggtgaaacgcagatacacatggatttggcaaatgagagaaaatagtttgcactcataacaataaagtcaagtcagtttagaaaagtgcttgagaaaaaaatcttaattacaagccaagttgccttaagttctgcttttggaaaaagttaagctatcaaggaactaaaatctcaaaaatattcagaagtccttgaactcatataaaagttacaacttgtttcttgagtaattagaacatcgacaaaagcttaaaggaagaaatagcaatgatacttatttatgaagagctcgcgttcaaatattgaagtgtatgttcctgtgttttaacatgtcaggtaatatggacattttccccttttcccaacttctacactgtttcctcttatctttagaatattaggaatctgacataacataaagtgaggctctaaccagagaaatcagcctcatcatcctggcgagaaggtgaaactgaccgaggtcgagaatttaaaaagtgaaggtatgaggaaagtacataactgtagtcacatccatttgcttcaggaccagagtcagaacctaaagttccacatagcaaaactaatgtgacctaatttagggttttccccagggatgccacatgaaccttcatgtttgctgaaaacaagcacatctctaacttctatgccctgtaccggcaatagagcttgtggcctatgccttcgtgtccctagcctgctctttaaaaaaacactgcaagtggtttcctcaagtaattcaaggcaaaatgttgagactgaacatgttaaggtcacagtgcttcagagagagtatgattctgatattcatgacttttaaactacaatccacttcagtgatttgacaagaatagagaatctttgataggtctatcttttttgaatctcaatttctctaactctgaagagcaaacaatagtattgacctcttcatctcacagagggaaataagactgtatctgataataattacaaagatattcgtgatgaggcccaaaatattcttaaaatctgattcattttttaaaaggaatttattgttctttagatgtagtaataaccatataaattataaacttgctttaagattagacggtagaatgagttgcagttagacctctaggaaactcttttgcaatggggattatctgggaagtcctaatttgtaacacttattgacatgatggtctaaccctgcgtgctaaagcacgtgattaaggttcccgactcctggacgctatggcctcaggtgcatcaatttagaatttaagccaaatttcaacagccacaatatttctttgatttaggaattagcattcttatttattcaatcaataaggatttaaactctgagtatgtgcacaggatacttagagtcaaaagatggtaaatacatcctctagggcttcagttttcatggtggtggaaaaacaaaacttttaacagtaattaataacgataataattataaataattaaggctcaaatatgtggaattcaaggttccattaagcttgcaatggttagagaaggttccagagagaagatggactgagtgagccttgaagtatggtatggagaaactaaggtcttgtgtctctgttacattatgtccttctaagtatagggagaagggacagcattttagtacctgggcagagcacgaaggaaatgaattagctaaatatagaattactatatttctattcacacctgcatttttcctgggcaagagtaagccaccatgattaacggatactgtgaaccatcctatctcctattaagagaaaaataatgtacacgtgttttgtgtataatctaccatgcatatgcatgttcaagcttatggaaaaataaaaataaatttcgttgtacatattcaagtactaaatagctgattgatatatatactggaaagtttgcattaccaagatgattatccagttgacagttgcttaaagaaatcaagaactgacctccaactattgtttttttctttttcttttgagatggagtcttgctctgttgcccaggctggagtgcagtggtgccatctcgaccactgcaatctccatctcccaggtttaagcgattctcctgcctcagcctcccgagcagctgggactacagatgcgtgccaccacaccaggctgtttgtagatttagtagagatggggttttgtcatgttggccaggtgccaggctggtcttgaactcctggcctcaggtgatcctcccaccttggcctcccacaatgctgggattacaggcgtgagcaaccgcgtccggcctaattattgttagtaagaaaaataatcattcagacactcccttacctgtctctggggccaggaggctttgagaatggcttcagttctaaagaacacgaggagcttgctgtcctcctcagtcaggtgaaatgattgccccaaaatctgcagcacgtgaatgcggggccgcaccggccaggcgtcatcagcacagaaaggccgcagccactccagcaggtcctcaggtgaaaccagctcctcactgcagggcaaaatccagaggtatctgtaaactcctaagccttttattttcccccttccggtaatcaaatgtggtcactgacctaacacttgtttgttggatgacttcgtttttttcctcttgaaaggaaaaattttggtttttaaatggcttacagcgaactgtattaggtatttaaaacctatgtaaaatgaatgtaattttaaaacagtatcatattaaaatgagttatataaagcagataaacatccttggctagcttatttcaaaatttaataagtagtaaggtttatttctgttaataataccaatagtgcaaggctgcattctagtaattttttttttttcttttctttttttttaatttttttttttattgatcattcttgggtgtttctcgcagagggggatttggcagggtcataggacaacagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagggcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcggctggccgggcagagggctcctcacttcccagtaggggcggccgggcagaggcgcccctcacctcccggacggggcggctggccaggcggggggctgatccccccacctccctcccggacggggcggctggccgggcggggggctgaccccccccacctccctcctggacggggcggctggccgggcggggggctgacccccccacctccctcccggacggggcggctggccgggcggggggctgacccccccacctccctcccggacggggcggctggccgggcagaggggctcctcacttcccagtaggggcggccgggcagaggcgcccctcacctcccggacggggcggctatatatctgattacttgctgacaataattaagcaaagtaggcatcataagttactttttacagctgaaccaacaaacttcagggaagtgatataatatgcccacacaaatgaataatagtgctgtaggaccccaaagctccagttctttctatcattttccccagatgattagaatttcaatatgccattagagtatcaaatcttatactactctaaaagtgaagtatgaatgcttggttattataggactgtgaagtttaaaatgattcagaaaaggggacagtttgtacaatgttctatctcatactggaatctcttttcttgtaaccccaaatgaatatcttatttgattatgtcaatggattatttatccataactcttaaggggttatccatacaggagactcactcccacaagggcctggagatccatgctaaagcactgaattatacaggttttgctgtagccagatccttataaggcttttagctataaatcacctaggctgaatcccagtctaacttaccttaaatcaaattccatgccctaataagattacaagtcttttttttttaacttctgagaagaatacaattctgcaatgccactgagtatgtctttcagtatgtattatttaatatacttgtcaaatgctatcttatggcaatttaaaagaattatttgtatttaagaataagtgaaactacaaaatgttgtggataattggtttaagaatttcataaatttagcaactcagttgttaattttacctataagattcctaaatatttatcagaaatggaaacaattagggtgtaaaaataggatgctacaagtatttctggtgaaccttttgcaagctgaatagacagtacagtgtaatgggtctaacgggaagaccgttaaaaaaaatctgatggacctaactgaatcctggctgcagactttcctaagaactctaggtaaaaatcatgaatattatccttcccaggttatactgacacagacgaaggtcccaagagtgtgtcacctggagtctgtgaaatcaagataacatatacaaagcacctagcaaattatgtggtacagaggaagtacttaataaatagtaaccaccattgtcataataacaatcttcaccataattatcagcatcatcaaagcactatagtttgtgcttaatgatacagagataaaaaaaaattatatggtccgtgccttcaaagaactaataataccatggaacggcaagactttaaaagtgactattatccaaattactaatataaatgtgaacaactgtttcggaggaagagagaatagaaccaggaaaggcttcagagaggacgtggcatctgaacaggatcacagaggataattagaatgtatataaatgcaagtgtgggaaaatataatccagacagagaacagcaagaaaaaaccagcaaaagatttcaaaggacaaagaattttcagggagagattaaagcacagatgtgtgggtggtaaattagaggagagaggtaaggaaagataggctttctcacctaggtaaccaagagactgaatacaaggctgaaaaggcggtgcagtttaactctttgacagcacaggctctggtggtgtttggcccagactcactgcccacatttgccacttcctaacaatgtaactctgaccaagaagtcactcaatagagcagagcctcagttcccttattcgtatattggagatggataacaacactttcctcatggggttgttgagaaattaaacagaaacataaaataataaatgcaaggcatgtaatacaatgtctggcatataactaagtgcttcaattaaaagcaaccattattattaaggatatctgatcttttttgcatgaaatgggaatgatagaggatttctgagcagtgaaacatcaaaatcatgttactgattagaaaaatgtatgggctggggcagactcaggcacttttgatgaaggcctgaagctgtctaattcaggaagaaagtaatttaaagcccatttctgactataagtcctaaccagtttcacataaaatgaagctgattttttggccctctcacccaagtgccaagaagagataagtaggaaaagctagaatgtgaggaagctgttgtcatgaagacaagctggaagttataataataaccaaagcccccaatatggtgaataacaatgaaaacaatattcataataatttctgaaggtttactatgcaccatgaattatatcacttcatcataactatctttttcttgtatactgttatcatctccaatttgtagatgaggtaacaatctcagatttaagaattgactatggcattttgagctgaatgatattaaaattttaaaaaagataaaaataacttgtccaaggtcacacagtaagtagtggcaccaatatctgaacttggactatctgactgccttgtcaattactatgcaatgctactgaaccaaacgggctattccagaacagtgtggcagtggattaaaattactcagctatgatgagatatagaaggattatcactctaatatttttcaagttattaaatcaaattagttccttttacattagaacttactgtgcagctaataacatttgacattttaaaggaacatgctctcattttgtgttgatagttcaaacatataataaaattatgagaagtccttcctaaaatagaagcattgtgttctggaagcaccgagtcatagatgtgcttcactattactggtgctcaagaaaacgacacagaaatgaaaggcagctctttagaaaaagctgtcaaggacattgactagacactatctcctgaagattttagcttcaaaattgcttatattttgatttcaaattgagttcttaaaattcacagtcactcttacggttcagcaaatatacaaacacatacacacaaacatatgcatagggaaacagagaggaagaaccgtgataaaattttaacaactggcaaatcaaggggaaaagcatgtcagtattttttttttatctgtgtaatttttctaagggttttaaatttttcaagattaacaggtaaaaaaccgcaattataacttttataatgtaaaaactagaataggaagaaggaaagtgatttcatttctcatcttttatgaaagcaaggagaggacttaatgagcttaaaaattaaaaaagaacatcattatttcaaaacttatttacttcattataagggtaatacaaatgatttttaaaagtcatgaaatacactttgggaggctgaggcaggcagaacacaaggtctggagatcgagaccatcctggccaacatggtgaaaccccgtctctattaaaaatacaaaaattagctgggcgtggtggtgcgtgcctgtaatcccagctacccaggaggctgaggcaggagaatcgcttgaactagggagtcagaggttgcaaagagccgagatcgcaccactgcacttcagcctggtgacagagcaagactccatctcaaataaaaaaaaaaaaaggtcataaaatagataaaaaaagaaaatctctcatagtttcactacaaacacgtagggaattgcttccacctttttccctataatgagattggggaggggatattacactgcaaatgataatttagtacgctatttttaaaaatttgctgataaaggaaacacactcagaatcagttttggtccgaaagataggaagtcatgtgcaatacataaacagctctatttacagaaaagaacagcagcagcaaccatgacaacaaaacatgtccattgaatgactaatttgagactgtgttactctgaggtggaatgagtgttcatctggcatttccctattatgtaatgtagcatggaagacattcacaaaagtacaaaagaatggaagggaaatgtcaagcaaagaaaggaaattattgaatcacagcaagaagacagattttttaagaatataaataagcgaatcttcagtaagagagttttcaggttctgcatggcatacacatacaatcaaaataaaatattcttatatgagaatgcaagaaagcagaactacattcaagcaagcaaaacacacacatttgagatttcttgtaaatataaatgtcatagaatttgaatcaaacctgaaggaacattaggtctcttccatactgaaagtaaactggcaaccagattttgtggctggcttgcatagtagatgccaatgtttcaaaattaaggaatttcaccaacacatacatgaagtcaggatgttccaccgcatgtttaaaaactgggtgacaggaaaatagtggaaaaaacaggctggggccaaggcagcaggggcctcctttagacaaggcctaggtgagctttctagttcgtcccaggctctcccactgcctacctcctctgaaggccactggaggaagggaggggtatatacaagcgagctaacagtgagggacataaacactcattccatgtaggtcccgtgcctccattaatgaactgacccacatactatgcacactttcctcactacatatgcagcgggtggggcagacacttcccaggagaatgtcttctatttatcagctcccatgaaacaatcggggaactggcaaggaataagaactgcaaataaacaaatgtgtaaatggtaccgtagtaatataaaaagggtgaatttaggaaaatcataatcaaggtatattaaaagaaaaatgcctggaatggtaaggatgttggtatgcacacaattccaatctcaaagcttgactcctgataaatacaaataatctccttgtggctgctctcaaatatatgccaacctagaatatcttcctgggttcttggagaactgtaggcataattaaaaaacaaaacagagtatcttcctgggcttcacttatcagtgaaagggtggacacaccttgctgtaacatggcagagtggatactcataaatatggcctgaagtgatacagaaatattgcggtaacagagtggatccaccatcctggattgtgacgacagctttcaggagggctcaacctcacgaaacataaggcctcatgcactgcaggtgctcagagaacactggatgatctactttgcctcacagagcaggaagaaggaaaaaaaatcagattcaatttgctctaggtgggccgttctttcttctcttttatttttcctctccttttcactttaaaaacaatgtgcaatccctagataacagcaaagagtttaataaagtctgaattatgtgacattgttcaatatttatatgaaactttaaggcagctgaagctgagactgtggtgaagtagcaatttaaacaatcaaacccccccaaaaaactcaatagttttgaagtaaatctttcttctttttttgaatattgcacagaggaattctgcattaattacctgttatctgagtgaatttaatgctataaatccttttgagaatgacaaatatactggctcacgcttgtgggacattcctgttaggaagttttttaaagctagatgaaggcaagaagtagaaagggaaataaggcaaaggcagagagaagcatgtcaaagagacaaggtaagaccttgctactcaaagttcttccatggactgggtatcacttgggagctggttagaaatgcagaatttcagaccccacccagacctactctatcaaaatctgtattttaataagatctccaggcaattcctatgcagaattaagtgtgagaagcactgctttactttcctgtgctggctcttagtgtcaaaaagaggtgatatggtgagagaaatgcatacctctctgagcttcatttcctaatctgtaaaattcagatgacaatttctgtatgataaggttgttctgaggactaagggagttactgaatagcacctttccaaagtcttggcatagaggaattagatgttcattaggattttttgtttgtttccttgtttttaaaatatttgacagcagtattttcttaattccaggtttgacagatatatgcttttagaacattcttagtgttgaattttttttaaagaaaacttacttttcttaagcaaacaaattcttaacacgaactagaaattgatattttcttcttgaaatatgatgttataaatacacataaataataagagacagcatacacatttatagatttcttttatgaaagaaatttcatatgcacaaataattaattcctttgtcctacctttaattgtagatgtatgaaaggtctttggcatgatttaaaatccttaaaacactcaactctcatgtctagaggcaagaacgtggttaaactgaaaagaaagccatctgtacaggtggcctgtctaggtgttataattttaacacaaaattagcacagataaaggaagaggaaaagagagctttttgggagaggcaggagctgcagtgaaagagcaaatgattctaacactttttttgtggagtcgtcaggattttctacatagatgatcatgctatgtgcaaacgtggacaatctgacttcctcctttcccatttagatgccttttacttccttctcttgtcttattgctctgaatagaacttctagtgtgatgtgttgaataaaagtggtgaaaatgggcatccttgtcttgttccaaaccttggaggaaaaactcaattttttctcattaagtatgatgctatgggtttgacacagatggcctttactgtattatgttccttccatatttagcttgttgagttttatcatgaaggaatattgaattttatggaatgctttttcagcatctattaatgaatttggtcaagctgcagatataaaatcaacatacaaaaatcagtagcatttctatatgccaatagcaaacaatctgaagaagaaagaaagcaatttcatttacaagtcagctgtgaaaaaaatacctaataatatacttaaccaaggaggtaaaagacctctacaatgaaaactataaaacactgatgaaaaaatggaagaggacacaaataaatggaacgatattccatgttcatggattagaagaatactgttaaaacatccataatacccaaagtgatttacagattcaatgcaatccctatcaaaatatcaatggcactctacacagaaacagaaaaaaaaaatcttaaaattcatatggaaaggcaaaagaccctggatacctaaaacaaacacagctggaggcatcacactgcttgacctcaaaatatacaacaaagctatggtaacccaaacagcatggtagtggcataaaaacagatacatatacaaatggaacataatagagaaccccaaaattaatccatgcatttacagcaactgatttttgacaaaggctccaagaacacacactgggaaaagtacagtctcttcaataaatggtgctgagaaaattagataaccacacgaaaaagaatgaaactggacttctatctctcaccatatattacaaatatcaactataaatgaattaaagacttaaatgtaaaacccaaaaatatgaaactagtagaagaaaacacaagacaaaagtattataaaattggactgagaaaagatattttgaataagaccccaaaagctcaggcaacaaaagcagaaacagacagatggaattacatcaaactaaaaagctctgttatgtcaaaggaaacaatcaataaagtgaagagacagcctacagaattggagaaactatttgtaaactatacatcagataaggcgttaatattcaggatatacaaggaactcaaacaactcaatagcaaaaatataaataatctgacttaaaaggagcaatagtgacctgaagtgaaatagacctgaagtgacatttctcaaaagaagacatgcaaatacccaataaatatatgaaaaaaaatgctcgacatcactaatcatcagggaaatgcaatcaaaatgacagtgagttttcattttccccgagttaagaaaaaaaataactaatgctggccagggtgcagagaaaagtggacccttatacactgttggtgggaacataaattagtcgctgttagggaaaacagaatggaggttcccctaaaaattgaaaataggactaccatttgatgcagcaatcccgttactgagtatacatccaaagggaataacatcagtatgttgaagaaacttctgcacacccatgtttattgcagtactattcataatagccaagatacagaatcaacctaaatgcccatctaaagattaatgggtgaagaaaatgtggtacatataaataccattcagccacaaaacagtgaaatcctgtcatttgcagtaacatggatgaacctggaggacattatgttaagtgagatgagccaggcacagagacaaataccacacgatctcactcatatgtggaatctaaaagatttcatggaagtgagagtagattggtggttgctgggagttggggagcagagtgtggtgtactaggagaggacggtcaataggcacaaagttacagttgggcaggaagaataagttttggtgtcttatttatatagtaggatgaattagagcaaatacccatgtattgtatatttcaagatcgctagaagaatttgaatgttgtcaccacaaagaaatgatacatgtttaaaatgatggatatggtaattataccaattttatcattcattcattgaaacattacaggttgggcgttgtggctcatgcctgtaatcccagcactttgtgaggccaaggagggtggatcacctgaagtcaggagttcaagatcagcctggccaacatgatgaaaccccatctctactaaaaatacaaaaattatccgggcatggtagtgggcacctgtaatcccggctactcgggaggctgaggcaggagaatcacttgaacccgggggcagaggttgcagtgagccgagatcccatcactgcattctggcctgggtgacactgcaagactctgtctcaaaaaacaaaaaaaaaaaaaaaaaaaaaaaaaaagaacattacattgtaccacctaaacgtgtacaattattgtgtgtcaattatacaatataaaaaattaaatttaaaagaagcaaataatatttgcatcaacataaaaagataaaagaggacatgtgggcctggcgcagtggctcatgcctgtaatcccaacactttgggaggccgacgtgggtggatcacctgaggtcaggagtttgagaccagactgaccaacatggcaaaaccccatctctactaagaatacaaaaattagctggacatggtggcaggcaattgtaattccagctactcgggaggctgaggcaggagaattgtttgaaccagggaggtggaggttgcagtgagccgagactgcgccattgtacttccagcctggccaacaagagcaaactccacgtaaaaaaaaaaaagaaaagaaaaaaaaagaggacgtgaaaaatggcataaattgcttaaaaattaaccacaaaaccacatatttggtggtggctgtcaacacatgcactcaaattcttacttttttatgcagtctccctgccaggaatattgtgggatagtatatacataacccaaaagcatgtaatgtgcttttgtgtgtgacatctgaagatgtatatgagtgaggttattgtcaaaacagacactatggagggtagtgggtgtccaggttatgagtttgggactgagggaggcttggtatgtcaacaagagaaagggtgaggggcacataaggcctggcacgggctcctagaggttaggctgtcatgtcatgccaaggaatgaataacttgacagcattactttcaaaatccacaataaccatatcactgcaaagaccctccttagaactacctggaaaacacaaactgtctcccctagatgattctgccaggtgcattattgggaagggaaacccaaacaaagggtgtcaggtttaactgtgcagattcaaaaaatacttgccaaaataaaagttatggctttgtttttcttctttttattttttaggcaaaaaaaaaaaaaaaaaaaaagttctctgaagtttcttttgttaagaaggctttgttattctgtgtctctagaataaaaagtaagatcttgttctgtttctccactccctaatgtcttcttcaaaccttaaaaaacagtctgtattagagtaagtctcaaattggattcttctgtaaacgtggctagaaattcactaagatgaaatactgccttttaatattcttgagatgccccagtgggacaagactaagaagccccattgaaaggggactaaaacagtacctgttgagaccctttcatcttgggagaccaggatccagagtcagcctagcctgaaagaagctgcgctgcggatggcagctccctgggagctgatggctgagaactcactgacaagctgggagtgagatggcagtagtgagatgggccctggaaggagggtaagtgtttcccacgtagcatctctgcctgctctgctacctgctgcatgtggagttgctcaggcagcttcctcagcctggaattaccatcatctatctcctccaaacagactgttctttcactgaccagctctgtgtcaccccttgtgtatcctgccctaactactccctccactctgccttctgtacagcgcttcccattctatagcacagtgactatggctacaggccagatcgtctcccgcgcaagactgtgagctccttggggttagaggttgtttcttatccatatgactcctttgtgacttcacacagagcatggcacagagtaaaccccatgaatcattaatttctttttaaaatcgggggcctaaattagccactgctacagcgactttcctatctgaagaaccataagcaaaggggtttagaaacactgtgcaaggtaaaaagcacgggaagtagaaacccctgcttgcaatgtttttccaccttcacctacatagctcattctatattctgtcactcaaaccttgtgcacaaagccatgcagggaaatagactatgaaggcatcggcatctgagtactacattatcatttagagccagggtggaatcctggttctatttcccagctgtatgactctgggcaagtcaactcctctctctgagcttttaggtcctcctctgaaaatggcaacaacatatacagccgttagaaataataatcacaataatcattaaatctacaaagatcaatggaaagtcttacaatagcaagtagataagagaatacaaaagtttatacatttaaattgaaactatataaaaagatatctgcacctgaacaataactggtaggtaacatgcaaataaaaataattatattaccaaatggaattatggggagttttctcaaacccatcttcattatattctatcatattttcaattaaagaaagaaaattggggagaggacttacatggctgacatggatattaggcattgtaaagacttttatgaatttcgaggacatgcataactgttcatttgtggttgctctttttcttatcagtatcattgtacctgaatgaaaaattctttctaaaaatagcatcggagatacacatctttctaggcttataaagcctgtacactttgagtcctaaaacaaagctgactttaatttatacaaagtttttttgtttttattttaaagagcatatatactcaccctgggaatttccacacttaatcaatacagttaatgtgttggaaatgagaatcccctatcttgtaggaagctcagagcagtttctgccctgacagaatgatcatgatgattattatttctaatggctttcaaggaggcaagagaaaacaatgctctccatggcaagcaggacctggagctggtggggtcagcacagagctaagaataccatgtctccaagtgcagagccgctcctttcccacctaaaaatgtggcttagtcttggaagcctcatacatacggatactaagagcaattctaatactctgaggaaagccagttaatgaagatgcacatactgttctagtcttaccccttgtccacactggcgtggactgctgcaacaacaccttccaggaccttcagtgggtcccttggcccaccaaggtcagcactgccaccactgtgaaaagagagataaactgattcagaaaaggatcactcaagtctcagaaataaacttggtattcacacccttaaatgaacctggctggattttggcacagtatactgcctgcccatagtcatttgtgctatgtgatgtctacaaatgtacgaagccctacactaggtgctaatgaaacattttctgcccttaaggagctcagtctaatatacacatgttttcctatcaagagaataacacattctacttgcgctgtgtcattcgaaaaacattcgttgaacattaactgtattgagctactttaagcattaaatgtaataatgatttaaatcctccagttgaagtttttttttttttttaaaagcactaatatttacttgctactaataagtaccaggcaatgctaaacagttcacatatattctgctactattaaatgcaacatcctatgagacaagtactattattatgcccattttacagatgttatgtgtagaactctagtgaattctgaaaatgcaacagagaaaaaaaatattttcgatgagtttttcgaataatttaatgatataaatcaactgccagattcggttcctttcatgtctttgttatttcgtgcctactacattttattaacttcctaaaaggtaaatgttatgaacactgtcaataaaaatttattttccttagaaacagaagtagctgaattccttaagttcccttttccttccattgctggaagatttaattcacatttattgaatgtcttctgtgtgccaagtataccatttattggatcagaaccaaatctttagtggtagaattggatgcagaaaaagataagtataatttatgtcaaaaatttataagtgtaaaaactattccatcgtattttaattattcatgaaaatgggcaatttttaagaaataaactaaattaatcaaaacactaatttttcaaaatgcatatttttgtgagcttcatctaaaacttggtttaagaaataataaaaagataaccataaaccaaaaggtatgaaatatggccaacaaatatctgtcatcatttgaaagaggacactggttcatataatcaacatcaaaaaatcctaataagcaaacaataaaacaaagctttattaatttgaaatttgttcttttttagaaaaagttatgaaattctatatatctccctatatataaaattaatggatacctcagagcattaaggtaaaaactgtatgaggctggggtaattaaactgataaaggctcatttgatttcagttcagctgcagaaaactgacatgcatttaatcaaaaagttcctcaagagcaatacagaattaaaaagaatgcttaaaaggagaataaattaaacataactaaatcttttagcctaattgtattattcacagaaagtccttgatgcctcattatttcctgagcgtcacttctgcctcttttctaatcctcttggatgcattcctacaaaggcacccacatatcgacgcaaagcaagaatttctcaattgtcggttttatgccattaattgcaggtaaataatgtctaaagacactttacagatgtctaacttcatcagtgtatgatcagccttgccttgggtttttcaaaacaaccttctgggaaccattttcccactactacaaagaatgggaattagaaatggtaagatctgaaaaaccatattgaagtcacaggagagtctgaaacttacttacctgtgtcaaatgccattttggcctttcccttatttcaagaaaagattgtaaaagggggtccaaccagaaattacatagcttaagatgttatacacaataccaacaatgaaacattttcatggtctcccttctgaagacataagactatgagaactctaaaaataatctctcacttttgtaaagtccttcaaaacttataaaatgcttttacatacaggatgacagtttagcaccatcactgacaaagtgtcaccccagtttttccacaatgaccactttctagcttacctcaatgcagaaattattttcatgattgcactctgcactatatccttgggtgagatgtcaagagggccaactgccacctctagcagctgctgaatcattgctagaggctgaccatctaaacaaatagccacagcttcatcatgaagtttctctttttctgatcgggacagatcatagaggtgactgtatttttgcagtgtttcctgtaaagacatggtaatcagcacttaagtatcaaatagaaattaaatgtatctacatgcacaaagtgaaacatatttagatcctcgaaccaaatacatgaaaagcagcaacaccataccaaagggcatgtattagttagttattaagagcttaggctcaaggatcacccacatttgagtgcaaattctggctttaccatttattagttagtgggcctttgtgatctcaaatttcaatatctgcaaaatgaggttgaggaaaatagggtcgtgtgaatagagggtgttgtgaacattaactgagataatataatggtcagttctttagcacttcgggaataaagtaatgctcgataagtatgagcttttctattattactaacgcactacgaccacataataatctattgagctataactatgtaatcccaggtattatacatatggtatctaaattaatacttgtaataacccggcaagtatttttaaattagctgcatgttataaaaaaggaaattaaagaccaaggagattgagtaacatgaccaaagtcacatggctaccaattagcagagctaagattagaacccaaaagtctattcccctgccctaggccacactgcctgcctctctttgataagatctgtaaaaacaaatgttataccaaataatttaagaaataagagggaagctattgttttttggcataccaaatacagtcacttaatgataataacagtttccagattctttatagtttcccttgtaatcctgaatatactgttttgcctttgaaaccaaccatgagaaaactctgaatataactgaatatttgatgatattaaagaatgtttattaatttttttctagtgatcatgttatagtggttattttaaagtatcttttagagatagatagggaggtatttatgaataaaatgaaaagatgactgagatttgcttcacaatccacaagagcaaggtgagggaaggcagcggtatgcatgaagattgggcacgttctgacagttgttgaagctgggagttgggcacatgaagtttcatttcactgttctgcccattgtgaaattctctatttcagaaaaatccctatgagttaagcagggcaatttctagtatcctcacctaagagaagagggaactgaggctctgtaggatgaaagccttcaactttgattaaatgaagcttcatgaggatataagtttttttgtactgggtatataattaaggatgttaaaatgaaggtctgaactataaaagggataaatgcatggggttgaaggttatttccagcttttgctatataaggtgccttaataaaattaaataatgtctaatttaggaacctcaagagtttcctattatgggccatccatagtctgactgaacggtactcacaagtagctatatggtacctttgcatcatatcttagatgaaacaaacatgttttttatcaataatccccttgaatccccccataaactattctaggtattggaagacaatacttgtggctgggtgaagtggctcagacctggaaggccaaggtgggcgagtagcttgagcccaggactttgagaccagcctgggcaacatggcgaaactctgtccctacaaaaaatacaaaaaattagttgggtgtggtggcacacacctgtagtcccagctactcaagaggctgaggtgggaggattgcttgagcccaggaggtagaggctgcagtgagtgagcctgggcaacagagtgagaccctgtctcaaaaaaaaaaaaaaaaaaaaaaaaaaaagacaattcttgttccacagagagtaatgacaattctctgggttttaatatagtatattaaaaaataatataagtttaaaataattttagatgtgtttatttaaaaataagtacttaaaaatttataagtatagatcacttttccttgaagattgtaattttactctacttctcctaattatgaactgtagtactgtaaatgttagtaggataaaatcaagattggtaaagccaatttgtttcctgcaaagccttctatattgttcataccattatttaacattattcattagacagaaaaataggcattccaaaacacaaaatgaataaaatttctttcaaaattttaagttcttcccattatcttttcaatgggggctttgcatttatgtcttgtacaaattttgaagtctcccatttgctcattacctgaagtctccactgactgatctttctagccattctacaaggcaagaatacaattcaataaatgtgtaaggtttaagaaaaataaaagaggaggttaacggccacttacaaggttcatttaccatagtattatagggcaaatggaatattattcatatatataagcactgttttcacttacatggaaatcatttatttattgatttgtcaactttccagttatagaaaaaattatctcaactcccacaattgttaaaatatagaacaaaatctctaagggccttagagagcttctggtttcattgtatagtcctaacacctgcgttttcaaacctcatcacaggtagggaaccccaaacttcatgatgttgtttttgagacaccaaggaactagaaaccacctagaaacaattttagtagtcaaaaaattcctctcaataatgaaattatattttatgttggaaacatgcaacataaaaacaggataagggtatacgtttaacaaaaatacagtgtagacataaaaggctatttctgattttttttctgaaaattaggagggaaaagaaaatcaaaatatttatttatttatttatttatttatttatttatttatttatttatttatctgagacagagtctcgctctgtcgcccaggctggggtgcagtggagcaatctcagctcaccgcaacctccgcctcccaggatcaagcgattcacctacctcagcctcctgagtagctgggattacaggtgttgtgccaccacacccggctaatgtttgtatttttttttttttttttttttgagacggagtctcgctctgtcgcccaggctggagtgcaggggcgtgatctcagctcactgcaaactccgcctcccgggttcaagccattcccctgcctcagcctcctgagtagctgggactacaggcgcccgccattgggcctggctaatttttttgtatttttagtagagacggggtttcaccatgttggtcagactggtctcgaactcctgaccttgtgatctgcctgccttggcctccctaagtgctgggattacaggagtgagccaccgcgcccagcctatttttatttttatttgttaattctaccagctagaagtaaagtctgagcaccactgtcttctcatttcttcattttagagacctctcccctcaccccaggcagctatccattgttcaactcctgctaccatctccatttccacccttctcacccacttcctctatttccccatatcaacggtgccaagtggcttaacatcattttgaaagaagtggaaactgaattgtcaatcaagtgatcatgaagaggttaaccaataaaggcttgcggacaattttcaaggatatctgcaagcctgaaaaccctgtcaaaacgactaatgtaactttcaaggaaaaaagaaagaatatactgatacagagtgagcatatagaagttcccatttctttacctgctcactattcttcagagaaaggatgaagctgtggctcagggtttccaggtgggcaagtgatttctccagatgattcaaagtatctgcataggtaactttagaatccttagcttcttgagcttcgtcttctgagtttcttttccttggcttctcaataaaatgtttgactgtcttaatagcctttctagtcatctctttacgggcttccacagacagcttaaaaaaaagaatagtgagaccaaagaaccctgcattattacctattgcatattcagcaagtgttaatgagttagaacaaaagtgaaatttttgtatatatgattttaaccaataaatagcacttgttatactagtttttcttctgtgaagaaaacaaaaagtgaggtgccatttgcatcattaaactagtaattaagatttttaaaaatgttaatatccaaagcaggtaaagtgatgaaactagtattcacactgactgccagttacagtgcaaaaatgaggagtcatttctacagccatattcccagttctgatcacttattataagaaaaaaattccaaagaagaaaataaatacaggcataaagattttaactggaataagactattaatataacctcaaaagtaatctaattgatagaagaaatgataactagcttattttaaattacaggctggaatattatgtagtcattaaaattagaattataaaaacagtatccaaacattttggaatatgtttgtcatagaatgttaaaacttagaaatcagaatataaaactctctagataatgtttacattaaacttcaaactatatctgcatatacaatatatgtattttatgtattttctattttatgtgtgtgtgtatgtgtgcatttatatattttctattttatgtgtgtgtgtatgtgtgcgtgtgtgtgtgtgtatatatatatatatatatgttgagtattgcttatctgaaatgtttggaaccagaagtattttagatttcagattttttttggattttggaatacttgctaatttagcatccctaattcaaaaggctgaaatccaaaatgctccaataagcatttcctttgagcatcatgttggcactaaaaaagtttcagatattggagcatttcagattcctagattcaggaaattcaacctgtacatgcatataaagtatatgtatgtataaaaatataagaaatatgtattcagacatatgcatatacatatatatatattattaaggtgttaggattatgagctatttttttttctttccttctttccaaagattcgaaacatcgttttcacccatttattcagtgacacgcatcagattcctgtatactgtgttagatatatgggagttatatttttctaattaataaaatactatcctcaagaatgtgcaggagttatatttttctaatattaaaatattaagctcttagcctcaagaatacaaaactaagtctaaactttgtgctttgttgatggaggaagcagacgcctctgagagatcctagcgccttctcaggcctcactgatttgtgctgctttggatcctgggctgtagtcttctgtcagctactcaagtacatttttactatatcctcaaaaggacgtgttgatttttttgttttaataaaaagagataaagactcctacgacagactctcattttttttctacttcctaaaagcagtcattgtacatgtctggtcattctgaaaagcaggactaggctgaaatacatggcatgagtgaccacaccaggaggtaagctgcccccagacccttcctttcctactagctccctccaagtcactcaacagagttatgactttaaaatgctgacaggacgcctgtcatcccaggactttgggaggccaagatggatggatcacgaggtcaggtgatcgagacaatccgggctaacatggtgaaaccccgtctctactaaaaatacaaaaaaaaaaaaaaaaaaaaattagccgggcgtggtggcgggcgcctgtagtcccagctactcaggaggctgcggcaggagaatggcgtgaacccggcaggcggaggctgcagtgagccgagatcgcaccgctgcactccagactgggagacaaagtgagactccgtctcaaaaaacaaacaaaaaaaatgctgacaggggacattttcctaatcctatataaatattgataaaagagatctttaggaaagtactatttccaatgaaattggaaatgcactgcaaatgcagctttcaaacaagttccgtagtccccacttcttaccagatttctggctctaagccattaaaaaaatcagagcccaccattgactgacaagtattaattatgttactgtgtttgcccacaaataaactgttaactcctccctgtgattcagaagtacaaaatactagatctgtgttttgttcaacagaccacccctcccttcatacatgtagatgaagagactgagctccaggaggctcagtggcatgttaggggtcatcgtgtacaagagaagagtaaaaactggaatccagaacacttggttaccaagtgcagtgctccctgccaccttacattacacagcttccactcaacgatttctgcatcttcacaggctccaagtttattagagagtgcatgctggttgaatgctgaatgacaaaatcaagactgaataagagtttatagcagagtgaatcttttattatattcatatttgtttccccaagaaatataaatttcagaaattacttggctatatcagctagccaaatgtatacactcttcctagcctattgtgtgatatggaagagtttcaaaaacagactggctacagaatagggataggcagctaattcacatgggcaggaagtagggtcctggatgaaacaatgggtccctattctcttaaagaggtccagatgagatcattgttgtccaagtcttgactcgcctttgtcaaccaaccatggaatgaatatatggtaagcaggaagaacaatacattcagaaaagttgtgtttaatatttactactggtgtgactttaggaaacttgacaaagtgcttcaagctttagtttcttcatctacaaaatgaaaaaaaatgacccctgctgcacaactttaagaacttaagacaatatgtaaaacagtcagcacagtgccttgcccatagtaagtgctcagtaaacagatgctgacatttaatttgaccaatggataaaatacatgtgccatcctctcccgttggtttgtcatcttcctaataaatttgtcacatgtttcccttttagaaaaaccttttttttaaataagctccccaaatttctcagcacggaactcaagaaccttcacaaactggtccctagctaagtctctggcttcgtggtataattgtaactcgaaccctaagctacagccacactgactctttgtcattacctggtgcttttacttgccgtcttgtctcaaggaaatgctcctttccctcttttttgcaaggcaaattcccagtcatgtttcattatcgagacacttggagtcaatctagcctctacaagcattccactggcaagtcctctgctccaacatccaagtgcataacccacctactttgtatgtataaactgtctcgtcagcattactgagtctagccctcacactgaagtctatgctttcagaaaactagctgtaggttatgagagacaggtgtaactttttcaagagtttaaattgtttgacttcatcactacagtgtcattagaaaattttctatttaaaataatccttcaagagaactaaatatttcaaaataactatgtaacctgacactgaacaaggcagagtgtaaataaatgcaatcctaagttaattttcctgagccagctagaacctctaagaagcagaatgatattatgattaaaaatatgtaaggtgttttatttgactaggcgttttacttaattcaagctttttattactatactttgtaaaaacaggttcattgctgaaagactccagggtatggttaaaaaatatatgtttaacactgaatttacatctagtagatttattttctttaaactgttccataatggaaggaacagaagtaaaagaaagaaatgattaaaaaaaaatgtaccagagtaaaaaaaatggcaatttctttactgtatctagtggccccacggtaccattattcttaacattcttttcttaagcccacagcattaacatgtcattcatgtatatcattactataatatcaaaccaagatgatatttttaactgttccctgcagcaattagtagttgctatgaaaaataataatggattttttgaaataaagataagtggctaaaccgtttcatcagttaataaataggtactaaacatctactttccaagacctgtaaaaaatgagataaaaacatgaaccaggcttacaaagaaaccacatatatcatgggagataatatagtgagaagggggtggagggactgaggaatcatggatgacatcagcaaatcttattgggtcaagcttcaaaatatatctaggttctaaccacttcctaccaccttcactgccaccactcagttcccagccaccatcatctctcataaagagcactgcaacggttctaacttgtctcccagtgtgacagagatagtggtgctcaccaaacacaagcattccaactcttccactgcatttgtcaattcccttgtagttaggatgagctgtgttccagccagtgaaatctgagcagaagtgacatataccatttcagagccgggcaataaaaaaacccacatggctcactatccagtttcccttttttaaccacaacaattaaggagaacatggggcccagatggtgccaatacaaaatgatggggcttccatcagcctggatccttaagtgactttgtggtacaggcccctttgcagtcttttatcggattaggtgcatgagagactatctaccgaaagcctctacaaaccttagcttattctgacacacaacaggtaccaagagggaggcaatatgtggctttggttttcagatatcaggcaatgaaaaaaaaaaaaagattagaaaaataccgtaatctatgatatgctataaaaaatacttaataaaactattatctgtggtaacttggggggcagatcatacccctaatgaacttgggaaatggaacaccagaaatgtgttgggtgttatatgatgctgtgggtattacatgaagtactgtccagatcggaagcaggagtgaaacaaaataaacagcccagaaattcagggccatactgggttaaaaaacaaacaaaaacaaaaaccaacttactaattctagaccccatgagtaagagataagacggagaaatccttatataacaaatgccaagtaaaacctttagaagattaaaatgattcagggaagagataaaacaagggcgtgacactccgtaaattctttcaattggacaaaatgactcagggcagagatccaattaatgatgtcatccttaaacagaaacctgatagctttaagctagccccctttaagtggagagagagaacgtacaggggtgatacatcaaagatatacagaacaatatttcaaaacaaatgaaaagaccctgtagatgtggctacgggcacatgacactaacagatattaaataaataagaacctgactgaatttctgagatagtgatgctgcccaagaaaccacaaacctggactgaaaatgcctgtgactgtttaaaacttaacacttgggccttcaaccttgagggtacaggcctccaacaagcactcctcatgtggcccaggaaggaagtggggaggtcttccctggagggaagaaactggggtcatggagaacaaaggataacaaggttgctcctagaaagcagaattaaggcctaattaaggccccttacctaccccacagtagggaagccttcataatgtctgtacagcagattttttaagctgcctcacagtcgtgtctgccaaatatctcttattgtctccctttccaaggtgagcgcttaatgcaattatcttgtccctgtttcaccatgtaagttgggtgtcggggtgggtgtgggggaaacagggcagaggatttgtccatttggttcacagtctggatcacagctggacctgatgcgcagcctactgagtattatgccaactttgggctccctggagggactaggaccctgggtggtttcctctagtggagaagcagagtgtgttctgtggtggaaagaaggcttggtgaataaaagggtgggctgtagcagacagtggtttctaccacacatcttatccgcttctctatgcttctcaacccccttgtagttagacagggtttcatggctaggtgggcccatgaaacgtgagagaagtgtcatgtatcactctggctaaggcaatcacacccgattttccagtcccactccttctcctgacaaggtacttgaggagaccccaagtgggtacgggccctgagggaggcgtctgttgtgctaggccactgtgactctggggttgctttgttactccagcactacccagcagcacgatggtatcttaaaaacacacatctgctccagccacgcctctgctcaaatccgtgtaatggcttcccaactcactaagaataaaagccagtctttcatgccctatcaggccccatgcgatctgctcttcccctcaccctgcctctctgatcctatcccctccctgccttcacactctcaggccacttcaaccaccccggcacccttgcaggccccctcagagtcttcacagtcatcggtctctctacttggaatgttctcccaggcaccctcatgacttgaccctctacttctcttgggacttcacaaaaatgtcatcttatccgagaggccttccctgaccactccatgaaacatggcactctctccacctctttctcctggccctgcagtactttttcctcctaattgacatactgggcttctattgcttattgtttgtcactgctacattcccaaagcccagaattgtggctcatacataacaaatgcctctctgttgaatggaaggatggatggatggatggatggatggatggatggatggacggacggacggacggatggatggatggatgacactgtttaaaaagagaacagtaaaagtgcatttgaggaagcacgtaagtaggagggctcatgacacatctctaactactagagcactttagtttagacatggtgtggcataaagggctggacagtaaatatgttaggctttgcaggccacacagagtctctattagacactctggtttgtttggttggttggctggtttttgcaatcctttaaaaagatgtaaaagccaatcttagctaagggttgtacagaaacaggcagtgggctaaatttgacctgtgggccatcattttctgatctctgatttataatattaaacagttctagttgaaaagataaactgagagtaagttatatgtggcctggaatgccaggctagataaggaatctgacttggaagccactgagagccacttgtatattgaagataattacatggaaatgtctccttagattcccatttttaaaacactgtaagaaaatcttatttcaaagaaaaactaaaaactatagttatctgagaaaaacataatcaccctttcttaggcctttgcctgtgtttctggaatcagtgcaggggttcactcctctgaggagccttcctgacctatatcaaagaatattgcattgaaattacctagttacttgtacatctccctgactaaacaatgagatcctttaggatagaaactgtgcttttaaaatctctgtatccctagacctaacataatgtctaacacactgtagactaaaagtaaatagctattaaattactgaacaactctgatcaacatacggagaaaacaaagattctttacaagtgcaataaaattacatgttctcaacatgtccctggaaagttgtggttcagaatgctccaaaattacccagttactctgcagtaagtaattcctgtaagaaggccctaggagacatttaaaaaggacactttaagtgagttgaaacaaagaaacaaaaaactgagaccaaatgtttgccattgggacaatgccaccctggatcggaagtcatgcaggaaggggcacaacggcatcaagctactgatggctgtttattcattcaacatacatccactgagtgcacaccgtgcatctgccttgggctgagtgctggtgacaaaattagatcaaggccctgcccctgggtatgtcaaagtctagttgtaaatacggagagataaaagacattacaaagaggcatgatcatcctacaactacaacagggtaaacacaaggtgccatggaagccctcagaagggccactctgcagactggaagtgatgggcatgcaaggtcaggaaagggttgctgaaaggtgacatctccaaggagagtcctcaagagtgaatagaaactaagacaagaaaggaggaatgtgaagaggtcactagtcaaaggagcaagtggggcacctagaagtacatgggcttggctggaatgcagaatgaaagcgttacgggaaaggtgtccagatccagacgccaagagagggtttctggatctcgctcaagaaagaagtcagagctcctgaaggaagcactaaacaaggaaagaaacaaccagtaccagccactgcagaaacacaccaaattgtaaagaccatctatgctatgaggaaatcacatcaattaacggccaaaataaccagctagcatgataatggctggatcaaacttatacataacaatattaaccttaaatgtaaacaggctaaatgccccaattaaatgacacagactggcaaattggatgaaagtcaagagccatcggtgtgctctattcaggagaccattcaggctcaaaataaaggaatggaggaatatttagcaagcaaatggaaacgaaaaaaagcaggggttgcaatcctagtctctgatacaacagaatttaaaccaacaaagatcaaaagagacaaagaagggcattacataatggtaaagggatcaatgcaccaagaagagctactctctctctctctctctatatatatatctatatatctctctatatatatctatatatacctctatctatagatctatatatatttatatagatataaaatccatcacataaagagaaccaatgacaatacgggctcataaagcaagttcctagagacctacaaagagacttagactcccacacaataatagtgggagactttaacaccccactgtcaatattagatcaacgagaaagaaggttaacaaggatatccaggatttgaactcagctctggaccaagcggacctaatagacatctacaaaactctccaccccaaatcaacagaatacgcattcttctcagcaccacattgcacttattctaaaattgaccacataattggaagtaaaacagtcctcagcaaatgcaaaagaatggaaatcataacaaacagtctctcaggccacagtgcaatcaaattagaactcaggattaagaaactcactcaaaaccgcgcaactacatggaaacagaacaacctgctcctgaatgactactcggtgaataacaaaatgaaggcagaaataaagatgttctttgaaaccaatgagaacaaagacacaatgtaccagaatctctgggacacatttaaagcagtgtgtagagggaaatttataacactaaatgaccacagaagaaagcaagaaacacctaaagttgacaccctgacatcacaattaaaagaattattgagaagcaagagcaaacacattgaaaagctagcagaaggcaagaaataactataactaagatcagagcagtactgaaggagataaagaaacaaaaaacccttcaaaaaatcaatgaatccaggagctggtattttgaaaagatcaacaaaattgatagaccactagccagactaataaagaataaaagaagaatcaaatatcaaatagatgcaataaaaagtgataaaggggatatcaccactgaccccacagaaatacaaactaccatcagagaatactataaacacctctacacaaataaactagaaaatctagaagaaatggataaattcctggacacatacaccctcccaagactaaaccagaagttgaatccctgaatagaccaataacaagttctgaaattgaggcagcaattaatagcctcccaaccaaaaaaagtccaggaccagagggactcagagccgaaatctaccagagatacaaagaggagctggtaccattccttctgaaactatccaaacaatagaagagtgaatcctccctaactcattttatgaggtcagcatcatcctaataccaaaacctgccagagacacaacaacaacaacaaaaagaaaatttcaggccaatatccctgatgaacatcgatgcaaaaatcctcaataaaatactggcaaactgaataaagcagcacatcaaaaagcttatccaccatgatcaagtcagcttcatcccggggatgcgaggctggttcaacatactcaaatcaataaacgtaatctatcacataaacagaaccaatgaaaaaaaccacatgattatctcaatagacgcaccaaaggtctttgacaaaattcaacacccgttcatgctaaaaactctcaataatctaggtattgatgaaacgtatctcaaaataaaaagagctatttatgacaaacccacagccaatatcatactgaatgggcaaatactggaagcattccctttgaaaaccagcataagacaaggatgccctctctcaccactcctattcaacatagtattggaagttctggccagggcaatcacgcaagagaaagaaataaagtgtattcaattaggaaaagaggaagtgaattgtctctgtttgcagatgacacaattgtatatttagaaaaccccatcgtctcagcccaaaatctccttaagctgataaacaacttcagcaaagtctcaggatacaaatcaatgtgcaaaaatcacaagcatttctatacaccaataatgaacacagagccaaatcatgagtgaattcccattcacaattgctacaaagagaataaaatacctaggaatacaacttacaagggatgtgaagggcctcttcaaggagaactacaaaccactgctcaggaaataagggaggacacaaacagatggaagaacattccatgctcatggataggaagaatcaatatcgtgaaaatggccatactgatgcccaaagtaatttacagtttcaatgctgtcaccatcaagctactgttgactttcttcacagaagtggaaaaaaactactttaaatttcatatggaaccaaaaaagagcccacattgccaagacaatcctaagcaaaaagaacaaagctggaggcatcatgctacctgacttcaaactatactacaaggctacagtaaccagaacagcatggtactggtaccaaaacagagatatagaccaatggaacaaaacagaggcctcagaaataacgccacacatctacaatcatctgatctttgacaaacctgacagaaacaagcaatggggaaaggattccctatttaataaatgatgttgggaaaactggctaggcatatgcagaaagctgaaactggatcccttccttacactttaaacaaaaattaactcaagatggattaaagacttaaacataagacctaaaaccataaaaaccctagaagaaaatctaggcaataccattcaggacataggcatgggcaaagacttaatgactaaaacaccaaaagcaatggcaacaaaagccgaagtagacaaatggaatctaactaaactaaagagcttctgcacagcaaaagaaactatcatcagagtgaacaggcagtctacagaatgggagaaaatttttgctatctatccatctgacacagggctaatatccagaatctacaaaaaacttaagcaaatttacaagaaataaacaacctcatcaaaaagtgggcaaaggatatgaacagacacatctcaaaagtagacatttatgcggccaacaagcatatgaaaaaagctcatcatcactgttcattagagaaatgcaaatcaaaaccacaatgagataccgtctcatgccggttagaatggcaatcattaaaaagtcaggaaacaacagatactggagaggatgtggagaaataggaacgcttttacactgttggtgggagtgtaaattagttcgaccatgtggaaaacagtgtggcaattcctcaaggatctagaactagaaataccatttgacccagcaatcctattattgaatatatacccaaaggattataaatcatgctactataaagacacatgcatacgtatgtttactgaggcactgttcacaacagcaaagatttggaaccaatccaaatgcccatcaatgataaaccagataaagaaaatgtggcacatatataccatggaatactatgcagccataaaaaagaatgagtcatgtcctttgcagggccatgaatgaagctgaaaaacatcattctcagcaaactaacacaagaacagaaaaccaaacactgcatgttctcacttataagtgggagctgaacaatgagaacacatggacacagggaagggaacatcacacaccagggcctgtcggcgggtggggagctaggggagggatagcattaggggaaatagctaatgtagatgatgggttgatgggtgcagcaaaccaccatggcacatgtatacctatgaaacaaacctgcacgttctgcacgtatatcctagaacttgaagtataataataaaaaacaaacaaacaaacaaagtccatagagtggaagcaaatttattaagaaagtaaaagaataaagaatgtctactccataggcccttggggctgctaattgcccattttaatggttatttcttgatgatatgctaaattaggggtgtattattcatgtctcccctttttagatcatataggataaccttctgacatcaccatggcatttgtaaactgtcacgacgctggtgggaatgtagcagtcaggatgaccagagctcactctcgtcaccatcttggttttggtggcttttagctggcttctttactgcaagctgttttatcagcaaggtctttatgatgtgtatcttgtgccgacttcctgtctcatcctatgacttagattgccttaacctcctgggaatgcagcccagtaagtttcagccttatttcacccagctcctattcaagatggagttgctctggttcaaatgccgctgacacaagtaacagtctgtcagagaatgaggaagaatgaagcagaaatgacaacatgaggaagcgccctgcatactgagctgatgacagtatcatcatcttcatgccttgggaggcataaaaggatctccagcaggagagcaacacaatcagcaccagaggttttagctaatggcttgattcataattcaccaagatgacctacatcatctgcacctacttcaccgctgtgaaatcttgctaagcagactttttttcttttaaaaatgaacatagcgccgggcacaggggctcatgcctgtaatcccagcactttgggaggccgaggcggttggatcacctgaggttgggagctcgagaccagcacaaccaacatggagaaaccccatctctactaaaaatacaaaattagccgggcgtggtggcgcgtgcctgtaatcccaactactcaggaagctgaggcaggagaatcacttgaacccgggaggtggaggttgcagtgagctgagatcgcgccattgcacaccagcctgggcaacaagagcgaaactccatctcaaaaataaataaataaaaaataaaataaaaattaaaaaaaaaagaacatagcatgactttgaacataaggctgttatttaggaaatggcaggtgacttaagaaaaatccaggtgctacctacagagtgaggtggaaaaaatcagggtttacaaacagtttattatttaactaattaaaaaaatacacagatgtcctctctttataggtttccatttacaaactcaccctatttttcatccatctctccctcctccttttcatgttcaaacactttcatactcgctatgagctaggcctggccttggcacagaggatacaaaggtaaattaagacagaatcactatcctggaagaacatacatcctaatggaaaagtctacatggaaataaaaatatataaaatgtgacagaaatataaattaagtatgtgggtacaccaagaaaaaaaattgttttagaaaggcaagtctttaaaaagaaggtgacacctgaagcagaacttgaagcatcagcaggagttcatgtggaagaaggaggggagggtggattgcaggcaaagaggacagaatgaggaattaattaaataaaggcttttatagaagaagaatgttctaaggctgtaactctcaacgttttactgtgctccaaaaaacctacaggatataatatattctcaccaaaaacagtagctcatgaccgcaagatgtctcatggggtaggggagtgggtgcagagcagcagctgtagtatatttgggaaaggagggggaatcaattctgaaaaagattaaaccatcccaggagttcaatcaccaaagccaaacatcattccttctccagtcttactcccaagctatacctgcaaaagctcttggtggtgcaaatgtgtgtatgcgtgtgcttaggcaagggattgtccagcaagagaagagatgcaaagggtgctggggccactgggggtgccatgctgggaaacttacacattaaccttgggccagtggtctccaaactgaggtatgtgtgccactagcacacaaagccttccaacagggacgcaggcacaggcagtttaaagggaatctgtttctaaattaatttccaccttctctaagtattctttcctaaaactgatcaaggtgtgaagcctgtgctctttcccaactcccctttgacaacagccttcaactaacacaagaaaggcatgtctgacactcttcctgagtctgactctgatacattgttctgatgtctaaagagctccagaacaccaaagggacaattcagaatgctggtgtataacagactccaatggagaccacctttgcaaaaattttaacagtgagaaaattatggcagtgggggagatctaatttagccaacccccatcttgcctttagccttcaagctgtcagacatttagtttatagtttaaatgataacagcccttgccccaaaactcaaccgcctttgtaaagtgagtgagagactatcaggctaagaggagagaggaacgtgaattctcctaagatgtagacataagcaattgccagccattattacattctggggtcacaagatatgcaacttctccaattactcctgcagataacgtcactattgtagactggccttctgagatatctattcatgtgttttgcatgtctgagatccatggctccacccagacccacccagaagcaattgggcacccaggaggctcacttcctacactcctatgattgcacccaattaatcagcagcaagcacccatttcctagccacccacaccccttcccccaaactgcattttaaaaaaccttaacctagaaggcttcaattgattaagtgataactccatttccagcatggcacggctggcctagagtcaattaaactctttctttactgcaaagctggggtctccgtttgtgcagtggtagaaagtgattacaaagtggtagaaaggtgattacacagtgactggataacaaacttcttcttgcatgtcacaaggttcccagtgctttgctttcttttttttcttctaagttatttttaaaaaaattcaacagttttaggggaacaggtggcgtttgcatggaaaagtccttcagtgatgatttctgatattttggtgtacccatcactggagcagtgtatactatatccaacgtgtagtattttctctctcattcccctccacccttccccaccaagtccccaaagtgtattatgtcattcttatgtctccgagtccccatagcttagctcccacttataagtgagaacataagatgtttggttttccactcctgagttacttagaataatggtctccaactccatccaggttgctgagaatgtcattatttcatttctttttatggctgagtagtgttccatggggtgtgtgtgtgtgtgtgtgtgtgcacacgtgtacctcacatgttctttatccacttgttggctgatgggcattttaggctggttccatacttttgcaattgcgaattgtgctgctataaatatgcatgtgcaagtgtttttttcatataatgacttcttttcttccgggttaaatacccactagtgggttgctggatcaaatgttagttctattttagttctttaaggaatctccagtactgttttccatagtggttgtactagtttacattcccaccagcagtgtaaagatgttcccttttcatcatatctataacaacatctattattttttgatttttaaattatggccatttttgcaggaataaggtggcatctcattgtagttttgatttgcatttccctgataattagtgatgttgaacattttttcttgttttttggccactggtgtatctccttttgagaagtatctattcatgtctttgcttactttttgatgggattgtttgcttgcttcttgctgatctgtttgagttccttgtagattctggattagtcctttatcagatgcttagtttgtgaatattttctcccactctgtaggttgttgagtagctgatcatttcttttgcagtgtagatgctttttagtttaattaggtaccatctatttatctttggttttgtttcatttgctttgggttcttggtcttagcctaatccaatgtctagaagagtttttccaacgttatcctctagaatttttatgcttcaggtgttagatttaagtccttgaaccatcttgagttaatttttgtatttggttagagatgaggagtcaggttcattcttctacaggtggcttgccaatgaagtatcccagcaccatttgttgaatagagtgacctttccccactttgtttttgtttgctttgtcaaagatcagttggctgtaagtatttggctttgtttctgggttatccattctgttccattggtctatatgcatattttcatacgagtacagtgctgttttggtaactattaatatagctttatagtatagtttgaagttaggtaatatgatgcctccagatttgttttttgtttagtcttgctttggctatgaagactctttttgggttctgtatgaattttaggattttttttctagttctgtcaagaatgatgatcgtattttggtgggaattgtattaaatttatagactgcttttggcaatatggtcattttcacaatattgattctacctatccttgagcatgggatgtgtttccatttgtttctgtcatttatgatttctttcagccgtgtgttgtagttttccaagtagagatcattcacctccttgcttatattcctaagtattttattattattattattatttgcagctgttgtaaaaaaggttgagttctcgacttgattctcggcttggtcattgttgttgcatagcagtgccactgatttgtgtacactgagactttactgaattcatttacaagacctagaagctttttggatgagtcgttagggttttcaaggtatacaatcatatcaattggcaaatagtggctgtttgacttcttctttaccaatatggacaccctttatttttttctcttgtctgactgctctggctaggacttccagcatgatgctgaatagcatcaacattatagtgaaagtgggcatccttgtcttattccagttctcagagaaaatgctttcaacttttccctgttcagtataatgttggctgtgggtctgtcagcgatgccttttattaccttgaggtatgtcccttatatgccaattttgctgagggttttaatcataaagggatgctggattttgtcaaatacgttttcctgcacgtattgaggtgaccatatgatttttgtttttaattctgtttatgtgatatatcacatttatttacttacatatgttaattcatccctgcatccctggtataaaacccatttgattatgcagtattatctttttgatatgctgttggatttggttattttgttgaggatttttgcatctatgatcatcagggatattggtccatagctttccctttttgttacatctttcctggttttggtattagggtgatactggcttcccagaatgatttaggaaagattccctctttctctatcttttggaatagtttcagtaagatttgtactaattatttgaatgcctgataaaattcagctgtgaatccatttggtcttggacttttttggttggcaattttaaaaattactgtatcagtcttgctacttgttatttgtctgttcagagtttctatttcttccggatttaatctaggatatttccaggaatttatccacctcctctgggttttctagtttgtgtgtgtaaaggtgttcatagtagctctgaatgatcttttgtgtttctgtggtatcagttgtaacatctcccatttaatttcttttttttttttttttgagtctctctctgtcactcaccctggagtgcagtggcacaatcttggttcactgcaacctctgcctcccgcattcgagagattctcctgcctcagcctcccaagtggctgagattgcaaaagcctgccaccacacccagctaatttttgtatttttagttgagacggagtttcaccatgttggcctgactggtctcaaactcctgacctcaggtgatctgcccacctcagcctgccaaagtgctgggattacaggcccaatgctgtgctttcaacacaatttatgaaggatctaaatgaggcgtctgctgataaatcattaaaaattaatttttaacaaaagtttgctatatgatttttggtctataacttataagaaattcaaagaattaagtgaatctgctatggcaaaacttctccacccacttatttatgtgaacaatgtttttaagtactcatatctatgcaaatataaaatagaaaactgacattgaactcaatcacaatctaacaatagtcatccaagagcacataaactagttaaaaacaatatttaaatctctacctcattaagatgtgcattttgaatataattttatttttatatttaatagttatttatcaaaaaaataaatcaatgttgcgggaactcagggacgccgaacggagggactggctggagccgtggcagaggaacataaattgtgaagatttcatggacatttatcacttccctaatactcataatttcttatgcctgtcttacatttaatctcttaattctgttatcttcgtaagctgaggatgtacctcacctcagatccactgtgatgattgcgttaactgtacaaattgattgtaaaatgtgtgtttgaacaatatgaaatcagtgcaccttgaaaatgaacagaataatagcgattttagggaacaaggtaagggaagggaaccatgaggtctgactgcctgtggggttgggcaaaaagagccatatttttcttcttgcagagagcctataaatggacatgcaagcagggaagatatccctaaattcttctcctagcaaggaatattaatattaataccctgggaaaggaatgcattcctggggggaggtctataaacggccactctgggagtgtctgtcctacgcggttgagataaggactgaaatacgccctggtctcctgcagtacccttaggcttactaggattggggaacctcgccctggtaaatttgaggtcagaccagttgtctgctctcgaaccctgttttctgttgtttaagatgtttatcaagacaatacgtgcacagctgaacatagacccttatcaggagtttttgattttgccctttgccttgtgatctttattggcctcagaagcatgtgatctttgttctcctttttgccctttgaagcatgtgatctttgtgacctactccctgttcatacaacccgtccccttttgaagtccttaataaaaacctgctggttttgcggctcagatgggcatcaaggacctaccgatatgtgatgtcacccctagcggcccagctgtaaaattcctctctttgtactctttctctttatttctcagatcagctaacacttagggaaaatagaaagaacctatgttgaaatattgggggtgggttcccccgatacatcaatgctgctctgatcaaatatatgctgcaataattgaaaaaataactgaatatagattttttaaaaaaacccttgaaaccctagagtcacaagacattttttaaatgttactttctatttgattatttctgatgcagagaaacatgattttaagcacaaagacgttgaattgcattacaataaaattatacgaaagtgaaaactacacaaactctccacacaaaatgactccatccaaacccctgcattaatacgcttgaccaaattttagcagggcttctagcaaggccatgtccctagaatgactccagtccccgtcaaaatgccaagaaagttcaaagctgtcagtagaatgcattgtttgttctagccaacacctggtgataagccaataggctcctcaacccctctttacagcagttactttagaaagcttgcaattataatcctttctctgtccctttgagatgtaaatcttctaccacctagtgtgtttcctgaaggacctgggatcagtctctttgcaatataaacactcaaggagccaactctctgtgggagggtaagggcctcacttccatggatgccttgttccaacttgcacaactacctgctgtcataaagacatgagcagtttgtttcttctccagataagtgccaatttgcaaaccaagatggttcagttacatggaccaaacctcccttaacgccccttgtgcctttcctttcacacaccccagtgttgaaaaagtattctgccttttttgttttggtgaagctgagcttggtttatgctgggctctcttccctctgcagtagttagtacttaagaaaatctgtctttactgcctttaaaaagtatctggctttctctttgacaaaagacacagtagaaatggtttgaggaaaaggaaagatgcaacctttctgacagctgtagatgtgttcttgtatgtttttaagtgatagcagtagatatcaaatcacatatgttgtatacaaatagagctatgttacagttttactttaaatgtgaatatttaaaatgtgctggaaactatgccttcctttgtaatcatttaaaattataaaatttttagatatcaagtgtgtgagaggtaatcaggtgattttaatttagctacatgagtaaaaaaggttcaagttcacagctttgtagcactgttttcctaaagtgtgattttcagaccacctgtattgaaattacctaagtgcaacctcaaaaaagcaaattccctggctcttatcaggcttactgactcaatccgtgggtttgggaaagacatcggcattcgtggaaagaaaccagtatcttgcatgagcatttcctggttaattctaatagcaaagaaagtgtgcagctctggagcctttaagcttctgagtgacccaaccaactggccaatggtgagtttaggaggtgaatggaggtgggtcctgggacttgaaacaaaggtacagtgaggtggtcactgcaagagtctggacagagtggatggggttgaaggagacaggcgatttcggttgtaaatgacattatgttaaaggactgaaaaacactcctatgctgtcttatgccagctcctggagcaggcactcctctgatgtatgtcgtcagctgccagtaagttgacacagtagctttcaaacttttttgcccaagaccaacagtaagaaacaatattatgtatcaaaagtcaattattatacatatatatacacagacatatttgcatatactgaaagcaaacaaaaatgtcaggaaacgatatgaccccctactaaggggagatacattctgatgtttccgatcctaatccacagtctagtggtctgttttgcttgtgtgtctttaatgctgaccacaatgctcaaactaattacaggacccactagtgagttataactcagagtttttaaagcacctgtaaatctgctctgatgataacaggatggcttgcaggagccagcaaacattggagccacaaaagagacatcaaattatctcagctatatttaactaacttcattaaaacaataaatcactttatgttttgctaatagcctaacagtcatctctctgtgtgctgatgccaaatgctgtgtgtgcttttatggtgtacactctcctcaccaggctgtggacccccacttagtcattcttttcttctcagtgcttagtatagcacgttaagtgctgtttataaatcgtatagaatatgatgaaacggtattttaaatattacgcaaatgaaagtgaaagttaagttttaaaatttttgctttactaaagctaataaaatattcaaacacaaaaataatcatacctgtcttgtcacattcatttatacacttaacatcaccataattatgcttttttgcttaattatcaattgctcatataataaaagtgagtaatgcagggtataggccactttaccttaaacttaaccctttgccttgtacaataaccacagaaatagtattactcttcagcaaagtgtagatggccctctcttttttactgctcactttcagcaatgatacaagctaatacattcctaagtttttcaatagcttgaaggtcacctttatcttcatggagaggggcatgaaaaatgttagaaatgagatgaaatgttactgaaatcagtaataaatacatctattgttattgagcacatacaggccttaacaaaatttgaaagcattcattcacattttccatttagaaatcttctattacatgcttgtagtggtatataccacaaattgttattattaatatcattgaaagtaggtccactgtatttatagcaaaatcaaatgttgatatgaaaatctaggtcttatcctaacacttcaaactactcaggatcatgcaaaaccaagagttagatcatccagggcaatctcatccctctcaccagagtgacaggtaatccaggctggtgctaattagcatctgccataccaggggccacagggttgattcaggagtgctctaaccagcataaagcttagaactttctgtttggtcttataggaggctctgtcactctatctggatggatgtgaatcaggaagcaacatagccccagttattaccaggtatcgtcctgcaactactacaacaaagtactttatggtgaaactaacatgacagaaagtagagaaaagaaatggaaagaaactggctccgtgatgaagcctgctgcttgcacagccagccctgaagtcagccccacctctggatctttcacttacaagagccagtaaattttctggtagttaaaccaattttaattgtcttcttacttgtgtctaaaaacactctaaaactaatctatatgtatacagcagtgattatagttcctcattatacaaaggcaaaaacttaactcagaatatagagtaattttcccaaagtcaaaactggatagaaactctggaaggtctgactataaacctgtctctttctacattaccccgctactattaaaatagcttatgatgtgtctaagatctatcaagattcaattcaattcaacacactgagagcctacaacattaaacaataaagtttcccagattttcctgtgtctatgttcatttaaaattgttttctctgttctcctcatgagaatttttaatacctggtgatcaaatggcatcaatctttcatagtctttactcatagggtggcataaaaaggccctcatcagatgaggcatactggacaaaaaatggttctataatgattaaggaactctgcgaggtgattcagtgaataaaatgttaaatagctggtggaatttcctcaaggcacattcaggaaaatacagtatgaaaacaaatgcaggtagcacacatgcccacattgcagtaatgagcccaaatccaggtgtttgctgctcatgcctcagcttgggccaccatcatctctcccacatcaggctgcaagaggcttcacaatgaaatttccgtggccctccacttctgttcctttctccaatcatcacaaaagtggtgagatatatgtatcttttcttgagacagggtctcactctgttgctcaggctggcatgcagtggcatgattttggctcactgcaacatccacctcctgggctcaagagatcctcccacctcagccttttaaatagctgggactccagggttttcaccacgttggccaggctggtcttgaactcctggcctcaagcaatccgcccgcttcagcttcccagagtgttgggattacagatgtgagccactgcacccaggctaaaagtaatctttctaaaacaaaaatatgacaatgtcactacctggttgacaacttacgtctaactgatccattcccaagatgaggtctatcctttagccaggtatacaagagttttcattcccaggccccttcctatctttctggcctcatcctatgctccaatttataccatattatttaaaattaactaaaggtactaggttatttcatgtttttattaaaactgctaaatatgtcttgaatgttcccatctttctaatatttccttctgtaatgctcatgacaaataccctcatcagttaaagactcagctcaaataccttttatactacggggcctttcctggctatatctccagctccactgactctattattaaccatttctacctttctgcctccacatctttaactgagttatttgtttaccatccccatttatgaagagatctccctggctgtcaagtcgacatcctgcgatagctgcaattttacatcctatgggtgccactacttgatgaagcagtaggcactagcagtgaggaaagggcatggctgtttattataagtttcttcactgcacaggctagatagtgtatttatgaaatagctattaggagataaatctgtctgtaagtttgaaaggtacttaaatgagaggagggagcttatacgatgaagaaagaatggaagagcaaagggagtccaagtcactaaagatttacagttgagtaataaacagctgcagaaccatgaagtttgccagaaagaggagagcactgtagtagggaggttattttcagattcctttccctcactgcttttatcgtgttaaaatatgttttggtatttgctggacataattctgagatcttttatttattcctctgtcttccccaagatttacaccccctatgaatttagaatccacatgctttgcaggaaggagagtgtattccttccagcttattaatgagcaccaacagctcagcatcccaccagagtcctctccaggagcagaatgcattagcatttatgattgtactgcgtacatggtcctttggccaattttcaatctctcctactaaatgattaccttcgccaatgtgaaataattttccaagcacagagaaggagttttcagcttgccagtcaggccagttaatcacaatcaccccggatgggcttctgcagccaaatttctcaggcaagggaggtagtggaaagcaagagtttaggagcgcgcccgtatgtgaatcctgactttgtcaattctagctcataaaacacgggagcagttatctaacttccttgggacttaaattctgtgtctgttaaaatggtgacaaatttacttcatggagctggtgggacaattcagtcatgttacaacatctcttcctcctcttatataatagcatctggtggaaaggctggatgtgacgagggagacggatgaaaatgttttatctgctccacaattcgagtgcagcctgagtgcctaggacagacttttggaggcattagttccccttattattattatgtggtgacactgacatccttaaatcatcttttctccagttcatgccactattcacaagtattcatcggcttcgtgtttcctttccacatcatatgcaaacttctttacttgtcttttgagggactcttcatagcatatggtccatttgggccaaattaactttccaacttactaaaggtaagacattgtataggctgataggcatgcaaaatacttatgtcttggctgtgcctacatggctatatcaggctacaatgacccttctcttttcagttcctttagcagaaaagtgtcatgcaatctcatgcgatcaacatcaaatttggaatcaggagacctgtgtttgaaaaaggaattggatatctcctgcttgttgaactttggccaatcactctctagtaatctgaccctcagaccagagatgataatacttgcttaataatcaccctcacaagatgtgtgtgaatatcaaatgagctagggtataggaaaattataatcctcaaattcagaactcactatcatgctatcttgtattccttgctttgtttttgtgagtgaatacactgttttcctaggttgcaagtccactagaatgagggaccatatctcaaacttcctttgggttctcactacaggactagcatagggttcggtaacaacaaagcagcagcaactacaatattaattttaaaaagtagcaaatatgtattttcatacttactatggcccatgcatggttcaaatcaccactactacgaagttatgtaggtaaggaaacctaatatttgtactttatagtacagaactgcctgaattggaaagggaagattctaaatgttttaatcaacatggaaatctgcataaagataaaagcaggcaccaggcaagaggagagcaaaaagtgaagaataaacagcagggtaagtccaagaaaagccaaagcactggagaggaggtaggtttgtccaaaccatgcaaattctaaggacagccgataatacggtttggttctgtgttaccacccaaatcttgccttgaattgtaataacccccatgtgtcaagagcgggaccaggtggagataactgaatcatgggagtagtttcccccatgctgctgctgtgatagtgagtgagttctcacaagatctgatggttttagaaggggcttcccccttggctgggcactcattctctttcctgccaccctgtgaaaaggtgccttcctccatgattgtaagtttcctgaagcctccccagccatgagtcaattaaacctcttttctttataaattacccagtctcaggtatttcttcatagcagcatgagaactgatgaatacagcagacattgttaacattttgagagctcctaagtacggctacaattaaaaactaaaagaggcactcattaggatgcccttaaggggccccagtaatcttactacatttttcttgtctgtctgctttcccagtctcctaaaacactactttgtaccttaccctctcttctctcctcaaatctctcctgctattgggagaaaccgacaggatcctatccaaggtgaattgttccacctggattccaggtctcatccactctcacccattatgacagaaacactgaagatttaaaaaatataatatttattaaaggaaaatatgtaataatgaaaaaaatgatgatatatgaaggaaagggtagaatttcttgatttcaagattgcttgtcagtgtttgttggtttcccctcatcctcaattcttaatattgtagggtcctagggcttcattctctctcctccttccttctctacctacttacttacttaaggattttaccgagcctcctagttgtgactcctctttatgcactgagaattcccaaatgtatttctagtccctacctctctaatacactctaaattcatatagatagctgtccacagctcaacttggatgtttgaaagccatatcaatcttttaaaaaactattttgaaataattatagatctaaaacaagttgcaaaatagtacagagagatcctgtgtagctatctatcacccagcttttcccacaatgacatcttacaaaaagccatatcaattttaatatataccaaatcaaactatacccagaagctatttcttgacattcagtaaatattatctcttctttgtacacatggcatttattaatatacttaaatagtatttcttatcttatagttcattcaatatgcatgcatgcatgcacacatatgcttcaataaactatgagcttcgcaaaggcaagggccatggcaatcttttatttgtctacagcatgcagaatagtgactaaacatttcctgaaagtatttggaacaaataaccttattcaggccagaatcaaaggagtcaaacaactagaccaaagccagagatcaatgggcaaaatacttattttgatcaaaaaaaaagtttgaataaacagtttgtgttctctaaccctgagaaaacattatataacacttttatagttgagttcagtatgattatagattagcaacaacaataactataaaatttagtgggggagaaggttaaaaaaatgagtataccactttctgcttaggaatagaagcttcgcaaatgcagtgtctttaagacaaatatgcattagatatatatctttcctatttaaaaacttacgaaaaagatcacaagatcttcattcaaagatgtaatgtatataccaaaaattataaaggtcaatgtaatttaatataaatatataaacctctagacactggaaaaggcaaataattacacatacatgtattttattcagctttaaagtgttatatcttgaataaagtaaaattaacttacttataaacaaacaaaaatatgtatgtacatatgacagtacacttcactttgacaaatatttttcaataattgtttcccatttttccactttggccttaatgacagtacttttataaagtattattaagcctataaagtctctaaaatcttattatatgtgaggtttggctccaaaagatgtactattatagtgcataaaatgtatagtgatttctgtaaaagacagataacctctaaggttttataatttattgttagctagacatttggttggatatgtgtagaaggaactattttctccatctttcaagttcctaccttggcccataaagcaggaagctcccgctatgagtcccaagatgtcaagtactcttcactctcccatttctgaggagagaaggagtggcatctgataagtgaagtggggagaaacaattgatacactcttctggtattgttgttttcccagtggtaaacatctgtgggtcaggaccagacgtttgctgcagagaagtatatccgtccaacaatggttacggaggctctgagagtgactagcctgagttgatgtgtgctgaaatacacactgcatttcaaaggcgtggtttttttaaaaaggcaaaagatctcactgtcatttttatattgatcacatgataaaatggtaatacttaggacaattttacctaatttgtttgattttttaaaatgtggctattagaaaatttcagcctccacatgtggcacacatgatagttctgctggacagcactaatctgggggccacctcgctggagcccacaaataggaggcagaccttctgacaaagcatgtatgctctgcagaactgactgtccttccagggctgtctgaagattgagtgcagggagtagtataggaggacaaaaatagcagaaaactgacatggaaaacaaagccacagtctccaggccaattctaccaacaataaagctggtattttcctttctgtggtacctgattcctctgtctcttaactgattgcaacttgagaatggacaatgacaattatttattactttttcctgattaaaacccgaaggcatgatagaaatatttctgctcccctggaagtagcacaagcacaaaattcagggagaagcacgcagcaaagaaagtggtcttctctaggtccttaggggtttaagtttcaaaagcttctaagatttcagtggagagttctgccctgggtggttctcagctgaaacaaaagtggcacatgagtgggaaacctgcctgggaagcaggtttctgagtcaagtgagattccccagcaaaaagacagtgacagccactggacacttaactgagaggaacacggggcttcagtggggaaatggaaatcaggaaggcagagtgaccacgggcagggatatgtgaaacatatcagtctctgccagaggaggcagtatggatggacggatacattgtctttcctccatggtagacatatgcctcagttaacatcctgatgggagactatttaaaaatttttattttattgattgattgattgagacagggttgcctatttgaattgtgagctgaagttgctgctttttgcatgccgggctacttttgcttacattttcttccaagtgaacaaagcgagactgtgacttcaagaaaaacaacacagaatttgttgtcatgataaaattggaactttcaagcaaaaattcaaattttggaaaacttggatccaccactgtaaggctgacagcttcccaatacttacagacttagctgctaagtgctcatattaatgaatgagattttttaaaatattctctgatgcaatctatcaacatttggatcatctatataactcagggaactgaaacttctaaatgccttcatgcaattatattacaaaatcatacctgggaaataaatccattcaagtgcaacctagaccaacagttttaatgcgacagggtacaaaaagttcaataatatggctttgtatttcacactgcaactagtctttaagactttatcacatgttgagtttcagtgtagtatcaaagaagaatactccaaattataggctattaaaatatctctcccttttccaacctcttatctgtgtaaggctggattttcttcacctactgcaaccaaaacaacaacagactgaatgcagaaactaacatgagaatccagctgtgttctattaagccggacatgaaaatgtaacacagtgctgtttttcaattattttctgtcttggagatatagttgtttttcattaaatatgctattcatgtcaacctataatgggtctattattggtattttaaaataaattaagtttaaaattttgtctttaattttttttgttttagacagagtctctctctgtcgtggcacgatctcgggtcagtgcagcctccgactccctggttcaagtgattctcctgcctcagcctcccgagtggctgggattacaggcatgcgccatcatgcccagctaatttttgtatttttagtagagacggggtttcaccgtggtagccaggatggtctcaatctcctgacctcgagatccacccaccttgggctcccaaagtgctgggattacaggcatgagccaccatgcccagcctgtctttaacttctaatatgataaatattattagatataaccttcataaacaaaaactctttagaatcctcaataattcttaagaatattaaagcatcctgagatcaaaagttttgagaatgaccaatctataattatttaatcaaccacttaagtataaagtacctactttatactgtgctaggacataggaaataagagataaaaggcaccatccctgtcctcaaaaatttccaatttcattggcaatgtacttctcaattaacataacttaaaaattcttttactgtataatttttaaaaaccttcatttcatgtttcttataaacatgtctttcatagcttaatgtctcctatggaaaataataccatatatggcacatagcaaatgcctaaatacttcatgattcactctgaatctgacatatggcatcagaaaatcataatatacattaaataaacattttaatgtcagtttcagacactgattactcatggtgaaagaggtactgccatccttagttaaaagatagtattggcaatatagagaccctgaagttacagctacaatgcaaccttttgatcaagacttaaacttatactatagatttcactttttggtcaaattatgctttttaagattaatttattctaccagatttttatgccaacaggctgaataataggataaaggaggaaacggtggcttatttagagaatctgaacagcaaacaaagatactcttatgctgttttcataactccaggaggcagaaccaaacagtggagatcaaaattaggcaaaagataccttttattaaataaataaagcaagtaagcagggatactggcttaattatcaatagaaatgagtttgaaggttagaaagtaggctagataagaggttctcaataatttttctgctacaatccaaaggagacaacatgtttcccattagaagcagtggtttacgatggcaatgaatcacaaacggtgggagttggaaaggcagcacgtgcaaggtgggggaaaggggagtgggtaaatacctatctaattccaggttgagtaacactgggcaaggtaccagaaggactttttaaactgtatgattacctgggaatttttaaagaaggatcctggcaaacttcttgacagcatttcatatgagagagaagtatttgccatgcatttatctatggatgtagcagtactagctattgacagcaagtggaaagtataaaacacaaaggctaagattatacatatgctccccattactaaccacctaataccaagcaaattgtgttctgacctgcctttcagcctcttttacaaccattttcctggatttctaacccattcacttgttctctgtcccttctataaaaatgcttataacagctgaattgacaagcaatagaggagcaactctaatctgattcaacaacaacaacaacaaaaaaaagcatttagatttggtacaaatacactttaaacatttgcttcctttttccttctgcatattaatcatctcaaatggcacacaaattcactctctgactgcaggacataatactatttgtaaatattttccccagagattctaggaattctgcaaatgtaaatggcaatggaatgactgttaccatgaaagtgaagagccttctctggtatgttttaccagtggattgggcactcagttcaggccttgggaatattcctttctgaattctagtatctgaacaattgcttattgttcttgttatgcactcgagaattagcttaccagttctttccaaaaatttctttctaaattaaatgtgggtacacatttgaaaactgcacactgtgtatgaatagtacacatttattttacatttttaacatcatgtacaagctgtgggaacatctggtgttttgcaaatttgggcaaatccagctgcatttcctcttccaaatatgttctctgacatttgcaggttgtgtttcattttgatttttatactctctctctctctatctatatagggcagcattgtgtgctttcaaacatgcattttttccaactttatacttctcctttctgaactaaaaattaaaagcttgctgattaatatgagaaaaaatgttgtggttagactaaagatgtaaattttaaatgtatctgtctcacctctctataatttacttgaatcagtagaaaatcgcctcttgagaacagtttacaatgaagaaatatatatgcttgcattataccatctgagctaagagaaagcaatacagtaattagcagactgaatctttactgagtcaggtgcacctctaacccaacaaaatacacatatgtgcaccaacaactgtgccacatattttcaggggttggcggacatcttgaaagaagtataaggttaagaaactaaagcgatgagaatgtgaataatttaatgtgaataatttaaaatcacctaacttaaagcatggtaaataacagctaaaacgcaaatggactttacatcctactcttatacttaatcataaataaaagattgctgttgccaagtctaaaactctctgtcccctctacacacacgctcacgattagcagacagccccagatgatcatgctggcttccctttcttccctcacataaaatatttaaaacaacctccagcctgagggtggagtggaaaactgcctgggagcaaagtcaccctcaccatcctggctgacctgctggcctgttagccccgaaggttagttcacaagtctcagatctgagctggttccttggattttaaactcccaacttggatcagttccttcccatatacaaccaggttcctgcctggactttctcatttagattcagccctgctctggacaaatcccaggacatgctgctcctactgggctaaaaatgctcagggctctctggttccactgctctcccacagtttctcaaatggttccaggtcccctgactctagttgcttgttctatgacttcttagagatagcacagttcaatggttaagagaaaaggccaggggataaatctccatgagttcaaattgagttctctattaccaacttaactttgctaagcctcagtttgctcatctataaaactagggtaataatattatctccctcacagattactcagccacaacctctgtctcaaggaagcagaagtctaagagagatacctgaagctaaaccacacagctgataagtgataggttcagagttcaaagccaggtttatatgtctccaaacacattcttttcaaatacattatgctcttgtcttttaaaatcacccttattggccgggtgcagtggctcacatctgtaatcccagcactttgggaggctgaggtgggtggatcacgacgtcaggagatcgagaccatcctggctaacatggtgaaacctcatctctactaaaaatacaaaaaaaaaaaaattagccaggcatggtggcgggctcctgtagtcccagctactcagcctcctagcaggagaatggcatgaacccaggaggcagagcttgcagtgagccaagatcatgccactgcactccagcctgggggacagagcgagactccgtctcaaaaaaaaaaaatcatccttatttttctctttaaaaacaaaaaacatgattactcctttttatagcagtggttgtaaaatttaaaaccaagatatattactagggttgcaataataagaaaataaagaagtacttggttatccacaactactaatctagtgatttggttaaaactagcattcttcacagaagttggaacctctgcctgtgccaacctccaaatgaatgatttgcaattcttggcctttacagtctatttccaggataatactaactaaaataacaatctttgcgatagggtactgggcagacctggtgacttgcacggaaggagaaggcaacagcaaagatggcaagagagaagattaaacaggagctccaaaggcaacagagttcagcagttgagtccaaatgctaagattttccaggagagagaatgcccagagtccaagtagtgaaaaatgtccatttgtttagcagcggtgtctaggtgagggggcaggaaaggggaggaggagaacccacattatctattctgagtgaggctacacattgctgagggattgagtgcagtcaaaggaggccaaactgatggaggagacatcagaaaatgcaatatgcactctcttcaataattctatcaccaagatatatactgcatgatatgaataacatcttttttatttttttatgttattattttgagacagagtctcactctgtcacccaggctggagtgcagtggcatgatctcagctcactccaacctccgtttcgtaggttcaagcaattctcctgcctcagcctcccgagtagctgggactacaggtgcataccaccacacccaggtaatttttttttttttggtttttttttttcttctagtagagatgggatttcaccatattggccaggctggtctcaaactcctgatctcaggtaatctgcctgccttggcctcccaaagtgctgggattacaggcttgagccgctatgcccggccaataacttttttaaagactcaggctaacccaagctaagttgttagcctggtttccgaatgcaggtaatctgggctgggcactggagctcctttacatttgtcaactggaaagaacagaatggcatatttactataaagtgacatgagaactgtaacatgtactaagtatacgtgtaaatgagaatagtcatctctattttagcatatttgtacatctacaatagagaaaaaaaatttcctaattaaaacacctcattcacagcaaatgaacaaaaactttttaaaaagccaacatgtaattattttcaagaaaggaaacaaaaataaaatctacagaatgtaggagaaattttcatttcttctactgtgctcaaaccactttaaaatatctttttgtttaccttggtcacagcttttggagaaaatgtaactgcatctaccacagtgatgaggtcacctgggtggagacgatcaaagtacttcatgcagacatcataggcatgaagccactccggtgaagagcctgggacttgtttaatgagatgagggtctccagtccagaacaacttctgtaaccagatggtgtacagagagcttggggaaagcatctgtccatccttttcagggattttgggaacaagtttggaaatagacaagatattttgacttgaaagaactggctccaatgcttcaagaggactcatgttttcatctgtcagctttttgtaattaagacctagcagaaaaaaaaagaaagtaggtaagtggttcattccaatgtaaacatagagtcactttcaaacacacacacatagccctctatatgtctgaacgcaaagatctatcaacttagctctaagtagctagtttatattttctattagaaagatcaggagatctgagttccagtcacagcctgaaacttattcggctttgtgatcccagataggccattcatcttctgtgtgcctccatctccttgtttgtaccctagagatgacaatatctccatgcctttcgaatccgccgcagcacctatgttttcttctatcagtgcttcaacaaactgcattacatttctttgttatttatctggcatttcactagttacttgaaggcaaggattgaatcttattcccttatcctctgtgtctaggccagtgtctcatttgattattcagaaaacaactgataaactgatgggaactctcacaattattatgaatatcaaacaaacagatttgaatgtgccttgcaaattatgaagtataaaaattaagaggtcttaaagtgtttaatttcttagttatgagcataaagaccattctaaagatttccataatttatcaaatattcaaaggctcttaagtgttccatgcatattttaaacatataggctccagtggaatgaaattctgctcaactgcctattataaagtgtcttggccttgccatttatatacataaaatataatcaatgggagtagtgaaaaaatcctggagcagaagtccaaaactttggattttagtaccaagtctaccataagtcactgtgcgactttcaataggtttcttactttttctggtatttaattccctcaactataagtgaaagagttggaaagataataactaaagtcgattagcttcaaaattctgtggtttcagagctctgcaaccataatgcatgaacaggattgtgtacagaaaattaatccccagatttaattgaaaagaatgaattcaagcagggaaacaaccatcctacctgatgcaacaaccttaaacttcttcagcagtcgaatgtgggtttctggtttaatggcacagttccccaaatctgcacagccacagttttccagaagagtgaaataatactgcagcctttcgtgatcaaagccaccaatagtagggtaaatatacttgaccatgtgctggtgaaaggcttctggatcagtcttcaaagtctcaaagagatgaaggtcttgggctctattttcaatttctagtgtggacaaactgaaattaagagccaaaggaactgtgttaagattttgttcctttattaaagtgattttttttttaaccaaggaagaaacactacttcttatagctcccttcttcctgcctactcaaagacagtaaaccaccaccagaagccagtcagcctgaataaaggaaaacaaatgtgttagatgcctactaacatttaactgactacacactcgtcatgttatctcacgggggtctacagcaaccctgtgaagtagctttaacttcaagttcctgcagttgggagagctgtctgatgtctcccagctagaaaataaaccaacatctgtcagcgtccactcttaatcatttattcattcataaaaagggtttaaaaatctatacttcttcacagaaacataaacagccttattatttcaggaatttaggaaatgatacagaaaaaaccctaaactttcaggcttaagatttacatgcaagagtcttgaattaatattcaataaacccaaattttatgctgtgtccagataaaagaaaaatagaaaaagagggataattaaactttcacttgggttatctgcagtaatgctacttaaataaaacacatatcttaatattttcatcctaacttagatgtctttgtaatctaattttaaaaagtcacttaaactcttgggaaaagaaaaagtaaggtatttttgcttggttgattggtttgtgcttttagaaggggaaaggagggggttaattttggtcttgtgcttctccctggacagaatctggacagagcctgtggtctagtgtaatctcaatgccccttacgtgatgagtttcatactccctaattgtaagagtccttcaggcagccctgcattcacagaagtacccaggttctagggttctcggaagcagcaacagaagcatctgggggcagtaagtgagaccttgggcagcaacaaagttaggcttcaaaaagttctaaagcagctcctctgaaacatgacaacttgtttactgaaagtgcccaaagacatgtttttggtttatgtagataaagttagtataaatcatgttttaaaactttcaggggaatgtgacaacacttgggttaaaaagggtaatctacaaagtcaaagcatcaagtaatttttaaaaactggtctttttacttttgcttcaagaaaaaccttatttttccattaagacacagtgcaaacatttacaagaatatctctatctataaatatgtccccagtctataaaaatttctctcactgcctcctctattggcacatgctgaatatccttctattctgttattcgtaacgtattttaagtacttattaccttgtctatcttccttcctagactgtgctgcttgatggcacagaccttattacatcatcttaatctctagtttctcaataccaagaaccagagtgtggcacaaaggaaacattcaatatatgtattatgaacgccaaatagatgagtggatgagcaaaaaattaggtgtcctctatgtacaaggcactgtgctcaccactggggaggatataaagacttacagcatagagctcccatccaaatttgaaaatccagttgagttacaaatacttacagttaaataatgatgcaaaacaatagtatcacctgacaaagggcacaaaattatagtccaattaagagaaggatcactaaaagctatgcctgcagaagatgtagaaatcaatgataatggaaggcttagtgaaagaagcacttgaatttggcaggaaggagtgaagcagaaataatgtgaacaaaagtatcaagaaagcaaaacgcctgtacaaggaacagtgaatataaatggctgggtggtcagaaaatatacttgataatatcactattcaacgaataccatcatctctgaaagacagtgtacacacagtagtatgggacagtgaatcacagaatttctgatgttccttcataatttgcaaaatgaagtctaaaaacaatgtagtaaggaagtaaataagaaactgtgtagtcgcaataaaaggaatcttattgacaaagatttgcaggcagaacaacatgccaaaaggaggaaagaaaacaaatttgtatttatcatgctgattactttcttgctaagttaaagttgggtaattatcaacttatagatgataaattgccattcagagaggttatatgacttgtttaagataaagagtccagatctgtctggactcaaagtacacaactgctcaggacatcacaaagcaaccatcaaggtcaagcacccatatcaacaaccacttcaaaaccaggattctttctgcaacacagatatgagttctctctcccagcagcaataatcgaaaagagttctcctgtcatacttcattcgtaacaccttgataaacaaagtattcaagacagactcatctacaaaatggacaatgactatatcataacagctttagttcatctatgtttgacttgattatgaatatagtctctctcaatcaacattactttccctcttgcccactcacttattcttctgtgcctacaatttagtttgcctgctgtgcaattttacccaattatcttgtcaagacagatactggaatacctttactgactcatgataaatacccaaacctcccttttcagtaaattacaaggtgctaagatcttttatagatgctagtaatcaatagctcattttaatagtttccattctgaagaaagaagctgttatcttccctttggaaccagaaaagggaaatctttctttgaaatctttgtttagaaaaaaattccaaagaacccatattcaagagagtagaaagaaataccatgaaaccactgtggacttttcactaatcaaattaatgattacccttcaaacctgtttaagtgatttttcctgaaccaagttttagttataaagcagcttatatacatagtgcatatttaactttcagagattaactaacagaagaagccagcattagttgcactcaatgcacagaaataaattattcatactaatctcatgattaaggtgttctgtaatggcttccagatgtcagtcacccaaaaatgtgattcaagaacatcatgtattgaaaggacttttatttgtgtaagaaaaacaaatttatttaaatacatttttctttactcagctgagatggagtgattataaaatttcattagctcactgaaaggagtgcttagaaggaaagaggaaggaggaggcaagaaggaagaaggtgaatgggagaagggagaaggctgccgggagagggggaagagagaataaagaggatggggaagggctggaagtgaaaatgtacacataacctgccagcactcttgttgctattagctcattaacactcataataaccctctgcaaaaggtctaattattcctattatctgaaggaagctgaggctcagacaaaaatcacacaactagtaagagatggagactgattctgagttgagtctttcaagttcggctttctgcttctactcaataaagcaatgaagctgatattttcacgttgaaattttatgttgggtacagttcagctgcagtggcttgtaagcattttccccaaaggctaaccctaagagcatgaagatctatgaatcaacgtgaatgatcatcactgctggtgaacagtggcctcaccattgactactgagcaacaagacaatctaccctccaaatcacaactgctcctgcctgaggaagtcaatccaacatcttagcacataaatgcctcaggatgaccttgatgtagcagacttgatctataatgcagcctgacagctgaatacgtgatttctcaaggaaaacgtggtcaagataatcatggcattttttagttttgccaacattctggccaagtgtctgcaaactgaagaatggaatttaactaacttttcaagaacacccagggagttgatgagagaatcaataaagagtgtcttagagtctatttctcatcatgctgatattcagtgagttcctttatggaatgttttatgacaggaacagagtgagaatgttgaaggccatatgaataggctttgtctcttctataaggacaacctggtatccctaaagccttttaatttctcatagaatgtcaattctgacttgtttatatacttcatattactaccttgccaacaaaaacagttttaagaaacactatagcatagaaatagtaatagacaccacttacagagaacttactagtgctaagcactatgtcatctgatttaattctcacaaagcgtatatcttatcattgatacccatactgacttgaaaaataattgttgaaaaatcagatgtgcaatgttaggttgccagggccatgtgatgggtctggtaaatctagcctgttcccagaattaataataatagctactattttttttaacacctaatacatatcaggtattctgaataaatctcttcaatctcacagcagttctgcaaaatgggctgaaaatagtcattttgcagaggagaaaacttaggcttaaagagataaaacaacttgtctatcaataatattctacaagaaggtcacagagccagagcctgcagcaggtttgcataatttaaagcttgcgcactttccacaggctataaacataccaaaatgcattttcctgtttatgttttgtgccactatcaggcgtttctgactatttggagaaaaacagtgttaaggatcacaatatgaaaatgaaggttacaagttacagatatatggaaggaatcacttccactttcataatggcagtaatcagtatttctggtttttaggatttctagatttcttcttaggcacaatgcaaatcacagtcctaatcaaataatctgttcccctagaccaaaagaaagagcaaaaccaaatttagggctcaattttaacaactgtgtaagacctataacctgaatatggacattcaacattcctactctaacaaatatttcccctggtcttgtatttttgttttagttttcaatgtcatgacatacttttgatcatctaagttaccttaaatcctgggggattaataactaataggggttagatgctccctctctctctattaaccactctcacactaactcttcaactgagccagagttcttcaaggaaagaagagacataagggccagaatttagaattctttacagtgtagcaacccggacacaaacctatgtgaacaatagtaaccttcaggcagaaattctattttctgtttcaattcaggaaaaggtaaggcagatgcaatatagtttactcatctctcctcagatagaccttgttcttacccattcttgcatctgggaccaaaataatcctactaaagaatatgaaatcagctctggaaaacagcacagcacattcagagtccctatgacctgggaccctccccatgtgtctaaaggaaacaacagtaaactcaccaacattgaagaaggtgctattatgatctctagcaaccaagataaatcacttgtataaccatttgagtgaccaaaaagtagatattagagtgaaaccaaggcataggatgtttggccttgaaatctgctgtctaaataagaagggaaaagatggaaggtattaccgagtctggcagtataaagacatgtcctgtcctccatttagttctcctttgcttactctgtcccagccacaatggtcttcctttagttactcaaaaacaccaagaactgtcctgcccttcttttctgatggcctggaatgccctttcttccattcctcttcaatagtcagctctttcctcctcacatccaagagaggccttccccatctacttcgtgtgcatttcctttatggtacttactacaacatacaacttgcttttcggcagcttttgtgggcgtcagggtgacgggggagggttccctattagaatataagctccattagggcaaggatgtgtctgtcttgttcagcacttaacactatgctgggaatacaaagatactaagtaataataataatatttgatgaataaatgtggtactattatatcagccagaagcatcctctgcatttcaaaatgaccctgtgtccaaaactgaaaagtactaatcaaatcagcagaattaacaagaatgacacaaataatcataatagccttgatatagtttgattgcatgcccacccaaatctcatcttgaattatagttcccataatccccacgtgttgtgggaggaacccggtgggaggtaactgaatcatgggggtggttacccccatgctgtgctcacgacagtgagtgagttctcatgagatctgatggttgtataaggggcttttctccatttgctctgcacttctccttcctgcctccctgtgaagaaggtgcatttcttccccttcgtctttcgccatgattgtaagtttcctgaggccttcccagccacgtggaactgagtcaattaaacctcttttctttataaattacccaagctcaggtatttcttcatagcagcgtgagaatggactaatacaaatttaaaagagccactcagttatacatttttcacagattttctctaatcttcacaaccctctaaggtgaggataatgatccctgtaacccagaaaacagcgactcgaaaggattaagaaacatgctccaggctacatggttggtggctgtgggcagatttggatcttgaaagttcatctgactacaaaacccatgctgtcatcaataggccacaggtaatctggtagttactattgtctataaaaatccaccaacatgtctagaatagccagaaatgaagatggctactaagtttgtaatgagtgacaaatcagccttgagtctggggggttcaacatgccccagtggaaccaagaggctgagagagccagtgtctgctagttggaagtgattctaggcattcatggccacccaaagccatcactgctatttaaaactagcaagacattaaaacaacaacaacaagaaaaagcgggaaatggaaaaaaaaaaaaaaagagtccagcaactcaaaaacatatgtgttcatgagaattatctctgacaagagtgaaattccaggaaaaacttccattaatgaagctgtgatcatatgtcagatactacaggttagatatcttaccactaaataatttaatttgtattactccttgcttaaagaggaggaaaatgagcttcagagaagggaattatcttgcccatggacacacacctagaagtgacaccaataggatttgtttgatctagctattttgattttaaggcttatgattcatctgctatataatggtatctcacccaaccctctctgtgtacacttattcgcaaatgtgctgatgcaggtgatacctccaaaatcaaccaggatgaaggggaatgtacaattatgagaataataacttcacaggggaaaaaattactttttaaaggaatagtaaaacaaaaccctaaaacaaacaacattatttctcttgcaacttcccagtggcactcactcaataaataaatgttgggcaatttctattgtattaacaaggctgatttctaatactatgttaccaagttagattaaatagtaaagcaaacagctgccttttaagtaaagaacaggcagcacctaacaccacttactaaatcaatattaaatgctttgccactcacaagtgatggtgccaggaggtaatgatttcctgcttttgtaattgctgtgcatctgcataatcacagtgctaccaggtataatgatatgctaggaacagccttgcacatcactcgattgcctgataatttataatatattcagagaccaaggaagcatcctgtttgtacagatacaacatccttttacgtaacattcaatgaaagaaaaaagatatttaataaaatgccaggatatttttaaatgccagtgtgtgtatcataagaaatatttatttgaacatattactgtgcttcaaaaatgacgtccatgcaatatttatcacagatcacactatcttccatgtagcaatttaataaatacttaaaaaggaaatgttaaaatttctaagtgattaataaaaattaaaggtgctaaaaatagcatttcttgaccattcagcaggatttgaccccactcaatactcactccctttctttaaactctttcttcccatggcttccctaaaataagattcctgtttcccctcttacctacctctcctgctgctctttctgacccttttgttagcagctcttcctctaccattttaaatgtggaagacttcaagcactgcctcaagctttctcctttcctcattctctgttctttccccaagcatatccacaacatcactatttctcatctatgtgcgtatgactcccaagttagtatttccagctccatttgaaccccagatctgtaagatccaactgcagacttggccttttctctcggctgtttcagtatggataacttcctgattcccttgtcttcctattttttctttttttgagacagagtctcgctctgttgcctaggctggagtgcaatggcgcgatctctgctcactgcaacctccacctcctgggttcaagctattctcttgcctcaacctcctgagtagctgggattacagcggtgcctgccaccatactcagctaatttttgtatttttagtagagacagggtttctccatgttggccaggctggtctcaaactcctgaccttaagtgatctacctatcacagcgcggcctcccaaagtgttgggattacaggcgtgagccatggcgcctggcctctcttgccttttcctcacacttcccccaaaataccttacttcattgggtgcttcctgtctcacggagtgatgccaccatctggcaagtgaacaaggaagaacctagggatgcttcgcgacacctccccttttactcaccctcatatctagtttatccttattaaccaatatattaagtactatctatttcaccttttaaatatctctaaaacccattctggcctgcctttctgtacttcaaatcccttctccaagcaatggtcacttgtcatgccgtctgttaccataaaagctccctaactggtctacatatgtccaccctaactttcctaacatctttcaacacagtagccaaagtgatcttatcaaaatgcaaagctggtcatattatgtccttgttcaccagaatccttaactaaccttctattatcctagccttctatttattattcttaggaagaagtcaaaagcccttgctagggcctccacaatcttgctgtacagcctggctcctatgccttgccccagtctcatctcacgccatgttccacccaaatccctggaactcaccaacactgtccatttgttcctaatcaaagggcctttgaacttactgtattgtctacctagaaaatgcttcccttctacttctgtcgttaattccaacccaatatttaagtcctgcttaagtgttacttcctgggaaaagcctttgctaactatgccaaaccctccaattgagctcaattacacagtacttatcagttttaatttcacatttgcctatgtcattattcaattatcatctgtctcctactgtaagctataagttccaagacagctaggatgcctgtttttgctcatcattgtaaccctagtggctaatacttagtctagtacacaaaaaattttcagtaaaaacatttgaatgaatacatcaatgaatggtaaaggtgtatcaaagatgtataaggaaagaacttaccaagacactagtccactgtagattaaaggaaaactaaaattgtactttacaacttcttcaagagtcttcaaaaatagactctaaagaaagacatggaaacaaacgtacatatgaactgtgtgcttacccactgtccgtgaagaggaactccaaatgggtcataaaaacttcccagcgggagacactgtaacgttgtgccagagaaatagcaatgctgtagacgctttcctctagagttctgcagaaatgtccatcaagcccaggaagggagagaggagaaacacatgacttcaatcagcaacgaaaatgctcattaggactgctctccagtgagagaggtgcaagcagtgtggtccttaataagacagttcacagtgatccaggaaaagtacttccaaggaattgtaatgctctttttcactgtggtgtattacaatttactaaggacttgtctagaccagtagttctcaactgtggatgattttgttccccaggggacatttgacaatgtctgaaaacattgtgagcataaaaagtggggcaaggggcagatgtactacactactagcatctcatgggtagaggccagggatgctgctgagcatcctgcatagacagtcccacacaggcatcccgggcagccctgcgtgggcatctcccagtaggcatcccgagcacccatgtgggcatccccctgtaggcaccccgagcaccatgtgtaggcagtcccgtggaggcatcccgaacacccgcagacatcccgcataggcatcccaggaatccccaggtaggcatccccgcataaacatcctgagcaccccatgtaggcatccccgcataaacatcctgagcaccccgtgtaggcatccccgcataaacatcctgagcaccccgtgtaggcatccccgcataaacatcctgagcaccccgtgtaggcatccccgcataaacatcctgagcaccccgtgtaggcatccctgcatgggcattctgagcaccccatggaggtagcccgagcaccgtgcgtaggcagccccgcatgggcatcccgagcacccagcgtgggcatcccgagcatctgcataggcagcccccacagccaagaactgtccagtcagaacgtcaacagtgctgcggttgaaaagatatgaactagactccagagcctacaatcaaaagatagtgcatccctggtctaggggtagagatttgagaaagcacaattagtcacttaacaaacttctatgttttctaccctgtgccaggtattgtgctagctccttaggaactaaaaacaaacaagcatttttcttgaggaattcacagcctagtggaagacaggaaatgtgaaccagcaattaaatatagcggtggtagagctaaaagagaagaccatgaagctccacgagaatggaaagtgaccattgtgaactgcaagtaggaggataaacacacacccagcagagggtgggagggagaagagccttctgagagaatgagggcttctcagacataagagagaaagcgaaggtcaaagtgaggaacgtactgggtcctcaggcctgctaggggacctgcgtctcattctccaggcaatgaagagtccatgaaaagtttaaaacagggaatgacatcgccagatttgagaatctctaggcatataaagagttccaagaaagcagtcccgaacacccacattataaggccattttagaaagactactgcaggactcctattttccagaagagaaacgtaggatggaatttttagttggaagaatggtgtgggtgaaagcacagagacagaaaagaaatctcttactattaagtcactctgctaagactgtatttccccaagctaaggaaaccatgccatttatatgcttgcatagccaggggctggcaaacgttttctgggaaaggtaatatagtaaatatttcaggctttactgccagtctctctggcatagtcttctttttatggcttttgtttttgtttttgtgttactataaaaccttaaaacaaatgctaaaaccattctttgttcatgggctataaaagagaccaaggctggattgactttgtcaacccatggattaggtcattgtcaattagcaattcttattttttatttattttttattttttgcgacagggtctttctctgccttccaggctggagtgcagtactacaatcaaggctcattgtagccttgacctcccaggctcaagccatccacccacccacctacccacctcagcctccagagtagctgggacttcaggaaaacactgccacacctagttttttgtttgtttttgtttttgtttttttggtagagacaaggtcttgctatgttgccagggctggtagtgaactcctggcctcaagcattcctctcaccttggcctcccaaagtgctgggattacaggtgtgagccaccatatctggcctagaaattgtctcttgaagtatttatttgagtacctacctccacatcatggaatgagaattccttgagaacaggggaccattactaattcatcctttctattatggggttatggcacattgcctggcacaagacattttcaataaggactgatatctttatctcttgataaaggtgggaaggacccaaactatgttataccctcttcacagttaccctgcctgacccctgagaatgtattccctgagacatacagatagtaaaggacaggtacaatgcacttacagaaaactaatgccatgaaaatggacatgcagctgggcgcggtggctcatgcctgtaatcctagcactttgagaggccaaggcaggcggatcacgaggtcaggagattgagaccatcctagctaatacggtgaaaccctgtctctactgaaaatacaaaaaattagctgggtatggtggcatgcacctgtagtcccagctactcgagaggttgaggcaggataatcacttcaacctgggaggtggaggttgtggtgagctgagatcgtgccacagccctccagcctggcgccagagcgagactccatcaaaaagaaaagaaaagaaaaaagaagagaggagaagagaggagaggagaagaggggagaggggacagaggagaggggataggggagagagtagaggggagaggggagagaggagaggggagaggggagagaggagagagaagagaagagaaaagggacatgcagtgagaaagacaaggaagaatggtcactctatgtacaagtgaaggtgatgctgcaaacggaaggacacaaatccttcaagaattcttgtgtgcaagacattgacaacccagctccacagtagaagaggaaagcagcaagctggtggaaactctgaggcatcttaaagaagccattcaaacactgctgtatatttttctaagtaacagattgtacagaagattctattatatatttatcaaaagcatatatttgtcctctagaacatacttcaaatagcatatgctagctgtatgcttaacaaagaaaataaaggccaaaaactctagcaaaatgtaactgatgatataaggcacgccctgccttatgagtttttattctgcatgataatcaccttctaagaaaccgtgaacatggcaccaaggattaccaaacgtccatagcaaaagcatactggacttaagaaacccaagctcaactcctggctgtgtgactttgagcaactctttaaagctctctagttctgattccttttcttaaaagtcagaaggttggcttaggttactttcaaattggacactaaatgacgttatgaaattatgaacctccagaaggacagaggagaagagaaaaacaattccatatttctcttcttaattgagaccagctataggttgttcctgctatttttcttttgatctctctatgccatgcctcgttctaaagataattttgggtgtagaagaagaatttggggtataagaaagaagttcaggctaatataaaattattacaaagaaccaagatgagtttgccaccttctcaaggatttaaatgataatgataaaaaataacatactccactatcataatgaagattatctttgctattttaaagtaatttgtcaggagagaaaaataaccattaaatgtacgcaccattttaccttagtttcaaaggctggaagcctagagactgaatcacatccactgcttttttgagaatgcaatgggttgtaggggaggcctgtggtgctgtggtgaagatgtgaggctttggatggatccaggctaaaatcatagctgtgattctcaccatctatggaacttaggcagttacttaatatccctaagcaccatttttcttaactataaactagggataacaacattttatctcacagggttatccttgaggattaaaagacatttatacaaagtttatagagcactttgcacagtgccttgcccatgataagcactcaataaattgtggtcttagaaacaaaacatctctacttaataactgttgtgggtgaacacattttcccaacttctgacatgtaaatacttctcatttgacctgaacaactaaaacaaaaagcaaacaccagcactaaaaccaaagggaattccacattgagaaaccaaggtctccgcctgggccttgaactgagcaaccatctcacaacaggcctgctcttcccttgacagggggaagggactaaaggagaaacagctggtttctggttctctagaagaccaggacagataaagtcaccctgaacaacaagtcaattgtatctagtttaccatactgaagaagaaattaaagtgccatgtgctttgaaaactgagatttctagccagacacaaaggacaatcttatttttaaatttccatcctgagcttcccatttttcgcccctgatcacatgttattacctctaacatggtcataatcttagaactgggctatcaaaactacaggaaactttaaaaaaaaatagtaactttaaaaaataagcttaaaaaatcattatttgatatttttgagacagggtctcgctctgttgcccaagctggggtggagtgcagtggcatgatctcagctcactgtggcctccaccttccgggttcaaaggattctcgtgcctcagcctcccaagttgctgggattacaggcatatgctactacacctggctaatttttgtatttttagtagagatggggttttgccatgttggccaggctggtctcaaactcctggccttaagggatcttgagatcttgggccaccttggcctcccaaagtgctgggattacaggcatgagccaccacacccatccaaaaatcattattttaactaatgatttaaacatcatgggaaactttttttagctgggaatgctggctgcatctactgatcggtttggagaaggcacacatcccacataagactagatgaagttggggaaagccctattcatagcaaccatgaatgtaaaacttcaaaggactgaaattaatagtcctggtaactgaacttattcttttgcagtttaaatccatccccttatgaaacaaagggtatcacttactctgccagaccaaggatagtttcccttttatactggtcatctgcagtaaaccgctgcacgtccacacccttccgaaggccctgaaggatctgcgcctgagtgaaatccaggagacgttcattgtagcagtgtaactgcttggtcagtgaaataaggtcttcaggccaggcttcgtgctcatgtcgagtcacatgcctggtgaccatcttgattagttctttgggatcagcctatgaaagacatggaaaagaagacattttaccaacatcatacaaacacgagcaagtgagtaacaaatggaagaagaccatgtctgcaaggaactgtttggccctgtacactattgccatttcataaggctcacaacggccctgaaaagtcagttgcagaagtggcactttacccagttagcagaccacaaagacaggacacagaactaggcccaaaaacagctttttgaactcttgctctgttattcttcaacctcaaaacctccgaacacttaaaaaacaatatattcttgctctttcaactattataaacctccatcagatttgtctgccaaccatctgatcactcacagtaactcactctagaagtaattttcatcgccattgcctctggataaattttctgtggactacagtaagtgttctcaataacaaaggtgcagttcaataacctcactataaatggctagacccctgaggagaaaagtattttctccagggataagttcgggaaaaaacctctaccctgttcctgaaatcataaatagtgcaagttgcataaaaaaaggcatccaaccaatttttactcctctaatttggggctcaatgggatattattctacgattcttagcagcttctctaataacaagaaactcattcaaatagaacacaacctagaatccaacagctgacaggaaaggagagtaagtgattaactagccacatttatttatattaaagttggtctgggtgttaatgaagttacagagctgagccatgattttggaattactaatagggagtttaatacttgaacagcattaattcaatccatcccaattcctgggaagacatgctacatatttaatataagcaaattagagaaaaaaaaaagaatctacctttggttctcagaaacacacagctaattatagtaagctgtcagcatttctaatgtgtaagccattattctgatctgcacaggagatttgtcaatgtcgagtctagattaccaaacccagcctgacattctctctcttgatcctattaaggaacaatctgggagtgctgataaaaaacagttaaaggtatcttcttagattctggcatgtggatttgagtaaaagtcaatcttactatatttatttttttccctacctctatgcatacactgagtcctactctcaaaaccacaaatatgtgtctcaagttaaaagacctgggtttgaatacgaactattccatagtaagctacaaggccatctttcattccttcaataaatttcttgtgcacctgttatgtaacaagtcattcactaagaggacacggcccttccctacaggaatacagtctattaggacagacagtcatgcaaacaactgtaaaatggtgtgacacaagtaagcctagggtgctctgggaatacacaggagtgggcaggtgttatcgaagtcttcttcaaagagttaatgtctaggttaaatactcaggtaccataccagtaataacgagggcagcaaaaaacagggagacaaattccagtaaaaggtagaaaatgtgctaacacctatatggctaaggcttgagggaaaaatgaagtgtataagccaaatctaactgcaattagagagtgatttgggaaccagctgcatataaacagtattcctggcgacagatttaggcaaaggggatgccgtgccccagctcttagtgcatctatggctgacatttaactaaatcccttttctatctgttggccaaacccctcagggcaccatcctgaacctccagcacgtgcacagccacctctgcagttccctgacccagggatgctgctcatgggccagctggcccatcttcacctgctcagcactctggtgtgcactgccgtggcctgctgctcttatgcctcatctgatttgcacttttcttcccagttgtaaagacagcaagaccaaatatccaatgatcatggttttagggtggcaggagagctcttttcagttgttccttgaaggagttcctagtgccccagatttacaccccacaaccaaatctatgttcaccaaaacaatgaagaaggcttttcttcatgtatattctcacctggtgctttcagactgaagttttcagcctgaacttgctgaatataccttgaaggaaaggctataaccatctaacctatctctgcgtataactccatgtccctctctttaccaggctattgtttctatcccctactcatagaaccagctaccttagttctcccaatggtttctcatagttttcttccacattcatttttgactttttattatctccaagatttaatacatgtactggcagagtggcctacacttctcattagcctcaatggtagaacccctgctgatttctattctttttgtattctaatatagtctatgaaacaaatcccaaggctaggtgaagagaaaagctccaaaatataagtgtatagcaagaatgagcatggttattgctacaaacatttccacaggctcttatgtaatctgcagaaagttttgagtctccacatacaatcttcgcatgtgacaaaaagacagtagtgtctccttttgccaatgaataaaatgacacagcacagtgaaataagcacagacacacagagcttactagctgaatgaccttgtgcaaattacttaactatgaacttcattgtctcatctacaaaatagcagtgataatatatagcgttcatggttgtgagaagcctaagagacaatatatataaaatatacaaaccaagacctggtaggaagcaggtgttccaaaaataaaaggaattatggaattggctaaaagccatatacaaatcatagtttaagtgtgcctctactgtataattcattttgcattgccttctcttaaattaaaacttctggagggcagagatcatgtgtatatcataatttgcagaacacagcacagtctcttgcacaaatcaggtacatggtcaaagggggagcagattggactggctttgaagtctgtagtactggttgatattgcagcttccccactcagtagagatgcagtctgaaacaagatacctcctatctatttcctcacttataaaagaatgtcaatagcacatcctcctcacagtttgttatgaggtaccaaaaaaaaaaaaaggtattttaaagctctcctttctccattattctatgaaaacaaattggacacagagcttactctaaaagaattaaaaactactgattgacaaggatgtacacataaacaattcacagaaggcatccaaatataagcagacttacacaatcataagccaagagttttgggaactccatggaaggagcagttgattccctttcttgattccactgggtctcagtttcttcagatataaagcaaaggagcatcaccaggtgatcacctttctaagactgaaatcctacagatgtataagaattttatcattaagaggctgggcatggtggctcacacctgtaaacccaacactttgggaggcagaggcaggtggaccccttgaggtcaggagttgaagaccaacctggccaacatggagaaaccccgtttctactaaaagtaccaaaaaaattagccgggtgtggtggcactcacctgtagtcccagcgtaggagaatcactttaacctaggaggtggaggttgcagtgagctgagattgtgctactgcactccagcctgggtgacagcatgagactctgtctcaaaaaaaacaaaacaaaacaaaaaaaaaaactttgcaaatccctccaggtgtagaaagaaggatgttctacgaggctggaggctcaattgaggccagaagtttaagaccagcctgggcaacatagtgagaccctgtctccacaaaaaaattaagaaaatgaaacttagcctgccataatggtgcatgcctgtagtcctacctactagggaggctgaagcacaaggatcacttgagctcaggagttcaagctgcagtgagctatgatcacaccactgttctccagcctgtgggacagaatgagatcctgatctcaaaaataaataaataaataaacaaacaaataaattagaatttcaggccacaaattatagccatcagatttctacacagtttatacaactttaacctcttctcacttactacatacaaattatctattcctctgtgaatcatttttatttcatattctttgtaggagaaacttattcacttttcccaacagatatttaagaataaaaacctagtatttcagtcttcaggatggaacacgcctactgctaaaacatgtactgagtctcattttgcattaacaactctgtaggacaggcatctcttactgtcatctctgttttacggatgaataaagaatgaacttagatctaaggcctttaagctggtaagtgacaaagcagtgctatgactcccatgcataatgcttcctaagaaccatccttttatattcggtatgtagggagggatatctcttaaaaatacaaggctcttgattggaccaatgtagacacagctcccactacatgtaagacttgctgttataacttggctttgtgtccccacccaaatctcatctcgaattgtaatccccatgtgctgaaaaaggccctggtgggaggtaactgaatcatgggggcagacttccccccttgctgttctcgtgatggagttctcatgacatctggttgtttaaaagtgtgtggcacttcccaccttgctctctttctcctgctccaccatggtaagatgtgctggcttccccatcgccttctgccatgattgccaagttttctgaggcctcccagccatgcttcctgttaagcctgtggagctatgagtcaattaaacctcttttcttcataaattacccagtctcagttagttctttatagcagtgtgcgagtgaactaatacacttgccattagagtccttttacaaatgacagattttcaatgatagatttaatgctgtcattccgtattgttccaggtagacatttttccatatattcctcctctcatgccatatatatgtgcttgtgtctgtgtgtgtgtgtctgtgtgtgtgtgtaaatataaacacccattaggttttcaactggatattctatttgagccgcttgctttttcttctctaatgataacggtgttttagaatcacaagcaacaataccattttctgttaaactccctgaaataaatatacttccttttaaaattctgtcttaataaagtggtgaggctgggcacggatgcttgtgcctgtatgtaatcccagcactttgggaggccaaggtgggaggactgcttgagcccaggggtttgggaccagcctgagtgacatagtgagaccccatctctacgagaaataagtaagaaggtggtggttagggaaattctattaattttttgataacaggttgtaagtatatacaagtttatagctcatcaaatatttgtgtataaaaaaattttcagtacttcaatttattgtataaaacatgatactgagaagaacttacaaaaatgagaggagacaatttctcacaaaagcttctaagaaaaaattacttacaggggaaaaacacaggagttggcatcaatgacctggattactagtttttccctctgagctgtaaattttccatttctaaaactgaagcaatttcttctgaatccccataaagactaaatgaaactggatgaatgagcatttgtaagttctagctccctatgcaaattattttctgatcattgccactggtactttctatctcttcctcaagaaattttactggttatgattacttccgatattcaaattaaatttgagtaaaaattcttcccctgagcttatcactacttctcccaaaatattccaaagcatctcctactcattccaacactgcatttcatacgttcatttattcactgcacaagtacacaacaattaaagtttcgaaagcattttcacgtgattttcatttgaccctcctatcaagctggggatgtgcacgggaaacactgtttcttgttttagagacacgcccatttgtagttgaagcatccggagctgtagtcttgcagctggagagtgactcaagccacctggcttcccacccgcttgccccacactgctgagcaagtctccatgagttgctctacatccagcttcacacccagaatcactcggaagtcttggtgttcagagtacactcagacttccctccctctttccagcatctgacttcagtgacatgacgcatgggtatgaaagcttttagcctctaggaagcttatgaagagctctctgggcagcttcaaaatcttccatattcagtattcaaagtgatatggcaaaatagcacaggctgcaaaaactaacagcataaaaagccattcataatttaaaaaggaaattgtgaagagttaaattacttgattttcccctcaaaacttggcaatgcagttcttcagggaggtgaataaagtatgatttctttaaagaatatggtcaaatccccgtaaaaacaaaatgtgcataaatattcatgacaacaaaatgctcaatgacttaatctactgcttactactagaggtaataaatctattctggtttaatagtctctacatttcttggtaatattatttcgaaagttttaaacaggtggtgtgtttcccctttagggttgttattttgcttgagataattttctacttagtattttcaattagtagcttaaaaaaacgcattttagaaatagtctaccataaaattctgaatgtcatcccccgctgagtttgcttccctagtctataaaactaaaggacgtttccatttttaaccgattttaccttctgaacacttttttaaaagaatgctgcaaagatcacacttcaaaatacatttacaacaattacaaaggtaagatatgagggaaaaaaaatcaagatacagaacaatgtgcacagcctacttacatctgtctaaaaaatagttatataagtatgtacagccatcaactatctctggatggatacaaatgggaaacactgacttattattatatactattttcaacacttgagttttggggtcacatgtgtattttttaaaaacgtaaaaatgagttaattagaacaaatactagaagagaaaattctctcagactgaccatttgctaaccatcaatgcataaaattaaaaggaaaaatgcaggcgagggaggcagctccatggatcatctgagagagctgctgggctccagggggcctctgctggctcaggacgatgctgcccttcaagatgcacaggctgtgcatgagaaataagcccacaaattctatcaatacttttatccaaggctagtaatctacctaagttagcattcctgcagcgcatatccaggaggtggaaagagaaaatgtgaaaagactgtggaattagaaacaagttgaactgacaactgagtgaaagctaagcttcactgggtgttattatgtgcaggcaacaaattgaaaccactttgatttcaatttccaagatgattcatctggagtttgtcatatttaattccaaactcagcagtgctgttttatgcagaggaagatgctgaaaacactcaaataatgagccattaggcagtcaatgaaaaactcctatatacttaaaacatccaacatccaactatcatgtctaccagtgtttccttcaaatccatgagggtcagaactcacaactgcaaacctgaagcctcaagctgtcctgacatgcagcacttgacatgactcctgaactcatctacataccatcaacagtcactgaacaactacagtgggctaggtctggtgatacaggaagcaagagaattcctgtcttcaaataaggttgccacactgagcggagagagatgtgtatcgactgtcatcctaaaataactgcttccatgggtgcacacacaaggaacagacagagatggaaggaggccaagtaagtttcagaggaggcgcctctgagctcagacttgcctgcccacagcggggagaaggaagaagtatttcagatggggaactggatctgcatgtgcacagaggcacaacaaaggatgttaaattcagagaaatctaagttctgagcagccagaacataagcttcaaaagaagcagtgtcaggaagcacggctggaggggtaaggaagagccagccagttcactgagggtcttatctgtcatatgcaggatgttacctggtagacatggagtggcacatgaaaatatcctgctgggaattacccgttaagtttgcatgccaccaagatcactcatgtctgaaaaagactgacactgcttctctggaaacaaagcttgagcggtcgctgtccaagtaaaaagcaggtaaagcctggaatcaggggctttacatgacaggatgttactttttaccagagtaaccttgaggaagtaaccacacttctgagttgtatcttctataaagaagattccttttctgagaaatgaggttgctcaaaggatcaaacagcagaatgaacgtgaaaggtactttaagacagctgtttagaaaaatcccacaccgtgttctgctctgctctcacaccacaacaatcaccaacacagaagatgtctgtgaccaaaaatgggggaagagtttctccccaccaagtgagcaatcagtttgggagcagacaggaactggtgtcctccaattcaattcctggagacagcgccagatctgatgtccaagaacagaacacatccagctcagaagaaagatgaaagccagaaggctcagcaaggcagcttatcccaccttcttccagtaagatgaaaagtatttacgttcaaaacaatagaatacatgcgctctgacagaggtaagtacaggggagtacaaaagcacatgggggaggacccaatccagcttggaggactggagaaaggttcctgagtgaggtaacacctgaaccaagtagctaagcaaagaaatggtagcaaaaagcattaaaggcagagtttttggtatggctgcagcatggaaggatgaagttggaaaaacagaggccaatcatgggatgtgcagagcatgctggggcaacgggagatcctgaaggattttgggtggagaggaggatgtctacacctccattttagaatgactactctggcagttgtttgggggaaaatacagaagtaaataaatgaagacaaggtgatgttcacgaggctgtcgcaggacgtttaggtgaagaactatgaaagactgaattaaggtgagaacacagggtggagagatggaaacaaatggagaggtggtaactctcacccactcactggtgatgtatctgtctgtctggaagacattcaaaaaggctttgcatcttgataggaaaaacatcctggattctctctaactcttcacttctacttttagacctacaatcggatgctttccagaagttgccaagaagtccctggagaactagctgactcatgcccatgtgctatctcaggctaccagagagcacctctttccatctggagcagctgaaaggttagaaatccggtgttcaggcatcatcactgggccccatgtactgtactggcttctgttcccacaggattaatgctgcttcctcaagcaatgactctgaacagcggctaccctatgttgttgcacccagaaagggaatggtggtgggtggctggaactatgccacagggtgggtgggtagtgtgacaaccaggaattagagaacaagagatagcatgagggcaggagagctccaaggaacactttcaaaggaagagacaatttgatagatgtgatggttaatattaagtatcaacttgattggattgaggaatgcaaagtattgttcctgggtgtgtctgtgagggtgttgccaaagaaggttaacatttgagtcagtggactgggagaggcagacccaccctcaatgtgggtgagcactgtctaatcagctgccagtgtgcctagaataaagcaggcagaagaaggtgggagaagccaactggccaagtcttccagccttcatctttctcccatgctggatgcttcctgcccttgaacatcagactccaagttcttcagcttttggactcttgggcttacaccagtggtttgttagtggctcttgggctttcagctgcagactggagactgcactgtcggcttcccttcttttgaggttttgggacttggactggcttccttgctcctcagcttgcagattgcctattgtgggaattcatcattgtgggtagtgtgagtcaatactgcttaataaactctccttcatatatacatatatcctattccttctgccgctctagaaaaccctgactaatacaataggaaaacagtgatagaaataagaacgacagttaatgggcagagatggtgggttgatagaagctggatggaagaaacagaaatcggggtaagagggagaaaggaataaaaacccagatgtattctttataccacaatgtcaagctctatgtcctttagagtaggtactctaacgctgaattgataaaagggtacacaaaatataagacctggaaataaaacacactttccaccaagtggaaagaactgtaggaacacagaagcagaaaccaagataaacacacctacttcgaacccttatccttcagtattttgctttatttcttggcaagctttagctgtggacaccccaaatagggtttcctgcagagtgactgtggtgtgtgaatttggaaagagtggtggccagatacaaaaggtgggatggaatgtaatggttttctcctgacttatctgagtcacaaacagtacatgcattaggacttttcattttggtacaaagtaatttactatcagggaaaacaagaaagatataagttgtactacaattttcctccaagagaactactttaattaaagaaatgaaactgaagattataggccaaaatgtggctgtggagccagcttttcagctttcttaaaagctgtaacttgttgtctgtccaacatccatcttcagttctctactttgctgccagtctaatccacatttacttaactgtctcatatggatttagagcaagcagcaaggtcttgaggtccagcatcatgccatagtcatcttccaacaccaaggctcagaagcagggtgtggcacatgagggatgcttaacgactgacagctgactgatggagtggctgatatggttaggtttgtgtccccacccaaacctcatcttgaattataatccctataatccccatgtgtcaagggaaagaccagatgaagataactgaatcatgagggtggtttcccccatgccgttctggtggtaatgagtgagttctcacaacatctgatagttttataaaggggcttttcctgctttgctcagcacttcttcctgctgccttgggaagaaagtgcctttcttcccctttgccttctgtcatgattgaaagtttcctgaggcctccccagccatgctgaactgtgagtcaattaaaactctttcaagtctcaggtagttctttacagcagtataaaaacagactaaaacagtaaattaatactgcagaaagtggggtactgctataaagatacccgaaaatgtgaaagcaactttggaactaggccatgggcagaggctggaacagtttggagggctcagaagaagacagaaagatgtggaagggtttagaagttcctagagacttgttgaatgactttgaccaaaatgctgatagtgatacggacaatgaagtccaggttgaggtagtctcagacggagatgaggaacttgttggggacaaagacgactcttgctattctttagcaaagagactgctggcattttgcccctgccctagagacctgtagaactttgcttgagagagatgatttagggtttctggtgggagaaatttctaaaaagcaaatcattcaaaaggtgacttggatgctcttaaaagcaatcagttttatgcattcacaaaaagagatggtttggaattggaactcatgtttaaaagggaagcagagcacagttagttctaggaagtaactaacttgcttttgattttacaggctcataggcaggagggacttgccttgtctcagataagcctttggacttggacttttgggttagtgctagaacaaattaagattctggggaactgttgggaaagcatgactggttttgaaatgtgaaagggatatgagatttgggagaggccagaggcagaatgatatgattacgctctgtgtccccactcaaatctcatcttgaattataacccccataatccccaagtgtcaagggagaggccaggtggaggtaactggatcatgggggtggtttcccccaagctgttctcatgagatctgatggttttataaggggctcttcccgctttgcttggcatttctctttcctgccattttgtgaagaaagtgccttggttcctgctcaccttcctccatgattgtaagttttgtgaggcctccccagccatgctccatgctgaactgtgagtcaattaaatctctttctttataaattactcagtctcgagcagtttttttttttttttttttttagatggaatttcactcttgttgcccaggcggagtgcaacggcgcgatctcagctcactgcaacctccgcctcccagattcaagcgattcgcctgcctcagcctccccagtagttgggattacaggtgcccgccaccatgcccagctaatttttatatttttagtagaggcggggtttcaccatgttggctggtctcgaactcctgacctcaagtgatccacctgcctcggtctcccaaagtgttgtgattacaggcatgagccactgcacctggcctgggaagttctttatggcagtatgaaaatggacaaatatagtggccttccaatcttatgtattcaggaaaggtacagcatggggtaggcaaacagtaggaccttaataaagatgatatagttggaatggaagagtgagatctaatttcagcaccagcaacccagttcaatgacatccacttagagacctcagtaaaatatattttgagaactcaactgacctttagggggaaaaaattcaagtttacaataaggtactatgcatttggtcaaagtaaagcttcactgtgtttcaatgtacttagagttttagaggaaattatttggcacttgtgtacacacatagcactaatgaaaaggtaagagtaaaatacatttgccaaatttccacttaatcacttcagtcccttaatttataatacatattaatgcatgtttcttatttcacattaagccatacctgagatataaaaaaacaaaattactagagtataataaagttatataaaataagtatctgtataaagcagcagtagctaccaaagaacaaaaaacaccattcccaaaacaaagtaacaccttaggcaaactggttaaaagaataaagcattcctgtttcttgtccaaatgctgacatgagaataaaatatgcccaaaaccaatatacacccaatagtgatggtgtcctgggagagtcatgtgttatggatggtctttccacgtgtcttcttgtaaataaacactgatgaatgaaagcctatctaccaccacaaatggaaggttttcacatcatcctagttcttagatatgatttggaaggttgaggcagctagaactttgacagacacatgaaattatttccttacataaaatataagacctggaaataaaatatgctttctaccatgtggaagaactataagaacatagaagaaatcaagataaatgcatatttacttttaacccttatctttcagtattctgctttatttctttgccagttttaattgtggaaatcttttttttttttttttgcacttcatattaggatgaactttattattacattgttgtacaattcattggtaaacttaaaaaaatacaaatacatgatttgactgttgtcccagaaaagaattttgtcacattgccagctgtttcctcagcatctcctgctcctctcagcaattctgtatgtaactgcaatagtttgtgtgacttgagaaagatgtgccaagggcgtcctcacagtgagaagggaccaggcagaaatcctggggccctcagcctccttctgcctcccctcccgggggatgtgatgacaggaccccgaagctatggctgtgacaggtggggatctaaaggggacagtcccatgaaagacacatgggcacaccagctcactgggagcttttgcttcccaaacaagatgtgggcagcatgactccagcctccggaacccaacaatgtatctttaattgtggaaatctaaaacgggctttcctatagagtgactgcattatctgagtttggaaagagtgatggcgagatatgaaaggtgggatagaattgaacaattttctcctaacttaacccagtcacagacagtacatgctttgggacttttcattttggtataaagtaatttactcagggaaaacaggaaaaatttaagttgtattagaatttgtttggggttgggaaaggaagaatcctgcctcaataaaatctggaccttggatttatgtacacagtggattttaaagtctaatcaatttaattatctactcttaaaatgatccaatacaaaaatcagataatttcacaatgccaataattaaaactggtctgtctatacaagtacttggaaggatttttcagcggcatctgtaatactcttgtgtccacaaaagaaggcacatgtaacttgaggccatgtttacctgctttcacttggaaattaacaataaagttacataaaagctgtctgaggtttttggcaagtatgaataatatgtttcaacattctgtccgtacaactgactactctcatacctctggcttaaaaaaaaaaataaaagtgcagtattgctcaaagaattatgttgcctactttcctaagttaggcaaagtcatcttccttttagaaagtaagttaaaaaaacaattctccattttgcctttcctactactttagccattcctaagaacttagtaaaattaagtaaatgagtaaattaagtaaaagttagagggaggaaacagtattcacaataaatattaaactctacttactgatacctggagaagcaactttgtcgaatacaggaaagccaagagctgcctgccacttggaatacattctggatacatatgtaatcagttcctccaaaaattaaacacgtgttttgagtattttagaaaaggcttaactctgctcaataataagctggaaatcatgaagactcaccctgtaaagaggatggcacttgtccctgaaacatggggccaatcgggcatagatctggaggctatagtaatacgctgccagctggagagataatgcagagggggactgcttttcaaagcaccggttagcatctaacacctaggagggaacatgttagaattaactcagctgaaaggaaattatgaagatcattataaaccattatatttctagtcattcctgcagattttttgtacaaagttcccattacatcaactcaagctcaagatcaacttaataatgactatattaaaaatcacaaggcactataaaacaaatcctatgcagtaaaagtagatgtaaagatcgacatttaagctaactgtagaattgactctctagatactgaccaggatcctttcagcacctaagaaataagaggaggaaaccctttatttccttctcctgcctaattgccctggccagaacttccaacactatgttgaataggagtggtgagagagggcatccctgtcttgcaccagttttcaaagggaatgcttccagtttttgcccattcagtgtgatattggctgtgggtttgtcatagatagctcttattattttgagatacgtctcatcaatacctaatttattgagagtttttagcatgaagggttgttgaattttgtcaaagatagcattgggagatatacctaatgctagatgacgagttagtgggtgcagcgcaccagcatggcacatgtatacatatgtaactaacctgcacattgtgcacatgtaccctaaaacttaaagtataataataaatacataaataaataaataaataaataaaagaaaaaaaagaaacaggaggaaatggcatgcaataaacaattttaccgatgaaaattcacagcatacattttccatttagtcattttaaattcttcattggtaagggcaaacttacttgtggtaaggcaagaaggtaagcaagagccaaggtcatgtcatttggcaaggcttcacttgctagttgcaagagaactgaatgcagaaaaagaaacattattttactgaggttgcatatgatattcatagttattaaatgccatgttttcagccccataagatttcaacaaataattagtggcagagaccttttaggaaaggctgttcagcaccatctaaaaacagatcatatggaactgtgttaaatagtaaccttgccttaattcagaaaaagtatactattggttacttacacatgaggaaattctgtcagggcagctgcaaaggttaagtgcaaagacatgagagaggctggtttcctagagctgggtattttggttttaaagatgcagaccatgctgcaaaattgtgtatcaatgttagctaatatggagggtgataatatgagtactaaagatcagagcaataaaatagctttaggagtgcaaatttagagtaaatcttttgattactacaatgatgataatatgattttgttccttccaataacacccctcctcatcacgctccacaaaaagaaaatcagtctttcattttgcttgtatgtcttaaaatatcccaaccattaaaaacttgtctttttcacataaatttttacacaaaccacaacttgccaatgtcatagctttaacataagagtatgcattgtcaatacggtctgtgtttgtacacagcttgtttcaataaggatgtatcctattcatttagcatctcagtagcaaatactaagtagtcatatgtaatcacaatatgaatcctttatttttaaaaaacacagatgctcatgatcggcactaatgaaggggatagtatacgaataattcaacggaaatgatatttgactttggaaatgcaccacatgatttttccagaagatttaccctcccaattatgtcttacttagactgacatttaagttgtttgtataatctctgtttagctgatagtctaggcactggggatggtgggagggtgagaaggaaactacaaatggctcaagtgtcagaggctgacctagaactctaaatttcctgtggatgattcacagagaaaacctactgtgtcttccccactgtgtatctacaaagggaacatcagttatccaaatatttatttcctacatgttatccgaaccttaggaaccaaatggaccaccagtcagcctcagctcctgcaaggaatcatacagttttagagacattttctaatcaaaagctatttatttcaaggtctacttccaaatttattccttcactcaacatcaacaagaaccttctttgaaccagacattgccttatgaattagaatcctttcaagaataaaaagactctaaacaaataatgtaaaatgtaattcaaagggcccaaatcaaattttgtacaagctattacaagatcaaagaagaggtagctgggcatgggggttcatgcccgtaatctcaacacttgtctaccctgcctcgcctattacttcccacgaaacctgggccctcacccatgccttctcctggctccttctgcctctaaaccaccaggatgcttccccacctgggtgtgtcctgccttccatttttaggcatctgtgaatataaacttcttccttcgtgacaatcgtttccatgtctgtgtgtcttaccaatacccagataaaaccaaaatcccaggcatgttttagaacaacaactacaacaaaatctatacatatataatgaatctcttgcctacaaaatccaacagaatgatacagcaggaaggaaaccattgtcagaaccagaaagtcctgggatcaaagctcaggtccccaactgattgactacataattttgagttccagaattcagaatgttttggactttaggaggttgtgctatatacatatcatgtattacataacaccctaagtatggtgtgggaacacccaataatcaaagacattaatatatctgctgcaaaacatctgaatactcatattaagtgagataagcagactataaagtagcctcatgtcagtttagttcaggttttgatgccaaacaaattataaaaatctttctggttttcaaagcattttgcatttggggtctgaagcagtaaataaggactaaatgaagtaaagtatgcaaagtgcagagcatcactctagcacacagaaagtacccagtaggttccctccatccctctataaaccacaggcttgagtaagcaaattcttttcttcagttacaacatgttttcgtttcccactaaaaatgattgataaaaggttcttccaataacaaccacagtgcaacagagacaattatttccattttagataaatcataattattaatgaattaacaattgcatttaagcataaagactaatttcaccaagaagcaagaacagacttaaatagtcacacttgatgagctgacaaacctctgttatcttatttcctgtggcttagctgcttctcaacgagcactcagcaatcatttgaattagttccccctcacaacctctctacggaagaagttagatgttttcctcaacttacaagagaggattcagagtcacagtaacttttttatttgcctagtgccaacacacaaacaaatcatctcggtgttagaaaagaattctccccttgataactctccactctgacaacttccacagtcccctttcttttcactgctaaccttacaaatgagtggtctgccccactgcacccattaccttgacactccctctttcctcaagtccctccatccctgggtcccaagtaatatgacctccaaaggtcaccaaacccaaggtcttttctctcttctttttctcttaaatctcactgtagcactaggcactgccagataggcctgcctttggcttcaaggacactgagttctcctgcatctgttcctcagatgatcctcctctgtgtgcgtcaccagatcttcgtccttgattcttcaatgtgagtattcagttaggtcagttcttcactatctcttaatcccaccttacatcctcacctagagaattcaactacattctttttttttctttactttttaaagagatggggtctcagtctattgcccaggctgtagtagaatgggacagtcttggctcactgtagcctcaaaatctgggctcaagtgaacctcctgcctaagcctcccatgtagctagaatgacaggcgtgtgccaccacaccagactattgctttaaaatttttttatagagacggagtattttcatggtgcccaagctggtcttgaactgatggcctcaagtgatcctcctgcctcgaattcccaaagtgctggtattacaggcatgagctaccatgcccagtctcaattctatccttaaattcagctggtaccctggtctattttcccactatttaggtttgaaccatctcataagactggccttaccaactccttgttggacactgccactcaaatgctacctcaaattaatcattctttacccaataactttcatatttctaaaatagtaccttattttcccaataaactaaacttaacaccacagagtcatcttggacttcatcctctcctctgctgccagcacttggttcctcgtcaaatccaactgaataatttccaaagaactctttcacacatactttctattttcactgccacaaactctaggctttaattgttcaaaaattagaccatttcaatagccccccaatgctgctctacctgatgccttcagtctttctccttccagcactttcttaaaatagcagtttcatattaattttactcaagcactcagtaattgtgtcattctctagctcagaaaaagaatcttcattagtttcccattccctaaaaaacgaaagttaacatttcctatggagcgtttaaagtctccataaatatgggccaactttaatttgtggttttaatttgccattaaacctaccctgtatgtcaaccaaatcagtctgctatccaaactctctgcctgtgctcatgccattgctttgtataacaaaaataataaaattaatctaaaacacaaatacatataattttaaaaatatatgctctgaggagccaaacatgaaataggtgttttatatcacttagctctatgtgtctcaaaaatcctgcaagaagatagtattatcttgtttttacacaggcttggaagcttatgtaaatctgccaaactcagaaaggcagttcatctgtaaagacaggaaacagaagacccaaaataaaatcgatgtctttcttgatcagtacctatcaggcgattgacaatgttatgctatgacaaacaattaatatatgccattttaagaatgtgaatgaagatattcttaggataaattcctagaagtggagctactgggtcaaacaacacatgcaactgcaattttcattgctactgccatgtggtttttaaattctcactttgagcatctcctccagaaatgctgttgagcttgtgcagttcacccacctgaacatccatgaggtctaattccctagggacttcttgacatctgtttcaaccacccaagccagctggagaatgtgcaaaattattttgaccagttaaagacttcattcatgagttgactcctcagaattaatcctaagcaaaaggctctctggctttctattactctttctaggaaactatgactcagacattaaccacacgtcacctggtgaactccagtgaaatccagaatagtaattctatttaaattcttcagtgattgggttctattatccagacagccctcctacagattaaaactgtaaactctagataaaatataaaaaacaagtattaaaaggccgggcatggtggctcatgcctgtaatcccagcactttgggaggccgaggcaggtggatcacttgaagctaggagtttgagaccagcctggtcaagatggtgaaaccccatctctactaaaaatacaaaaaaactatccagacatgatggcatgcaccggtagtcccagctactcaggaggctgacgcatgagaattgcttgaacctgggaggcagagactgcagtgcgccaagacaagatcacaccgctgcactccagcctgggcaacagagagagactccatcacaaaacaaacaaataacaacaacaacaaaaaacaagtattaaaagccactggatagttacctaaagccaataaaaactggaagatggctgccatttgaaagaatgaatggtattggtgagtttcccatctttacagcttcaatcctgagggcaagctcctgcccgtgccatgctgggcaggtaaaactcagatagaaaacccacagtcttgaaaaaccacagcccaaaaaatccacaacagctgaaagtaaaagaattctggcggtcccttataaaactaaacaaacccataatctttgacccagcaataccattaaaatttacctaagagaaatgaaaacacatgtccaccaaaatacttgtatgagagttcacagcagctttttaaaacaataacaaccataagctgaaagaccccaggtatcctttaataggagcgtggatgtacagttttatatgcctacaatgaaatactactcaataatttaaaacaaaaacaaaaacctacggatggatacaacatagatgaatctcaaaaactttcactttgttatacaaaatatatgattgcatttaatgaattctagaacaatcaaaactaatctacagtggggaaaaatcagagcatggggtgccctgtcggaagtgtgggttgggcgtgtgctgggaagaggctaagactttctagggtggcaataaggtctgcatcttgacaggagtgagggttacacaggtgctgcacttgtcacaatctgtacaatcatacaactaagatttttgtaattcactgtaaattttaaaacacacaaaagtaaaaaatagttaaagatatgcagtgtagtgtcaagaggtgaagtttactgatatctatgatttactttgaaatgcatcagaaaagaagttgggtttggttgatgaatagaggggtggaaaaatacaggtacagtaaatgtggcaatattaactggagggtacacaggagtgtacgggagtgaacggagaatgagcaggattgaacaggagttcactgcaaaattatttcaactttactgtgaattttaaattttctcaataaaaatgctggggaagaaaaatgaaagaaatcctccctgaaaactgcgtcaaatgcttaagctccctgtcagttacttattccccaaagggggtttcctagaagacacttctggacaagttatatatgcctggtctccagcactgcactcagccagctgtttctggccacactaaacccatggcctcccagctgcttcaagactggaaaaatcccaggcatcaagtataccactctccacaggatttgagatggaaaggaaaggaatctctcttctcaaatccctaacacaattgttgttgaagttatctcatgactttttttctcccacacaataatcccaggcattaatctctataatgtgcctagcccagggctctcctaactaacatgaattgtagggaactgatgggaacagtggagaacatgagtctccactctacctctgggcatcaaaactgtctcagcagccctcacccagactcagagatcctaataaagtagaaatcaaaacccacacttggaagtttcttagtcttggaatccacaaaccatatgaagcaatatttgacaaaatattcagaaaagatggtaagtaagtttcactgggatgcacaacatgtaatactggctagagactgaattacatggacgttgccattaaacataaaaaataaataaataaataaaacctgctctacatttagcagtgtgcacgaatttaatttgtaatgctagttctcaaaccttgaatataaagcattgtctaaacaagttatatggccaaaatcagaggaaatctatgcttaactctccccccgttccaagacagccaaataggaacagctccgctctgcagctcgcagcgtgatcgatgcagaacacaggtgatttctgcatttccaactgaggtacctggttcatctcactgggactggttggacagtgggtgcagcccacagagggcgagatgaagtagggcggggtgttgcctcacacaggaagtgcaaggggttgggggatttccctttcctagccaagggaagccatgacacactgtacctgaaaaaaatgggacactcccgcccaaaatactgtgcttttctcaaggtcttagcaaccggcagacaaggagattctctcacctgcctggctcggcgggtcccatgcccatggagccttgctcactgctagcgcagcagtctgagctagaactgtgaggcagcagcctggctgggggaggggtgtcggccattgctgaggcttgagtaggtaaataaagtggccaggaagcgcgaagtgggaggagcccaccgcagctcagcaaggactactgcctctacagactccacatccgtgggcagggcacagctgaacaaaaggcagcagacaacttctacagacttcaacatccctgtctgacagctctgaagagagcagtggttctcccagcatagcgtttgagctctgagaaaggacagactgcctcctcaagtgggtccctgaccccgtgtagcctaactgggagacgcttcccagtaggggccaacagacacttcatacagggggtgccactctgggatgaagcttctagaggaaggatcaggcagtaatattcgctgtgctgcaatatttgctgttctgcagcctccattggtgatgaacaggcaaacagcgtctggagtggacctccagcaaactccaacggacctacagctgaggaacctgactcttagaaggaaaactaacaaacagaaaggaatcgcatcaacatcaacaaaaaggacatccacaccaaaatcccatctgtaggtcaccaacatcaatgaccaaaggtagataaaaccacaaagatggggagaaaccagagcagaaaagctgaaaattctaaaaaccagagcacctcttttcctccaatggatcacagctcctcaccagcaatggaacaaagatggatggagaatgattttgacaagttaacagaagtaagcttcagaaggtcggtaataacaaacttctccgagctaaaggagcatgttctaatgcattgcaaggaagctaaaaatcttgaaaaagggttagacgaatgtctaactagaataaacagtgtagagaagaccttaaatgaccagatggagctgaaaaccatggcacgagaacttcatgatgcatgcacaagcttcagtagccaatttggtcaagtggaagagtatcagtgattgaagatcaaattaatgaaataaagcaagaagacaaggttagagaaaaaaagagtaaaaagaaacaaacaaagcctccaagaaatatgggactatgtgaaaagaccaaatctacgtttgattggtgtacctgaaagtgacggggagaatggaaacaagttggaaaacacacttcaggatatgatccaggagaacttccccaacctagcaagacaggctaacattcaaattcaggaaatacagaaaacaccacaaagagattcctcgagaagagcaaccccaagacacataattgtcagattcaccaaggttgaaataaaggaaaaaatgttaagggcagccagcacaaaaggttgggttgcccacaaagggaagcccatcagactaacagcagatctcttggaagaaaccctacaaaccagaagagagtgggggccaatattcaacattctcaaagaaaagaattttcaacccagaatttcatatccagacaaaccaagcttcataagggaaggagaaataaaatcctttacagacaagcaaatgctgagattttgtcactaccaggcctgccttacaagagctcctgaagggagcactaaacatggaaaggaacaactggtatcagccactgtaaaaacatgccaaattgtaaagaccatcaatgctaggaagaaactccatcaattaatgggcaaaataaccagctaacatcataaagacaggatcaaattcacacattaacaatattaacctaaatataaatgggctaaataccccaattaaaagacacagactggcaaattgggtaaagagtcaaaacccattactgtgctttattcaggagacccatctcacgtgtagagtcatacatagcctcaaaataaagggatgaaggaagatctaccaagcaaatggaaagcaaaaaagaaaagcaggggttgcaatcctagtctctgataaaatagactttaaaccaacaaagagcaaaagagacagaggaggccattacataatggtaaagggatcaattcaataagaagagctaactatcctaaatatatatgcacccaatacaggagcacccagattcataaagcaagtccttagagacctaaaagagacttagactcccacacactaataatgggagacgttaacaccccactgtcaatattagacagatcaacgagaaagaaggttaacaaggatatccaggacttgaaatcagctctggaccaagcagacctaatagacatctacagaactctccaccccaaatcaacagaatatacattcttcttgcaccacatcacacctattctaaaattgaccacataattggaagtaaaacactcctcagcaaacgtaaaagaacagaaatcacaacaaactttctctcagaccacagtgcaatcaaattagaactcaggattaagaaactcactcaaaaccacacaacaacatggaaagtgaacaacctgctcctgaataactactgggtacataacgaaatgaaggcagaaataaagatgttctttgaaaccagtgagaacaaagacacaatgtaccagaatctctgggacacatttaaagcagtgtgtagagggaactttatagcactaaatgcccacaagagaaagcaggaaagatataaaatcgacaccaaacatcacaattaaaagaactagagaagcaagagcaaacgaatgtaaaagctagcagaaggcaagaaataactaagatcagagcagaactgaaggagatagagacacaaaaaaccattcaaaaaatcaatgaatccaggagctggtttttttaaaagatcaacaaaattgataaaccactagcaagagcaataaagaggaaagagagaagaatcaaacagatgcaataaaaaatgataaaggggatatcaccaccgatcccacagaaatacaaacaaccaccagagaatactataaacatcctatgcaaataaactagaaaatctagaagaaatggataaattcctggacacatacaccctcccaagactaaaccaggaagaagttgactctttgaatagacaaataacaggctctgaaattgaggcaataattaacagcctaccaaccaaaaaaagtccagaaccagagattcacagccgaattcttccagaggtacagagaggagctggtaccattccttctgaaacgatcccaatcaatagaaaaagagggaatcttccctaactcattttatgaggccagcatcatcctcataccaaagcctggcagagacacaacaaaaaaaaaagagaattttagaccaatatccctgatgaacattgatgcgaaagtcctcaataaaatactggcaaaccaaatccagcagcacatcaaaaagcttatccaccatgatcaagtaggcttcatccctggcatgcaaggctggttcaacatatgcaaatcaataaacataatccatcacataaacagaaccaatgacaaaaaccacctgactacctcaatagatgcagaaaaggccttcgacaaaattcaacagcccttcatgctaaaaactctcaataaactaggtactgatggaacgaatctcaaaataataagagctatttatgacaaacccacagccaatatcatactgaatgggcaaaaactggaagcattccctttcaaaaccagcagaagacaaggatgccctctctcaccacacctattcaacatagtgttggaagttctggccagggcaatcaggcaggagaaggaaataaagggtattcaattaggaaaagaggaagtcaaattgtctctgtttgcagatgacatgatcgtatatttagaaaacccaatcatctcagcccaaaatctccttaagctgataaacaacttcagcaaagtctcaggatacaaaatcaaggtgcaaaaatcacaagcattcctacacaccaataacagacaaacagagagccaaatcatgaatgaactcccattcacaattgctacaaagaaaataaaatacctaggaatacaatttacaagggatgtgaagggcctcttcaaggagaactacaaaccactgctcaacaaaataaaagaggatacaaatggaagaatattccatgcttatggataggaaaaatcaatatagtgaaaatggccatactgtccaaggtaatttatagattcaatgccatccccatcaagctaccaatgactttcttcatagaattggaaaaaactactttaaagttcatatggaaccaaaaaagagcccgcattgccaagtcaatcctaagccaaaagaacaaagctggaagcattacgttacctgacttcaaactatactacaaggctatagtaaccaaaacagcatggtactggtaccaaaacagagatatagaccaatggaacagaacagagccctcagaaataacaccacacatctacaaccatctaatctttgacaaacctgacaaaaacaagcaatggggaaaggattccttatttaacaaatggtgcttggaaaactggctagccatatgtagaaagctgaaactggatcccttctttacaccttatacaaaaattaattcaagacggattaaagacttaaatgttagacctaaaaccataaaaaccctagaagaaaacctaggcaataccattcaggacataggcctgggcaaggacttcatgactaaaacaccaaaagcaatggcaacaaaagccaaaatagacaaaggggatctaattaaactaaagaccttctgcatggcaaaagaaaccaccattggagtgaacaggcaacctacagaatgggagaaaatttttgcaatctacccatctgacaaagggctaatatccagaatctacaaagaactgaaacaaatctacaagaaaaaaagcaaacaaccccatcaaacagtgggcaaaggatatgaacagacacttctgaaaacatctatgcagccaacagacacatgaaaaaatgcccattatcactggccatcagagaaatgcaaatcaaaaccacaatgagataccatctcatgccagttagaatggcgatcgttaaaaagtcaggaaacagatgctagagaggatgtggagaaacaggaacacttttacactgttggtaggagtgtaaattagttcaaccattgtggaagacagtgtggcggattcctcaaggatctagaactagaaataccatttgacccagcgatcccattactgggtatataccccaaggattataaatcatgctactataaagacatatgcacacgtatgtttattgtggcactattcacaatagcaaagagttggaaccaacccaaatgtccatcaatgacagaccagattaagaaaatgtggcatataaaccatggaatactatgcagtcataaaaaatgatgagttcatgtcctttgtagggacatggatgaagctggaagccatcattctcagcaaactatcacaaggacagaaaaccaaacaccacatgttcttactcataggtgggaattgaacaatgagaacacttggacacagggcggggaacatcacacatcaggacctgtcagggggtggggggctgggggagggatagcatcaggagaaataactaatgtaaatgacgagttgatgggtgcagcaaagcaacatggcacatgcatacatatgtaacaaacctgcatgttgtgcacatgtaccctagaacttaaagtataataaaaaataaataaataaataaataaaattttaaaaaaacagaaatctatgcttaagccttcaagcgctaattctgtgcaaagtaagtgcctctggaaagcactcagataaatttaattctagaacaaaactcacagaggaaagttgcccatattattgatttggaaatcattagccattaaatcattcattttgctaaataaataatgaccaactttctttagtctccataaacatcttttcatcaactttattaaaaagttctataaagtcagattatgttaggaagtttaatttgtattatgacctacttctaaaccaaagtcaagaattacttttttaccacaatttttaatctgtgtcatttataacctacatcacccttcaattctgctgagtttctgacaaatgtttgacactataaaatagccaaaggtaactgttccagacatattggcattatcaaaatatacaaaatgtgatagggaataggaaaatgcttcataaattataaacccaaatgtaaataaaagagattattattattaaaatcacctctatatttaatattgatggtatattaatacattttttaatataaattgtaagtgctctgaaatgtttttatcgctcaatgatatttgaaatttttaactccttagtagactcagattctttctgtggtgaaatattaaaatcagattgtcagaaaatataatctcaagaaacaccagggcagacaaaaagtcactgcaagcccttaaaatcccatagacatgactaagaacagtacacacactaggatgcagacgcactaagagcatacgctcagttcactggcccaatgactccaatagacacactgtactttcatcatggtgaggagacattcattgtgcacccaccacatagaaaatcctcacagctttgaggaaaaaagagtgagaagtagatgtggtactcagagtttgagccttaagttgaagagaccacacacagccataaaagacacagggagctttctctgtgctgcctggtgagaagctcagagagttaagtctcagtatgaagaatggacacatgaggctggggagaacctaatatctgaagtgaaactttccaaacagtcttcactatggtttcacaactgaattccctgaggttctctagaaaaaacttgatgtatgagccaggtgtgctctgggcggctgagatgggaagactgcctgagcccaggagtttgagaccagcctggacaacacgaggagactctgtctctgcattaacaacaacaaaaaattagctgggcatggtggtgcgcacctgtagtttcagctactcaggaggcagtggtgggagggtcacttgtgcacaggaggttgagattgcagtgagccacaatcacgccactgcactccagcctgggcgacacagcaagaccctgtctcaaaacaaacaaacaaaaaaacaaaaaacaaaacaaaacaaaacaaaaaaacccgggcccaactccacagtttctgaaaaaaaaaaaaaaaatcacctacaacggattctagggccacaatatttcttaaaaattcctaagagattctaaagtataaccaggaaggagaactacagaggtaagtttgaaaaaattgtgaaatcctaattggatcgagtaaagggcaagatggtagcgaggacaatcatgcaggtcaggggaccagtgtgagtgaaggcgcacatcagggtgccatcggagagcaacagcccaggacagaacattcaggctattatgcccattttatagataagaaaatggaagcaaagaaaaatggaataatattcttctacttgaaatccctacagcttttgatagagggttccttcaaaatgtttaaattcactcacaaagccttgcatttcttctcagcctactatcgcttcatctctccactggctggccacacatacccttcctctccaggtattggaatagcctacaaatccctgacaaatcatgaagttttaaatcttctttgcctctatgaattttattccctcttcctaaaatatcccatttcttcttcctccaaacccatctctctatctatttccccttattcatccttccaagtccaagtcaaatatcggctgcttcagaaggcctcttcacaacaccttctccctcagctgccactctacaattccagtgcctctgggtttgcctatcatagcgcctgtcactcacaaatctgtctccccaactcttttataagcccgttgaaggcagggacaatgtctcctactttatattctaagttcctaggacagggctagcacacaggtggctcgaggacctctctttcagtgaataatatccacacagttagaaagggaactggaagagatccctagtcatcttcaagtatgtttctcccactccctaaagctccacaagagaacgtcactatttgctttacttctcaagatcattttgatgtctcatcatttagttatcaactacaacaaagatggctgagcactgtaaggattctatgaaaacaggaggccgactaacccagaaatatgcacctctcaagggcctaattgcttacatactcaacatttctccaaaaacagcactagaaaatatcagaagccttaatacactgagaaatcagtttgagagagtctactccaagaaagcagccatctttaagacctttaactatgtgcttccattattttgcctttttgtaaaccataccttttatatgagaggtattcaaattcacatacatgtacaagcatacctcatagatactgtgagttttgttccagactactgcaataaagcaaatattgcaataaactgtatcacacaaattattcggtttctcagtgcatatcaaagttgtgtttatactatactgtagtctattaagcatgcaataacattatgtctagaaaaccatgcatatatcttaatttaaaaatcctttattgctaaaaaaaaagctaataatcatctgagcgttcagtaagtcctaatctttttgcaggtgaagggtctcaatgttgatggctgctgactgatcaggattgtggttgctgagggttgtggtggctgtggcaatttctcaaaatgaaccaacctctgctagcttcatacttttcttctgtagcttccttacctctctcagccttcacagaattaaaggcagtaaaagggacctgttctggattacactttggcttaagggaatgttgtggctggtttgatcttctatccaggccactaaaactctctccacatcagcaataaggttgttttgctttcttatcatctgcgtgttcactggagtggcacttttaatttccttcaagaacttttcctctgcattcacaacttggctaactatttggggcaagatgcctagctttcagtctttctcagctttcaacacaccttcctcactaagcttaatcatttctagcttttcctttagagatatgcaactcttcctttcacttgaatatttataggccattatagggttattaacttgcctcatttcaatattgttgtgtctcagagaacagagagacccaagaagaaggagagagatggaaaatggctggtcagtggagcagtcaaaacacacacaacatttatcaattaagtttacatcttatattggtgcagttcatggtgccccaaaacaactgcaatagtaacatcaaagatcactaatcacaaatcaccgtaacagatacaataataacgaaaaagtttgaaatactgtgagaattatcaaaatgtgacacagacatgaaatgagcagtgttgaaaaaatggttctgatagacttgcttgacatagcgttgccataaaccttcaattttttataaagcactgtatctgcaaagtgcaatacagcacagaacaataaaacaaggtatgctcacactttatagactaaataataaaaatatcgtataaaccaatgtttgcgaatgttttggttattacttcagtccgttattacgccaaataataggtccacatccaacctagtattttcttaaggtctcagattctatctgtacaaactaccttgataaccattcatatttaatccatgagcaactgatgtaagacaataaaaagaaaagcaagaagtaataaagaataattaaacagggaaagagaaacatgactatacttttcatatatattcaatttcaactgtaattgtaatatgtatggtacatatgtaagatgtaccataaatttaataatagctttttggagaagaaaagaaacataaatatatccataattgtgatacatgccctgattagagaaggataggtagaaaaacatgcatctcagaattgaagaaatatgatatacttagtaaaaacctctagtgttcaagggacccgcacagtggatagggaagtggtatttgcctctcctctctccagcagcatgtgagtactgattgatagaaaaaaacatctaaaataagctatagtatcagcttttggggggaattagcagttctattccctgtatgcattttcccaaattttactttacataggaacgtgctcagttaacagacggcactgcccaggcttattggcagttagaggtggccagtaatacaataaaaagtaataagtaataaaataataagtgcaagctgtggataggactttcaagaaaactgctttttcttcacccttttcttcctcgctgacatctgaaatatagacaagatagctgaagttccagcagcctttgaattatgagatattcactaaggatggcagagcagagagagggggaattcaaaggacacagtcaaagaaactatcctagaaacctaaaaagaaggaggctaaaggaaaaaaaggtataaattgtaagctgtcttcggtaaacttgcatgcctttaattcttttcaaaaatttccacatggaaagatattccaccaagcagaaaattctgaagatcaaatatgatctacattctattaagcataaaatcaggaaataaattttattgagcattttttccattcactaggagaatcactttacataactagccagttaaagataggaatgatattcatccctttaaatcctcaatttacgtacaaatcctgaaaatagcaggttctcaataagtgttttaaacaaaattaataaatggatgaatgaacgaatgatgatgtcaagttatgcaattcaaaattactgaaaaatttcttttccaaactcttgttcattcacaaatttttggttaacaatgttcacctagagttacacactgtcaagggactagaaccttctctcttaccttcagttgttggaaatacttctcctttatttttagcctctgccaattttccagttctcagcaatacttctgcaaagctttccactggaacatgctgataggtgtcataggtcccttcagactacacaaaagaagcagtttcactatctagtagggtgccttttgtcctacaaacatatgcttagaaaacaattataggatgttatgttttctggtgacttgaataataactgctcacaaactaaagcatgttattttatgaaacatttttaaacagattttaatctcataatggtcataatatataccaaaaaaatgtaaaaaccaatgaataacatgagtaagaaccaagacaaataagtatattttcaagaaaattttagtttttgtttctactgtctacaacagcatgacagttaaatctatcttcctagacacgctgtccttacctcagcgacaaaaggatttgagatgacagattcataaaaaggatgacacccttgtttctctagatcttcattggctgtagttccgatttgatatgcaccaccacatttttgcccctaaaaagaaaaaaagtacagaacaatggataaaaagaaagagaaggcaaggaggtagaagaagtaaaagcaaggaaagaagggagagagggaggaagaaaaggctgatttcaaaagaaactggtaatgcctgctgcatttcccacgacctaaaaagagagccagagtcacacacatatccggcagagaatgaaggatcataactacatgctaagagcagcacatcaaccccaccctgcagtgcctttttcttttcctggtcactttgacatcaatgaattagaaacactgaagcaatcgatgttgttcatatggtgagtttttatactacagtcagaataaccactcgaaaacgtcatcttgtctgtgttgctgccctccttaaaaatcctttagtagctctgaacaaggcaaacaaccaacagccgaacaactaaactatgtggaacatcatttgaggttgttaaatgttaactaacattaaaggctaactttccacctcaaccaaactgcctgctttatgcatcctatccgcttctatgtctttctctcccactgtgagggtcctgccatgccgactgcctggttagatcctaactttcctttcaggcccagttcagaccttacctgctgaatccttgacagatggatgcaagatgatatatgactgtgtccctttcatgatccccatctctttcacaactaccaccccacacacggctttgagacttgttaccagcactgcagagtagcaagaactttagtatgcctagattatagttaattatgttttgctctctccaaatagattgtaaagctccttactggaagagccaagtaaaaggaattcacccattcctccaaggtttattgtggttactttatgccaagcatagtctagggaaacgatgaagctgctgctgcaaatgataaaaattacagctgagatttaatagcgtctcactaaacggcatcttcatttatccaactgtttggaccattgttcttaggtctcctctttcttccacatccagaccaccagaaggtctaaaaaatatatcccatccccaaaccaacctcttcccactgccttcatcactaccatggttcaaactacccacttctctcaccgggaggactgatctcactgtctcttttcttctctttctacagcacttaaatgagcatagtaaaagtaaagttggatcacacaattgcattgctgaaattctccataagctttccatcttactcaaaatcaaaatctatagtcgttatcacagtctacatgaggctctcaatgatgggcctccccaccaccttctgatctcatctcctaccattctccccattgttcactcagctcagaccacactggccccttttatgttctgtgcagatgtcaagtgtgctgccccagtccaggggagctagagtttgtatttgttctccttggttcaatcatatctctgctcgaagtgactccttttctgaaaaacctaacttctctatcttaatcagaacttccctcctcagtatttacccaccttgcttatgttatctctgtcatgcttgttattacctgccattacattattatacaaatatgtattttctgtgtctccctcactgacatgttaagttccacaggagaagggaattagactgaagtgtttcttcaccatattcccagtgattaggacatttgacaggaaaataatgcctaataagtatttgctgaatgaatgaatgagatgcacatggagtgtttgtttgaggtgaactgctaatagttgtatgtttttcctctttgttttccagtgtgagattaaaggactgcagtatgagaatgcagagcaaactcaattgctctactgcctgccctgactgacttccagaatggaagcaagaatctgttcaactgttctccttcctgagagcccccagtctgcctccgagcactcttcctcaactaccagtctgtagaaataatagcaaaagcaagtaagcattgataaaatttttcttttcatcacactaaattctgatatataaaccgagccttacctaaatctctattactgtcctttgcaagtactccatgggaatatattacattctataaaagagattactccctatctgatgagaggcctacatttcttaagagattgttttaacaatctagagaagataaagatataacagtgaaaacaactgaaacattgctaatgaatttatataaaccatgcagttgattttaaaaagaaagatgcactgcttacctgaaggggtcgaaggtaagttaaagacttcttccaccactgcccatcactgacggcctgcagcaccgctttggtggtggttgtggtgttggaaaggactttcatggtggtagcagtggtccagcgcaataggtcagctgaattgctacctggaacacctacttcatcctgtattaaagaaacaaaatagcaagggcaaaaatgcattaccataagaacagagaagacagtgataatgtgactgcttaaaatgatcagatattaaacttgaagacagacacatttaaaaatccatccaactttgcttgtaacaaaataaatgttaaaagagcactatcaacatattgttcctctctcaatcatttgccaaaaaataaaaatagaattgggaaaagagaaaaaccccatagtgtattaaataatccctcagaagtacttataaagcaaataattggtattttattttttaccaatctaatatcctaaccatgagatactcatatttgtttccttgacaatacattttgaagtatttattatttaattaagaaataaattattcatctgaataatgccactgtgacccagaaagaagtagaacattcagacaatcaacctttaactattaaaaggcatgtttcccatctaaacaagtaggtaattaatagtgtttgatgggtttataatgtgtacggtacctcctgccaatcttgaagcaatcagctgaaattctcactctccatttactaatctgagagattccacgaggagaaaatgtcaatacattaattacagtcttttaaacagaaaggatgaagaccatatctgcatttagtcaaagaaaaatattatttgttctataacttcctagtttagtgtctatccacttccacttactatttttttcttaagaatctcagttaaacagaagaaaaccttaaggcttagtttatcaataccaatagcttgttgtgatcacagaaggataacgtaatagcttagtttggctacttagatctatatcatgttattcattaagacacaatgtaagtaataataaagtaataaatcatgtaatcaattaattacccgggcatcatcacataacaaatacttaaaactcactcttttagatcaagctgacagttgccatatatggtaagtagaattatgggcccccaatgatagccatatcctaatccctagaacctgtgactatgtaacatgccatggcaaagaaaatttgtaggtgtgattaacagtacagacctcgaagtgaggagattatcctgaattatctgagtaggaccaagctaatcacaagagcccttaaagcagaggatatttctcaataaggatcagggagagtgagtgtcagagataagccatgaaggaagaggcaggagagatttgaagcaggagggaactcaacccacagttgttggctttgaagaggaagaaagggaaccacaggccaaagaatgtaggcagcctgtagacactgagaacagccatcaggcgacatccagcaagataatgcagacctcagtcctacaatcatgaggaattaaatctaccaacaccatgaatgagcacagaaacaagatcttctccagagcctctggaaaagaacacagccttgtcggcaccttgattttggccttgtgtggctctaagaagagattcaaccaagtctgtcaaatttctgtcacatgggaatggtaaaataatcaactgtattgttctaaagctgcaaagtttgtggtaatatacaacagcagcaacagaaaacaaatatattatgttaggacacaaataaatgcatttattcttacttctaaagggaaaacatatgtaagctatattaaccaatgcttacaatttacccaactggctgttgtttagggttgcccatacgtattctaaaccggtttggtcatgcaaaaaaaaaataaaattgtttcttgttggtttctcgggcattagaaagtgcaaaaaccatcaactcaatacaatattatatactataatttaattatgaaaaaaacaacatataaaaatgaatgacatataaataaagaaaaaaacatataaaaagcctgtatactatcagggcaacaatgcaaaaaataattgcttgaggtttgagtaccaataaaatacagtgcctcctcctgggttccagattgtggcatatactacagtttagttcactcagctccactcagacccccttacagattgtcttactgttgctagaagttgagaagctaaaaactacatttcctcaattcccttatagctggtgttccacacatgaactcattttctctctcagtttacatatctcctactaggcaatggggtgacaaaaaggagtaagacacaggctctgccctcaaggagctcagaaaataggaaggaaagcagagatatagagaaataattacaaaataataacaacttttatacgagaggtattaacacatatagagtattaccagaacacgaagagagatcattatatcctctgcctggaggcacgatcacagaaggcttcgcagagaaggtaatctttcagtgggaaaaaattgagagtttccagagaactggtgaaaatgatttcaggaagaaaatacaacttaagaggatgcaacttctgaaacacggcaaaatagaggaatcttaagtgactcagcaaagccacagaacgcagcacagaaagagaaatagcaggacatgaggatgaaagaaggtagaggtaagcccagcaagagacctataaaccacgccaaagaacctccattgtcaactagagggaagggaaagccactggaaggctttaaacaaagggagtaacaatcagatttgtgtttcagtaacattattccaggagcaagaatccagtttggagactgctgcctcagtcccagcttaaaataattagcgactgaattgaggtagtgacactggaaacataatgaagttatcacaaggtattttccaattaaatgtatatattacatttaaatgtttttatcctaattcatataaatgtaaaaagggcccaagataaatcagacaagtagagaaattccatccaatcagctaacaaagaaagttcaagatcaccaagctggaacttagtggagatctgggagaaagaaaaaaaaaaaatggaaggaaagtcagtaacagataaactataattgtttgtgaagcaaggttagatacagtggaggtaaaaaaaaaaaaaaaaagaagagccgcgcaagttgttgaggaatacagaggaccaggttcgtacagagaggaaacaaagacctagatacattatttaccagcagtaaagtccagcatcttatttataatatataagaaacataatggctaccatttattaaacacctactatatgtccaggactgagctaagtgtttcatacaagcatccctaaattttacagtaacactataaaagtgttaaaaattataatactacttgacacaaaagtaaactgaggaacaaataagttaaataagctgcctacagacaactggcctagaggtgtctcctcctctcttctcctttttcttttctttttttttttgagacagagtctcgctctgtcacccaggttggagtgcagtggcacaatctcggctcactgcaatctccgcctcccaggttcatgccattctcctgcctcagcctcccaagtagctgggactacaggtgcccaccaccacgcccagctaatttttgtatttttcgtagagatggagtttcaccgtgttagccaggatggtcttgatctcctgacctcatgatccgcccgcctcggcctcccaaagtgctgggattacaggtgtcagccaccacgcctctcttctccttaagccaatttggcatcaaagtgttcacttgttctttacaggattttgacacgctggcaatattacatgcacatttatatttgtatttatttaagctcatttatttttctgtgttataaaactaatacaaattcactaaagatggtttgcaaattcagaaaaagtatgcaaaagaaaaagaatactatttattcacagccccatgatgcaaagacaattacagccagcatatattctcctttcctgtgtttaatccatggtatcctctttaaacaacttttcattgatgtgtaagccacatcaaatgactgtatggtttaacatattttaacacgcttatgtaacaagcccttaggcaaagaaacataacaccaccagaatcctagaagctcctcttgagctcacttgcagtcactaaccctgccaaaacaaacactatcctgacttgcagcagcataaattaattttgtctatttttatactttatatgaatgaaatcatgtactcttttgttctgatttctttcactcaacaaacattcattcagattttaagagtagttaaagactgttcaactccacgcctgtaatccccgcacttcgggaggtcaaagtgggaggacggcttgaggccagaagattgagaccagcctgggcaatgcaatgggacctcatctctcttaaaaaaaaaaaaaaaaaaaaaaaattgttcaagtcattactatgtcatatcatgttgtaataaacatgccagaacttatttatattttcttctattaatgtgcatttgggtagtccccagattgaagataataccaatagtgctgccctgacatgctggtaattatattttgggtatatacttagcagtggaattgctaaggcatagaatatacatatgtccagatttagtaaatagtgccaaatattttctaaagtggttattacactagccagcaattgtaagagttctggttgctccacatccacgccaacaaatggtatttcatgtctttttcatttgagcaattctggtaattatgtaatggtatctctttgtggttttaacgtgcacctcgccaggactaatgaagttggacacctttctgcatattttgggccatttgaacacgttcttttgtcaagtgtctgtttgagtcttttgccattcttctaatggttatccatctgttttattcacttatacaagctctttatatattctggatacacatcccttattagatacatgaattgtgaatacttgctattactctgtatattacattttcattctcttaatgatgtcttgtgattaacagatgttcttaattttaaattagtccaattcgtcagtttttaactatgattagtactttttgtatcatatttaagagatctccagcctggcaacaaagcaagactcccatctccacaaaataaaaaataaaaaattacgcaggcattgtggcacgtgcctctagtcctagctatatgggaggctgaggtagtagaattgcttgagccctggaggttaaggctactgtgagctgtgatcatgccactgccttccagtctggatgacagggatcctcatttcaaaaaaaaaaaaaaagaaatctttgcctgttccaagatcaaaaagatgttctaagttttccttgacatgtaatatttttgctgtaagtaaaatcttaagacagtatcacacttctacccactcaaatattacatgcatactattaatgcacttaccataatatattgatatttacttttttgttgttctttccaactagacagtgagctattcaagatcagagacactatttattcattgctatagcctcagagtatgtgaaaaatctctattgcttggatctatatataggtgtaagaagtctgcttttactgtgctgattaaatgtttgaagatatattttcacaggtctcatttgtggtcaggtgcggtggctcacgcctgtaatcccagcactttgggaggctgaggtgggcagatcacgaggtcaggagttcaagaccagcctgctcaactggtgaaaccccgtctctactaaaaacacaaaattagccgggtgtggtggcacacaccactaatcccagctactccggagcctgaagcaggagaattgcttgaacccaggaggcaaaggctacagtgagctgaggtcacgccaatgcactcgagtctgggcgacagaacaagactccatataggaaaaaaaaaaagtctcatatgttgtattcagagtgggtaaatgttatttaaaaaagatttcatgtcacattttcaattcctgttcatctgtagaatcttctaaattgagaggatgtattgaatgatttgaaagtcatcaactaatccaagtatagaactgaaaatataaatatggtaagaattatggcacttaagcagactacaactacatttagaggtaaatgaaaccaattgaaaaatatcaataaaaaatgcaggctaagccagcacagtggctcatacctgtaatcctactagtttgggagcctgaggcaggaggatcacttcaggccaggagttcgagactggcctgggcaatatggcaagatctcatctctacaaacaattaaaaaatccatttaattgtttaaatcttatatttaatattttaaaaattaagtaattttttttgtggtggcatgtgcctatagtcttagctactccagaggctgatgagggaggaccacttaagcacaggagtttgaagctgcagttagctataatcgtgcactccagcctggaggactcagggggaaagggtgggaaggaggtgagggataaaagaccacaaattgggttcagtatatgctgctcgggagatgagtgcaccaaaatctcacaaatcaccactaaagaacttactcatgtaaccaaataccacctgttccccaaaaacctatggaaataaaaagttaaaaaataaaaataaaaaaaagaaaagaaaaatgtaggccacaaaacaatgattctatttcataaaatggacctaaactgtgcttctgtccaaatggatgggctagctcaagataggagacttaaaatgtatgaaacctaaaagtttgtttcagaagataaatgaaattcacatgctcagaaatgaatgtgataaaaggattttctgtaagagcttctcctaatgagaatcatgaaagagaaagtaaaatgaaaggctcatttggaccacagaagcaacatttaatttggggggcagtctaccaagatcatagtttaaccagaaacattaatgaagaaaatagatttcttttaacttcatataatggagaaagaaaaaagaggttaggcaaaacttacccccgaaatgattactactgccactttttatattcatagtggcacactgctaattaatttagagtgtataacagcagaaatagattaaacctcaaaaccacgtcattggttcccagcataaaatttaacatgaaatctcattaatgtaaagtgtgttacacagctcaaaggttagcttattaagcactaataatatttttcaaatcctgtaacaacagacaccatcaccaaacaagttcacaagaacatggatagtgccatgtgtcaagtgtgactcacaggaagaattattgttggtcaacgactatgacaaattatctacctgggagtaactttctcccatgtctggcaataagggttaatttctgagaaatctattggcctactgtaaactgagctgttggcacatataaactaggcaaggattacaaatagtttaggttgagctcaacagctaccactctcctccaacatagccttaaataacccaaagtacttccctccacctaacccttacttatagcaaatttcatctgaactcaaaatactaagcatgcaatccttattactggttatactacttttagaaatacctgtcagaacaagcaatagaaaaatactctatggagtaaatcactctaaagtctgactctgcttcatctcatctgccaattagcaggcaaggctacagcttagctgctctcatgtttagggaccatggactcctgtacatgtctcatggaagctgagccctttccccagaaaatttaacaaacatgcatgtgcactcacatgaatacaaacacacacatacacacacacacacacacacacacacacacacacacatcaaattaggtatactggccaggtgcagtggctcacgcctgtaatcccaacactttgggaggctgaagcaggagggtcacttgaggccaggagttcgagaccagcctgggtaaaatattgagaccccgtatctaaaataaataaaataaaaattacccagggatagtggcatgcgcctgtagtcctagctacttggggggctgaggcagaaggatcacttaagccccggagttcaatgatgcagtgagttgtaactgcaccacactgcactccagcattggtgacacagccaaaccctgtctctaaaaaattttttaaaaatcaatattaagcatactatttcaggggatttagaggccaaacccttcttggatgtcctagaattcttagatccagattatgaaacctacattctggaaaaaatagaggtgtataaggtatatttttttttccatgcccaatttttaaaattacttttgataaatgactttgggttctagatgaacccacaaagtaagtttactgaacacataatttggcatgcctactatgtttaagacccagcgctaggcaacaggattactatgacaattaaggtatgacccctattcctaagaaactcatggtacagtagggaagaagggaaaataaggcaatttgccttatttcaccaatgaactgagaaattatcaaatagggtcccattcaactattcctccccatttcacagcagaacttaccccactcatcacatccatatcttactttcctcatttactcattcattcttccacaaatatttatgacaccaacttgtgacaggcattgttgtaaattccggaaatacaaaactgaccaaaatatgaatagtctctgctacaaagaacttacaatccagtaaaagacaagcaaaaataaatacaaagcatgtcagaaaagcatgtcagaaaagcatatcagataagttttatacatattgatatgggctagaaagaaaaataaagcggtgtggctgggtgagaacaccataataacacagagaaagagcagggaagatctccatgaagtgacatttgagcagacacctgatggaagtgagaggataagtcatatggatacagatatttgggaagaacattccaggtaaaatacagcaagtagaaggatccagaggcaacagcttgctgggaatgcttaaagaatggcaaaaaggaaaaaaaaaaaagccaatatgactagagtcagctaagcaaaatgaatgtgtatattgggggcagggaagaggtggaaggaaaataaagtccaacattaaagcttaacagtggagaaaagagaccatgggtgtccttgtagatgactataaagccttagtttctactctgagtgaaaggttttgagaaatgtgtcatgatctgatgtattctgaaagaatcactctggctatattgttgaccattgactatagcaaaagcagaagcacggagacaaacaggacactactttatgactctaggggagatatgatgataatctgacctgggtggtagcagtggtgatagtaaaatggagcccaattctgagtccactgtgaaaggtgggtcagcacgatgtcccaaagaggaggagaagaatcaaggatgacagcaaaagatttatggtacgaacacctacaaagagttctatttcgtgacatgggaaaaactgcagaaagaaggtcattgtttggcaagatgtggtaggtggggagaggaagagggctgaaatcagtagttcaattttaacatattgagattgggttgtctataagaaattaactatagatgttaggttggcagctgtacattcaagtccggaactcagaagagaggtcagggctagagctattaagcagggaatcatcagcacaaagtcgattatttcaagtcaggataatgtatgaatgcatctaaggaatgagtgtagacagagatgatgtttaaagactatgacctagggtatctaacatttagctggggagatgaggacaaaccagcaaagacagtgagatgcagtggccagtgaggtctgagaaaaacaagacgaccgagatgtccctgaaacaagtatgtcaaatgttacttataggtcaaataaaacaaagactgagatttgacccacgaacttcgcaacaagaggtcactggtggtgaccgaggcacaagctgttctggtaaaatggtgacgaaagaaggccccatggagagtagatgaaagataatgagagaaaacaaaaagatgttaccaatactaagtataaactaaagaaatgtagggaacatctatcagagtggtacattttagaccctacagggctaaataatattatggtatttccttaaaagtaaaaggagactggccaggcacagtggctcacacctgtaattccagtgctttaggaggccgaagtgggcagatcacttgaggccaagagttcaagactaatctggccaacatggcaaaaccctgtctctattaaaaatataaaaattaaccgggtatggtggcacacacctttaatcccagctactaagagagctgatgcttgagaattgcttgaacccaggaggcggaggttgcagtaagccaagatagtgccaatgaactcctgcctgggcaacagagcgagacactatctctaataaataaataaatgaataaataaataaataaataaataaagtaaaagaaaactgttaacacccatagattacactgtaactaagatagaaaacttgaatgtcttattttttggaaaatgtcttttgcaaatgaatttaaatagcaattaataactcaataacaatagataaaaaacaaaaatgtattgcttattacaaacacagttattttaaaatataaaaaatatatcagaaatgcacgggccttatgaagaaacagcgggatagaagaaagaataaaattctaacagtggtgctaaaagaggaagcgactagtataaacctttgtgaagaatggaaatctatgatgtagatttgccaatctaatcaatatcatgattcacactcctgcatatcaagctatcaaataagtaaagatattatcccagaagcatgacaatgagcaaagtatttccttctttggtcagacctatatgctcactaaaatgcagaaatggatgttctgaattgtgttggcactgtgttaccatccagatcactgatgtcatgatcactgtaaactgaatcttccacagagaacacttatcaggcaatactgtccaaaaaacaactgaacaaaaattaatgaggacataccatgcttccagtgatgtgctggtatcaacagtaaacaaaacaaagtgagcatttacacaaagttataaaaataaaccacaagaaaataggaaattacctatcccaggagcccatttctaccattttattgcagagcaacactagcatgaatatacaaagatgtgtacgtagaatgcacagtgcagtttagtctaaaatagagaaaagttggacacaatctaaatgtacaaaagcaaaggaaacaatacataaatcacacaataaataaataaaataaataaatcaaaaaaataaataaatcaaacaataaatcatggtacatgcatccaatgaataccatgatgccattatgtaaatggtctatatggaatcacaagggcagattcaatgacacataccagtattacatgaaacagtaagctgcaaaataatatatgcagtatgaattcattttagtttacaaaacaaaataataaacctccaggagacagaggagaagctatacagaaaatctgtctgtacttaggaatatggaaggaaacatatgaagttagaaatgtttatatctaagcagtgggattcatggggctcagaaagatcagagaatagaaagatcagagggaggaaaaagagagaactttgtctttcacatatattaatgtattgtttattaaattatttttatattttaaaaaagcagaaagtataaagttatacatatatccatgtatctattttatcatagatgtttcacatctaatttcttttactttcaagaaatatagtgtgccggataatgtcaatatcccttatttccctataaatgaattattaaaattaaagcttgcattatttctgtaactaaagaaaacattataaactccagtcaacatgggatggtaaactcctgtttgagtacactaactgtgctctaaatactgagcacagaaaaaaaaaaaatcaaaggacacccaagttcaatagagttcaacattttggggctcagaattcagatatcaagagtggctatcaggttctcctttccagagaagaaccatgaatcaaaagcataccctgcaaagaaaaaacttcatccagatttactgtccaggctatgcatttacacaagatgtgggcctaaggaggaagagcacatgaacaaggctgaaaggaactaggacaatcccttcactggctccatgtatgcattctcatattctcaaccttacaaaggggaaacaacgtcatatgaaaaactatcagtggacatattctggagtgaagtgccacaggactgagcagagagaaaccacaatactacagaatcattagatgaggaaggtgggacagaatgatgtttcatcactcaaaattagcttgcaaaccaaaattccagagcacatggggaaaaattaataaagcaataattgtaacaaaaattcagcccaaataaaattatttcatttaaaacttcaaaataattcatttgccatctttgtgtgtactaaatgtgaaatttaaaatctactaagaaagaataagtatcataagataaagaaaacaaaacaaacattattctattaatttttattgtgatatgaggtaaagttctaatttcacctttttacagatggatatacctcaagtctatacttatttcaaaaaagggacaacttattcttacttaaataagtaaataaataaatgtaagcactaaaaactataaaactttcagaaaaaaagcacaggagtaaatttttgcaatcttgggttaggcacagatttcttagatataacaacaaaagtataatacataaaagaaaatattaataaacaaaacttcaggaacattaaacattttttgtacctcaaaagccagcattaagaaaacaaaaagtcaaatatacactgagagaaaaaatactttaaaatcataaatctgaaaaaaaaaaaaaacacttgactgcaagatgttaaaaaacaaaacaaaataaaaaacctcttacagctcaataagacaaataaccaagttaaaacatgggtaaaatatttgaataccattacattaagaaagtataagaatagccagccaataagcacatgaaaaaaaaagagttcatcatcattagttacttgggatataaatatcaaacaaatatcataatgagatagcacatatataggaatggctttaataaaaaaaattctatcaaaaagccagttaaaaatagactgctagctgaaagaataagaaaaagagagaagaatcaaatagacacaataaaaaatgataaaggggatatcaccactaaccccacagaaatacaaactactatcagagaatactataaacacctctcacaaataaacaagaaaatctagaagaaatggataatttcctggacacatacatacataatcccaaaactaaaccaagaaaaaggtgaatcccggaaatagaccaataatgagttctgaaattgaggcagtaattaataggctaccaaccaaaaaaagcccaggaccagatggattcacagccaaattctaccacaggcacaaagaggagctgggaccattacgtctgaaactattccaaacaactgaaaaggagggactcctccctaactcattttatgaagccagcagcatcctgatactaaaactgtgcagagacacaacaaacaaagaaaacttcaggccaatatcgctgatgaacatcaacgcgaaaatcctcaataaaacactggcaaaccgaatccagtaccacatcaaaaaacttacccaccacgatcaagttggcttcatccctgggatgcaaggctggttcaaaatacaaaatcaataaatgtaatccatcacataaacagaaccaatgacaaaaaccacatgattatctcaacagatgcagaaaaggcctttgataaaattcaacatcccttcatgttaaaaattttcaataaattattaatggaacatatctcaaaatcataagagctattaatgacaaacccaaagccaatatcacattaaatgggcaaaaactggaagcattctctttgaaaactggtacaagacaaggatgccctctctcaccgctcctattcaacatagtactggcagttctgaccagggcaaccaggcaagagaaagaaataaagggtattcaaataggaagacaggaagtcaaattgtctctgtttgcagacgacctgattttgtatttagaaaaccccattatctcagccccaaaactccttaagctgataagcaacttcagcgaagactcaggatacaaaatcaatatgtaaaaaccacaagcattcctttatgcctacaacagatagagagccaaatcatgaataaacttccattcataattgctacaaagagaataaaatacctaggatacagttaacaagggatgtgaaggacctctcaaggagaactacaaaccactgctcaaggaaataagagaggacacaaacaaatggaaaactatttccatgctcatggataggaagaatcaatgtatcgtgaaagtggccatagtgcccaaagtaatttatagatttaatgctattcccatcaaactaccactgacattcttcacagaattagaaaaaactactttaaatttcatatggaatcaaaggagaccccatctagccaacacaatcctaagcaaaaagaatcaagctagaggcatcatgctacctgacttcaaactatactacaaggctacagtgaccaaaacagcatggtcctggtaccaaaacagacatatagaccaaaggaacagaacagagacctcacaaataccaccatgcatctacaaccatctgatctttgacaaacctgacagaaagaagaaatggggaaaggatttcctattcaataaatggtggcgggagaactggctagccatatgaggaaaactgaaactgaaccccttccttacactttatacaaaaaattaagtcaagatggattaaagacttaaatgtaaaacccaaaaccataaaaaccctagaagaaaacctaggcaataccattcaggacatcggcaagggcaaagacttcatgacaaaaacgccaaagcaattgcaacaaaagccaaaattgacaaattggatctaattaaactaaagagcttctgcacagcaaaagaaactagcattagagtgaacaggcaacctacagaatgggagaaaatttttgtaatctacccatctgacaaagatccaatatccagaatttacaagaaacttaaacaaatttacaacaaaaaaaacaaccccatcaaaaagtgggcaaagggtatgaacaaacacttctcaaaagacatttacacctccaagaaacacatgaaaaaaagcttaacatcactggtcattagagaaatgcaaatcaaaaccataatgagataccatctcacgccagttagaatagcgattattttaaaagtcaagaaacaatagatgctggcaaggctgtgaagaaataggaatgcttttacactgttggtgggaatgtaaattagttcgatgattgtggaagacagtatggcaatttctcaaggatctagaaccagaaatgccatttgacctagtaatctcattactcagtatatactcaaaggaatgtaaatcattcttctataaggacacatacacacatatgcttattgcagcactatttacaaaagcaaagccatggaaccaacccaatgtccatcaaggacagactggataaagaaaatgtggtacatatataccatggaatactatgcagccataaaaaggtatgcaatcatgacctttgcagggacatagatgaagctagaagccattatcctcagcaaactaacacatgaacagaaaacaaaacaccacatgttctcactcataagtgagagatgaactatgagaacacatggacccagggaggggaacaacacataccagggcctgttgaggggttgcgggagaggagaggaaacttagatgacaggtcaataggtgcagcaagccaccatggcacacatatacctatgtaacaaacctgcacattctgcacatgtatcccaggacttaaagtaaaataaatttttaaaaaagtcagttaataacacacattagcaaggatgtagaaaacctggaaccttaacatattccttgtggaaatgtaaaacatgtgcagacactttggaaaacaaaaagtttggcagtttcttcagatgttagacataatataacaaacaatgcagaaattctacatctagagaaatcaaaacatatttccatacaaagacttttacatcaatgttcagagcagcattattcaaaatagctaagaaatggaaacaacccaaatgtccaccaactggtgaatggaagaagtaaatgctggccaagatactgtaatataactgacattctgctcacttttatttaaatatttctaaacaataattttacaaattcaaactagctctatacttagcccatgctcaagttttaaacattaatcagtccagtcgtataaatctgtagccacttaaaatgctcataacaagctttcccacagtgcaaatgattttttaatgggaaccttgtatacaatccatttctaactctaattagatttatctagagaaaacaccattggttaagtgatatacctaatactagctaaacaaaatgttaatatactctaagtggtagaatactgttccatctaaaaagcataatgaccaacattaataagaaattggaaatctgtaattttggtagttattcacaaattatgcattttgttctatttatagacaaacatcctgttcacagggacaacagcaatatcttcaaacttgtcggctccatttgtactaacataaatgctactgcataacaattacatctttattttgcttggatatataaataaaaatcattattttcacaagtgaagtaatgaaagtcttaagtattaaagtagattacacataaagtcatctctcatttatgagctataatttaatgtggttattatatctactgttaatgtgtaacacacggcatcttatagctaagcactatattttaacctaatgatagtagctataacattctgaaatgtgcctcataaatcaaagccgtaatgcgtgcattgcaggtttggactagcacttcatgagatctagatctattacaatttgctgaaaggggacaaaggcagacaggaaagcttttaagaggcttaaaaagaaaagcaaaagacaatcattttggaagaactccttttccttgctaagtggaacttgtagaggactaccagtggtctccttcatttactgacgggatttaatagagtaacatgtgcccacttgcagtaacacagcatggcccactgcaaagaagccaccaagaggccaggctgacattttataattcactgtagaagcagaaaatagaagtccccaaagtcacaaaaggcttttcacagattttggaaagaacaagcgggttccaaataattcataaagctgagcttagcaaacacattgcaattccatgctcaacagaaaaatgatacactcctcacactggccaaaacatcacagcacctcagtagcaccacatgatgactgaaaatccacttcctaattcattttaggaaaaaaaaaaaaaatccacttcctaatttatttttaccactgactgatcattatgcagttggtgtttccaactgagctttatgaaaagttaactaggcattcactaattgagaagcacaataagagcacacagagatggcatacctccagtgaccggacaataccacgtcacaccgtaaagtgctaaaacggaacagtgagagagaatgcttagggaatatagagaacggggcaattaaaggactcaaggaaaacttcacaaagaaaatacttcatatggaagggataagagcacaagacaagcacaagagcacaagataagaagtgtcctccaaacagagagaaaactctataaaataacactaaaggcaccaaagtgcctgcacagaaaatggtgatatgttccccaccactggaacataacagatgtttgaaaggcatgaaaagggatgatgctggaggcaggcagagtaggagatgtgactggacaagttgtggagggatcagaggttcaaaaggaacaaaacttcagataaagatctcatgaaaactaggtcttcaattggaccttgaaagacaactcctcctaatacatggaacatttagtgacccattagctagtataagaactgttctgaatcccacagagagaacagcaaagaaatgtaatgtgttttcacatccaatgagggaaaacaatagttgctagtcagtacaactacaaatcaaaacatgccaaaggacaaagtgtatccatatcactctaggaccctagaaaatgctatggctgccatctgaagggagtgagtgcaacaacaacaaaagaagtctactgcctgcagtgctggtggctgaatgccatcctccactgaatggtgcatcttctagacctctgatgtccaatctggtagacagtagcctcatgtggttatttaaatttaaattaaataaaattaaatacaatttaaggttggatgcagtggttcacgcctgtattcccagcactttgggaggccaaagctggtggatcacttgaggccaggagttcaagaccggcctggccaacagagtgaaacctcatctcaaaaataaataaattaattaaatacatttaatttaaaatgtgatcccttaagtgcactagtgatatttcaagtgctcaatagctctgtgtgatcagtggctacaatgatgaacagtgcaggtatgacatatttccttcactgaagaaagttctattggcagtgctgtcctagagtcatcactgcaggaggaagaggcgaaaattccataggggcaaaaagtaacattacaaccctctttgagataatcagattacttagtattgaactgggaatacacacgcatattagatccatgttcaccaaattaaattttaatattaaaaaaagagttgtgagaatggggtagttgcatatattctactctgggcaaaagctaagtatctttgccctaattccaccaatagactccacaactgaagctttgtaccagagttctaaaagtaacagtagagtacacaaatactaatgactttgtcaagatggatacagcaaaaaaaaaagttagtgcagttcacttaccacaataggtgtctcccaaaatagtcacaagaaaaataaaggatattttacactgtgaaagtgaagcttaccatttgatggaatctcatgaaaaaccaatctatatagagaatcatcacgtcttaatttgtctagctgggatgtcagaaaccgggccactgtctttgatctaaaaaatgctaattctacgtttctagaaacagtcatgaaaagttaaattccctggagcaaacactgaccaaaagaagacaggtttcagggagcatactcttcctcctttgtctcccaggatggaagattctgaaacacatatagacttaattggttcggacaattttattcataagaatctcaatgaggaaaaggaacacaacaaaaatccaacacaaaataagcaagagaatcgaacaagtacctcaaaaagaggatctctcctgagctatctccatctcattagtaatcagaaaaatataaatcaattaattaggtatcattaaacacttaggataacaggcaaagtttaggaaaccaacaatagcaatgtcctggattggagtaactagcaatcctgtacactactgttcaaagtctcattggtaaaacaaaacaaaagcatttggcattatctatttaggttgaattatatacatatctcacaatgcacatttccagtgctacatatatgcctgagagaactgtttgcccatgtacactagagacatgtacaaacgatgacagtcacattatttttagtcaccaaaattgaaaacaaaccaaggtcaatcagtgttcatatgaataaactgtactatgcacaccgaaattgatttctacatggcaataaaaatgaataaactacagctacatataacagcatgaatggatctcacaaacataacactaagtataactatttctataaaatacaaaaacaggtaaaactaaactatcatattgagggtatgtatggtacgtatcgacattatttaaaacaaaaacaaaagtcacaaagatctggttatcaggattagtcaggacagtggtgatctctggaaagggagagaaaagttaggaatgaaatacggaaggccaggcatggtggctcacacctgtaatccacgcactttggaaggctgaagagggtggatcacttaaggtcaggagttcgagacgagcctggccaacatggtgagaccccatctcaaccaaaaattcaaaaaattagcctggtgtggtggcgctcacctgtaatcccagctacttgggaagctgaggcaggggaattgcttgaacctgggaggtggaggttgcagtgagtggagatcacaccactgcactctagcctggcaaaagagtgagactccatagaaaaaaaaggaagtttaataaggagagggtctgggggatttggaaggtggttaggtactgcttctttacctgtagtttcatgggtgttgtctttatgataatttattgagctggacattttttggtatacttatctatatgaatgttatatttcacacacacacacaaaagctgaaaagaaaagtggtctgcatgcacacacacacacacacacacacacacacacacaaaacccctctcatccacaaggttaggtaatcccactttattccactctcagccacctttcaaactccgctccctcattttaacttacctcttgtactgctttactagttaatggtgaagcactgatattttcccctccttcatgatggatctggaaattcactctttgataaagaatctaaaacaagaataggctatattgtaaaggagttacgtttttaaatttgcttctcatcacaatataggcttgaaatttaaaaagtacttttaaaaagaaaattaccttttcataatgattagttttggtaacaggcttacttcaggacttcacaaacagtttcaaaaggatgcaatggtttcagaagtggggatcaagtgtgaaaaaaatgatatacaatgtaatgaattgttacaggcagtgtatgtgttcaggtctggaacagcctcaattcttgcctccaaagaagaaaaaatttgactggggggcatatgcagaaaaagagaccgaggcgagttttagagcaagagtgaaagtttattaaaaagctttagagcaggaatgaaaggaaggaagatacacctggaagaggcccaagggagggatttgaaggacaagtgcgggttttgacctttggcttagagctttacatcctggcacgttgccaggttcttgtgccccttctctcctgattcttcccttggggtgggttgtgcacacgtgcaatggcctgctggtgatgggaggggagcgtgcgcagtgtgtttacaggagtcgtatgcatgttcagctgcagcgttcttcccttttccggtggaatgccctcacaggtcatacgccagtgaaactccaccattttgcctcttagtgaacatgcttgagctcactggccaacacctgagatcttatcaggaagctgctgatcaccagtttcaggggtttttttctatctatagggaaactgtctttccctggtgctggctgcaaccaattattatcttagagaggcagtgtgacaactgcctgacccatctgatggtcgcctgactttcctggtggggtgtgggggccctctcccgtcttgctcatgtctgcctgactagctaccaactgtaagagaatgactatgggatgaaaatgtgaattctagactctcctcatacatttaacagtgtttctccacaggggcactatcctctcctatgcagatctattctgtgaattttaggaaatttagcatcccccccaaccaaagcccacctcaatccccaatttccaaaggatccctaagggaatggttgctccactggctttaacccatatgatttcagacatattttacatgaccatttagcatatgtttaattcacaacactaactttccccattattttcaataatttctttccaaatattactttctttctttctcaaggctgtcttgtatcctttcttccttgctgttataaagccagcaacattatgttatatcctaatattttcatgtcccttttccataagtgacaatctagttttcttccataaattaaaattctcatactacttttttaagtgaccacatacctcagatacacacacccaacaacatggacgtcatacaggttaggatttcctttatcgaaggacttacttctgtctgcagagagctgctagctgccaaaagaagttcaatgctgctaggagggcaatgtgtcaaagcaaaagccatgagctcttgacgagtggccaagtcctggtaaccttctgattgtcctaactggctacaaacatcccaacttttaggataacctgcaaaattggcaaggaaaaaaatgattcccaaaagaagaagaatattcaatctaagatgacaaatgcaatggcttcctgctcaggtcttgtggtaccaaagcaaaatcatagtcattagtgacacattattttataagcagaaacagataagaatctaagctaggaaagattagggtggtttattatccagaaagttcaatgctactctaaacaagtgtttctgacaaactctgttaaattttagattaactgacaataaatgcaaatgatctactgagatttggtgttctgtgaaaaggcagccatctgaattccgaagatctgagggcctgctgcaaccctgctacttagcactcctgtgagagctttaagaaagagccaaaagtctcacaattcttttcctacaaggacaataataacaccttcctcttgggttgttgaaggaattaagtaacatttgtatttaaaagcacatgtaaactgcaaagtgctagaaaaagagatattatgatagatctccatacagaatcactcactttatagataagacagacatctaaggacagtgaccgaatcaccccccaactcccagcagggatctttttcctatacattatactctgaattcttaaaatacatttttattcttatttgaaggaattccagccttaggcctatttgtctaagtacaaaacttgtagtacagaataatttttttctaaatatgtgaagtaaaaattaattcagctattacccttaccagaataaaatcattataaagctctccatatgaacaatttagatcagtacattttcacagacagccatagttattctaaatttaatgttgcaaaatcactcggttaatattatggaacacagctcatttatgaaaacaatttgctaatgctgaagttgtaatatattgaatcatttttgaagagttttaaatgttttcacagatgtaaagccaaagatcctctctgtgaccaaagttaaatcagacaaccctgagccctcttctcagctaggccttaaccttggcccccagccttgctaggctgcatactccagttttagcaaaaatcctactaagtcagtttagccagaatcctcaaattctcaaggactgatcaaattacttatccctcagcggtgatatctgatcatcctggccagccttcagcaaggtcctattaaatcattttagcaaggatcccctgcccttgatgtctcttaattttccacccactgacccttcagttagcctgctggctacaaatgtccagctatccttgctgtattcagagttgagtccaatctctctcccctattgcagtggtcttcatacacatcacaatagtccttgttgttattaacaagtgtcagaataatgttttctttaacagtacacatgtgaaagttgcacaaatcattagtgcagagctccatgagtcaccatgaagtgaagccctgcattttaaccactccctaattaatgctttgatagtgggtagaaagatgtgtttggaccttcacatattcttcacatattcaagcatagccatggaaagctgacaatttagtacagagcccatgataagaaaacaacaacaacaacaacaacaacaaaactccctatcacactgaagaatgtgttctttacgtgagaaattattctacaataaaatctgattatcctgcagagacttgaatttgaatttcaatatgaagaattttggagttgcaaaccacttcccaatttctcaacatcggtttgaaaagcactatgctatctgatacggtttggatctgtgtccccatccaaacctcatgttgaaatgtaatccccagtgctggaggtggggccttgggggaggtgattagatcatgggtgcaatttctcatggtttaacatcatatccacttggtgctgtcgttgtgatagtgagttgagatctggttgtttaaaagtgtgtagtccctcccccatctctctcttccttctaatccagccagttaagcctcctgctcccactctgccttctgctgtgagtgaaagctccctgaagacttcccggaggcagatgctgccctacttcctgtacagcttgcagaactgtgagccgattaaacctctttcctttataaattacccagtctcaggtatttctttatagcagtgtgagaacgaaataatacactatctttaaaaaaaattaaagaatggaaatattgactatatagacacaaactaatataaaaatttaaattttctcttagataacaaatacaggaaatggcattgaaatattttgcataaaattatttttaaattacgagcatgttttgaatagggactagaaagcaaccaaaatctcaaataaaatttaatgtctgaatctgttaaaatgtttacattaacatataagtacacagcctatatacttaccagtgctcataaaatgtatctcaagcctcaatgtggctggcttaccaatcaggtcaattgatttcagaacagaccttttccattatccatcacataaagaggacataagcaaagtgttaaataagctgtctactcacctgtggccatcagctcctgacaatgcatactggctgctttgtagtcatggaagcgaagtgcctgctccactaaaaggattagaacctgtccccgcctttcttctgggttctcacctgtaagtccaagcaaaggacttaatgattatgacaagcaacgtcaattgatagaagagcttgttaacactgtctttcaaattacttaaaaaataaaacagagagattacagggattttaaatgatgagaggaaaaagttgctttgacctttcaatccacttatgaagcatggaattagccatcagtctcctaagagatcaatgattaatattagttcccaattaaaatacccaaaccaggaagtccaaaatcatggtagtttggaaccctacaaaaaagtcttggtattaccagggtaagggaaagagaagaaaatttatgtttccaaaagaaaccaggttataaaaagggcttgaaaaataatgaccagcagattaagtgaacggatgaagatgatgcagcaataaacttctcatcataaaaattcaactactatttagaaattggaatgcaaatgctgtccagagcactggcaaagattgttccttaacaaattctcgttgggctcctctgagccttactgggccctgtccttggacatatccttgagagcccaattttagcacaacttctgctatcagttgtagccagaatcctccactctggatatctggtcatccctggtaatctgatcaaatccctcatccccaccaccaacccccagatgttatctggcaccctagccagccctcaggcaagaatttgtaccctgttaggtggtttaaccagaatgcctccttaccacagtgattcttctttgtaattttccatctgccccaactgaggttccaacataagtaaaacccaactcaatggaaacagtaaaatcagaaacaaccaactacaactagagactacccacattaactaatcaagtattttctttgtccacaaacaccttatacaattttcccatcacactcactcagaagagccctgaactactgtgagtttggtgctgcctgattcatgaattgctgtctgctgaaaataaacccttaaaattttaatgagcataagtttacttttaacaagcccaatttctctctcttactgcaaaattccattgcagtagtccctgtacctatagtgcagagtctcgcttacaattttttgtttattcatttgaagagacaggtcaaaacctatgttgcccaggctggtcttaaactcctgggctcaagtgatccccatgcctcagcctctcatttaaacatgcatcagggataattttttcattaacagcacccatggatctcaatcacacagatgaatatatatataaatgaggatgaaaaatacaatttacaatatctttaaagcaagtcttacattattaactttaccctgtgtaaacaggatcactatgagatacataggaatgggatatggctcccccttcaagcattttttcttttgtcttctcttgtccgactgatcacaaaacccacaccactatcttgctggcaatataaccactaaccctggggctttagtcataccaagagaatggccattcttctgtgctctcatgatgtttgaccatgccttttacttaaagaattctgggaaatggacttaagaaaatctaaatatcaaactaaggttgtggagtgtctctcctggggaacaaaggctggaaatggatctgcggcctgttgctaccagccagaccaccaagtgacccattatttaaggtaactatggcaaccaaataacaccgacctgcataccctaccactcacttgcacaccctaccactcacctgcgctgcccagcccagccggcatactttaccacagatatcaattcctgctctttgcctaaaaacaaaatcaaaaacaacaacaaaaaatccctaccgtttttttcagggagtctacagagtccttgtgcctctgctgtctcccatgtgcttgagcccaaaccctaaaataaaagccttgactgggaaagctgcttggccgtgtgtgtgtgtatgtgtgtgtgtgcgcacacatgtgtgcatgtgcgcgtgtgcccgtgtgcatgtatttatttatttagagatgtggtttctctccgttgcccaagctggagtgcagtggcactatcactgctcactgcaacctcgacctcccaggttcaagcaatcctcccacatcagcctccagagtcactgggcctacagggacataccactaaacctggctaacttttttattttttgtacaaacagggtcttgctatatgacccaggccagtcttgaactcctggactgaagcaatcctcctgcctcagcctcccaaaatgttgggattagaggcatgaaccaacacacctggcttgtgttcatttttattaggtgaggagccaaccggcctgtgatctgcaaaagccacaaaattactatgctagccaacacactatctacattaaatttttgactttttttccttctaaaggctaacagaatgaaaataatttggggctcaagggatcacagttctggcatgcgggttatttcaaagtgaaaacatttgagctacagaagatgcagaaagaaatcctaactgaatttatcttatctgaataaagcactgtcctcctaaaataaaactgcaattaaacctcctccacaggagtttcctgagaactcagttggaacagagactgtcagttcgcatcaaaaagcccaacagaaccttctatactttcccactgaagccctagcccctcccaccccatccccctttttgttaagttggtatataaaccttacttcttgctattcaagagttattaatcactaagtgacttctgcatgcatctgtaaaaaaaatcttgtttttctcctgtctattgtcaattaattcacaggcacctgaccaaccatttgaaacaaagtagatgaagaaaaagtttttgtcccaacagggactttaaacatttttgccaggtcttttaaaagtattttcccctttgagtgttcttaaatgacaaatataaagggggaaaaccttaaacacaaaataagtttatagtttcactgacagtactaatcttttatttatcagagtaagtttctagagtctaaaaatatacaagaaaaattcagctcatgttaaaagatctaaaattattttcccaaaagttttagaaaatatttcttaaaatattttacataaaatattttatttctttacataaaatataggttttcgttgccctttcaacatattcctttacttttcactctctttaaaacaatttatttgaatggtaggctatccggacaaaaaaaattgtgattatctttttaataatctttattatctattaaaatgtaagcttttgacggacaggggttggttcatagttggatgctcaatacccagcatcaagttatgcacataatagaaaggctcaaaaaaatacagtcatgagttgcttaacaagaggaatacattctatgacatgtgtcattaggcatttccgtcttgagcaaatatcacagagtgcactcacacaaacctagatggtatagcctactacatacctaggctatatatatggtatagctcctaggctacaaacctgtacagtatatttctgtactgaatactatgggcaactggaatgcaatggtaagaattatgtgtatctaaacatagaaaaggtacagtaaaaatattgtacaaaagataaaaaatggtaactctgtataggacatttaccatggatggagtttacagggctggaagttgctctgggtgagtcagtttgttgggtggtgagtgaatgtgaaggccgaggatatgactgtacactactgcagacattataaacactctacactgaggctacatgaaatttagtaaaaaaatatttttctttcttcagtaataagttaactataggttaccataacttaaaaaaaaaaaaaaaacaaaacaaaacagaatctcactgtgtcgcctaggctggagtgtaatggcatgatcaatatttacataactcactgtaacctcgtgaactccttggttcaaggcagcctcctgtctcagcaccctaagtagttaggcctacaagcatgcatcaccacacccaggaaatttttatttttattttttgtagagacaggatttcactatgtttctcaggatggtgtggaactcctggcctcaagtgattcacttgcctcaaccttccaaagtgttgggattagaagtctgagccgccatgaccagccttttttttttttttttttttaactttctaaaacttttcttgttaaatactaagacacaaacacacatattagtctagcccaaacactgggtcaggacatcaatatcactttcttccacctccacctattgtcccactggaaggccttcgggccataacacatggagctatcatctcctatgatatcaatgccttctggaatccctcctgaaggacctgcctgaggctattttaaagttaacttttttcttttataaacaggaggcgcatctttgaaaataacatagtatagtaaacacttaagccagtaacatagtcatttagtaactttaccaagaattatgtaccaacataactatatgtggcaaacttacacaactggctgtataggaggtttacatctccatcaccataaaaaagtgaataacgtgttataacggctgatgtcactaggcgataggaattttcagctctattttaattttatggaaccaccattgcatatgagatcgttgttgaccaaaatttcatgtaccattgctgtgcagtacgactgtaaattctcaattaaacaggcacagaggccaggcacagtggctcacacctgtaatcctagcattttgggaggccgaggtgggtggatcacttgaggtgaggaattcaagaccagcctggccaacatggtgaaatcccatctctactaaaaatacaaaaattagctaggcatggtggaggatgcctgtaatcccagctactcgggaggctgaggcatgagaataatttgaacccgggaggcagaggtggcagtgagctgagatcgcaccaccgcactccagcctgggtgacacagtgagactctggctcaaaaaaacaaaaacaaaaaaatggcacagattaaattcggaatgttattttcaattatgagacaaataattcagctacaaaacaaatacaatgtaatttggatatgtaggctaaaaaggacaaaaatctaatatatttcatattttaaagagccttaaaattatttttaatatttccaggaaatggctgggcacggtggctcacgcctgtaatcccagcactttgggaggctgaggcaggcggatcacctgaggtcaggagttcaagaccagcctgaccaacatggagaaaccccatctctactaaaaatacaaaaaattagccaggtgtggtggcacatgcctgtaatcccagctacttgggaagctgaggcaggagaatcacttgaacccaggaggcggaggttgcagtaagctgagatcgtgccattgtactctagcccgagaaacaggagtgaaactccatctcaaaaaaaaaaaaaattccaggaaaaaatagaaaatatgtttagggcccttgattttctaagctataatatggtttggaggaaaaagcaaacatgttacaggaagggttgaataaaacttttaaaatatgtccctatcgatcttctttatgtacttcataagtttaaataaaatccaaggcaagtattggcccaatctattctgagaagattctagggccaggcacggtggctcacgcctgtaatcttagcactttgggaggctgaggtaggaggatcgtttgtgggaaggagttcaataccaacctggaaaacagagcgagacctcatctctaccaaaaaaaaaaaaaagaaagaaaagaaaagaaaaatgtttctaattagctgggcatggtggtacatgcctgtagtcccagctagtcaggaggctgaggcaggaggatcccctgagcccaggagttcaagattacagtgagatatgatcatcccactgcacttcagcctgggcaacagagcaagagtctgtctctaaataaataaattcttaaaaagggatgatgttgcactgagattcataaacctattattagaataacacactcatgatttagtaacagtaacatatattggaaacggaatatgtaatgtttctctataataaatgcacctataacacaatataaaacctatttcctacataacattgaaatgtttgcatttcttcagaatacattaaattaaaaatgaaaggtccagattataatttttttatgtcaacctagctaggctacaagctctaatctgggtggtattgtgaaggttattttgcagatataattaaatacggtactctgttgactttacgtaaagaagtttatcctagataatcctggtgggtctgactgaacttcagggaaggctttaaagaggttgaggttttccagaaagaaagaaagagatggggccaggcgcagtggttcacacctgcaatcccaacactttgggaggctgcgacaggtgaattgcttgagcccaggagttcaaaaccagcatgggcaacatagtgagaccccgtctctgtaaacaaaaacccaaaaaacagtcagaaaaaaaagaaagagctggtggttggggagagattcccacctgtgaatgacagcttcaggccatatccacagagttccctcctgctcctgatcttctcttcctgactgactgcctatggatttcagacttgcttagccaatccccatagtagtaaaagcccattcctggtaatgaagtctttaacatgtacctctcctacagtttctgctcctctggttgagtcatgactaacagaccaggtatctaaactactcagtctctttcataacctcatttggatgcattcctttctcttatgttatcagatcaattaatttttgatttgagatgtggtaaaatctgctgaatgtctgtgaaaatagccagatgcaaaggtcttgtgaatgaaatgaaggacaataaagtccactgattattattatatagtgtcaaaaaaggtggaaacagaatatgagtaaaggatttaacttaaaacctcttaactataaaatcctcagtaattatttaacttttctctattcctgtctcctcattttcaaaatgagattcctatttctgcctataaaggacaaagaaggaactgagataagtattaaagcataaaatgagtattattattgttgttaatggaaactttttataaagatgtgccaaacagttatcttaaagttcaaagttatttaactgtttttaattcaagacaattccaatctgagcaggtggattaaatgaaaaaatataaccaaagggctgatcttagtgatttacttctacacataaagtggaagtgatggtgtgtgacttccaagaccatatcataaaaggcattacagcttcctctttgctttcttgtgaatcagatcgctctaggagaaaccagctgccgtgctgagagaacacactcaagcagcccaatggagagttccatgtagcaggaaactgaggcctcttaccaatagccataaaggactgaggccccctgccaagagccatgtgaatgagccctcttagaagcagaaccttcagccccattagagccttcgggtgaggtctgtaaatattccccttgaagttggcaaggtctgtctaactgagtccaagaataaaatacactggaaatgaagctgcccaaatatcaaagctagatttgaaaatgccttgaagcagccgggcacagtggtcacgcctgtaatcccagcactttgggaggccgaggcaggtggatcacctgaagttaggagttccagaccagcctgaccagcatggggaaaccccgtttctactaaaaatacaaaattagctgggtgtggtggcgcatgcctgtaatcccagctactcgggaggctaaggcaggagactcgcttgaatctgggaggcacaggttgtagtgagccaagatggcgccattgcactccagcctgggcaacaagagcgaaactctgtctcaagaaaaaaaagaaaatgccttgaagattttgctggtttctcctggagcactgactccaggagacttcagccaacaagaaggaagtctgggtactctgagaccatcaaatggaaaaagtacaaggagaaatcacagagagcagagacacctgtaaagccctatatcagcccccagctatttaagtcttcccagcccaagtacccagacatgtgagtaatgcagcctttgacagagtccaaccctagccacgatctgatgaaatttcataaaagatgatgacctgcttagctgagcccaatctccagaagagattgggaaaatctcttttctctttttctggagagagaaaaataaatggttgttttttaagccaccaggttttggatggttcgtaaagcagtaacagataaccaaaacactctataaggtaaaggccacctatgatacctttcttaattccccaggcaaaaattagcacggcctttcttcgagtcttctattatttgtttacagaagccatgcactatgatcacatcctatgttggcagcataattacttgtttccctagctttctaagagtctaaattctcagagggcagcagctatgtgtaacagaactttgtatccacagtacgtagcagaaaaatattactttctctcttcccattaaaaactcatatagattaccaagaccacaggtattcctgttactatgttaacacatcacaaagacaaaagaggaaacaaatcctagtaggaacataaaaatgcagatggcacctctgagctgctttgttagcttctgtggcctggatccttatggaatattccctgatgatcagagtgcatcagagtttacagagcactttcacatgcattaactcatttgggcctctcctaacttcacaggtgaagaaagggggtatcattcctattttccagatgcagaaaatggaactaaagtaatttagcaaatgtgtggcacagagttagaacttgaaccagtgttctgactccacatgaactgttctccccattcattccagatgtctcacaacggatgactggccccagtcacactgccatcacattggcagtctgctgcaagtccaaatataaagatgctgatgctataccttcacacagactagaaaaggataaatgacacacacgattactaaaactagagaccttaagactcctacataatacaattttaaaatatttagtccattaaatatgttacatatatatatggcttagatgaatacaatttccaaccactgcttatacaaccaaatgaccaacaactcttcttgcagagatcagcataagacaaaactacaaaaaaaaaagtattaaaaagactggtgagcagaaggatgtagttaaggaaatatgaaatgtagagtcaaaaagactttccttaaaagccaaagcctgctatttaaccctgctgggcaaaatatttaacttctctcatctccaacttcccttgcaaaatgagaagaataccaaaatcaacatcatttatgagatgattaaatgagataaaatacatgaaaaccccaccaaatagtaaatgcataaagttttctaacaaattgttcaggttcaaacacaaaaccaaatttagacactgaaggtgaactggtaaggttggtttgttttatatgtaacttttctggttataaatggtaacactgacttctgctcctgactacacaaccattttgaggcaccctgaataagcttgtcttcgtttaagtaatagatagttccagaagctcaatattggcacatttttataacacgtcaatttttctagaaaatactaatccttgcccaaagatgttcttcttagctaactgagaggctgaggcaggaagatttcactgcactccagcctgagcaacagagcgagaccctgtctaataaaaaagctgttcttctgacgctgtaagcacatattctgctattgtcctgcaatgatgtcaagaataacatagaaagcttattctgcagtttagtactcaaaagacttacctgcaaccctcagcagctcagcaaggcccagaagcttggtggattgtttatagcatgtgggggactgggaaatacactccttgatgagactgatccgatcagggcacaatcgcactacaaaagaaagacgtattaaagacttggaccagggacatcacaaaagggtgttaatggccttcctaatgcaaggcatccaaagaaaatgaaaactgggtaaggcatcagatgaaggagaattaagtaaaagtaaaaggcacgtttaacaaacagcaaaattattattgcttctgagtaaataatgtacaaccttgatcttttcttcataaccaaacttctgaagcacaggaaatgaagtgttaatctgaaactagaaaaaactgtttcactgttttatgtaccatgtcaggacttagggaaaaatttaaacgagacagtatttgtctctaaaaacttcatatacttagtattataccagccccctcaaacctcaccctctaagccccattccttgctctaaatatacatttgctatctccactcattaccccagtttggaaggcaggagtcttcaaagtgctcactgttgcaatttattaaccttcctccaaacataagcccaattttctcacataaactggatattaggaaaataaaacacatctgatcaaaccaattcaaactataaagaaatgaaaatcacattaaaaaaaccctagacaaagggtactacgtatattctaggaacaaatggtacttatttacagcagagatggcaacctttaagaaacacagcactgccagggaggctggcccccaataattataataacaacaactacgataatagcaactgatgtgaaaggaatacgagctatgtctcaggcactgttggaggtgctttatgtatattaaccctacacagcaaactcttattaatagaaggcaggtactattatcctcaagagaagaaactgaggtgcagaaaggttaaatactttggcaaaggtcactgaaaaagtgatgggaccaaaattcaacccagctcgctaaatgttttcacaccttgaatcctttatcctttcctaaacccatggctgttctccatatatcttgtgttctctcaaaacttctacataggtgagaggggccagggacgggggagataaagaagagaggtggtatttttcctctggaatgggcttttttggggaaggtaaggatttactacaatttaatgttgaactcaaaaaaggttgcaaggaaagtacaaagaaatcctctatactctttgctgaggttaacagatgattaataatttgcgccttcacacatgtccatgtgcaatcatgcatgcatacagtccctgcttccttcctctgtatattcacacaggaatatgtatatacacacacaaatacttatacatgtacaaatacatacacatatttataatacacatatatacaagtgcatatatacacaaatagttacacatatatacacacaaatatacatacacatttatttttttctgaaccatttgagaataagttgcaaataacatttctctttattgctaaatacttcagtgtgtgtttcctaatgttttgacttttttttttttttttttttttttttgagatagaatctccctctgttgcccaggctggagtgcagtggcgtaatctcggcttactgcaacctccacctcccaggttcaagcgattcttctgcctcagcctcccgagtagctgggactacaggcacgtgccaccacgcctggctaacttttgtattcttagtagcgacggggtttcaccacattggccaggctagtctagaactcctgaccttgtgatccgccctcctcgacctcccaaactgctaggattacaggcgtgagccaatgcacctggcctagactctcttaaaatgaatatttatacatctacaacaataatcctgttgtgtgtggcctttactataaaatataaagtaaatatacttactcttcagttacttccttcaaaatcaccattgctaatacctacatctgagtatagcttctgtagactgtattactcttcccaattatccactgcaactattcatatcccaaattcctgcttcagtaacatgaggcttggccctgtgacatctacaggcaattaatgtgagtggaaatgacatatgccacttctgagtgaaagctgttaagagtcatcgtggaattccactacagatctttcccttctactgtgacaagaccgtgtctcaaggggtggtgctgcggctaaccaaagtggacacgattgtgagcaaggaataagcctgttatcacatattatggagattctgagtttttcacaacagcacaatcgtaaaaactcaccgatacagtatacttcaagcctttccataccttatcacaataaaaacactatgggttttttcctcaatatccgctactattttatggggctttttccagattcagtaacatatgataattgtgagataggtacttttaacacatttctaattttattttcaaaacaaaatttgttgcagatattatctgcattccacatatgtaaaaatctggagttttcatagctgcttttatggctttgttgatgaattattgtattcttcttagagaagctctagctttagtaattctactaaactgacttccttacttttaccactctttttccacctcaataaactcaaggtagagaactgaaaccacacatagcaatggatcatgattttctctaaacttccatttaatggaacactcaagtttgattatttgtctcctgttgccctaagcgatgcacactactaatatttgaagtacattaaataaatttggagagcagaagtctaatagactgcaattaccctgttcaaatgactttttactttatttacttacgtattttctgatcctctggacaatcactataccagttccctttttctgctgatttagggcctgcttaattatatttcaaaatgtgaattctcagttaaataaattcaagccctatctttccaagaaggaagaagtgttcaactcctaaaattcctttccaaattgaatgaatgaacatgaaaaagataggcatgtacgtaccttttaataattaaagataatctaattttcctgcagaaatcatgaatatatctcaaatgatttttcaaaaacctattataaaacacacgtatacacacacacacacatacacgtgcatgcacgtctcagatgtaaaaagcattttctaaccagccacctatattccaaatgcccctcaaaagatagctgtgcaatatcaattgcagtcacttgggaatggcaacagaggcccacaacatatgaagttgctagtgatgctgtggaagtattatacaaatctgaaccgtgtgggcaaggaaggtgtaacacgcaggagtcaaacacttagctgaccagtaggaggacaagtaagagtttccttcttgaagaatcttttgctctcacatcttttcctcagtagagtattctccactgttacaaatgcaggttcttgagccagactacctaggtttgaatcctggctccacctctaactagctggatgaccctaggcaacctaggcaagttacttaacctccctgggccttgatttcatcatctgaacattggaaacaataccaccacctcatagggtatggttttaatttgagacagggtctcgctctattgcccaggctcgggtgcggtggcacaatctcaactcactgcagactcaacctcctaggacaagtgatcctcctgcctcagcactccaagtagctgggactacaggcatgcaccaccaagcctggctaattttttaattttttaaaaaatagagacgggttttgccatgttgccaaggctggtctcaaactcctgagctcaagcaaaccacccacctcagcctcccaaagtcctgggattagaggagtgagccaccatgctgcctaaggccatgagagcccaccctttgcatcagtgtgccctggatgtgagacatggagtcaaaggagattattttggagctttaagatttaatgactgccctgctgggtttcagacttgcaggggcctgtggcccctttgctttggccaatttctcccatttggaatggaggcatttatccaatgcctgtacccctattgtatcttggaagtaactaacttttgattttacaggctcctaggtggaagggacttgtcctgtcacagatgagattttggacttgaacttttgagttaatgctgaaatgagttaagactttgggggactgcagggaaggcacgattggttttgaaatgtgaggacatgagatctagaaggggccggggtgaaatgatatggttaggctctgtgtccccactcaaatttcatcttcaattgcaatccccaggtgttgagggaatgacctggtggaaggtgactggatcatgggggcagtttcccccatgctgttctcatgatggtgagttctcactaggactgatggtttaaaagcgcggcacttcctcgttctcaaatatactcttctctttcccgccaacagatgaagaagatccttgcttcccctttgccttctgccatgactgtaagtttcctaaggcctccccagtcatgtggaactgtgagtcaattaaacctcttacctttataaattacccagtcttgggtatttctttatagcagtgtgaaaacaggctaatacaatgcccaaagggcattttgagaattagtgaatacatataaagcatatttggaacataaaaatcactcaataaatattagctatattattacctaccgccatattcacagaaacacttataaagaatagaatcttctaatacaaggtttctccagatataacttacaggactgtgtcaggaatattttattattatcccaatctgagaaatgtgaagctcaaagatactgttgccacaggttacacagctcaaagtggctacatcagaatgtaaactcacacatgacactctggggtaatcctgtctccttatcagtgtggtagccctgtaaagtcatagaatgtgccttgtccccatcattatttcagttcccagagtagggtaagtgcctaaatttatgtttattaaatgaaagcaaaggggggatggaaagagggcaatgaacagaggctgaggagggaggggaagaatctgaggaagaaaagaaaatgaatgaagagaaaggatgtggggagaatgagaagacaggtaagactacactaattctatgattatttaaaaaatacctttaagtataaaaataatcattgatattgtacagtccttactatatcttaggcactataaatgaacagacattccttataagcaattctgtaagattcttattagtacccccatttggtaaatgaggaaacttaaagaaaggttaaaacttgcccccagttacccagtaataagtggcagaagtagctccaggctgagtgtaactataatgctgtaagtcagaaaagctgacttaccctattatagaaataacatgtggaccaaatgaaatattcaaaggctgttcatttaaatattaagaaaaatttacataaacacccaaaataaagagaaaagcatatacatatacacacacaaaaatatttcacagaagactcacacatagggagtcatttttacatgcgacttctgttcctgttttcaattggctcattgattataatttagttagaactgctagcctttacttgatgagaaacagcaactcctggagtgtaggcaaagaaggcttcaaaacaaagcaaagtgacaaaatgaactacgtacactgactacaataaaaatacctaaaccataaatttctaaatatctagttgttttctttctccaatattactgatgaatacaaaagaagctaaaacctaaatggcatctgtaagataaacacaacaaaaagtatacaaaggcaatattccatcttcacatccagaaggttttctgacagtcattctaataggaaactccaaatcaatatatcaagctggaaagctgtcaagacatgaaagcaaatgtctttcttaaaatactcctcagtcagaaaattctcagaagccacagcagggcagcggttttggttgcaggtattcaaacccagcagctgatatacacatattaccagcaaaaaatcctgctaattgatcagcacagaaaatcagggcttaatgtaacatttcaaaatccagtagcacttgggtggactgtaagaaaatgttttgtattataccaatctgcttgaattaaataaggaggtaaaacacagacacacaggcacacacacacagagtcaaatccgtaacagcatggcctaacaagagatacaaacagagcaaaggtttcatagtgctctggattcttccttgactaaaattgcaattaaataaatatttgagggagacgtagttaatgacttcagacatttaagaattgaaaaaagtaaacctgatcaatcttcacaattttaagaagttttgagctcaaaagtcacatgaattgtacaaatgaataaaattttccagtgatttagcaatcacattagataaaattgcttaagataccacaagatagttataatcacgtacaaattgtttccaaacaatgatattcaaagtaataataatattacctcttttgagtctaataagttattttgagacaggttctaggtctgttgcctaggccggaatgcaacagcgtgatcatggcttactgcagcctcaacttcctgggctcaagcggtcctcccacctcagcctcctgagtagctgggactacatacgcatgccattacactcggctaacttctttaatttttgtagagacagggtatcactatgttgcccaggctggtctcaagcttttggactaaagtgaacctcctacatcagcatcccaaaatgctgggactacaggtgtgagccactgtgcccagcctaatgaatttgtctgagatgcaaaactttaacttttagtcaagccacgttggaaacccactgaaaacatgagaatgcctctactggctcatatctctaaaatccatccagctctaaacactacacaggacaaagacaccaaggaacttgtaagagatctaaacctctaccaccatcagtctcaaatatttccagacttaagaacagagataacagattacaaggaagccagccaagcacactgctaataataccaagccactctgttcatttagggcacagaggtccaggatttaatgcaacagaaaatctaccttcctcaacagggaaggtcaggtttaaggtccagtacaccatgagatgtaaacagtcctcacagcataaatagatgagacaagtgattctgtagcaggatgcttgtttgggatgataccaagttgacttttatattcaaataaaagaagttgagtaatattaagatatctctagtaattaaattctaaacaaaaatttcttatcgttccctcttttaaaaaaatagatggacgtaatatactgagtcaagcataaaaagaaaaaaactatttttatttatagctagttattaatctatgcaatggaaacaaaatacagaaattgtagatcaaaactgatataaatctgatatattctcatccataatccccaatatctttttttgtttttactctataccctcactgctctgttaccgatgttatttctttaaatgttatacacgtgaaatttaaaaaataaatttatggtaaaatgttggctttattttttcttttgggtttccacttgagatttcatttaaaataatgggtcaagggcaggatctattgctaatggattacatgaccaaagctactctttagttttaaaaactaaaaaagaatactagtaaattgctgcaatataagttagtaacaatgcaacagtaagtagaaaactcaccttgcaaaggcaggatctttaccccaaattcttcaagacatccaacggcttggataagatctagctcctcttgaatggcagggggtctgtctgttatcagttgtaagcagcacctagaagaaattagataaatttttaaaaagaagcaacatatgttcacctttctatactcaacaccatgagatctaacacatatttatcaaaaatctaccacatcccaggaattcattccgctggatgccttctgttatcttaatcctcatagcaagcctctgaggtaggcaaacatcatcatctatctgccttttcagggagctaaaactgaaactcacagaagtgaagtaattgcccacagttacatccacagtacataatggcatcatggtaggaagcatcataactctgtgttcagtgccgtttttactgttgaatgcaaacattatgattctattacaaaaaaaaattttaaaggatgaagttcagataatttccagtttcccttctacgaaaaacagaaatgtcttgatttggtcacaatgtgatgtctcaaaagaaacaagaaatgacttagggaaatgcagagaacatctttctgatcaaaaaagagaaatctgttggtaatacacagttctgagatgaaccataggagaaagtgatttgctaagctaagaatgtgggattcccatggaatattttaagtaaatttttgtttaaattcaaagaaactgcatttaataaatgtttcacttgatgaataaactcattctctaaaggtgtttagaggaacattggaatgtaagattagaaagacagatcaggcggtaacgggctcatgaatgctagaatcacagatcacgagatgcaggtatctaagccccagtatggcatccatatgactgagtgacagatacaggccaagcctgctctcgtaaaactggaggatttaaatcagttgtgcactcacatctactgttgattcaagtgtgaaaggtctataacctctttgtggtttctatcaaaattgtaaatgtacttttttacattttttactctagacccaggaattacaaataaattctaaattacaaataaattctaaaaatttacattacagataggctcgcacatgctcaaagacatataattgtgggtgctcactaccaaattgtttttaaaaatgaaagaaagcataccaaatcaggaacaaattaaataaattatataatggaatgttctacaaccatcaaaaaggaataaaatagaactgtctgtactcacatgaaaaaaccttcaatatagaatatgagtgaaaaaaaaacagggcatagaaaggtatgcataatagtaagaatttattcatgatttaagaaagaagaggtaacatttaatcaaatgttttggaaggatacataagaaaccgatatttaaaaatgatggaaggataaagttaggggaactagaatgaggagggagatttattgtcaatacatatatcctttttgtattgtttggatatctattgcttcctcaacaatttatttataaagagtttataaataactctttaatcagtaaaaatgtaagcgctatttcctgcattcaatataactgtgaacactgaaatacatccaggctcacaggtcacaatcagtttggtaccacattatacacacagggcatgtttgtgaaatgaaggtgatgaaggtgtgtccttgcaagagagaaagagatgcaatgaaggggaaatatagaaggaccggctttttaaatgatctctgggaaacacctgccaaaaagattgaggtgaaatacaattcccagtttcaaaggctatttggtattttcaaagactatttggtattttcatcatttgaaataaaaatagaatcgcttaggagaaaagaaagagctaactgctttaaacaactttgtcaagttcaataacatggtttgtgaaacataattccttctgagataagatatcacctgtgtggggggaatggggggacttggtgcaggagttacttttaagcgttgctaggtctgaaataaatattagtcatctgggggaaaatgaatctctccaatatatcctttttgtattgtttaaatatttattgcttcctaaataaaatgctaattaataaataatactttaatcattaagaatgtatgggttattctctacattcaacataactgtaaacactaaaatacacccaggctcacaggttgcaatcagtgaggtgccaggttacacacatacagcatgtttgtaaaatgaaggtgctccaattgctaccataatcaaaatatcaaaataaattccaaataaagataaaactgaaatgtaaaaaataaaactatcaaagcactaaaaaatatgaaaacctgtcataatagtcttgggatttaaaggtctttcaaaggatgacagaaaagacagaaattgtaaaagaaccacaattttaaaaaaattctgaatagcaattggaaagataaatcatatataatgaaaacttggcaatgtagtaaaatatttgagataggcatagggtaaatattccttatgcctcaaaataagctcctaagaatcaatagtaaaaagatgaacaccccaaaagaaaaataagtaaaggctagaaacaagtttcaaatgaaaaagtgcaaatgaagctgttcaacagacaaacactggaaagactgaaaattaatttagagaaggggccctttagtgccttagggaatggaaaataaactggtgccacatgataacaaagaccaaaattttgcatgtgcttaccctttgattcagcaattccactttgcattatccatctacaacaggcacagttctaactattttacatactcagttaatattacaatagccctatgatataagcctactattatccacattttacaggtgaagaacctgaggccctgatgactggcccaaggtcacatacctgttagctggaaaaaagtggatttgcacatagccatctggccctagaaactgctgtgttcttaacctctacactctgctgcttcttggacaatgaaaaggtgtactaaatgcagtcagaaaagaactaaacaaatctagcacaaccactcaacacaatgctgtaaagcatatgaaaatgctgcagatctgtatacactagctcaataaacaactgaaaaaactgtgtaataaaaagaaatgtatagtattatctcatttttgtaaaactatatacaggtataacatgcaaaatagtgggcaaacgattgggctcaaaaatctcattactttatttaaatactgagtggataattcctatcaaataaaatgtataatctcttatagactgttaaccagaaaatctgagaaaacaggataagcttaggatgcacagtgttagaaaaatcagacacagtaagaataacaaataagtaaataatttgctagagaccatagccaccttattactgaagagattctacctttcttcagtttatttgatcaagaaacaaaaactgagagattacatgacaaactcagggcctcagaaaaattgtcagttgccttgaggcggaaaaaataaattaaaaagtatgtctctagaaatgaatgaggatcaacacaactctgagtaagaaaagtagagcagggtctagaaaggggatctcagacaaagagaaacaaaacagactcagatgtccagggtacaaatggaaggagaaatacgtattagaggaactagacactgcaaacgagagttggaaaatggctagtggaagaacagcagcgtatcagtcagcaggcaggggacagaggacataatacaattgaagatgtgccttgacttacaatgtgattacatcccaataaacccattgcaagttgaaaatatcataaattcaaaatgcatttaatacacctaacctaacaaacatcatagcttagtttagcctaccttaaaagtgctaagaacacttccattagcctacagtttggctaggcttttaatcatctaacacaaagactattttataggaaagtgttgaatttctcatgtaatttactgaaaacggaactgaaagtgaaaaacacaatggttgcatgagtactcaaagtactgtttctactgaaagcatatcacttttacattatcataaagttgaaaaattggaagttgaaccgtcttaagttggggactgtctgtaaaccacttttctgaaatgttgaacaaggaagataatcttttttaagcttttaagattcattaatacagaggtgatacatgttttattccttgatctagatttattatgctcttttaattttataaaaaattaactttaaaaaagcaaccttaaatcctgaatgaattattcttaaaaaatcgctgcaattgggtatacctaattacgagaactcaggtcatgaacacacctttctagtgttaaataagaggggtgagctaaaataggagtacaatggggacaagagaggaattgaactcatagtctagaaatttcagccaggaagtgacttcggaggtttatcatctaatcaggtcccttgtctctctctctttttttttttcaaaagacttatgccctggcatttaggtcccttgtctctaaacaaagtgaaagctacatgaacgagacaggcattacctacgcatgctgaaaattttcagaacttgaatttataggctatcacatgaatctcttccaacagaagagaaatacacagccttataatcagcaaaaatgaccatgggaaagcgcgctggagaaaaatgtttaagaagctgatggacattcataacatagtttttctttttatattcaagcaaaaaataactgtgccccatatagtgtagtcaatctgtacctgtgataatatatttggtaaagaaaagaataacaatgcagtttgtacattctgactttccccctccatcttagggaagaatatagagttattctacctggctagatccatgcagctatcagtgaggttggtagaagaattgaagtactctctgctggcagccaaaaccaagtcaatactcttttcgtagctgaccctgtagtggggtttccctttatgggctataccagctggaggattttctgaacaagcactgcagtgcatcatctgtccagccaggtggatgttttcaaggcgactagagcacagaaggctttctgtaaatatctggaaaaaaggagaaactggaattagttatagagagggaagattcagttctcagtgaaatgaaggctctgaaatccaaatgaaagaaattaaaaacacatccaccctagaggtggtggctgcacagcactgtaaatgtactaaatgacaatgaactgtatactttgaaatggttaattttacattatgtgactttctcctcaattaaaaaaagtcaatcttttagaaagaataatttcattgactaaaccaaaattaagcataatattttaatttattacaataaatacttgggtcaagtatccaaagttgatattcattaaaaacaggattacacatactgtcccactctcaacagggcccattttgcttaaaactatttttaaccatttctgtttttttctttttcctaattttaattttcatttttaatatgggttcttgctatgttgtccataggctggtctcaaactcttgggctcaagcaatcctctcaccttggcttcccaaagtgttgggattaaaggcatgagccactgcatgcagccccattttaatttcttaaaagaaaaatctttgaatacaatacatataattcataactgcttgaagcatctgaattcagtcttatgaactaaatagccactccacaaatgctatacttacaaccagtcattaaaattacaatatattataatgtagagttttttaataacatacatattaaaaattatttaaataaaacaagagacactgaaggtattcatacaaatatcattgtactctactagacaactaacaacatcaattaacataaaattacttctataattgagatttatataaacaaagcaatccttttaaacgtacattaacaatgttacatataattagtctaagaacttccccaaaaatgcacttccctgtcactctacggttggataaggatagcacagaaataagagatttttaaaaagtaacatttaatggagaagcaagagtttcaatataattaagaagaccatccaatcttcataggatgctcttattttcacttctttgtgtctaggcttcctgcagaaggcatttttagacaagtcttggtaagatatctgataaggataaaaacactatatctaagagggatccgctataaaatagatactgtgacagaaagcaaactattaaagagcaaccctaatcacttatatctgacagataaaaatggcttacaatacgtctaatccaaatgacttatatgtcatagtttctccatatttctctggtctactcaagtaagctgtaaggagtcaatgtccaatactgaaaaatacattcaccctcaaacttggaacagtttgctaaaatgaacaacatagatttctgttctacaggctatatataaatctttatctaacattttcaaaattatgccactgaacttattttccaaggacagcaaaatctaacaaccaagtcactaagacaacatagtatattttaaattatatttaaattttaagtttgtcaaatctatattactgtctcctacagccttttcaaaactgttataatatgctttcaaatgttttctcaacaagggagacccgtggacagaagtcattaaaatatcaaagcctaataaaaacgtgttaaaatatttttaaaatgtaatataataagttgttttgatggattactccacacagaaactaactcaaatgtaatatacttactgccaattttgcaatcagaatcagaaacaggaatgtatcaaaataatgtcactccaatgcacaaacactacctcaaacacactagtgacagttgggttttagatctcatgtgcatacaaattatgttctaatgaagttggtttcaggttttgctttagatgcaaaaggggaagacaatggcagttgtatgtggtcagagactgcaatcatcaataaaaacattagttattcatgcatttaaaaacttgaaattcaaatataaaaccattcatttctcaacagtctacattagcacacttttgttaaaatcgccctgaattcaaaaactaaacaatttcacaaagcagagacctatttttacaattctgatttcatcaatgggttatgctttgtggtataagagcaaagcgacacaagaaatactctttatgattttgtgtctggcttatttaacaagaaaattctaattaaaaaaacttgttttagactgcatgttattaaaaatgagttaggtcattttttccacacaaacggaaatatatatatattggtaaactgcctttgacttggagattttacacacagaaaatggaaatatatatactgatactctgcctctgacttggcaattggacacacgcgtgcacgcacacacccacacacaggtgtacatatctattccaaattaatgagtaaatccccctggattatactcccagtcaactgacaactatttcttacgtatcctttatattccatatgttataatatgcactaggggatatgagagttcacatgatataataatgcctgtctaggagctgaggaccaaatggaagcaatgcacaaataaacaaataactacattttaaagaaagaccatagtagaggcaacttatgaggaaggacaaagataattagtgagctgagttctgaacttttattaggagttttctaagtaaaggaaagaggaatatattccaggccaagggaacaacgtgtgcaaagtgagggaaacatgaaacagcacggtggatggaggaaatgatgacaggcttgatggtgctactgcaacatagggtacatggtggacagtgacaaaagtggaagaggtgagggagctggcatcttctatagctttctatgtcatgctaaggagtagagctactttttgattattgatatggaacaacaacaaatttttagaaggggtgtgtcatgaaaagatttgttttagaaaaatactctttatcagtgtaaaccagagagttggaagtagggaaacaagtagggggattgctgcagttcagcagagatgaagacaggacagatttgaaggtctttctcagatgcattagacaagtgttagtgaccaccaaaactatggaagtgagaaaagtcaagtacgattcacattttctagctgatgattaacctactaaacagatagtgttgcaatgaaaaaagacaagggagacaggaggttaaggaataaagtgctcaacctataaagcactagtcagttattagctattattaaataatattacttccagggtagcttatggtcatcaatcttgtatccaataaaccataacaattaaaattgttaaattaaaaaaaaatcgtatatggttctagagttacctcatagcaggcatcagaatctagacatgtgtatacattctgctgcatagttaacatgtcttgcagcaacgttctccaatgagactcactgacaggaggctgcctggaaaaacacataaaaaagacaaggaagagggaaagaaaacaattaaaatctctttcttcaaatgatctaaagttaaaaaaacaaaaactggtaccaccactctatatccacatcagctctcaaatgatcaaaaagaatatatctcctttaaatagacaggaaaacacttggattaaagatagaggggaaagttgggcagctatgcatcactgctagagatggtgacaaagtggtctgtcatagcctgagcagacacaggctggaatggaattgaatggtaattacagtaaaggtaaagaagctgtgagtttctaaggtaaaatgaaccactgcaagataaagcagctatgatatagcttgatgacagaggttggtttcaaattccatcttcatcactcagcaatccctgtcaaggagtcttcttgacttcaactgaacattcacatccataggacaaccgcaggccacatttgccatcagtctgggggacaagaatcgcggctcaccagcagggcagcatcagttgcttcttacagtgagactactggcagcagtccacaaagcaactcacagagcactccaggagttatcttctcaagtgaccgccccagtacaagaagccagagcctcagagagtagtcgctggcattgctgtgtccggcgtaggaagaagcttcatgtcctaaaacagtcaacatctcttgcaacacactcaggaaagcccaaagcataaagcccctatcaggtatttccagttcatttacagttcctccaggccagaggcaatttaccaatcagggatctgttttatctaagtagtgaggcctctataatctggttgattaaaaaccactttatattgatttacagagttacagagctaggaaattaatggtcagattctcccatagcaggggaaagggttttgttcccaaattcacccatagtcacaaattggttgtgtgattgtgagcaagtcatttaatattcttgactttcactttcctctctggaagctcacttcagtgataaacaataaatgagattaattttgacaaaacacaggcattgaagcaagatgctcctaaatataagaataagctaaattacccatggatttgaataaattttctaatctctctgaactttagattccctttttgtatagcataaagattaacttatactaaaatatatgaaaagaccccccccccatttttctggtaaacattcaacaaatgtgaatgaatgaatctgaaattacaaatacatcttgtttttttattttttaagtcacgtatatgattctaatattgtttctagtaggagagacaatatactgtaattctctctgcctctctccaaagttcatcttagttaaatacacatgagtttggaatcaccatttatgtttactttctagtcttgacattctacataatcatgaatatcattattcaagaagagcaggtttttgttttaaattggtcaaataccaactagacgatgtttctttttcatgcatctttttattttttatcttttacaatgcctttaaaaatcatcactatttccaaacactatgcattaaaaacagggcagatagattgtatgtgtttaatagttattgctatagagaaagtatatatttgggatcattacagcaaaaaatatagtctttaaaatttttttctcctaaaatttttaataagcacatgcttcatttgcctatgcatttaatatttattatacaaaagaacaattactcttgttccacatgcaattaggcataagagaacactttttttcttccagcacacaaatacacaaaacaaactgatatatttcaagtatttcaggacaatccatatactgtttccatttgtttgacctgggtacattaactctttagccttcaaaaaactggagggctctttcagattgcttacaggcagagaagtagcagaatgtttgctgaagtgagtgtccatcttgcacacacttgataaaatcagatctaggcactgtctagctgaattcaatttcttacagcccagctgttcttctggaagccatcaacactggggcagatggtactaatgttttctcgcacatggctagctgtaagtacaggttctaataaaaataaactactatgcattacttacaatggcctttttaagaatatattcagtaaataagaatcaagagcagaacttgaagaaaccaagaggtttgcaaattaacagacagatcctgaacacgaatgtattagttgcagctttggaatagatgtggatttcccagggagaaatagtagtgtactcaagttcgtaaaacttgcatttgtgaagatttgctgacatctgccaccctttagaatatgtataagaatattctatgggtagtgaaggtcaagccatggaaatacgcataaaataattaagattaatttcaggtcaactactgtgaaaacaggcatcacattctcttacatattcacagtaaatagattaccatgagtagaaattaacttcagggactccgtaagtatttagggaactaatttggggggttgggggagatggggtggtaggtaatctagcagcaattgcaatgctttcctgctgaaaagtagattttagagtaaaatcagcatgatcttggaaatactggccatccattttagctataaagaaatcttaaggcatttaaatagtcaaagctatctaaattaccagagagggccactgatatgtaagttcctaactgaggtgtatggtggctataacacttgcactggagaaattatgatctagaagggaacttaaggcacatgtgttaatgactgtagtatagttgcagtgtaacaccgtatagctgcaagagacagtcagagaggtagatacaaaacgcttaggaatttctaggaaggagaattcaattaagcttggaggagtcaaacaaggtttcctggaagatgtgttggagccagctcttaaaagataggaaggaatatacaatagtgtgtttttactgctggattttatttttactttgatagttgggttaaactgaatctctaaatcctaaaatttaggtaaacaaaatatgttttaaaagttcttgaaaagttgcccttgcttaattctactccttcaggattagtgcttggggtggctttttttcccagccttctttacatttttacgtagtctccctacagatctggaatttaactgtcccatacacacatggggatcactctcaaatccataactccagttcggacttctctgctgatcttcatgtccaccttcatagcagcatctccacctactgtccggcaagcacctccaagtcatagttaccctttattttatgcataaactaaatgactactaggtcaaaaagttgttagtttctttattgaccatttggatatcatctaactgaaatgtctttcaactctgttgccaatttttcttttctttttttaaatatatattggatgtactatgttgccaatttttctacagagtaatctgttagttctctcatggccttcatagcctttataaatattctcttcatattaattgagtgtgtccccctctggaccagggaggtacgacatctttttctttgtaagccagacatcaagcataatactgacacaaagtatgtcaaaatccataataaaatattcattaaataatgtaaataacaattcgtaaataaatgcacaattataaagtattaattttttttttttctgaaggagtcgcccaggctggagagcagtggtgcaatctcagctcattgcaagctctgcctcccgggttcacgccattctcctgcctcagcctcccaagtagctgggactataggcacctgctaccatgcctggctaattttttgtatttttagtagagacaaggtttcaccatgttagccagaatggtctccatctcctgaccttgtgatccgcccgcctcggcctcccaaagtgctgggattacaggcgtaatgaatgtatgaatattaattgttcagttttcctgtctctattgtaactggctctaaatgaacttccaaagaacttagcaaaatttctaatttcattagatgttctactttaaatgatgacaatatagaaagagacaaaatgaaacaaagtttttccagatttttaaaatctgtcattatcttttcactcacttattctcacttattcctttgaaatgagtagctaaaaattatcagtgttttaagcaacacatattaaaaaatgaataagtcattcatctggaaattatttttttttttaagacagtgtcttactctgttgcccaggctggagtgcagtggcaagatctcggctcaatgcaacctccacttcctgggctcaagcgattctccagcctcagcctccctagtagctgggactacaagcctaagcaaccacacccagctaatatttgtttgttttttgtaaaaacagggttttgccatgttgcctgggctggtcttgaactgctaaactcaaagcggtctgcccgcctccgcctcccaaagtgctgggattacaggcatgagccactgtgcctggcccattcaccaaatctttattaagcaacacagtaaatattttctgagcatcaactatgtacctgtcataatgtttttatcaaagattctatacttgtgcaactctcaaatgaatatatacatttgctggaatttttatggggaatgcaggaaaaaaacagatgagtgagaagaattgacacctttccactattgattcttccaatctataaacatgaggtattcctccatttcttcagatctttaatggatctcaacaatgtttcataattttcatatatatacttttgcatatctcatgttagatttattcttaggtatttaatgttttgatactattataaagttttccacttcattagtcctgcacatctcatgttagatttattcttaggtatttaatgtgttgatacccttataatgttttccacttcactagtcatgtaagaaatgcatattaaaaaaaaaaagaaatgcatattttaaaaagacaatgaaatgctactatatacccatctaaatggttaaaatgggagaaaagaaaatcagtatcaggtatttgtgacatagaggagtgacataactcttacacattgctgacagaaatatacacagtacaaccattttgaaaaactgtttggcagaatcttctaaagttgaactcaggtacatcctatgactcagcagttccactcctaggtagatattcaagtgaaggacagaaatatgtacaccagaagacagataagtacaaatgtattcatagcagtagtattaattacaggagaaactaagaaacaattcaaatgtccatcaacagagaatgtataaataatgagttacgttcacaaaatggaatacttcccaacattgagaatgaacaaactaatgttataccaacaatacagaggaatctcacaaacataacgtcgagagaaagaagctacatacaaatgtatatactatataattccatttatataaagtaaaaaaaagaggcaaagttaatctatagtgttttagtgttttgaaggggggtaacttatagcacaaacaatccatatatatatacactcagttctcactgctgtgagctttttatacacatggatagcatcctactttagcaaccagacttctgtctgaggacttccactgccaaatggcatccttagttatgctggaagtgtaagggagttaacactcgtcagacaggctctcaaacaatgatagccacgagagggtagatgagtagttctccaactcccagatgaccccagcaatactgagccctagtccacagtggaaaaccagcttatgtaatacaaccagtattggctcccttttctttcctttatcagtttcccattctcctactgatgtgaggctagaattaccttccaaacaaacaacttacactctaatcttagcctcagggaagcccatattgacagaagaataatgcactatttcttcatttaattgctggctacatgggtatggtatgatcattttataaaaatgtatgaagcagtaaacatcttttttataaaaaagagttgatggtatactgtggagttagaaccagaacccaagtcatctgattcccgagtcaagataatttcctaatatgacttccttacaggaatttagaagacatgaaaagacatggatcaagggggaacttccaaagggatgttcacattcagaaaagattaagcaaaaggaaatgaattaaatctccaggctaaaacaagtaaaaatatgcaaaaatactggacatcaggcaatgaaagacagtgatccctgagagataaaaacaagtcttttttgttgttgttgtttgagacaaggtctcactctgtcacccagactggagtgcagtggcacgatcatggctcactgctgagatgactcttaagactaccccagtttactgtcttgagaaagattccaggccacagcacaagaaaggatcaatctaagcagagacttctggagtccctgcattgagaagacagaactgaaattccagagaaaccaaagcagataaagcacatgcaggatgaagcaccagggaagacatagcagaactggaagaaattcccaagatctacgaagggtccccacgaatattcagacaagtagaagccataaacgcctacaataaaactgcctgaggctaggaaaagaaaaggggaaaaagaaaacatgtcaagctcacacatgctggaaaacctcaagacacacaggcattaagcagagtcttagctcagttatggggaataattagccctagaaggagctcttcctccatcccaactgcaaaaagcaaaaagattaaactgtttgcaagtaaattaaccatgtcccagaaaaaagtacaagaatatttatgctaagtgaaataaatcagacatagaaaaatattgcatgttttcacttacatgtaaaatttttaaaaatcaagtataaagaaatagacaccaaaacagtggttactataaagggttggaggggacaaataaggagatgcagattagaggatacaaagtagcagatatgtacatgaacaagcctagaggtctactgtacaccatgagaactatacgtaataaaattgtcctgtatatgggatcacgctaaaagagtagattttagctgctcctgccacacaaacaaaataaaatagataactatgtgagatgatgaatgttaatttgtttcaccatagtaacctttttactatttatatgtatcccatcacttggtgttgtatactttaaatatataaaataagacttaattttttaaaaaagaaaatttataaaaatacaaaaatatgatagcatacaagaaggaaaaattcataatgtctagtattcaataaaattattttgcggccaggcgtggtggctcatgcctgtaatcccagcactttggaaggccgaggcaggtggatcaccaggtcaggagtttgagaccagtctgaccaacatggtgaaaccccgtctctactaagaatacaaaaattagctgggcatgcagcgtgcctgtaatcctagctactcgggaggctgagacaggagaatcacttgaaccctggaggtgggggttgcagtgagccgagatcgcaccactgcactctagcctgggcgacagagcaagattccatctcaaaaaaaaaaaattattttgcattgaaagacatgaaaaatatgacagataatgaagaaaaaattattcaaaacctatccagatattagatgggtatcacagatgttagaaatatgcttttaaaaagaagaaatgttagaaaaagcaaacgatggtgttagaaaaacagacaagagtggtttaaaatgtattatcactgtttaacatacgttcaaaaagttaatgaggcatgaaagtttaataaaaaccaaaattgaactcttagagattaaaaaaaaaactcttaatgaaaaatataatgaatgtacaaattgatgagacatgagagaaaaaaagatttagtggactttaaaaaacagcgatagaaattatccaaaatgaaacaaaaataccgaagaatattaaaaacaaataaacaagtaacacagtattgatgagccatgaggcaacctgaaaggtcctaatagatgtataattggagtcctgaaaggagaggagcagaagataaaggagaagaaatacgcaaaaattttccaagttggatggaaactataaacccaaagacccaagatccaagatccaagatgctttataaagaaaactacaccatgaaattaaatttgaaactgatgtcaaaaagagacattcacaatagcaatttaaaaaatatgagaaacacatcagaaatagattaactctgacagcagatttctctgtggaaaaaaatgcatgctaggagacagtggagcaatttctgtaccgtagcatactaaaaaaaaaaaaaaactgtcacattggaagtgaatatatccttatataccaagtgaatatatccttcagagaaaaatgtgaaataaagacttttttaaacaaacaaagatgtacaaatgaatcactggcatcctagcactaccaaaaaaaaaattaaaagaagccttccagacaaaaagaaaatgcaaccagatggaaacataagtctacataaacaataaaaagtgccagaaatggtaactacatgcataaacatgcaacacatttttcacattatttacatcactttaaaaaatagtttactgcttgcaaataataatacaatgcaaagtggggtttttaacatacataaaagtaaattatatgacaacaaaaaaaaaagcttggagaggagaaagtatcttgctagaaactcacattgtagaggtaaagaaacactatcacaggaagatctaccttcctgtgatagtgtaatcttttatataggaaatcccatgaagtctgcaaagaaaaactattagagctaataagtaagcccagaaaaggtagaggacataagaccaataaactgaagaatcaactgtatttctacgcattaggaaggaacaatctgaagatgaaattaagaaagaaattccctttacaataggaccaaacaagaataaaatacttaagaataatttaacaaaataaatgcaagaatagtacactgaaaactacaagattatttaaagaaattaaagaagaactaagtaaacggaaagacatcagtgttcatggattggaagacttaatattgatttaggatagcaacactctccaaattgacctacagatttgatgcaatccttatcaaaattccaaatgaagaaattggtaagcttattctaaaatgcatatggaactgcaaaggccctataataaacaaaacaactttgggggaaaaaaaacaaagctgggagactaatgttacctaatttcaatatttaatagaaatctgcataattaacacagcatggtatgggaagaaagataaataaatggatcaatggaacaaaataatcaaaaactaggcccccatttacacagacaacagatttcaagaaaactgcaaaggtaattcagtagagaaaggatggcttttttaacaaatggtgaggaataattagatacaaaaagttttttgacccatactttgaacaataaacaaaaatggattcttagaatggttcatgggtctaaatgtaaaatgtaaaaccaaaactttgttaacaaaggggggagaaaaacattgtggcaaagcaataaaaaagtacaaattgattaaaaggcaaatttttaaaaagcatactcttcaaaacacaaaggtaaaataatgaaaagacagggcacaaatgggagaaaatcttcgcaaagcatatatctaataaaaggacttatatctagaatatataagaaaactcccaaaactcaataaaaagaaaaattactcagttttaaagacaggtaaagaaaacatacagatagcaaataagcactgaccacaccaaatgttgatgaggatatagaagagcaatcaatgtaggatgcagcaactgtaactctcctacaagagtggtaggaaagtaaaacagtacaaatcctttaaaaaacagtttggcagtttttgaaagttaactattcacttaccaaatgatcctgccatttcatccttaggtatttgtctgagagaaatgaaagcgtatgtctacacaaacacttgcatatgaaaagtcgtagcaactttatttgtaaaagccaaaactcaaaataacccaaatgtccacggacagagaagtggtaaacaggctgtgaaaaatccatacaatgaaataccattccgcaaacaaaaagaaataaactactgattcatgacacaacatggatgaatcacaaaataattatactgagtgaaagccaaacaaacacacaaacaaaaaagttacactgtgtgactgatttctataaaattctaggaaatgcaaagtaatatacagaagtaaagaaaatagattagtggtagccctgatgaggagaagggagcacgataaagaaaagcaagagagaaaggattctaaaggagtaatcaaaaaactttcaggggtactggatgtgtttattatcttaatcataatgatggtttcccatggctatacacacatatcaaaacttatcaaattatacttacactttaaatatgtgcagtttattattagttataacacaatgaggttgtcagaaaaagagaaatacttttaaaaatatttaaaattaattgacccaagtatcaattaattttattactcacttccggccagtgtgcctcgtcaatctaaccatcagcttgcgtgcctcttctgagctagattgagtgtttttaacaaatgaaattggtttctcgagtccatgtttttccaaaagctctgacacactataagtgaaaaaagaattatttaatgtcttgctaccaaacaaaaagagtctaagaatcttaggcatagaggtagcccttcagtgtttagtattaaaaaaaaattatcccatagtgtaatccaattttacatataacgttgattctcagcaaaaaagaaaaaaaatcgaataattaaacaaatcttacctttctcattgacttttattagaatgtagttgggctaagtagcatactaaaagaaagcataacctatctttatctcaaaaatctttttgctacagcacctgtcagtaaaataagccaaatctatactttcagtacagttttaactcttattaatcctattgagtattctgttataggctgttataggcaagactactagaaaagcaataaaccaagaatgttagagttagacgactggaaatcatcaggctcattctctgtcaagaatccattttataaatatacaagatatgtcaaaaattctctctgtctcataagaatcttcttgagatatcccattccataatcatcaacatcatataaatacttgatctgactcacaaaatctcacatttatgaactgactactacaggactgaatagagttactggatcgaatccagtaactcttcagaatataggtttcatcagtaaagtcgcctggcattatgtatactaaaacatttatcaagtgtctggggctatcaggtggaacaggatacaaagctcttagtttgaaagcacagtaaattaagctaaatagtgaaacctaaacatcatccagaaacctgtagggtgttaagtgtttccttgaggtactgatggcatattaaaactaccaggaccacccatggttacaaccagacatgtgatgaaataaattacgtttatttcactgtatctctttgagctatctcttctcaattttactagagaaataaaggtaactatgcagatttgtagagaatgaatttacattgactcaacccaacaaaccttagtcaaactaaactgaatgtgttaggaaggtagtggggatggcaggcacaagccaacctataataggaaaagctgattttgtaaacatttttcaagaaatacaactgtataactttcagaacacagaataacaggaatcaagctaggtaataataaacacaggtcttcaggaaactgaagagttaattctctattaaactcacatattacggtgcacaaaaacattctgttcccttaaaggcaacttgaaatatttttacactaaagtccattaatttgaatacgatttctaatcagtggactccaaattatcatacatactactattagtaaagtaatgttattagctataaatttctacaattatatattggaagaccacagtttattattcttaaaattttacttttaatacaatacttaaagttaaatgtgcatatttatataaacataaaaataaatattagtaaaaatatcagactttctacatgggaaattaagatgatttcaatctccagaagagatagtttaacattttattacaacagtagagaatattcctccagtgttgcatgagggttctaatgcagtttgacataatacaaatagtcaattcaatgtattatgccctaaaaagggaagttagcgtaataaacattgtctgctgataaagatgcaataattgctgcaggaactaacatttcttatgtgcctactatgtaggaggcactttaaatgcttaatctaatattgattccacaattttgtgagttagatattatacataagaaaaccctaggcccaaagatcacacgactagtaagtggcaaggcctaaatttgaacgtaggttttcaaagaccatgttattattctattactccactacaataggggtgcagtgtatttgttgttgagaaaattcactcccaagacaatcaaacaaaaatgaggttaaagtagaaacgatgactcacaggcagacttaatgtgacatttcttggacaaattcccttaataagcatggagaaaaaaaaaaactgtcatttttctcacctgagaatttgttccagttggtctaccatgtcatgaagctttgtggttgcctctgtcttatcactaataaattaaaagaagaaaaaaaaaagcccttaagtttagtattagctttttaaataaaatacaaaacttaatgaagtgaaaaaaagatgtttcttttatatgtaatgtataacaatattatctaaattcattcagcattattaatgattcaagagaattatataagaaatgctagagtagaacaatattctctgttacagattagtcagatatgaacaactattttctagggtacttttggttcagttgtgcttaaaggtaaaaaaatatataaatcgattgtttatttaagatgaggtaaaaggtaaaatcactctttactactgttcttttaaaccaataaaacagattaagaagaagcatagccatgttggctttctcctaggcctatctacacaacttaggacccctcctctccaggaagtttccattaggattccatatactcagaaaagttcttccacataatcatcccttgtgctttaagggaaggaaatcccatccacttcaacgttaaggaatcagtgagaagtatatccatcacatagataatccctagtagggagtgaaggtgaaaagcaaatgctttctgaggaagccagtaagcagggactaggagaaacaccgtcatgaaaaagatcacaaactaataaaaatgtgcctggtagggaagattaagtatggcacaacatatgtgcaagtgaatacagggatatggtgaaaaagattataactgctataaaagtcctctttcatcctagacaactctgtgtcccaaacactctcaactgagaaacactgctgctgccactctcaggtgccttctgtgcaatgctccacctaaactccagcaagatcttatggttttatttattttttatttttttttcagtacaatttccattgtatttttctccagagaataatctgtctgcattatttaaggacttagctccttacatgggctttggtgggggttgtggggcagcacccgcaggtcaaaattggcgtgggggtgttcggtccttgcaggcttcatgatatcaattcctgactattttgctgtgaattgcacaacccacacagtaacgtagcttcacatacagcttgggaagcacataggtttcaaagacgctcgcttcagaaatgttcctgactgctgtggcctccactatgtttcaaatgacgaatttcttaatgcccttgtactcgggcacacattgggcacagttcatgcagtgaacaggctgcatgtggctgtggccctttttggcatgaccgttgttccttcttttctttgtcatcttggaggcccgcaccagagaaaagaatgactttattaacaataagcccaaacaaaaaatctttgcctggacttggaaaattaaaaatgtcctgctttggacaaaaaaccctcattatttttaaaactatctatctgcctggtctaaatgtatttaacaattaatcagtgcaacttacaaagattacactatctgtttaaactaagtttcaggctttggacaggagtgatgagtgggatatagtctacttaaagtccttcagaaaattattcatcagagctaacttcccttaacatactcagtcagccgtgtgtgtgtgtgtgtgtttgtgtatgtttttttgtttgtttgttttgttttgtttggtttggttttgtttgagacagggttttgctctgtcacctaggctggaatgcagtggcaggatcatggctcactgcaacctctgtgtcctgggctcaagcgatcctcctggctcagccttccaagtagctagaactaaagctgtacgctaccaaacccagctaatttttaaatttttttgtagagatggggtcttcctatgttccccagactggtctcaactgattctcccgccttggccttccaaagtgctgggattacaggcatgagtaactgcacctggccttattcagcaatatttttgaaattatcattttacagctctattataatcatttatcatagatattagagatacaatattcttcctttgtgagctgacattcacgaacacaatgagtaaagtttttttagccagattaaataatctgcctaggtaagatgcacaaaaatttaattagattaaatgagtgattgctcatttctcaaatagcaaatggatgtattcatagtttaccacttgataaataacaactaccactaaaaataaacaaataatcactgagagaatataaattgacaaacttggcatgaagaacaaagagaaccacagaaaatattttgagccctatattttaatacaaggctaatttgtaattataatttacttagaaaattagaaacatgaaatgcaatcattaagaaataaatggagtaacaagaaaatatcaagtcattttttgtgtttacattaaaaaatgttacatcagaaatcattaatctgaagccaagaaaagcttttggctatgtatacatgagaggcatttcttagcctatacattcttcaaaaacaaatatggtaatcccctaactgtaacatctacataaaaaaagtttttaatatcatcagcctattgatactatgacaatctcctcgaagtagacaaattactatttaataattaatagataagctctgattgatatttatgctatttgaccttagtggaaaacaaagcctaatatatttacttttaagagttatgcacacgagttggaagtcagtgattttgcctggtcgacttaggaacaagaaatgagatatgaagctgacagaggaatcataaggttcccacagagcccagcaaggaagaaactccctgccactccagctctcggaggaaccaggggcttctgcatctcttgtcaccctccagggaaaagcaatttgactactgccacactgatagcctttgggttgaggtttttaaatgatgggaacaacagtttgctacaaaaatctattaagactatctagtttacctgcctttggctgcctatggaaggcctacagttctcagagacacacttgctacactctgctgctctctactagggatgtgaggtagcctgtgttcaggtacaggtctgaataacaaacagatgctgagtccactctgatttacctttccctacatgaagaaggaaggaagaaaaaagaggagtacaaataaacttatcaaggaaaaaatataagaacataccctaaaggtctgaaggttatgaatttccagaatggattagaccattcagtgaacaccacaatgaatttacatatgaaacagaaacacaaaaaatgaagatattgaaatcttctttaaaaaaaatccatatttaaatagggattattcagaatgccattgaacttctcaacaatactagaaagaaaagacaagagtcataccttcaaaattcacaagataaggattctaagtctatgattccatgtacaattaaaccttctaccaagtaaaagtgtgcaattgtggcattttcctaatatgtgacagtcttttaaaaaatacctcccaggcaatctttgacaggaagctatttgacagtatgctccaccaaaatgaggaaaaagtgaagaaagaagaaaggaaaaccaagaaatgcaatatgcaacacgagagagaggcaaacgaagtcccgggataatagatggacaacagacacagagaacaattcattcataccaattccaagaaggatgtttcaaaaggaagagagcgagaaaagaagagacagagaaaaaaaaaaacatgaaaggaatagagagatcattaaatagttttcacgactgcaagtagttcatgagggtgatggaaaaaaagaaaacaacagaaaaggaaattattcaatccaggaaaaacagagagttgtattaaaaggaaaataaatcacacctagttccgcagtataaacaatatttacgtaatcataatgatgaaaacactggagaatggtaggagaagtggatatgggagaagggaaaggacttccataaaaggaagtcaaaaatgatctaaaattgcaaaatcaaaaaataacaacacgagcataacattttaaaggaggtaggcaaagacaaggaaaaacctaccagtgaaagtatttgctttttgaagataggaatccaaggatgggaaaagtgggcagcaaacagctgcttatcagctgatattactaataccagtcttagaattccctgactttatgttcatacattatttatatttaaaaatcagaggaagatcatgtccctttaggctcctttattttagaaaagtgcctccccacggccccacattttgtcttcctaaatgacactaactgtttaaagtaaaaagaccagttaatgcatagaatatcccacattcagtagttgtcttactgctttcttcatggtgttatttaccttgtctctctatttcccgtattaactgcaaattagaagttcaacctaaaagactgattagactcagggtaaacaactttagcaaaaatatttcttaagggatgctgtaagaccaggtacttcatattggatcacatcaggaggcacgtaaggtcaggctgtctgactgtaagttatgccacccttcacgacttggttaagatcatggcagttagagcccaactttgaaacttaaaaaaaaaaagtcactagggtaatactttggtatcatgcaaataaccttttatcatcaatctttcacctgatttcagtaccactaatgactgcatgaataactctttcatggtagattgcaaaattggtgactgctatcatttgcttcataagaaataaaaatttcctttagtcagatatgagccccccctcccaaaataaaaagaagaaataaaaatgtccttaaaagaaaaaggaaaagagagaaaagagggagaagataaaaagagagcaaagagaaagagaaaacagagaatgaggctttcttgtctaaatatctgattttgtaaatcaggaaactaatgaccaaagaagtaaagtgacttggttaaaagtcataaaagtttaaaacaggtctgctggtattcaccactctttcatgtgttgttatttatgtctccagatgtgaaatttatcatatgtgctaaatttaatagagggattagattgctacctgacttccaaagaaaacatacaaatttgacttgcatacaactaaataatccaaaagcatattatatacgtttccatttaaacataaaagcagttaaaaattaggtacattcactacttaaaagaagtactataggcaaaggccaagaagaaataattcatagaataaatataattagccaataaatatgaaaaatgcttcattaaaaacacaattactacctactgacttataaaaagtagtttttgtggagatcgtggtggtatttttgtttttcaataggaaattatcatgtttgacaaaattcagaatttaattataattacagttgaacaaaatatagaacttcccatatattggtaggacaagaaatgtttatcctaggcaataggattgcagataattttattttcttccttatgtttttttcacattcccaaaattctctaaggtaagcatttggggaagcaacgtttttgttttaactgttagaataaaaaaacacaataagactggcatactgtgtattcttacccatatcctctttctggcagacattctagtaggtcatagcaaagacagagttgatcatttcgttcacaggtatagatgcactctagtgctattgccatcagttggtcctgatcaggaataattttttgctgcagctacagaaaataaagtatgttgtactaaatgtcaacagatttatagtcaatttttccatatcccaatactactgtcaacagaatattaaatagcacaattaatcaactatagaaacaagtcttgatttttctttatagatttctggggtctttaataattctaactgaaatcacattttaattacagatcaactataaaagataatttgtaaccccataagctatgtatcagctgaaaacagattcttcaatttatgacccagtcaatatagaaaaaagaaacactgtgaattaaaaaggcaattcattaagaacatttctaaccctgaagccaaattctatgtgtttcagttacaaagttatataaaattccttaactaatattcaaagatgttacaacctattacttttcagtaggcattatatattactcatttaactacagagtgctgacattctattcaaaagaaatccaactgtaatagatcaatacacaaatcacagaacacattccatatttctgatgaagaaagatggctacttagggtgactttctgtatagaacaaagcatttcccatggcaaaccacagattcccattcttggagtattttccaggatatgaaaataaccaattgatttttttctcatctataaagcatgaatattaacaatacctttctaagaagactatttcaaggattaaattaataaatatagaatgaaaaataaatacagcaaaaaatcatttgcatgcttatattattagcaccacagcaaccaaaatgaaagtaattttcttagagctcttttgaacaataaaataaatctaagataatttccatgataatagtctactggttttcaatgttttagtagaaactcatcagtaaacacaaaagagataggaaagtgatggagagaagctaccaaacaagggcattttctcagtagaaaaatcacatcaatggacgtaaaaaagaaactttcaaggttaccaggaaaacaaagttttccaaagctgttgaattaaaggatttatatacatttcttcaaggtagagttggccctccatacctgtgggctccacttccctggattcaaccagccatgtatccaaaatatctgggggaaaaagtgtctgtactgaacatgtacagaccattttttcttgtcattattccctaaacaatatagtataaaaactatttacataacatttacattgtattaggtattatatgtaatctacagaagatttaaagtatacaagaggatgtgcaaaggttatcacaaatactacaccattgtgtatcagggacttgagcatccatggattttggtagcctggcggcaggagggcttaagaggggtactaaagcaatcccccccagatactgagggatgaacgtattcatctgaaaaatgtcatctgacaaagagttaaccaaggttgcaaagtgactaactggtaaaataggaacaagctgacagtaataaaaataagtactgttgaaaattaataaaaacagctaccttttcctgatttatttttccttccttcgtgtgtgtgtgtgtgtgtgtgtgtgtgtgtgtgtgtctatacactttttttttttttccagatacaaggtctcactatgttgctcaggctggtctcaaacccctggcctcaagtgatcctcctgcctcgacttcccaaagtgctgggattacaggcatgagccaccacacacagccctctgatttcttattgtgtgccaggtaccatttctaagtgttttgtgtgcactaattcataaatcgtcataacaatcctataaaattactactagtactattctcattatacacaaatgaaaaacaaataccctaagaggtcaaataatttgcctgaacccacagagctaataagtggtaaagccaggattcaaaccaggcaattggctccagagcctaaactaagcaagacaggctctcataatcctgcattcaggaagaatgaaagaaattgagagaagatatggcaataaaacactcatatatggtaagaaaacatccctggaagataaaaacactgaaaccaatttcagtcaaggaacaatttgggaaaccatttgaaataaaagccaaagtccttgatgtcttacttgttctccccacttcctatctttccctctgtgagacattaaataatcacttttttttttaatttttttttttttattttgagacagagtctcgctgtgtcgcccaggctcaagtgcagtggtgcaatctcggctcacagcaacctccacctcccaggtccaagcgattctcctgcctcggcgtcctgagtagctgggattacaggtgcccacaatcacatctggctaatttttgtattttcagtagagatggactttcaccatgttggccaggctggtttccaactcttgacctaaggtgattcacccacctcaggctcccaaaatgctgggattacaggcatgagccactgcgcccggccctaaagaaccacttttacattcaatgtccttgagtccatatttgaccacatatgttcaaactttacgttgagaatcctttaacagtccttcaatatgaaaggtaaagaataaatcttttgccttccacttaaacacctctatggcctgctcccatgaaccacttacccttctacataaagttttatttcactcaaattaaattacttgcatttacctaaacatgatattaaccagattatgtctccttgttttagtctactcctacctggaatgtcttctcaagaagacatgtcttgccatgtctaaaacctacccaataatccagtgttatctccgtttgactttgacttaaattcagctttcccagatgtctacagtcctggagtatgctcaacagttgctagtccagtgaataagtccttatactactctcatacataagatacccttctctctctgtattcctatggcacatttcttttctcttcttatgccattctgcatatcttttaaaatataatctatcatgtacatgaaacatactgttcaaatttataagacatttttcaatctttccctgttagaatccctataagatgcctaacttcatatagtctaagacacacttttttttcattattccttccctattatctcagttgtcacttttatactgtcatttgccctttctcaagctaaaagaggacagcccatctgggacttcctaagaagtcaatgaaatgagtcttccacaccataggccgcagatcatcacccatactgcatagcaaggtaaaatgcaaaagaataataatttctaaaaactcttaaaattatgcactatatacaactagaaaagaacacagatgataagataggatacctggaatatcccaaagaatcaagcaatcaaatcagtgaagtagcagaatacaaaactaacatataaatagcttttatatacacaaacattaaatagttagaggaaatgaaggtagatagtataaacagagaaaacttaaaacttaggaataaatttaacaaaaaatgtgcaaaacatctaagaggaatattttcaagcaattctaaaagagatttaagaatacataaactaatagaacaacatccgctattattggataagatgactgaacattatacaaatattggtctccctaagttaatgtacaaattcaatgcaatcacaataaaataccaataagcaattttatgaaagtagacaaactgttactaaagttcagatagaaaaacaaatatacaataacatgtaaaaaaaaaaaacaaaacaaaaaaacatgaggaaaaaaacccacagaggaatactacctcctcagacattaaaacacactaaaatctctataattaaaatcatgaagtactagtgcatggacagacagaccagtagaatatagaaactctagaattaaacccatgtacagatggaaatttaggtatatgacaaaggtggcatttcaaatcactagggtaatggtaaactttttaataaatgatgctggaacaactgcgtggtcatttgggaaaataaaatcagatccatgtctcacaatacaaaagaataaactccaaataaattgggaagagaaaaataaaaccatgcaagtactagaagaaaacgtgagagaattcttccttaactctgagtatgaaaaggctttccaactattactcaaaatacagaggcagtaaaagatcgaacaatttgactacacaaaaattaaaaagtgaaaacattgtatgacacaataaacaaagtcaaaagacaactgaccaactgggagaaatattaatatatgccacagagaaagggttagttacacgaatatgtaagaattcctaaaaattaaggtacaaaggaacaaaaaccctatcgaagaatggagtaaggacaggaataaattcacaagagaggtaatgcctatctaacatatcggaaaatgttaaaactcttaattagaaaagcacaaattgaaacaacactgaaataccatttctcacctatcacattggcacaaattttaaaatatgacaacaaattctgttggcaaaattgtggagaaacgggcatactcctacttggctggtgggaatgtaaattagaacagtcctactaaagaaaaatttggctacatcaagacaactcttgcctttttaaacccagcagtctccttccaggaatatatgctgaaaatacaccaataatataaaaatacatgtggacaaggttattcattgaagcactgcttgtaattgcaaaaatattgggaatggcatgtatcccaacacatggaaagctagtgagactaagtaagtttttaaaattttattagatttagatttatatccatatgtggctagtgactaccattttgaatagcatagcttgagaggtacttttcacttcctgaggaccatagaccaagagaaagtgcacagaaaattgcagccaaaagtttaaggggttaagtatgccctccgcaaacatatcttgctgggacaggagtccaggacctgccaaggagaggggcctagtaatcacccaatacttctgatactttctggaggactacaccctaggaataggggagaactggaaataggagagtctttttgaaacttgaaaccgctcaatccctgatcagatgacagtgacttcactactcagagaataaaatggcaaagagagtggagattatttgccacacgggtaactagcaaaggataatttccatatcacagtactgcaaattaaaccacaaggagatgttgctacgtacacagcagaatgagcaaaattttaaaaaagaccctcaatggcaattacacaggtgttctctttagaaaaatgtctagccttatacattatttgtagttttctgtatttatgccatattatttttctatgctgccataataaattaccacgaacttggtgacctaacacaaatttatcctcttacagttctgtaggtcagaaaccaaaatggacctgactgagctaaaattcagttgtcagcaaataaatgtgttccttctgatgttctaggagagaacccacttccttaccttttccagcttctagagggtgcccacactacttgtctcaaggcccctttctctatcttcaaagacagcaacaatctgacaattctatagcatcctgaccacagccagaaagatctgctacctttaaggactggacacacctggataattcaggatagctttgccatctaaaagtccttagtttaatcaaacctgcaaagccccttttgccaggtaaggtaacatcttcataggttcaggaattaggacatggacactttgggaggccattattctacctaccacatgtgctatacttcagaataaaaatataataaagtaatacgcatacttgactattcaaagtctggttaagattatcctcatccaacacctgaacaattcagatcctctggtcattttaactctgatgctaaaactaccttcttactattgttcaccttgcttttaatacttcccatactttttcattattattaatttatacactgaatgctttatatttttctcatatttactgtttcctaagtatgattattttttccccactctttatcattccctcttatatctcactactttctttttgtatataatttccttcttcatgaagtacatccttgaataattctttcaggatgggtctgtaaatgataaactctctgttttcacttatctttaaaaagtcttttttacattcacatttgaatgatagtgtctctaagtaaaatatcctgggttagaaatgcagtatactatgtggcttaaagattttgaagtcatactacttaggcttaaatccctaatgcatcagtaaataagaaacatataatgtgagcaagctaattaactactctgctttctctgaatctataaaatgcgaacaatgatagctatatagtcataaaaattaaatgagttaatacatgtgaaatgtttaaaacataactaccaaagaaaaagcattaagtagccaggcgtggtggctcatgcctgtattgctagtgctttgggaggctgagctgggaggactgcttgaggccagaagttccagagaccagcctgggcaacgtagcaagacaccatccctacaaaaagttattttaaaagcatcaagtaaatcctggctatcattaactattaggttgacttaaatatcaaggttaattttccttgacatttaacacatatatattatttcattgtctgctggtatccattgttcttaagaagtctgctttcagatttacggttttcctttgactgtaacttttgtttaatcctaggccatttttaagattctctctgtgcccgtggtatccttaagttccattagagtacatctaaatataggctgaactgtatttcacttatcctcctcaagatctgaatgcacctcgtatctttcattgattttaggaaagtcccacattgaatactgtctgcttattgtcatctctagtctctcttcctggaatgcttattactctcatgacagacctgctctctctatcctcaatgtcttttaaccccatatatttttcatttcttcaccttcatgtgtaacaatccagaaaatttcttagattatcttcaagatttcaattctttaattgtagccaaaattcttttgaatccatccatttaatgttttgcttttattattacagtttcaaatctagaagttctatgtgctctttttcaaatcttactctttttttcacaatttctccttcctatctcatgtctttatttctttcctcatatcctaaatatttaaaatattcattttatagcctgcatctgatcatctattaccagaggggaagtggagcaaggcctgccacggagttttgctcaaagtttagtttccttttgtgttttataaagttggattgtaaacttatcctcatcaaagctttatctataagaatcttgtacaatctagattaaagtgagtccttcagagaggttttgcttttgctgctaccaagcaaactaggtatcaccagcccatgtccagttttatcacaggtcacagaggcgtattaattgaaagcacaaattcatgttaggcaagcctgttgtttgactgctcagaaagaaactccctgcccccacattccccactcccctagaatccagaatacatacccagggagtcatgctcctctgctaccttcatgtgccaatgataagcagtttcctattctacattattgacaatgcatcttttaaagagccatggcattatatagaagtcttatttcttctttttcttttattttctgcatgacaaagaatctttaattttaaatgagtatcagtataccaagtaataacatgtagaaagtttgtgaattctatcatctggtgattttgattaagagaaactaaatgtagcccaaacaattcccaagtgttcattattctaaccgttagcaagaataaactactttaaggcttgctgcaacttctcacaggttcaagtaactatttaatactttttcataaagcccatgaccttcaagaaagtgttagggcaaaaaaaaaattatttcatccctttttttcttcaaagaagtggatttcttcttaccagatctaagaaagaaaaagtcaacactgatacatgtgtatttgactaaaaggcataggaaaacagacaacaagtgctcattaaatttctaagaaatatgagggaaaaagataaaatctttgcataagttctaagtctgtacaaagaagctagatttgctactctcaaaaaattaaaacacctactgtataatatacagaaataatttaatgccttttcacaagaccataacttgagctttgctaaagcttcatattccatgcgggcatctaaaatgccagtccatgaaacaggtgctcctttcttctggaagtttccatggatttctagccaatatagcaaaggttgtccaagacttcatcccagttctgctagaagtaggtctggaagatgggcatcttctcgtgggtctcctgcagttccgtgggatcccagtgctgcagcttccaaggccttgaacacgttctccctctgcggatggtactgttcaatttcagcctgagctaaggcactggcctgcttcctcctcctgttcttttgcttggtacccctcctcggtggatggcttctcagcctacagcagctgctggggccaaccgactggccatggctgtggtgactctgaagccgaggcaagcgccctaaatcggctccagggtcagctgaccaggtcactcatgatctaccagaagtctgacttctgactcatcattttaaagacttcaccttctatctcaagataggtattaaaattcactcccctacaggtttcaagaccacaatccccatcccaagtagccactccctccttctcatgagtatttctctaacttctacccctctcttcacttttgcctggtagaaatttcccttgttctcctaaaagttcaaccacgcaggtaagcagattttttaaaattaacattttaatgagtacttctaaatattttagtggtaagatttttagaatttctagtcaatgatattgccagctacaaaaatttatattcatctttatattttttgagttttctaaatattctacagtaagcattaaattagaaaaggtcatgttcaaactaaaattgctcactgacatatgtaatcagaagtgaagaaaaaagatggcacctaacaaagctatgatacctagtaaagtcctatttgttaaaagaagagtggacatttaaagcagttgttcccggttttccatcaaaatcaccgaataaattgtcaaacgcatactccaggatgcttctgctaatttctaatccattatatctggattgagcatagaaaatgctaagaaaaaatgcacatggttctgaggcacagatacactcaaagattactagtttagaagtcagagaacaatatgagaaggcggaagcttttgtcccccagttacccctatctaggactagcccaagtttcttcccaagtttcactttccaaggaggaatccaagcaaagaacaatggcttaaaatcagaaaggagtgctttaagatactatttttaaaaagaggaaggtttgaggcataagagatggtttcaaagacaaatgtggcagtcaagtgtaatggtagcactagtataagtctaaagatccatttctttatcattatgactctggtcaacttcattatcattcccaagtatttgctcctctcttcctctgagaggattattcttccctgccccattaacatcaagcttgcccatgagacgttctttgacctgtgaaatgtgaagaagtaacctaagccacatttggactgaagttttgtgagccactgtgtggttctactttgttctcttccctatgccacaagagagaaaaggggactgttctttcttcctgagtccccaaatgaataagacatgggacacagcagaggccaaccacagctgacgtttgacacttgtgagaaataaatgttcgcagtcgtaagctactaagatatagatgtcacttgttaatgtagcataacttagtctatcctgtctgatacagaaataactgcacctattacattactaaaaatactttgtgcatgattcatggaagctctgaggtgcattctttttgtaaataatcaagtaaaacacaaacaaggctgcctgcacaattttaataaagcaaacaaatgtaatcaagtgatataaagcatcataataaaatccagtgtgaaatttttaagaatcacaatagaagtcactgtgtcaaaccctggcaaatggagctggggagagccatgaagggggggctcttacacatcatttgcctgataacaggtaactatcacaaaaaaattttccaaaccaccgttgactacacgaatcacacaaggacagctaattacttctacataaacgcttgcctgtttcaaaaactatcccaagcccaatccaaaactacaagagcctaaccgtaactccaagattacaaagccctatcttactgcaactgacacttaccagtcagactcaccagctcttgtaaggcactgccagcgccaataagattgcttttcaaaacaacttgcgtaacctcctctttccccaataaaccctaacccattcctttattctccacacatactggaagccactttgctctgtatgtatgtcttgaattgcagtcctacttcttgaatattgttcccaaataaaatcttttcatttagagatttgtcttgctacattttttatattgacaccagtttcaatcattcatttatttattcacttgccctgccaaaatttgctgacatttgctctctactaggcactgtgcaattccctggtaataaggagataaataagatctagaagatatatacagaaagcaaagggggagagagagaaatatgtaagcaaataaatacagcacagtatgataagagctataatagagacagagtacaaagacagagaagtcacagaaggtttcatagcagagagaatcttagcaggaccttgaaggataggcaggtatttgttaagtgaagaaaacgggatcactactccaaacaaaggaaacagtctgtaacacacggagggccatgagtgaaacagacagcggaggagttaagttccatgtgagtatcctagtgcatgcatggagagaaataaagctaaagcagacaggaagcagacagcaaagaaccttccaagccactctagagaatccaacatttacctgtcagcaacggtcagtcactgaaaactttccgcagatcatgacatgatcacatatatgttgcaggaagacaacactgagagaaatacagaagctgggttggaaaggaagagcccaacaacatcactgttctctgttttgagattcacatgtttcaacaaaggcaaatggctgtatgttttgttcaaaaggcacacgctaaattgccaagtaaaaacaacaaaaagctgactatatacaaaggatttacggaagtataacacacaagattactggaaagaatttaaagtcacttctttcttcctcataaaacattcatattcaatccatcttgcttctcacaaagtattctgctgccacaagcaacccaccctgacctcaccaccccaaacttaaaatcagattactaagagcaaactgcttatgagaagacagaaaattttaaaaagccaatgaacagatatatttctgaaagaccacccttttagaaaccaaaacatagattagctaagcaatgttttcctttctattttgattatactggtccatgaccatgtatcttaccagacactactaatgaaggccggtgcaatgaaatagtcccagccagaatttagaattggaatgagccctacatggggcttccacttgaaccccaatctaatgttttgaacctcactacaaagtcagcgccttctgtggctctgccaacttgcttgcataccctccaatggaaagggagacactatctcttgaaacagtatatttgatctatggctaaatttttaggtttctgatattgccaaagtaccctacacttaacaaaatgactatactaccaggaaatatgagcaatcatttgtaccctttagaaatacaaagctatacatatagtaattgtaagcaaatataagaattattaagaataattacaaaatatcggccgtgcgcagtggctcacgcctgtaatcccagcactttaggaggccgaggcaggcggatcacctgaggtcaggagtttgagaccagcctggccaacatggtgaaaccctgcctctactaaaaatacaaaaatttgccaggcatggtggcacatgcctgtaatcccagctactcggaaggctgaggcaggagaattgcttgagcccggaagacggaggttgcagtgagccaagatcatgccactgcactccagcctggccgaaagagcgagactctgtctcaaaaaaagaaaaaaaagaataattacaagatgtcttatgagaacttaagaatttgcataaatactgtgaaggtcctcgagggcagaaacctcttttcctgtttgtggtaggagaaagtgtactggttaaggacacagttgtggaattagaatactatgttttaatcctggtttctctacttactgtgcaaccctgggcaattaccctattcactttatatcacaattttcatttcttgtaatattaacataataaaagtatctatgccataggattgttataaggattaaatgaggtaacactgggaaagtcatgtatagaagaattcaatacttgccaattattagtcttcttggtattgccagcttcttaaatatagtagatggcaaacaaactttggaatgaaataaatcaaaataaacataattttacaaccttttgactatgctgttaaaactttttaaacaataaaatgacaatcatttgtttttctgtttaaagggaaattatctgcaaagcctaccataaaaattgtataaataaaacctaatactgtaggggaaaaagtgcccagaattttaagaagttagtttctacttacatctggtttggaatgctgaaatatcttcaggggaaattttaagtcccctttagctaaagttactaaatattcttttaatagctcattagccacaccaggcgactgtttctcacaacgatgaagaaagggaaccatccactggtaggcacttgtcacatatttatcctcagaacactgaaagtacaatcaagcaaaacagacaaacaagaatgaagttaaactaaatgccttattatatcagacagcgagttctaaagcttacaggtcctcagactgatgttaaacagtgcaaacccaacactctaaaacacacagtccagttcaccactcacatgtggattgacaggtagcaggaaaatgaatcacctgctactggggctagtagagctgacagcaacaatatcactatggctcatctctttacatcataagcaatatggggtcccaaggagcctaagctcagctctagaaaaccaacatgctgctactacaactcagtcatgaggtcatccagagcaaagagaaggcatacgcaaaaacagagagagagagagagagagagagtataaaaagaggcagagacacacagaaaaggagaccttagaccaacaaagagtgaataaaaaaagtagaaagacagagatacacaaataagcacaggttctaaaataggggcctctagaaaatagggtttcatctataaaagtcaggaatctctcccttctttttcctcttcctctttgttttgcccctttacaaccacctttacaaaattccaaatgacagagatagttttactcattatccctaaaattacacaatcgtttctcttaattatcccccaaaagatacacctaaagctattaagaggagtcaacatataacacaaattaattttaattaggtagattatcaggaaaagaaactaatgagataacgggaaagtaaagacagagggagagacaaaaggaagataagccaggagaggtggctcacgcctatcatcccagcactttgggaggcctaggcaggtagatcgcctgaggtcaggagttcaagaccagtgcctggccaacatggtgaaaccctatctctattaaaaatgcaaaaattagcctggtgtggtggcaggcgcctgtaatcccagctactcgggaggctgaggcaggagaatcgcttgaacccaggagatggaggttacagtgagccaagatcacgtcactgcactccagcctgggccacagagtgagactccatctgaaaaaaagaaaaaaaaaaaaaaaaggaagataaatataagatgggggaaaatgtggaagggaaggagagaaaaagagtccagggaggaaaaagaacctatcatgcagttgtgactctgccccttcttctggaccattcaacctaagctgccaacaagcaaaagactagaaagagcgttggcagctaccacctccacagcaccatccttcttgcctgttgactcagtggccggagtacaaataaggttctaattttggggagaaagcacagaatgatctaagaattactgggaaaattctcttaaacatactaaccctgaagccaagatgttttcttcaaacaaccacccggtcctcttaaccctgatacttttttccagtccttgaaatacataagtaattgggaagtttaacaaagtgaaaggttaaatacaggattactagaatcactagctagtttagaaaaacacctaactagaacggaaaaaaaaagttatacagatgggtctgagtaaagggcaagcaaggtataaacacaaccaaaatagttttatatgtgtttagtaagttatgcataatattttactgtgaaaaaagtcaatctttatttactaacttctcaggtctgtagaacatttcatctttggtttgagacacatatgtatcaaagtgcatagaaaatgctttaaaatatttaaaaaggaagttaaaataaaacctacactattcatcagtaatcttagtttttcaatgtctttcatctgctggagttctttcagggttagagttacatcacacctggcttcataaaccaatgtttccagagtaaccaaattgtcacagagaaccagcaaaccaggaatattccgctccatcccaagtcgaataagtgacaatgcacagtccacctaaaattgaaaagcaacaataagttcctgagtattatatatttctcatctattctaaagtaaaagtctccagtacagaatctaattcttataatcattttttataaaattgcattaccagtaacatacgttttttatttactgcaaaaacatcagagtcctttatcaaatacatcagcatcaaactgtttcaaaggaatcaaacaatcagcaagaaatacggaagagaaagacaaccaacctattataaatttgtagagcgttacagttcacaatgcagctttacatatttcttttaattcttacaacattatatttacataataagagaaaaaacacatacctactaatgataatgtcaaaataaccttatttttactattaccactctgcttccaaaaagaatgtttgttttgaaggttttacttttatattcctgtatagtatctatcctttcacactgcctttccatataaaagtcattcaataaatatttgctgaataactatgttacaaacactttcttggtctcagttcaaatatttagccttcaaaagacaaaaacacagactgatattcctgaagatgctcaggaaacagccatttgacccctatttcctggtcaagtttatgaactgatacattctccgagtgatagagaaatgatctagtgtagtctaaagccattctctctcacactacttcttactctcctattcccaattattcatgaggacctactagaagctaagcaccattcaccatttgtgttagaaatacaaaactgagtaagatgaggtctcttccttcaaagatctctcagccttgtaagaaaagacaaccacaatgactgaagcagagtgcagtgagtgctgtgtatgatgcggatcccacagaagacagtacttagccagcctgagagggtcccagaggagggaacacttagcatggactctaaagaatcaaagggtatttgtgaggtgaggaaggaagattatgggaaggagagcagcatggaatgcagagatgcatggtgagttgtgaaagtacaattccacgtgactgaaaagaaggtgtgaggggcagcaatgagaaagacggctagagtaggagggacgggccggatcatgaatgctgtgtgtcaagctaaggaacacgcagctgatcaggaaggcagaggatttctgaatgagacatgtcacaaatagagctacactttggaaggaatactaagtatttactgactgatgaatgaaatgtacatgatgaactggaaatggactggagtgaaaataggcaggctggtcagaagaattacagttaccagtattagagaaattctgacagaaacacactgattcgccattcattgactgattagttcacacacttattcacagacagtaaatacttgttgcatatttctaatatactgggcaaaaataataaggggctaaactatgacagtattcctgaagacatacaagaaaaagaatataacagataattaagcagacagaatttgtgaaatttggtcagagcagatgagaaatttgagtaaagaggagtctagaatgatttctcatctaatccacagcagaaattcatattcatacatatatatgtgtgtgtgtgtgtgtgtgtgtgtagaagaatacatttattaaaagtaaaaattgtgtgtgtgtatgagtgtgtgtgtgtgtgtctgtgttagaggcaaggtcttcctatactgcccaggttggagtggagtgggttattcacaagtgcagtcatagcacattacagccttgaactcctgggctctagtgatcttcccacctccgcaacagagcaggtgggactaaaggcgcatgccaccatgccatgcctggcttttaattctatattgaccatgttgcttgtgaggtgcccatatcttgatacagatgcccaatagtaggtccaagaagaagaaaacaaaatctgtgccaaagtacatgtacttggttgacgatttttttcttttttttttgagaccgagtctcactctgcctcccaggctggagtgcaatggtgcgatctcggctcacggcaagctctgcctcctgggttcacaccattctcctgcctcagcctcccgagtagttgggactgcaggcatctgccaccatgcctggctaatttttttgtatttttagtagagatggcgtttcaccatgttagccaggatggtctcgatctcctgacctcatgattcgcctgcctcagcctcccaaagtgctaggattacaggcataagtcaccatgcccagccaacgatgatatttgacaattgtcagcacaaacatcatagaacagtatttggggagagggatctaaatgggtcacaactgcagactctcttctagtaataacagtagcacgctgggcaatagcaataattaagggacaggccaaagaacatgagccctaggagaagagtacaatgaatggttaagacaacaacaagaaacaccttaaaaatatcacagaagccgaagaagaattacaagaaagaagcagtgaataatgtcaaaaagcaacgatgttaaactacaaatgaagagaatgtgacattaagaggtagactgaggtgggctgtcagccttactgagtgcggtctcagcagggcggtgggagtcgccaggctctggggaaatgagaagtaaacaaaaagcagagtggctatttctgagctgaactgtgatagaaataaaaagcaaagaaagaagccaaggagaatatggttcttttttttatttacaaaatacaagggatgtgaattttatgcccacaaaaaggggaggggcagagagagtagatgcagtaaagaaggagaggtaaaagatacaagccagagaaaacagacagcttagaaagccacgctaagcaggggggaatgtggaatctagagcaaggtaaggaaagaaagtggctctgaccaaaagaggagagccctcttcctcgggaaaagctggaaggagcacatgcaaatggaatggagttctcaaattttcaaataaaatacaaagccaaatcatgttctgagaatgatgagggaagtggtggggtaaaaggagtagaggagaaggggaagagggggaagcaacgtaatgccaagaaaaaatgccacgcaataataaaggcccactcacaacccttcaaagacctagggatggacaagtgaagatgaagtgaaaaaagaagaaatgcattttcagttggaaagagtggtccaaataaatataaggggggaacagtagagggaggtacagtatgaggcaaaatatgggggctctcccagtacttcaacagacacatgtttttttaccttaatgcctagtaataaaaacaaagttcaagtccgaaagaatacatctacctttatagcaagtttttaaaaaaaacaaaaacaaaaaaacctctatctcaaatgaattctcagaaagcattaagaaagcttgatgcatagagcacagttttgtgcaagtgatagtctgaacacacagtacatcagcaatttgtaatatactcaccaattttgtgatccaaactagtatttttaatatcagctttgaatctgttgccttcccaaatacttactaaagtataagtgttttaaaatgaaattactgacactttaactgcaagtaggctctaatgcaacttacagaattatatcatataccctaggtcctggccagataaaattcaccacaataaacatttccctaaaccaacaaacaagtttcgctaaaggcactagggaaaaagaagtcccacatcaattaaatctctaaaaatgaaaaagataaaactatgtcagatatcactttgatcacagcataatccacatgaaacatcaatacctaacatgaagccaaaaaaaaaaagcctctaagtgttttaaaataaatgaaagaatgagagaaagaatacaagccaactgaagtcctccaaaatcaacttactttctttataattatcccttattactcaaaaagagaattcaaggtgtccaggcattattgctaggttatttacaaattaaagtttcagaaagctctataggtttttcctttaatacactttattttttagagcagtttcagctttgccataaaattgagctaaaagtacaatttccatatatctcctgccccaccctccaaccacacaacctctcccactatcaacattccccaccaggcccatgaacgtgcactgacacatcatcatcccccaaagtccacggtttacattcagattcactcttagtgctgtacatcccaagagttttgacaattgcataatgacacatatccaccattatggtatccaatgaagaacagtttcactgccctcaaactcctgtgtgctctgtccgttcattcctccatctcccttagccccttgtaagccctgatcttttcactgactccatagttttggctttcccaaaaagtcatatggttggaatcatacagtatgcagccttttcagattagcttctttcactaagtaataggcatttcaggttcctccatgtcttccatggtttgatagttcatttctttttagagctgagtaaatattctattttgggggcaccacaatttatctgttcacctactaaaggacatcttgattcttcaatgctaacaaatgtattgctcaaatgcaggacgttactaataacttgtgagtggggggagcaatatgggactctgtatttcctacccaatttttctgcaaacctgaaattcctctaaaaaataaagtctataaataaataacaaaatagttgattgtaaaaaaaaaaacccacagcttattttgcattccattgtggcatttttttctgtcactaattttttgaaactgaataatgtttgaaatttgggttacaaaatatttaaacaccaaaaattgaggaatcattaatgatcttttaaaattcatgatactgattgcccagcactttttactgacatgagaaattttttaattcacattcctagctcaactgacaaaactacctagaaataagtttttttgatgtatatataaatactcaaacacagacacacttttctccttattctcaaagagctttatctataagttcaactaggaaaccgcaaaaggctcaaacaaaacttgtccatctaacaaaatcatttttcttgttagccagagataacagcaaaacacatatatttgcaaaactcctataactcatacagtgccactggagtcttaaaaaatgtctaggtgcacgttacaacaacctacgtggagttgatcatttatttttttacagttttttttatacagattctattttaaaagattatacagggacccagattttgtctggctctgccactgtgtgtccctgtgcaagacgttcattctttctgtgaactttatctatttataaaatacggaattaaagtaactgaactagcttatttccaaagattcacttcatcgtgttatctcttcagattctacacattttcaaaagtgcatcttcatagactaggatgtcaatcacaaatgttcttggccatcacccaaagagtttagtctagaatattcccaacagctcagcaaataattcatcttcaatgctatgaatattataaaataggaattaggttaagcagaaattcaagaaatctatcatgtggaagcacatgggtcatgctagataaactaagtagaaattcattttatttatttatttttaaaatttttaaaaaacttgtcactgacttgaagctcaactaagtagaaatttaaacaaaggggatatattacctcccatggtactgctgctcaccagaccacctggattcacctttcctgtcaaatcaaaggctgatggtaggacaggcagtaaaaagtgaagactgaacgtggaagaaagaaatcatcatctgctagctagaaccaaccccatgggaaaaccaaggtacagaaaagacaggcaataggtccgagtcacaaagtctattagctgaagagtcaagattagtattcagatactctaaggttcagtataatcgtcatctctctcttccagatccttctctaatgcagctgtttggcatctctgtaaaagtgtctaagaactgagagaaattaggcatgaacttcaggaaaacattagaaacaacttcaaacagggttcctgaaaggcaaagttacaatcaactgcattactgcaataaaacagtggcttaaccaagaatttgtatgtagacacgatcttttaaattatatggtgttaagcctacgaaaaatatatagaaaacaagggacagtatgtaccacattttgcaacttaggttttaacgttacttttatgcacctgctctgtaagaatccaaaacaaaagccacaaaacgttctaatgcacaggataacaaagaaataaatattcaattcatctcttgcaattatatacatgattcctgcactgctgtcagccccgactccgtgtactgaatcctaaggatccaaggcagttccactaacattactgagcagcagctgccatttcccctcacctgccgagcataatgctctatttcctctgctctggtctgataccagtccataaccttctccaccgtaagctgggtcatcctgaaccttagtaactcaggctgtgcagcatacaagaattcactttcatcttggagattcggctcaacaaccattctgtgaagcacaaaaggaccaattaataactgactagaatgttggaaaaacatataattttgtgagagaaagacagggacagagatggggagaaagtaagagacagggagcatacatgtatgtggtttgtgtatctatcacatgcacacgcacccttacaagataaatgagacttttttggatgcgtaatttattttccccccgttttcccgatttaaaaaatcagaaggcataatacatcaaaacggctatgccacaaatcaatcaaataagtactaacaaaatcaaaaatcaccgagggaagcttttacaaaatatacacagctgggtgcttaccgcaggcccactcaatcaaaatctcctgtgctggccagccaggcctagtttaggaaaatatccccagtgattccaacttgaatttgaattaagaaatcttgttttcgatgttcataaaaataagaggaaatacaccttatttatgttgataatatacctctactaggtgccagcaatttagtactgtactgacatttgcacagcacaggactactctataccattccctatcaactgtgaaaaaaaaaagaaaccacatttggaggaacacacacagggctaacctcgtggggattgctgatcatgaggagtttttaacgagaatgatcatggccaattgccttccatgtttaaggacaaaaaaaaaatacaaagtaacaagtatcagatgggcatatgtaaaaatgctatgttccattagggatagtcattcatctaaagcaagctggcagtacatgactggtgctacaatggttcttgttgtaaggcaatgagctttggagtcagaatagaatcagacatacaattccatcactgaaagctgtgaaacctgcaaattccttaactaaaactagtctaagatctcctttattcctatttattccttttatttaaacggggaaaacactatacaagaatgttgtgaaaattcaaaataacagagcactgcctggcacaaaggaagtgcttaattttatttactgttatttttgttaaaattattagcagaaacacagcctgtaaacattggggcattttacccaaatgcctttgacaacctactttgcttatacctgccactacaataaaacttccctatatatggaatggtccttcacttactagtctcacagtgttgttaacattcttccagggatttccccccagctctgcccacacgaagcacatcactcactcctcctggcatctcttacatctgctctatttttgcaagaaaaaggggccaacagtaacgctgagttcctctgatacctccttcagttctgcatatttatttcctcctcagcaccctttgatagaactgaccgctcctccttctggaaatgccctttgcccctcgtcagtctgctgtcatgccgtgaagcattcctccctctggctgccccttctcagtcacctttgctacagcatcctccctcctctccccaagcatgaataccagaaaggacacaggcttgttagcccagctctcttcttgctttccactctccccagtctcctcttcaactctacactatcaattaccatagacattacaacagcaacagtacattttataaacctttaggtgtttaacttcatatctgactagtgattttagctgatacagaaatctatagcaaaaaatattatcctccaaaagtttcaaaggattgctccattgttttctagtttctagtgtttttcctaaggggcctgaggtcattctgattcccaactccttttacataacatgcctttctcttcacaagactgtatccctaatattctggaaggtcatggtggtatgctgtaatgtaataggcatttctgaggatgcataatcttccattcaaagcaataggcttgaattatttcttataatttcctcccctctattacccatggcatctctttcatctataacttgaatattacacttgttttttaaataactggtctcttactttctagctatgtatttttaacctattttctaggaaagtttcttgcttttatcttccaactcttctaatttttatgtaccaactatcacatttttaatgtcctaaatttctcttaattctgtttctattttatacaatgctattgatatttcacaaatacagtatcttctcttatctccaggtaatattaatgataatttttaaagttttcgttgtgtatgtggtatcactttctttcagttccgttttccgtatgttttgcccttcttgttcatttgttcttcctgctggagtctaacctcggatgtccaggaagctctgcaggggtggcagaacctgttcgtttgttggcttcattatgaccttgtggtgcactaacttttgagggccatatctcagtatctagaaacctcttttcagaggttactcatttctccagaaaagaactctctaaacttctacttggggaatatgcctgcatctgggagcagggagtgggaaggaaagcagagtttggacattcaggtcatacattttctaaatgcccagattttcaaaccaattactcaactcctcctatgcagattcagattaatatccagtaatctgaaggttttctagctcaatttagaggccctttgcctcaatgcatgagtcaaaaaaagcacaaacctcttgtctcacatgaaaaaagaaaaacaaaaaggaagaagagacagtgaaggagtatttacccgactttgaggagtagggcataaaggcattccaatattcctcacatgaattttcagccccacaccgactctcccaccccccttctgcagtactggatgcctacacattctgaggcttcccaaagttaaatctgacaagaaaaaaaattaaaactgatcaagaacaaaattgcatacataccataattacaactataaaaaaattaatatcactatatgtgaaagactgaaagggaataacacaaaatgaaaacagttgttgtaataagcaccattttttaacataattcctttgtagtatttaatttttccattaaaaaattttaacataactgagtcaaaggagtttaaaacttcactcaaactttctaaattagggagtgtcatcaagtaaggtttcattggtcagacaccactttcacagggccatcagttcacccatcccacaaagaaacaaagatgcctcctgcaggctcatactgacctgcaagccaactcctcgcaccaatctttagctcggtgtttatgttcatgccaaggaatgatcatcagggagtcaccgttaaaactcaaatttaaaaaaaaataagtgtttaaaattcacattacctcaatgacttagccacacaaggagtaaaatgcaaacagcatctctataacattaatatctaagattcatgcttatagtattttaagtggtacaggatacatattatatacatactatataaatgggaaataccatattgctgaatcataaaatggctcaaaaagaaaaattacaaataaaaaatttggcaagtaattaaaggaaggtatggataagttttcattcacaaattctaaaacacttatcaagagcctgcagtgcatgttgttaaaaccaacataaatggtcttctggattgtaagctgttggggcagagtagtgctttcaacagaacttcctgtgatcacagaaatgttttgcatctttgctatccaatacagtaaccaccagctatgtaaatgctcactggttataagcacttaaaatatggttactgacatgaggaaagtgatttttaatttaattttaattaagttaaatttaaatagccacatgtggccagtggctaccatattagatagcacagacctagaggacaggtgatagtaagagtaaaggaatgattctgcaggttgaaaagtatcactgaaaaacaacagaaagaaaatctaggcctggtattgtggctcacacctgtaattccaacactttaggaagccaaggagggaggactgcttgagccaaggagttcaaggctagcctaggcaacatagtgggacctcatttctacaaaaaatttaaaaattatccaggtgtggtggtggcatgcctgtcatcccagtgtcccaaccactcagaaagctgatgtaggaggatcgcttgagccctactaaaaggttgagactgcagtaagccatgatcaagaaagaaaatctacaggaggcaaagataaggcctgactgaatataacataagaataaattaaggccaggcgcggtggctcacgcctgtaatcccagcactttgggaggctgaggtgggcagatcacgaggtcagcagatcgagaccatcctagctaacacagtgaaaccccgtttctactaaaaatatgaaaaattagccaggtgtggaggtggctgcctcccagctactcaggaggctgaggcaggagaatggtgtgaacccaggaggcagagctcacagtgagctcagatcgtgccactgtacttcagcctgggtgacagactgatactctgtctcaaaaaaaaaaaaaagaataaatttaaacggaaaagcaaggtaaacacagtatggtaatagagcagagcaatgttccacaaatcaggacacctgagaaacagaaacaaatctgtctcttcatgagctaggcactctctggcatgtgactctctaaaatgaagggcttcaaacattctctcttaagtcccttttagctttaacatccatgaatccatgaaaacaactaaatcattctgaattaagaataaagacaaaaattgttaaaacaaacttcaattgccttgctttatagctcaataaaacattttctctaatatttctgagtatcaatagtagcattttcctaaaatttatcatagccccagaaaaaggattgtactttcttatattattaggttatacaacacactttgcacaagaaacacttcataaacgtttgaaaattatgttggtgaagagattggtcttcatgtaaaaagtaataagaaaccactggagggttttaaagcagaagagggaagctaatgaggtctgggaaggggcagtgacgactgatcaatcaacagcatcacccttgcagttattattattggggcaaattatccaaagtcaaggttcccctctagattacaaaataagaagtttattatatcgtgtatctaaaacacagatttccagttagcatgtaatatcctagcaaactatgtaccagagataggtttttgaaggtgtgtgagtccataattttaaatttctgaatcatacaaatgatgatttagaatggatgctacaaccatactatttcatttgtcaccaaataaaaaactattttattttcttccatgtcaataactaatattttatcacagatcactgaaaagtaaaaaagataacatctggatacaaggatgatgatgattactcttccgacataagaataaattacagcaatgaattgaggaatgaggagaaaataaataaacctagcaagctattatgacctttctaattaaaacagacatggctccttaagctacataaaatgttttctaaaagaattttagaaaaatgtatcacaagttgagatttgtatttcctattcaaagtatatattagatgcaagagttattaggaaccctcagcaaaataatacttatttggtatgtagagactagtaagttgtaaaatggtatcttcactgaacagaaataagaaaacagatatataatatacatattttttaatcaaaacagattttcacatttgctgcattttcaaggtacagcacaaccagtctgtttctaaatttgctgatcacactgatatgatgatgatgacaatgatgatgataataatagcattactattactactactactgctgctgtatcagcaatgatcagtgacaacaataatctttagcactgactgatctcctactatggactaggcccaatacaatgctgttaacataaaatgtctcaatttagtcctatcaatctaatgtagtagatattatcttcctcatattacaatgagaaaactaaagcataaattaacttgtccatcctaacaaagctaataaattgacaaagccaggatttgaacacaaccagtcagaatccaaagcttacacttttagctagcatactaaactgcctgtagaaaggacatagggactatagtctagtccccaaccatttttccaccattccccctccatgcatcaggagccaccagtcagatttgtacacagcaggtagagggcaactttttttttcttttttgagatggagtctcgctcggtcgcccagtctggagtgcagtggcacaatctcagctcactgcaacctccgtctctcaagtgcaagcaattctcctgtctcagcctcctgagtagctgggactacaggtgcccgccacagtaggcccggctaattttttttttttttagagagacagtttcaccatatcaatcaggctggtctcaaactcctgatcccaggtaatccacccacctcggcctcccaaagtgctgggattacaggcgtgcgccactgtgcccagccggtagagggcaatttgagccttctcaagatttaatacagacaacccaaaaaggaccatttacatgcatatcaaaagatacatttaaactaagatatataactactacattactagtctaataaaactaatatctatggaatatggtttaatcttaggtttgatcactcatgttcatgtaaaaacaaaaaaacccttcttgttgctctttttcttccaggatgtttctacaaaacaatgtattttaaaccaaactttaggcatttgaagtgctaataaaatcaccgtaagttctttattttgcttcaaatgataacatttgagaaataaacaggatcttctctccagccaacataaaaactctttaaagtcaggattcttgtttattttgtctagtgctatatcctcagcacccaaaatagtatctggcatttagcagactcaaaaaactatatgtaggttgaattaattgacaacacaacaaaaaaattttaaaatgatctcatggatatcacaaaaatttaagattggaatatagcaatggaaagggatagtttgttcatgaaaaaaatggatatgtcaaggaggtatgcttatacagaatctacggtctgagagtgagaacaacaatgttttcctaatacatattattaaactgatggaagagcaagctacactagtagtaatggtatacatctactaactggatagttggatatcccattatatctcagttaataaaaaaaagacaagaatacatgttaccctaaatgtcatcattctttacattacaaattaattgattggttctgttcttaccttttaaaaactgcccaaattttagctacttattctttcgttaggtaagcagaatgataaaatgtttaataaaattcagagaaaacccttttcatggattcgattcacaattaaaatattagacattaagtcaattactaaatgggttaggcaaaattgtagcttgaaaaaaacctagaaatcatactgttccttctacagaactatagaaactttgggtaggtgtaaaacttacaccttgaatctcaagttctataaacatgaaactgcatttacatatactttatttcatcttatttgtctatttttcccctgcttgggaagtcttaagatttaaatacatcatctccacttaaaaaaaaaaaaaaggattatatggtaaactcaaattatctctttacaaaataatggctgcttttacttaattttaggattctttatattagaaccctattcattgttttatttcaaacaataaactacgctggctttcatttgatggtaacatttatctgccagcaggaaaggaattaatataacaagttctattatatccaacaattctcccaccaattatttctcaaactaaatataaatgttttatttcaaagaaatttcatgaagaataaactttcaaaaagttcttttattcatgttctatgcctcggaaacaaaaggttaaatagacagtgtattactcgtaattgccaccttttaagcattggctttaaaatgtggagttatatttatttctattatttagcagagaataaaacgttctggcaagtaaagaataaaaataataatacttggggcctacatgtataactacactgtggttgacatcactgaacaagtcaaattgatctgaaactcagtgggaaaccaattaaaaagctagttatcactcataacaccaagtcgaaaaaaaagctgtccgaaggcattattcagagctctcttctggaccaatgggattcaatttcatttataaataacttagaaaacagagcagaaactaagaagatattttgaaacttaccagtattctcagaggctagcaatgtgtaaaagagagacaagagtgaaaacaacagcactctaggatttggattcacctcctcccaccacgagtttaatctctgggacccagctgcctcatctatttagtaaatgccgcaatactgcctgctcaaatgaaaatgagactaaagtaaagattgtcttgaattctaatccataatacttaagattatgctcttagagaagtctaacctctgggttagaattgtgagtctacctttcatagctgtagaaccttgatggagttactcaaactgcctgtgcctcactttcctcactagtgaaagagggataataacaatatttagctcatttggattaggagaaaatcagattagttagtacataaaggcccttacaacagtacctggcatacagtgaatgttataaaaacattaataccagcaagaaggtttttcacaagtagtgaatacaagatatatatgactctggttgacatttcaagatctactttatgataaacaatagcatcatattaataattatatcaatgattacatttccaaatacctaacaactgcgataacctccacttataccatcctgagtaaaatggcaattaacagtaatatgaaaatgtgatgagttgatttatgaagtagaaaaaagcaaccatttccaaaaggcattgtctctgtcccaaacgcttcaaaccaagttttaaaattagtttttacccatgagcaaaggacaatttgattattataaaggagaactagtttgttaaatcattaaagtacaagagaaagtcacaaacttcaatgagaagtattaaagaatttcccagggccaggcctggtggctcacacctataatcccagcattttgggaggcacagagaagggatgattacttgagcccaggagtttgagaccagccccggcaacagagcaagacctcatctcttcaagaaaaagaaaaaggaaaaaaaaaaagaaaagactagcaaggattcaggggaagctgtcacaggcctgtagtcccagctacttaggaggctgaggtgggagggtcacttgagcccaggagatgaaggctgcagtgagctgtgactgtaactgcattccagcctggatgacagagagagactgtctcaaaaaaataaattaaattaattaaataacttcccaaaaaagtcagttatataactcagaaaggctgctctatacaagatgattaatgtcaacaaaacaagagagataaacaaaacaagagagataaacaaaacagatgactagagaaaacagatgacaagagagacaacaaaacagatgacatgagaagtcactggtatgaaaactgacctccaccagtaccacttgcctcttgggcagattaccctaattttgaataagagacactgaaggtcctcagaacaatgaaggatgcctatgctcattacaaagaaagtcaccaggaaagaaaggaatcctcaagtataatttcaatggccttgtactttatcaagaataagctaaaatgacccacatcaaaaagtctcccaaataaaacacttaggtaataagttttacattctgaatttggtgttatatacgtaaaatgtttataaatacataggttttattgttcatttatttttgatatgatgttcatatttgtagtattacagatgaaaaatagggactcaacttaaaattgattaactacaactttcatttatagtaatcaactaacctataggttcgaggttgccagtattccattcagtgagggggaatatatattaaatgtggtaacacggaaagatctgagatctgagtcaaccaaggattgatgagaataatccttatacaggggagacccaaaagtacatatctacaactgccaaatgggaagaaatatgagagcaatctaataaattccactccctattctgtaacttagactgacacagaaccagtggagagaaaaacagagagacccttatttcacattacatgaagacaagcagaccctgacaaatagcctttagactattaatgacaccagaaaaatcacttccagaacaaagataaaaatatatgacatttaaatttatcaattacaaaactactgaaatgtaccaaaatattcatgaattgtatcagtgttcattataaaaaataacccacctatgtgagtatgtagtgctaatggattttgaataaaaggattagagaggaaagaatacttttaaatctcgttttcattcatcttaccaaaaaagcacagattatgcctatgcagaccccaagccaaaggaacactgatttcttcatagccacccttaagaatccccgtatgttcttgcctctaaactgtgctgaatggacatttcacacactatttatataaccattcaactctgcccagcctatgtataatacttatatagtacttaactatctgcaagcacaaatataaagttgtaagcaattacatatgtaaattcggcagccctgagagatagacaatattatctttctcattttacaggagaggagacacaggcacagaaacagtaagcaacttgtccagggtcaaatagctaagttgcagctggaatttgaacccaggcagtccggttccagagtctacgctctcagccactatggcattttacttatttgaatcccgccttttccagctcaaattccagcttcccaaagatgttactgtagccattccagtccagattggtttctttttgttctaaatcctcactacttatctggacaaccatgtggcatttaatctttcgatagtatataagtggtatacttctcaaattccctgaagttcttatctattgttaatttcctagattgtctccccactaaaagtaaatattctctgataaatacccctttgtgtccatcacaactcccagtgctcttatatgcataataataacatataagcaataattttaactaactttatataaatgcattatttcatttaatcgtgaatcaaacaccctaaaaggtatatatcacaattataaatttccagataaacaatccacatgagctcaaaaatagtcactaatgaatgaatgatcagtaggaacagaccattgatactctcttaattctaaaatcagagctctcaaaggaaaaaactcttaagaactagaaagacaagatcaaatcaagctgtgaaaacttattgcacattgaataaaaactataaaagtcaacgtaagaggaagactacatagctaagactatttgcctgtagataaccctttctgcatttatctcactgctactgtaattatttgtatacatatatttcagaggagggtactttatactcccagcacctaactcacagtagtagctcacagaaatgattcaatcaagtaactaattagcaagcttcctgaaatgaatcactgtgcttctcaagcttgtgaaaaaccctccaatgacagaaaaaattatactttggaaaccaagttatacaaaggcagtaggaagaaaaaaatgttgatataaaatattcaaaaagaaaaactaaaaatcataaatatggcacgttaacctcatctaaatggatagaaaggtagcacgattcacagcatgcatatttataatgttgtctttaactgtgtcagtcaatgcggtgttcattagaggaaaaaaattgaaaccttctgatgttcccagaccaagcttatcagactttcttccatgttattaaacctctcatgtatttccattactgctgtcattgcactgaattataattatttatttatgtgtcttgctccttcactagactatgagctccttcaaagctttcatcgtttttgattcgttagtggaatacctggcatttatttaaaacttactacatatttaatagatggatagatagacaggaggatggacagactgaaggaagaatggatgattatgtataaataaatgaaaaaacaaaaactatccccaaatcataagggtatacgcaatgctttcctgtggcaaaagattcggaacatgtacagcagattttttttcaaatgttcataattctaaattcccaaaatggtctacacaactccctattttccacccatgccatcaacaacaatgcaatgttctatgggacaggtgactcttcgcctgtgtatgagcacttatgagtacaaagagatgtggaatttagctgggcatgatggaggatacctggagttccagctactggggaggctgagcagaaggatcactcgtgcccaggagtttgagaccatcctgggtgacagagagtctccatctcttgaaagagaaagagagagagagaggtggaaagtcctaagctattaataaacaaagaagcacagaggttgtttgccctgagatactgctgcacaagtctatgtgagccttttacaatcatgagttctttgagtctaggcaaaattacactgcagacaggcataaaatcacagctgaggaaatgaagaccctggaaatgaagagggagtgttctgatgtcagttcgacagaatgtgactaggaagacaatggtgtagctatctgcagggcgaataagtctaacacactttagtgttgatgaggttcaagattaaactagagttaggtagagaagggaaacaaaacactaaagaatttgaagaaaacagttcttatgactgtcaatatagatttttaactacataacattcattcattccacaaacctttattgaacaactaaaatttttaaaaataaatacaaaggtattgctcctgccctcaagaaacacaaaaatagaccagaaaatagatgctataataagttaacaattgagacacaaagtgccactggtattcaaagagaaaatgaccctgagaggcagaatgagaaccaagggtccaagaatgaagtgggatatatgtgactgtttctttaaaaaattgtccataaatgcccttgagagataacacatagcaccaactctcccaaacacctgcggctgacagtcaacctctgggatggcaatttggaaaaagaacatctctggctcaatacattgcagctttgcttatttgttgttcgcagtaatgaaaagtccatgtgttaaaatatactgtatttcaactacatttctcgatcactttctgtaatttccagattaaggaaagcctttcacctgttcctaattctgaaatccatttaatcaactgcatagagacattaaccttatagtacacaccatgaggtggctggtggagctcgtattttgattaaataaatcatatgttatgggaaaagacagaataggctccatgacaacagggataagaactcaactaatgagatgaacaaacctacacaaaacagactaataaaagatcagctcaggaaaattactttaaaacactaaaagagaacttctgctttgaacaacaatgaagtatggagtaacaggaacagtaatgaatctcttgaattaatctaaaaaactaccaccacgatcaacaacaaaaatagacagcaggacaccaggcactgcaggataacgacactaagggaagggaaaaaaacaaagtgagcccagcagcgccctcgctcactgcctgaagagaagtgacaggctgcagcataaaaagggaactctaaacagagcctggcaggccttctgggctgcagagacagagtttgaaagtcagagagccagagtagctagaatttacagacaatggatcagagaagaacgtgcactgagaaagaaagctccaaaaatcctgggaggggtccctctagtcattgactaagcactgctcagtgtgtacctgtgatgaaatcacacaaggatggggaaaccaaccaaaggagcagaaagaacatccctggacctcacatagggccaggaatagttcaagttccagtcagccagaatacgaaaaactagtaatctgtagggtaacaggttttattattttatttcattatatattaaagaatattacccggccgggcacggtggctcatgcctgtaatcccagcactttgggaggccgaggcaggcggaccacgaggtctgcagatcgagaccatcctggctaacacggtgaaaccccgtctctactaaaaatacacacacaaaaaaaattagccgggtgcagtggcaggcacctgcagtcccagctacttgggaggctgaggcaggagaatggcgtgaaccgggaggtggggcttgcagtgagctgagacatcgccactgcactccgacctgggccaaagagcaagactcggtctcaaataaaaaaaaaaaaaaaaaaaagaatattaccccagcaggtgagcaaaattagccttagacaaaaggctgccctgttcccactaacaaagctaaaaggtaaacctcaagatcatcaaagttcttgagtaatttaactgcaccccagaaaaaagcttcagaatactttcagggataaattaaaaaaaaaaaatcttgaggggaggagccaagatggctgaacagctctggttgcaaacagcaacagctctggtctacagctcccagcgtgagcgatgcagaagatgcatgatttctgcatttccatctgaggtaccaggttcatctcactagggagtgccagacagtgggcgcaggtcagtgggtgcagcgcgccgtgcacaagccgaagtagggcgaggcattgcctcactcgggaagcgcaaggggtcagggagttccctttcctagtcaaagaaaggggtgacagacagcacctggaaaatcgggtcactcccacacgaatactgcgcttttccaacaggcttaaaaaatggtgcatcaggagattatatcctgcacctggctcggagggtcctacgtccacggagtctccctgattgctaacacagttgtctgagatcaaaccgcaaggcggcagtgaggctgggggaggggcaaccgccattgcccagacttgcttaggtaaacaaagcaggcgggaagctcgaactgggcggagcccaccacagctcaaggaggcctgcctgcctctgtaggctccatctctgggggcagggcacagacaaactaaaagacagcagtaatctctgcagacttaaatgtccatgtctgacagctttgaagagagcagtggttctcccagcacccaactggagatctgagaacgggcagactgcctcctcaagtgggtccctgacccctgacccccgagcagcctaactgggagacagcccccagtaggggcagactgacacttcacacggcccggtactccgctgagacaaaacttccagaggaatgatcagacagcagcattcgcggttcacgaaaaaccgctattctgcagacaccgctgctgatacccaggcaaacagggtctggagtggacctctaccaaactccaacagacctgcagctgagggtcctgtctgttagaaggaaaactaacaaacagaaaggacatccacaccaaaaacccatctgtacatcaccatcatcaaaggccaaaagtagataaaaccacaaagatggggaaaaaacagagcagaaaaactggaaactctcaaaagcagagcaactctcctcctccaaaggaacgcagttcctcaccagcaatgggacaaagctggatggagaatgactttgatgagttgagagaaggcttcagatgatccaactactccgagctacaggaggaaattcaaaccaaaggcaaagaatttgaaaactttgaaaaaaatttagacgaatgtataactagaataaccaatacagagaagtgcttaaaggagctgatggagctgaaagccaaggctggagaactacgtgaagaatgcagaagcctcaggagccgatgcgatcaactggaagaaagggtatcagcgatggaagatgaaatgaatgaaatgaagcgagaagggaagtttagagaaaaaagaataaaaagaaacgaacaaagcctccaagaaatatgggactatgtgaaaagaccaaatctgcatctgattggtgtacctgaaagtgacggggagaatggaaccaagttggaaaacattctgcaggatattatccaggagaacttccccaatctagcaaggcaagccaacattcagattcaggaaatacagagaatgccacaaagatactcattgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaaaccagaagagagtgggggccaatattcaacattcttaaagaaaagaattttcaaaccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagctgctgcaaaatcatgccaaaatgtaaagaccatcgagactaggaagaaactgcatcaactaacgagcaaaataaccagctaacatcataatgacaggatcaaattcacacataacaatattaactttaaatgtaaatggactaaatgctccaattaaaagacacagactggcaaattggataaagagtcaagactcatcagtgtgctgtattcaggaaacccatctcatgtgcagagacaaacataggctcaaaataaaaggatggaggaagatctaccaagcaaatggaaaacaaaaaaaggcaggggttgcaatgctagtctctgataaaacagactttaaaccaacaaagatcaaaagagacaaagaaggccattacataatagtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagatagttaacaaggatacccaggaattgaactcagctctgcaccaagcggacctaatagacatctacagaactctccaccccaaatcaacagaatatacatttttttcagcaccacaccacacctattccaaaattgaccacatagttggaagcattcctcagcaaatgtaaaagagcagaaattataacaaactatctctcagaccacagtgcaatcaaactagaactcaggattaagaaactcactcaaaaccgctcaactacatggaaactgaacaacctgctcctgaatgactactgggtacataacaaaatgaaggcagaaataaagatgttctttgaaaccaacaagaacaaagacacaacataccagaatctctgggacacattcaaagcagtgtgtagtgggaaatttatagcactaaatgcccacaagagaaagcaggaaagatcccaaattgacaccttaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctagttttttgaaaggatcaacaaaattgatagaccactagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacactctcccaacactaaaccaggaagaagtcgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaattaacagaaaaagagggaatcctccctaactcattttacgaggccagcatcatcctgatagcaaagctgggcagagacacaacaaaaaaaagaattttagaccaatatccttgatgaacactgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattgtctcaacagatgcagaaaagacctttgacaaaattcaacaacccttcatgctaaaaactctcaataaattaggtattgatgggacgtatctcaaaataataagagctatctatgacaaacccacagccaatatcatactgaatgggcaaaaactggaagcattccctctgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtgtatctagaaaaccccactgtctcagcccaaaatctccttaagctgataagcaacttcagcaaagtctcaggatacaaaatcaatgtacaaaaatcacaagccttcttatacaccaataacagacaaacagagagccaaagcatgagagaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaaccaaaaaagagcctgcaacaccaagtcaatcttaagccaaaagaacagagctggaggcatcatactacctgacttcaaactatactacaaggctacagtaaccaaaacagcatggtattggtaccaaaacagagatatagatcaatggaacagaacacagccctcagaaataacgtcgcatatctacaactatctgatctttgataagcctgagaacaacaagcaatggggaaaggattccctatttaataaatggtgctgggaaaactggctagccatatgtaggaagctgaaactggatcccttccttacaccttatacaaaaatcaattcaagatggattaaagacttaaacgttagacctaaaaccataaaacccctagaagaaaacctaggcattaccattcaggacataggcatgggcaaggatttcatgtctaaaacaccaaaagcaatggcaacaaaagccaaaattgacaaataggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaatcctgtcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcacaccagttagagtggcaatcattaaaaagtcaggaaacaacaggtgctggagaggaggtggagaaataggaacacttttacactgttggtgggactgtaaactagttcaaccactgtggaagtcagtgtggtgattcctcagggatctagaactagaaataccatttgacccagccatcccattactgggtatatacccaaaggactagaaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaatccaaacaccgcatattctcactcataggtgggaattgaacaatgagaacacatggacacaggaaggggaacatcacactctggggactgttgtggggtggggggaggggggagggatagcattgggagatatacctaatgctagatgacgagttggtgggtgcagcacaccagcatggcacatgtatacatatgtaactaacccgcacattgtgtccatgtaccctaaaacttaaagtataataataaaaaaaaatttttaaatttactttcaactaaaaaaaaaaatctacatccaaattatgtaaaattcttaatgtctgttatccaataaaagttaccaggtatgtaaagaagaaggaaattatggcttataaccagaacaaaaatcaatttcttgaaacagatcaagaaacaccaatgacatgagaacaagaggcacagaatattaaagacccaaatcaaacttctaggaatgaaaaacatagtctcggagattaaaaaaaaaatacactgaaggcatcaattatagacaagtcagaagaaaagaatagcaaatttaaggacacagtaatagaaacaatccaaaataaaatcagtataaaaaagaaactttttaaaatgggctgtaagatatgatcacatggtcaacatacatataataggagtcccagaaaaaaaaaagtgtgtgtattgggaaggagaaacaaggaagggaaaaaaatatttgaagaaataatgaccataaatttcctaaatttggtgaaactctgaagtccatagatccaaggaacttgataaccaacaagaataaactcaaagaagaacacaccaaggcatataataataaaatggctcaaaactagttataaataaaatcttaaaagcatgcaaagaaaacaagacacatcatgcaaagagaaacaaagataaagaatgacagcagacttctgcttaaagcaatacaagccagaagacagcagggtagctccaacgaggtactaaacaagtacaactgttagcctagaattctatactcaataaaatatcttccaaaactaagcaaagatttctccccatccataaaagcaaagagaattcaacatcagcactgcaaggcatgctaaagaaagtgtttcaggctgaaggaaactgacactagatataaattgtatctacacaaagcaatgaagaggactggaaatggtaaatatgtgtgtaaaaacaaaatacattttcaattttaaaaaattactgataagagcaaaaataacaaaaatgtattacggagttcataacacatgcttgtaaaagttaaatgtatggcaacaatagtgcaaaagccagaaggaggaaaatggaaaaacattattttaagttcttacattatacatgaagtactagtaaactatttgaagttagactattataagttaaagaagtctactataaaccctagagcaaccactaaaaagaaaaaaaaaaatcacaagaaagtataactaacaattcaataaaggagattgaatataattataaaaatattcaaatcaaaagaaaacagaaaaagaaaaaaagggaaacaatgaaaaattgagacaagtagcaaacaaatatcaaaacaaataccaaaaacgggacaagtagtaaacgaataccaaatgccaacacacgggacatgtgaacaaatgaaaataccaatgggacagtagtaaacaaataccagtttaaaacatcagctttacgctgaaccatattgaaccatgccttaaatacaaacagtaagtcccagcatgccaattaaaagctacacattgccagactggataatacagaaagatcccattatatgttgttcataaataacactttaaattgtttttaaaagtcaatgtacatccaacattagaaaagcaagaaaggcatctgacttgatggatatgagaatttcatctctgttgagagggaaagacagttctttatgttttcccagagtttaggtaaaatagttctcttggtcccttgattaagagaaaaagctaatgtgctgtgttagaaaccaagatagtggctctctggagtgaggtggctagaagacggtaaaaggagagagcacaagggatgctggtaatattctgtttcttaatcatgttcacttggtgaaaattcatcaagttgcacattgatgatttgttcattttcccgtatccataattcaattaaaagtgaaatttaaaacctcaacttcatttgatgcaatgctcactaagcaatttttttattagtaatttggaaactcaggtacctcacaccaggaaaggggcactgtctcagataataaatcaaagcacaagtgttatcaagaagaaatactcctgtcttactccatttatgctgctagaacaaaatacctgagactgggtaatttataaataacagaaatttatgtctcacagttccagaagctaggaaatccaaaatcaagggtttggtttctggtgagggcccagtctctatttccaagatagtaccatgtcactgtgaccctcagaggggacgaaggctgtgtcctcacatggtgaaaggaacaaaatggcaagagagcactcctttctctctcaagcctttataagggtgctgatcccatcatgggaacttggcctcccaaaggccacaccatttaatactgttgcattaagaataaagtttcaacatgaattttggagagggcatcatcagtcgaactacagcaatttcctgttataattttctattttgttaattcatcttcagccttttgcaagcccttttagcgtacctaaaattaaaagacatctataatataatgtatattcctatcaaaatctacagaaaaaaattgctgctgctactcctataaccatatcccctattatcaccaccattactgtctaatgaacaccacttatatgctagcaactgtgctagatgatgtatcgcttacgttacttaatcataagtacctctacaatctcccatttcacacttgaagaaactgaagccaaatgactttccaaaaataacacagctagcatgtactcacacaagacgtacgtccctgtttctgatggaatgcaccactctttccagtacactatactactacctctccacattaagtatgtcagcaccatatgccatgtgatcccaacattcatatatgtcatggattttttttcacagttcctattacatggcatctaaacttttaggattaaatgaaataggcacacactgaggacaaaacttttcttaaaataatccatgtcttgtcgacaaaatattattttgattcttagcagaatttttcttcttataaatgcaatgcttaaacaggcttgcctatatcagaaattagaaaaagggtttatttatatgttaactaaatatagtgtgacaaagacacatggctgttacagacaagttttacatactaatgaaatgtaggaccaaaaagaattatagggactatttacctcaggcaatacaaccattcagaagatgttacgatctatgtaagaagcacacattctgaaattattggtcaaggtttttagagtttgcaagaaaatgaatatgaaagagaactccatgaaaagggtatcatttggtatctgagtctagtaatagcatccttctttttaagagaacacattagtttaaaaaaaaggatctctcaaagatttcttaatttcaaataaaaatggaaactgaagattatattgttacattaaaaatactggaaaatagttacattcacactaaaacagtaataaaattaaaattatttattaaaataattccctatttctggacctgtttcactgatgcctcacaatcttgccctaaaagcaaaataatccctttctgcttatctcatgaacatgctatgtgaactatatgtgaaacataaagctggtttgtaaacttaaaaacaaatgttccatagtcagtcatgagatgtttgttgaataaaagaggaaatgggttaattaactagtacatcttcatttctttaggactccccagagtaccagatacataacaaatatcaatgtcaacatacttccaaggcccaaaaaaactactctgaaataatactgacttacaccttcttaatcagagaactcgccctgaacccttttttttctttaaataggaagataagaacccattctatcaagatctaaagtgcccacagtgccagaagacatgcaaaccaattacccctaccaccagatcctaaccctgttcccagccaatagaggctgttaggcctttcttagctgatacaaccacaaggttattcttagattcaggaactgccagcatattccactctgttaagtactctgtggactcctctctgcggacagtcacctcagaaggccaaacactttttccaagtcagaaatacaaagccattttattgttttttcctcacagcagctcagaaataaactgcacacaggggaattgaattttgattaggtaactaatcaagttttcaatcttaaagggaaaagaaacacttttatgtttccctggagaatcaaaaagtaaatgcaatgccctaatctttccataaatatttcatcatccagcctacagttaaggtggtattttattatcacaacaaaattagggtagaactagaataccaaatgaaaattacttctttttaaatttcagggaatacaaaaagaaataacaggactaggctatataaaagcataaataaaaagagattcatctttgtttactggaaatatgctacactagttcattttcacctaacaaattaattgggaatatattttgtactctgtgaataagcaatatgatatacacaaagactcagtatgtgaaatactttggattaaatatacattcagacacttctttcctactcaaatttcccaacatcaaaaacatgctcaactttcaaggtctagatccaaatcttacctttccaagaaggctttcctgattcacctcctttgcaacagaaagttgcatctctcccatctctaagcctatctaccctcctcatataacacattttaagataggtgtatctatcttaaagttgtatctaacctgtctgatcttccccactagattacaaatttatctgtggacaggtaccacatctgattcacatttctatttatttactgaatcaaatataattcctttatatggaacacaagtattccctaaacatttctgaaataatataaaatttatatgactcacacatttttgctaaactgttctttcaatgaaagtgaaacaatataaagcaatttagaaatgtttaaacttatttttctttttttcagcatcaggttcatttttgatgctttcatttttaaatgagtttacatgtactcatgattaattataaatttcactcaaaagaaggttaaaattcaaaagccaatagctgctttgcaagaaacattaacattcttcttatggaagacaaccttctggaatatccataaaactatgaaactataccaacagtaattgattctgggactgtttgggagaaaaaggtaatttagcttcattcattcattcattcattcatccatttatttatttatttatttgacagagtcttgctctgttgcccagactggagtacagtggagcggtcacagctgactgtaaccttgaaatccagagctcaagtgatcctcttgcctcagcccccgagtagctggggctacagaagtgtgccaccatgcccagctaattatttttattttctgtagagacagcgtcttactacattgcccagctagtctcaaatacctaccccccagctatcctcctgccatggcctcccaaagtgctggtattataggcatgagccaccgcatccagccaatttacattctaaattgaaagctgcctagagtccattttggtgtcaataaaaaagacagttcaaattatttcatttctggaaaatcataaactaatataatcatcaaaatatcatcaacttaaggcctacagtatagtaaaaagtagacttccatctacctttgatttgtgaagaactggaataatatcctctgatctttttaaaggtaaatttcttattaatgatttaaattataaagtgaatcaatttgacctaaatcaaatttgttctactggaaattttaataatatgaatattgatgttttgttttcatatcataagttttacgctgttgtaataacacaaaaagtctccacgtttgcctattcaaatccacaagagtaaaataaagtatcaaaagacactagaagttcccttcaggttggatactctctttatcaccaaaagatgaagaagaggttcttcgaagggattcaggcaaaaatagtgacataatctcccatctcaaactagagtttatcttcatcctttacagttttgcagcataaacagaaacatgacccacaagtagaaaccactctaaagcttatttaatcttaatattaatttcaccagaagtatatcataccttgagaacattacgctaaaaaaaaaaaaaagtcaataaatgaacaagtactgtatttccacttacatgccatacctagagaagtcagattcattgagatacaaagcagaaatgtggttgccaagggctaggtgggaagatggggagatgtttaataggtatagagtttcagttttacaagatagagttctagagattggttgcatagcaacgtgaatgtacttaacaatgttgaactgtacacttaaaaatagttaagatggcaaattttatgttaggtgtattttacaattcaatattttttaagataaaattaaaagtgtatcatggccaggatgggcacggtggctcacgcctgtaatcccagcactttgggaggccgaggcgggtggatctcaaggtcaggagatcaagaccatcctggctaacacggtgaaaccccgtctctactaaaaaaattagtcgggcgtggtggcgggtgcctgtagtcccagctactcaggaggctgaggcaggagaatggcatgaacccaggaggcggagcttgcactgagccgagatcgcgccactgcactccagcctgggcaacacagagagactctgtctcaaaaaaaaaaaaaaaaagtgtatcatagccaaatggtcctaatggtccctatgctcaactgagtcaacaagatataaagatataaagtgtgatttatgaatgcacaaaaaatgtattcgctctgaataggattgtagaagaacacaactagaattatctccatgtttacagtctgagaaagccaacaacaggtttcctttccagattcggtttcaagagaatgcttctgactgcatcttatttactttgtcacactaccttgtattttctaaatctgctcacgtaatcatttattcatccaacagtcattaaccatcatttcatgtatgcactatattcacagcactttattaggagatatgtgttagtcttgttattttaaaaaaattgtcacaggatactatgacatctgcaaacagaatagtaccctccaaattggtcactagaagggtgagtgaccctccagaatgggtaagtgacaatgactcatcagtagggagaaaagaatgccagacttctttacctgatgacactccccagttaaaattgggaattggaaaacttctggagaccctgaatttcctgttgcaccatcaagtggggcagagagcacaaaaggaacaaggcccaaggaaagcaggaatgacccagggttagcaagagaataaagtaccaaagccatcagttaaagcatgtagagcacaaagaggccctaaggaagaacccttctgccaacaggattgtcatacaatttatcacactgttttgcaacattgttctaaatgaaggcaggtgactgtgctttctgtgctctaggaaaacagcagtttctgaagatggggactaggtatatactgacataagattaaattggcatcctatgtgatctaaaccactggtgacctaaaattgttcactcagtcactttttagccttactgataagccataaaattactgtgaaaccaaaggtcaagaataattagaagacaacagataatccatgcaatcaaattcagaaagaaaaatggcaacaccgaaaacatattttcatactttactcaattacagtccatctgcatgttacagcaagcttttcacagtcaaactttgaatcatcaaataacctaactaaacttagatacttacaagcaagcaaattgccaggatactatagtaacagcttttcttttcttttttcttttttttttgagacagagtctcactctgtcaccaggctggagtgcagtggcgcaatcttggctcactgcaacctccacctcctggggtcaagcgattctcctgcctcagcctctggagtagttgggactatagctgtgcgccaccacgcccagctaatttttgtatttttagtagagacagggtttcaccatgttggccaggatggtctcaatctcttgacctcatgatgcgcccgcctcggcctcccaaagtgctgggattacaggcgtgagccaccacaccctgtctagtaacagcttttctaagagggcgagaagaatcaacagagattccatcaacagagttttcccattaatactataaaatattttaaatactgcaatatttcaaatatactaactataattcagtattttcttactgattctggagataatataggaatataaatgagtatcaattctcattgttcagtaaacatataattgtcacagcatttcttaatgaacagatatggaaaaatagagtttatttccagatattaaaagtaatgaagtctaaatgcaatgtggtatcctggactgtatcctcaaacagaaaaaggatattagttaaaaaaaaaaactgttaaatccaaataaatctgtagttagctcacagtactgtacagtcagttctgctataatattttaaaatgcaaatttattccaatgaatggatgtattaggaaacaacttacatgttacacaaatttctcatttgctgatgcacaatttcatccttctgcatgttacagcatcaggtgaacatggaaaactgcaccctgctgaaccaagccatgccggattccgtgtgcatgtacattcctcaaacatctaccagctacttcagttcaccaagtgtgtgagaagcaactcccatccacagctggtgttataactctccatcaaatttctgatcaccctcctttctccacttcccaatagctcacaaactgccactcttctgatactcaccttccataagcaaggtcttctccaggtatttttcaaggtaaagggccatattttagtatgtaagtatttcttaaccattcaatacacataaaactatactgcaattttttttttttttgagacagtctcactctgtcgtcaagctggagtgcagtggcacgatctaggctcactgcaacctctgcctcatgggttcaagcgattctcctgcctcagcctcctaagtagctgggattacaggtgtgtgccaccatgcccggctaatttttgtgtttttagtagagatggggtttcatcacgttggccaggatggtctcaaactcctgacctcaggtgatccgcccaccttggcctcccaaagtgctgggattacaggcgtgagccaccgcacccggccgatgctataatttttgttaggttactaaatatgttccagtgagcaaagttcttgagtactataccattaatcccctttttctcatatgccctatggttttcactaaataattctgtataatgcagtgacttttaggaattcatgtgtcacattatagcagaacggactattccagtgctaatttctaatttcaacaaatatgctatggttatataagaagaagaaaaaaaacctaggtgaatagtatataagaattatctgtattacctttgcaactgttctgtgtacatattccagtaagaagtttaaagcaataagtatatgaagtatataagcacataagaccaaggcttcagcatgggattctgtattaataataattgctaacactaaagcaacacttacttggtgccaagcactgtcctcagcggttgatataccttaactcattaatcattctcacaacactatgaagtaagtgctatgagcatatccactttacaagtgagaagactgcagtgcagttaagaaacccaagatcacaaacataggcaactagatagtcaatgctcttgctcctacgctacactatttcaacagacaactgttcaaaatacagtctttttaaccaaattgtattcatcactcaggaaatatttttaaatagaaaaagagcaaaaatgaaaaatctaaataatctttctgaaatatgctataggcaccaaaaaataccccactgccaaaatgcttcttctaacagaaaatctctattatctcaagttgtggaagctaacaaagactgcaaaaaatgtcacctttgtactttaaaacagccaactagaatataaaatgtaaacattttataacagttacaaactcagaacaggtggctataaaaagatgcatcaactatgacagcaaatgtaatttcaaagctttacaaaacttggtcacatttcatcaatgtcaaatacacatgatgatttaagactgacaatataaaacacaaaaatagcccataatttagaagtttcccagctttcataatcataaaatgtgtctgaatcgaaagtggttaatcaaatgttggttaaatgccaaggcaaaagttctgccagtgggatctcaaaacagagcaggcaataggtcaacttggcataacttactattgctttgcaaaatttaatatagcttgaactctaaaatctaaaattctatctacccttctatgcacttaatttgtggttcctaagtcactcattctttcaaaaaaatacttcctgagctactggtttgtactaggcactgttctcagtactgcagctacattcgtgaacaagaggcaaagtccttctttatggatcttacattcactcatgcatttattcattcactcaacaagtatttaacgaatgcctactttccaggcaatattctaactgcaggagataaggatggaaacaaaacacacaaaatcgctgtccattggagctgctatttcagaaggggaaacagacaataaataagataaataagtaaaacacaaattaattagattactatataataaatgctaggaagaaaataaagcagagaaggaagatttaaaatgagagtagaattttaaataggaaggccaaggaagatcagataaagtagagaagacaaataaccatgtaacatattaggagtaaggctatgaagagaaacagagtataggcaaaaagcaagggcaaagtgaagcttatatgaaaaatgtgatcagggaagacctttatgaagagatatgctgagtagagattcagaatgaagtaagagacccagtcacaggatgacatgggagaagggcacactaaattaaaaagacccagggcaggagcaggcttggcaaggtcaaggaacagccagaggcctgtgtggcaggaatggagagagcagggggctctatgcaagcctcctaacagctggctgaagactgcacagtgagacaggcatctggggagccatacacttaagagtctagtgacttgtttcaactcaagtcactaattgacttgaaatcaattcaacagattattaaaaagtcattattacttgcaaaatataagtggaggagtcaaagaaaagagcaaaatgaaacaggctgagccactgagcaatgtacactctcatagaagaataaggcacacacatggaaagttaacggccatccaaggcagtgaggggatgtcaaggtcattttgttagttttcagcattgctattgacgagaaaaaagaaaagagcagaatgagctgcaattacttatttagggtatgtttaagttttctttcttcctcagtttaaaagcatgatgctgtaacaggaagtgctactgcttcgtaaagcatccctgatcactcgtgctgaagaggagctatgctctactcatcctcaatccctaccacagttccatgcacgttcgaggtgcccaaccaatggtgcgtggaaagtggaggaaagcactcatgcaccaacaaataggacactgctcatctgaactgcttccaagtgagctgaaaatgaatatcaagtattcaaagaaccctcacaacggaaataatttctagaagtacatcttactgctctacttgtcatttagggtaaagcttcaattagaataaaagagttctgtccttaacgatgggttgaaacagcagttgaatccttcaggtcctcggtaaacacagacctgggcttcttccaggttagcaagtgaaagtccatctgcactacctgcaggaaacttcataatctcttttttaaatgacacaagaggacctaatttatgcagtcagcaaatattttcagtatactcactatacaagcgccgccctaactgggatctgaacataaggaagagatggtctctgtctttaagagttactcggatatttattaaagaaggaaatgagggaaaaaggcagaaataagtatgactataacacagtgtaaaaagtgttacattatgaaaataaagaaagaattatgagtatagggaaaggagtaccttatagaaatcctcctagaagaggttatgcctgaagcacaagtgtgattttgctttgcagtaactatgacatggtttagatgttttttcccaccaaatctcacactcaaatgtgattcccagtgctggaggcggggtttgggtggggacaactggatcatgagggcagatccctcattagtggttcagcaccatccccttggtgataagtgagttctcactcagttagttccagttgtttaagagtctgggacctcccccttttctctcttgcttccctctcaccatgtgagagcgcttgctcccccttcaccttccaccatgactggaaacttcctgaggctctcaccagaagcagatgccagagctatgcttcttgtacagtctgtgcaactgtgagccaattaaaacttttctctttataaattacccagcctcaggtatttctctgtggcaacacaaacagactaatacaaacctaaattatgaaaggacagagatattattgtaacctattgttcattctcactatttacaactatacaaaaaaacagtgtgaaagactttcttgagaacaaaggttaattttaaaaaaactctattttttccaaatgtgtttgaaaacaagctaacttaagaactcataagaaatcagtctcttcaaagtttgtctaaacaacatatccccaaacaatgattcaaaataacattatattcttttaattatactctgctgcaatagggtatgactaaattattgatcacaatttaaactggttcttgtggcaggccccataaaggaaccacagggcattcaaagaaaagtgtggcattgggtactgtgcagctcttttgcaaaccaactttcaaatttcaggttaaaatcaaatgcttatctaagcaatcatcagaaaacactgacaataaatgcatccaaatctgaggacatgggggaggcccttcagggtggtatggcctagacaaatgtatccaaatcgaaggagaaactgcctttaaaaaaaccgttaagagacagtagcccttttctctatactaacaatttacagtaggaaagatcatttccattttccattcagattagatttattctgcaaagagatagagaaccattgatctaattatattctgaaaacatgcataaaatatatttataaaacatcatttacattatccctcactatacagatctaaaaattatttgaaaatgaaaaaagcatcctgagcattttttctttttttttgagatggagtctcgttctgtcacccaggggtgcgatagctcactgcaagctctgtctcctgggttcacgccattctcctgcctcagcctcccaagtagctgggactacaggcccctgctaccacgcccagctaattttttatatttttagtagagatggggtttcaccatgttagccaggatggtctcgatctcctgacttcatgatccacccacctcggcctcccaaagtgctgggattacaggcgtgagccaccgcacctggccctttttcttgatttttatcagaacaaagagttacttttcaaggactaacactaatgtaaactaaggagtttataatatattctcgctgcttactgacctacaacttaaagtaaatacgggttcaaattctggctgcccatatatagatttcagcatgctactgaacttctgtaaatctcagctttctgtaataacagggtaataccaaaattatttgaagaccagaaataagtgccaaatacatagtaattactctatacatgttgaccatcatcattaatacccatgcctagaaataggatattgagtggaggcagcaagggaggaatgaggaaaccaaatgatcccctaatttgaataacatctcttagcactgtaagtttccagtagctgaaattagtaaaaatgatttcagtcagaattatcttaacagtgtactacaaggtactttacagtatactatagttaacaagcagatattataattatcaattctggtgttactaaaaatatgcaaagtgagtaagcaagacagggacttcaacccattttaaagataagtaactcaaatgcagaaaagataaatcatgtagttaatcattgagccacacttactagtgggctagcttacctcacgtaaaagttcacacaaatggatgtgtcatcttactcttttgccttatgcctctattcagtaactgacctaagcaaggtatgctaagccctcttttctcccaggtgccattcaggcctggggcaaatggtctgtttttgagctatgcagtgagacaaatgtactccctctcctttattctcaagaacagatgttctggcctctggaagactaccaggtggtaatacagggactcaatggttccaacataggctttgacactatatcacatgccccaacccaattatcaaatcaccgtgaattaagaggaggataattagtctagtggtaaagcaatattttgatttcccatttgtctttgtgcctgtggaatttcctatgaagaaagggttgctgagcaaaggaggatgcagtattcctgggtttctgggtcttcccacctaatactgtcaaaaacacacttcaatttctaaaagatacaactaactcagacatacattatcctaaaaactgttctaaaccagaaaacagtacatactgaatacacagaagtaaaatcaggaggctttcaaaaaaaggaaaaatttgtgctcattaagttaaggtaagcctgttacactggaaacattttggcttcaggaccatttacaataacttaattttttatcaggaaaaaagtttaaatatattacattaaaattattttttttaactttaaggtgttcagcatgacaaaaaaattatcaatataaaaaagaaggtaaaattctgttaacatagtcacataccaagcttcgggcagcaaaacagaatattcatgtggagaagtggtctctggaaagttggacagaattgcaaggcgatgaggaagcaggtcggaaccatggtaagtaaacagaatttccagggcttgtacattactttcctgtacaaaaggcaaggggtaagtttctaatgtaaatctaagaaataaaggagtgattttatatgacaacattcaaaaactaacttttttatgcagctctgatatgaaacaccttgaaatgaccctagtttttcctagcctatatcctgtttctcaatctaaggctatgaaaattatttatttttaaaactcagaatgatggatattaaattaaaattttctctacacttattaatattaaaacaaaaaagaaaatgtaatatatgcacacaataacattaactgcacagctcaaagatttagagagtgttaataaccataattattttatttacaaaaagcaaattacctgagcataagttcttgctgagagaacaatattctgatttctgaatttcttaaagaattcagcatcatatctctgttcagatgcatgaggcactcctaggatttcctgaggggaaatttaatgaaaagtgatttaatgaaaaggcttttaaatatgggtgacaagaaaatattaaaaacctttacaactctgcctgcctaaataaataaggcctgaattaattaatttcaaccatcaattgttaactaaagtactacatctgcattattgcctttattttggaaagggctatattaataaatgttatttttttaatccggaagtaaatgaaataggcagtaaaaattaagttaattgcagtaggacaaccaaaatcaaccaccaggtaaaaataagcaacagttattcatgacaatgtattatgagcacctgaacctctatagatgaactttagtttcaccactgctagggtgacctatgtcaaatgcagattgaaccattcattcattcaacaaatattaaccgagtgccactcaccatgtgctaagggagctgtgataggcactgtgatacattgaacaatacacttttcccaccctctaatgtgcttaaaatctagtaggaaagaccaggaacaggtgaggggaaatactcagtaaggtgccacaactagttctgggaggacagagaagtggcccacaagctgaaacataaaagacaatgaaaagttagccatggaatcgcaagtgtaggtctccctactacaacgtatgacttagggctcatgtctgccatgtttaatactgaatcccagattcctagcacactgcctgtcagtattcttctgactgtatttataaatagccaataaatatttgttgactgaattaatttgctgagacaggaaagagaagaatgaggagatgtggaggaggtgagggagggagggagggaggaaggagagctgagcagttcacttgtagatgggttaagttggcaactatggcatgtctaaaaggagctatgcagcgagcaggtgaatacacaggtcaggagttctggactaagatgtgagttagagatatatggcatagggctattaatacagaagtattattccaagggagattaaatagaatgagtttgaaagagccttgaggaacaacattatttaaaggatgaacaaggaaaagggaacctgcatctgaaaagtagatggaggaacagtcagagaagtaaagggaaaaagaatttaatgcatactcatggaaaccaaaagaagaaaagtatttcacagatgttccagccaggcgtggtggctcacgcctgtaatcccaatactttggcaggctgaagtgggaggatcgcttgagcccaagagtttgagaacagcttgggcaagatggcaagatctcacctcaacaacaacaacaaaaaattagctgggcatggtgccatgtatctgtagtcccaactacttgggagactgagatgggaggacagcttgagtccagaaagtcaagagtgcagtgagctatcactgtgccactacactccagcctgggcaacagagcaagaccccgtttcacaaaaaaagctctcagttccttgattcctcatgcatgacaattatttcctttatttcatctcagttacacatcctgtcacaaaaccctggatctctatcatcatcaaaagacactgtatgaaacacttcaatgtctaaccccgactctgtgatcaccgctcctaatcttcctagtcgcatactaagtggtattttaactactcctcaccctcacagaggcatccaatccactcactccattttgttcactttccatttcccctcaaagtccctcattccttctatcagcttaaactgcctggttcatggctttaaaagggtttcttaatccctgcctctttccctttatcgcactcatccagcaaatcataccctaaccagtcaaacccagctatgatccctgaacacaagctatgaagtcactgaagatatgccacaaaaccaagctgacagttcccattttaatttcaaaacctcaacactgcttgaatcctcattcaaatgaaccaaatgcaaaaaaaaaaaaaaaaagcaccaggaaaatctgaagatgaagtatcagatgttattagggaattactattaattttgttagaaataatcatatcattgtggttatagtttcttaagtccttcttagacacacatacctaaatatttatgggtgaaataagatatacgggctttgctttaaaatatttagtgaaagagagaaggcaagagtagaaacatggagaataaaagacacacaactggcgcatgctgaaaatggttggtgctgagcaatgggcacatcgggctcatcacaccactcttctctctacttctttgactgactgaagttctttataataaaaacctaaaaaattgacaaactcaagacaacacaattcaaatagataattagtgctgttcatcaacgctactacatttccctaagaagttttatttcctagtctctgttaggaacttttccacaactctcattctttccagacttccaacacactatttctcagcccctattctcagctgaaaaccttgccttttttggacactattagatgagaaatccctcatttttccaacccaccaaaactacacacctacctgcatctgtaataagattttccttcctcccagttacagcagaaagaaacatatctctgctcctaaaaagcctcaaaatcccacccatgccctggatcccatttctactccacttctataatcatgcaagtatcccctctttcttctgttccataaagtcctcctcaccctctactacttcattcccattaatataaaaacaatacttcttccttctattctaaacacctgctctagacaccaccatcttctctgcccctcttcacagtaaaacttcttgaaagggctacccccagccacagtctcctctcctctccttcactttttgttatttcctaaacttgcccaacctctgacaaaaattcaattcaactacttacatggcaggagacctttccaaacatcaccacaaactattctaaccatacttcccacctttgttctgtgccacccctcacgctccccatcctgtaccctgactagcttacttactcaacagcatgacacttgctttcatgccactgggcctttacatggcacactgattatcagcatgggctactcgtcagagagacctgattatgagcccttgcttcctatttatttggacaaattacttaccttctctaagcctcagttttcatacccataaaatggagagaagatgatagtacccatctcataagacaatggctgacaaatagttaagtcctcaaaaaaatgtgttggtatttcttaagggtattctcctacctactggttcttgcaacaaatatttactgacctcttcaatgagccaggaaccgttcagagctcagagacacagcagcaaacaagacaaatctctaactgtatggagactccattctaatgtcccccttatggtactccctagtccctgaaatctgcctgccttttgtgaaaggccagctattacttcctatgtggagtcttctcagacatccccaggaagaatttgacattcttcttcattatgtttcctcatcaattctccatacctttcttatcagcatttaatgcctatacaatgtgaactccatgaagcccattccttgttcctttctctacctctagcaatggcacaatatcttgcgtttaggaggcattcatgtcaaatctaaatgaattcgtttttatctcatttatcacagtattaataaaagaagccatgtcctgtgattaaaatgcaatgcctatctctactactatctaatggttagctattatatctgaatattttcattactaagttttaacagtgaaattcatcaaattcacctacttttcaagaactttgctgaattctctaaaaaaaagtaagctcaacaaatactttaaatgttactgttacagtataataataaatatacttactactatcatatagggaatagcaatttaaaaattaaaaaataatgaaaaaaattaactggatagtcaaactgaacattttaggcactttttaaaaaagatatcattagagaaactaaggctaagtataaaaataataaattgtatctgtacagacttctgcaatatattacctcaaaacatcacagaactcaggcatatcaacatgacgtgttttaaagtaatgtgatcatccaatagccaaactaattgtatctatcaataaaactactaagagtgttttgtaacttgtttgtaatgataaatggtaatgatatagtcattaccaatgtttttttaataaccacagccctctttcagtatttgtttaaaaacatttcaattatattagcagggtgggggaatcgaaggcttttggatttgcctgcatggtcagacgttcttgggaccagcattacattatcagatgtgacatacagtgcctactgtgtgccagtgccaagagctgcgaggcacacacacaaaagggaggcagaacacagactaagaaagtaacctccaagtgaagtcaaacttcaataatgaaaaacttaccttaaaatctggagaacttcagctataagagtcatgtgaaaaagcaacctaacctacgtattactgaaatgtggctgacttccacttacgcttttaacaatatctaagttggtcttaaactacagagtgctactgaaatgcccaacatggggacatctatgtttgtgtccctgaagacccaaatgtgaagtatactgtttttaagctcaaataatctaacttcagccctaattaggatcaaaggtgaatcaactaaattcaacccactaacaaataattaaaatacgccaggcatagtggctcacacctgtaatcctagcacttcaggaggctgaggcgggtggattgcttgagtctagaagttcaaaaccagactgggcaacatggcaaaaccctgtctctaaaaaaatgcaaaaatttgccatgtgtggtggcatgtgcctgtagttccagctactcaggaggctaagggatgagaatcgcctgaacccaggaggcagaggttgcagtgagctgagatcatgccactgcactccagcctggagaacagagtgagatcctatctcaaaaaaaaaaaaaaatcactaaaataaaacgagtcagaaatattcacattaaaacctagtatatactgaaatctggtatggaaaaaagttatgtgccattatcttaaaatcaaaatataaaagtaaatgaaaaagattataaatctagaaaacacaaatgcactgaaatggctaaggcacttctattccctagtctaacaaaacaacttctggctttcacaatctctaatttttaccaaaactagtatataagagaacttgcttctataagaaattaatttttcccagaaaaatagttctaaagaccaagaatatccgatattagggcagccatagcatttataatgacagatcaaatgaacataattggtttgacaaaaattattcattacctcatatgttgcaagtcgatctaagtaggttaataacttccgtctacaacggcaaagttccttttgttccagtgtcaacctgttttgaataactatgttaggccacttatatttacacagaattatttctctaggagttataatgaaaatgattaatattccgttgagcccaaaactcatgaaacagttcagaaaagcacaagggtaagataatagtaagtacatttgatctaagttgctaaaataatttggactaattattactagtaaggaacacactgaaatgattagttattttaaagaaactatcaaatgaacagtaacaactcatttacttggaaaagttcactaatttcagtagttcttgtctcttcttgagctccttttcctttttattcttggcaggctcttcatcaggtggtgaaagctcttcataggagatactgtcaatgtctatttcaccaggtaatgtaaatctgcaagtataaaagaacaaatatattttcatcatttttaaaaacttcgtgttgtgaaaagctttctcctattttgactgatttcattattgatttccacaaaaacagaagaaagtatttgaaaaaaacttttgccattgtaaacaaagtgatcattcattatatccacagatgggcaaaaagtcatcagtaattattacaaatagaaatctaaaaatcaagaaaatgaaaactatttaggaagagatgtggggttacattcactcaatgtaaagcagcctatgctgaaaatgtccacagagtttgctatttgaatcacttctacttaaggtcttcaaatggtagtgtcagtctcattttaattatttacttctcagatatactctcatatttatattttttaaaaagttccaaatgcctgatgagcaatgacttcaggtaagacagtattgatcaaaagcaactgcttcagtacagaataacttaaataaagaaaagtttacccagtccaatgtctcagtacaaaagttttcacaaagtcacctttactttgaatccaattctttctgtaaccaacctgccatcatctgctcctttccctattgctaaaagagcctccaggtctgtgccttttaatccatactgaagcagttcttttgcagcatccacattttcaggaactctttccaaacactcatggagaacccaggatcgcttctttattttactctgcatataaaggaagaaacagaggaattacagaatccatgacatcttacaacacattacaactgccttcagaattgtaaagctatacctgatgtattacagctatttaggaccttggccatagggagctgctagaggaactcaagagaaaagcagccagttgcctaatggtgactacaactggatgcggggagtgtgagttgacctgcttgctttcttcctctaatgagctacgcagaaacagaaagctcaggactcatttttggaaatataaaatgtttcctcctaacttttataaatgcctttggtttgcaccgtggctgtataatagagcagacaataaggcagaaaggcaagatatattctgtcataattaataagcatgtttaacttttaaacaaaacaaatgagcccatcaaatttctgtatttatttgaccatgagatatatcccagggtgtgaataacttgatcataaaaagtcatgatatgctgttttttggaaagatcaaagtcctattcctccctcccaactatttcctccaactccattcaaaatctctgactttattagtcttgctagtggtctatcaattttgttgatcttttcaaaaaaccagctcctggattcattgattttttgaaggtttttttgtgcctctatctccttcagttctgctctgatcttagttatttcttgccttctgctagcttttgaatgtgtttgctcttatttctctagttctgtaaattgtgatgttagggtgtcaattttagatctctcctgctttctcttgtgggcacttagtgctataaatttccctctacacactgctttaaatgtgtcccagagattctggtatgttgtgtctttgttattgtggaagacagtgtggcgattcctcaaggatctagaactagaaataccatttgacccagcaatcccactactgggcatatacccaaaggattacaaatcttcctactataaagacatatgcacacgtatgtttatagcgacactactcacaatagcaaagacttggaaccaacccaaatgtccatcaatgatagactggattaagaaaatgtggcatatatacaccatggaatactatgcagccataaaaaaggatgagttcacatcctgtatagggacatagatgaagctggaaaccatcattctgagcaaactatcacaaggacagaaaaccaaacaccgcatgttctcactcataggtgggaattgaacaatgagaacacatggacacagggtggggaacatcacacaccggggcctgctggggggtggggggaggggggagggatagcattaggagatatgcctaatgtaaatgacgagttaatgggtgcagcacaccaccatggcacatgtatacatatgtaacaaacctgcacgttgtgcacatgtaccctagaacttaaagtaaaataataattaaaaaataaaaaataaaaaaaaaatccctgacttgccctcttcctagaaagagctattatggttataaattttaattaagatttgactcattccctaggatcctttatatattgcctcacatcagttctttcttcaaatgtctcttaattcactttcccttttccacagctgcggcctccataccagtctaaatcatcaacacaaaacatctagcacactgtaggagtcccctgccccaagcaaggtttcctaccttccttccactccaattctctctacaccatcttcctctgcttccacagtcagaaatccacaacagtagataaatgcctaagtcatcagaagctttccacatcctcctgaactcaaatcaatatatcttttcaatcatgtttcccagtgttcactattgtcaaatatcagtgccagcaaactggttgatgtacagagctcatttatccataaaatgtttactgggcacctactgcacaccagccactgaactagacatggaaatatagcagtgaataaaacagatttagtcactggcctcataaatcatgctcagtgtcttttaatttgttcataccatctgtcctgttaagaatgtcttcctcccttctcattcaagaaggcctaatttaaatccttccaaatccctgctccaaacatcttcactatataaaatcttccatctctaccagatctataataatcactatcttcactgggtttctagagttgtatctgaaatctacttatacggccagttatttttaatatggtgaacccccgtctctactaaaaatacaaaaattagccaggtgtggtgttgtgtgcctgtagtcccaagctacttgggaggctgaggcgggagaatcacttgaaccagggaggcagaagctgcagtgagccgagatcgcaccattgcaatccagcctgggcaaaaaaaagcaaaactccatctcaaaacaaaacaaaaaaaatcataagctccctatgagcaaaagccacatttatgcctgtcctgtaccccttcacagtccctagcatagtgctcttgctcttaactgtctatttaactaaacgaaatattcccctccccaaaaaagtacttgctttgtctctcttaacatccctcaactccctcagagacaaaaactgtcctttactgtatcccagaaaaagatatacatgaactcatgagctcattgtcttagatcacaaaacaagaaagaaaaataatacagaattagtgttttgattttctaaagaaaatacaagcaactttatcttcttccgtttcattacctctcatgctctttcacctctgatatcttgcttgtattaatgttaggtttatcatcctgtttggctgatgcatcatcttcttccatacaactttttcatgttatatttttacttttaattactaacgtataaaacttttagggaaataatcatcatgaaattttcccagtgtttcctataatcttccacaatgcaaaggtattttcctttctatatgttaagatcagaagtctcaacctttttaaaagtatgccatgagtctaactataattctttcttacaaagatgccaaaggttaaaacatataggcttgctatgaaatcaatatgtcccccaaaatccatatgttgaaaaactaatccccagagtgatgatgtttggaaatgagacctttagaaagcaattaggtcatgagagtggaggccccatgataggattggtgtcctcataagaggaggcagtagagagccttctttctctctctctgctgtctgccatataaggacacagcaagaaagaaatccatctgcaaaccaggagagtgccctcaccaggaacgaaattggctaacaccttgattttgcacttcccagcctctagaactaagagaaataaatttctgctgttgaaaccacatagtctgatatttttgttgcagcggctaaaactaattgagacaagactatattaaccttaactatgggaggcaggtaacaggaagtatccagttttgagatttaagttttaaaaaggcatatttcgcagttttcatatatgttacctatttattgcctctcagctccaaatttcccctcaaagccagctctgtggtagcatatctcatttgtggttgacacgattttaagctctgggtgctggagggccactgcaaaggaagaggctctgctttctagtcctgatgtgctttggttcttttcttcttgctcctatggcttggccaccaacaaggcacgtgggcaacatcaagtggcacttacttccccgcttcctccctctgttgacaacctcccactgagtttcagtgacactctcatgggcagattgttttctagtgaatcacccaggcacctgagagggaagcttcccagactggaagctacagtaaggctgcctataggagtagacagttttttcttgccagtcttggccatgattccttaattatctaccagccttgagccacatgcatgctggtaggggtttcctgcttcctagtccctggggtcttctaaaccccaacctcagctcactggccccccccagaagcaggcgtccagctttcctatccatcccatatctccctgactgccaaccttggcaaccgtggaccagccctggctcaaggcaacccagagaacttctcttccatcctacatgctgcaaccactcctggtccaatgggtctgaatcccagcctaggggaggggcctcccttccaagttcattcccttcatggatatgtcccttcagccctagggtagtccttagcgttctcttcacatcctttatagttcatctctggttactagaaaataattctccatattgtaaatttccctgtttaaattactgtgtgatttctggcatctgactagctcttgactcatgcaggtaaagagaagtgattgtggtacaggaaagaaaacgttaggccgagaccaagtagttagctggtttatctgtgaatatttgttcacatgtattcagcatcaaagtccagttgcaggggcaataaaatctaacaaaaagaccatttttccagctgagaaaattgtacttcattggctgtattatagaaaagtcagcaatgtaaagtactctaaaatgaagccctataaacaaaagatattacatgaatatacattttaccacattaccaaaatatttaaacataccaaataattctgaattgaagcaacgttgaccgctgacttcctccactgcctctgatatacaaggtcagtatccaggccgtaggtatgagccaaggacaaggcttcctcatactcttcactttcaatcttcagataaaaacacgaggacaggaatgttacatgactgaattatccacagggtcctgatgatgatacaatgaatgatgataatcccttggacttatccagcatgtcactaattcctgtgcactgtggcaccagaagctcacagatattttgaggagcagaaagatctcgtgtttctttcagcacttcaacagaaagatgagagataaaaggtgcaaagctctcgttttagagtaaaacagcggcaaaaccaagacaaccatggaacaacccggcttctagtccagagctcctaccacgacattgcaagaacagcacaaatcacgtgaacacacagtgctggtcacctcggcttcccaagcaagccctggactagaaagcaagtctgaacttcttccttcaccctctgtagatggctgatttaaacacagataaagggagagctgaaggccacatgaagggtagcaaagaaatgagctaagccaccaagtggataatcagtctaagtgaattcaatttttatccatggttttgattttgattatttaggtacaaagattagcattattttaaaaagctttatagaactgatatttttaacatgtcaatgatccaacatccctcttgaaattttctcctttattaaaaaattaactttttctcaataaaagaaaagcttgatgacttcaaacttgggtagtaatatgctactctctcaccttcctctgataaagttcctctggtgtcgtggagcgcaaactcacaaggcggtagtttttagtaatggttcgtgggcgtttccgtggtggtgcaaatcgctccatttcagtcaccaagtaaaggccctgttttatataaccaaagtagcgagccttggcagatatttcataatcagaatcagaatcctcttctccttcatcttcttctccagctctagtctccaaacgagatcgtttgggggcaagtttaatctcacactaaattgaaaaaggagatttgaagttaatagtaaggaaataagaataactttttagaattaatgaaagaaaatatatttctaaatctactctggtttgattcattaaatcagctatgtgatcaagattaacaatggaactcaaaggaaccttacagcaagcattatatacatcagaaatatgcacatacattatcagctcaaatctaaactaaagcctgtttttttcttcttcttcttcttcttcttcttctttgagatggagcctcctctgtcacccaggctggaatgcagtggcgtgatctcagcttactgcaacctcggcctcccaggttcagacgattctcctgcctcagcctcccgagtagctgggattacaggcacccgccaccacgcccagccaatttttgtatttttactagagatagggtttcaccatgttggccaggctggtcacaaattcctggccttaattgatccacccgccttggcctcccaaagtgctgggattagaggtgtgagccactgagcccagcctaaagcctgttttaataacaggtcattaatacggtcttgtacatataattatcaggtcttgtacctgataatttgatgatttgtttttgtctctttagagaatgaacataaaggtacttacatttgttttaccaagaatagctctccctcacccccttataaagatgtctaacagctttgctaagttctgagtctgaaagtctggctgttaaagataactttcattccagacttaacagagctggcttagattttaagccatagttttctttaaggaacatctttagattccataacaaacttcagagtaaaaaatatgtcaatctgcattgctgaagtgaaagctattaaaggttgttacccttgaaaggcttaaaataaaatttttaaatgaccaaaagataactttacagaactagcctctattttcaagtcttttgtcataataaacaagtttccttactaaaagaatcaaaaactttgtaagttgccatgctttttggaaatgggttaaagagtatttttcttaggtactgataccattctacatttttaaatgactaatcgagggaggaaaaaaatatatcatttcagtgaaaaagaaatactttatacagagcaaaatgacaacaaattttcttcattataattgcaaatttttttattcactaaaaaatggattttttatactacaaccattacctgattccaatcacagatttttatttttaaagaaaagataataagacaactcaaataaaaaccagatatttaaatttttggttaaatacataactattctcaaacaaacaggaaaaagccttacctccaaacttaaaaatcccccatcatgggtagcagtgacttgaggtgatggttcaaaccattcacaggattttcccagtaaattcttcaaagttttcacagatgaaacagttaaagcaccagagcatcgagctaaagtcactgcactgtctgcccaccaattgacatctatcagtgggtaaaaggactctttatctaagaagcgaaaaacaaatcaatacaaatgcatctgctaatgtggtttaaattcaaaatatttagtataataatcaattttaaaacaaaatttatctacattatttgggccctaatggtatgttaaataataagaaaaaataaaatgtaagtcattctcaaaattttactctatgaggtataaaatgttaattcccttgacaaattgagcgccaacaatttgtcagtctaggtctaaaattctaaggatacaaaggcaaataaactgaggtctttcatttcaagaatacactcaggagagagatgtgtcactactttcaacctaagttgaaaggcaggtgtctaccaggtgtgcatacatgaaggtcatataatgttttgaaaaatgtacacataccactttcagacaaacactgagagaaatacaccctttagaaaaatataagacagatatgtaatagtttccagtgctgatttcctcttaaacttgtaactaatcagagagggaaaaaaaaaatttatggctagcaaagaatctttagaaatgaaaatgaattatgggccgggcacagtggttcacgcctgtaatcccagcactttgggaggctgaggtgggcagaccacaaggtcaggagttcgagaccagcctggccaatatggtgaaaccccatctctattaaaaatacaaaaattagccaggcatggtggtgcgtgcctgtagttccaactactggggagactggagaatcacttgaacccgggagatggaggtcgcggtgagcctagatggtgccactacactccagcctgggcgacagagcgagactctgtccaaaaaacaaaaagaaaaaaaggaaatgaattatggttcaccaaactaaggcattcaaaaggcaatgccatatttattataattttactgtacattttttgaatatcacctgttatacaaaacatatgatgtggtttaaaggtaaaagtaaaccataaatttaacaacatatttaaacattagactaagaagagagagattttaaatatggagttcagaaccatgagactaactcattgttttaatgaaaataaaaagcattaacaacactttttccccatgtaagcctaaggcaatccatgtaaataagaaatttcaagaaaatgtgaaaagcagagttcctggggcttatcactaagtgtaaagtagaaagaaagaggagcaaatcactaaaatcaaattctaatttctgctttgacaaagtagtacttttcctcaaaaatacgtctggatgaatattttggatgattatttaaagcgaataattcaaagcatggaacctgatgcataatattaatcaatatttttaatcttctttaaatgtgaactaaaagcatttttttttttgagacgaactctcactctgtcgcccaggctggagtgcagtcccgcgatctcggctcactgcaacctctgcctcccaggctaaagtgattctcctgcctcagcctcccgagtatctgggattacaggtgtgcaccaccacgcctggctaattttttatttccagtagagacagggtttcaccatgttggccaggctggtcttgaactcccgacctcgggtgatccacctgccttggcctcccaaaatgcaggcaagagccaccgcgcccggcataaaagcatattgtaataacagagcctgaaccttataactatcactgattttactgaagacacttaaaaattcatcacggatttaacttagaaagtttcacctaaagaaaaataacacagtcaaaaactaaaagtgaaaaaatctcaaaagtaacccctacaggattttataatatctctgtttcaatctagcaatcaaatgacaattattacttttatttaaatgtaaatcttgatttttttctacttataaaagcaatatatgctcattgtaaaaaagaaattttttctttaaaacgtggaaatgtatgcaaagacaaagaaagccccaccagcctaaccctaattacccccaacccgcgagataactttactcagtgtttcttctttgatgaagcttgatctcacccaagggcatctgaaaaggagcacgcttctaagcattgaactcagtgtaccatctcaatgctggctcctggcaggagagccagcttttaggaaagcctgaccatcagaaaactggatctgttgccttgacccaactctatgaaatcttgatgtttcttccaaagtgcagcaaaagtatctagagactttttatatcatccaaagagaatcttgtataataataggagtatattaaggtttcaattatcacatttcgtagaactcacctttgattttttttctcttctcagtagagagcctccaatcaggattaaggtcatcatagcctggctaaatatgaaaataatgacttcctgagtgaactatgtaagaaaattataagaaaatcatcaagaactgtggactttttcaaataaagagatgacgctttcccttgatctctcaattacaactaattgaaatctatttattgccatgatagtctggaaaagcaattgttcttacacttaaaatgtgcacatgtacatattatgacttgatttatgaagaatacagcatgcatatgaacaacaggatagcaagtatacaatcaatacatatgaaagcaaaatacactaagaattcatcctatacacatgcacacatgtgatgaataaacactggcctggatacagatcttatcccagccacttataaactgagcaacccctccaggctttaattttcaaagctttgagacttgactaggcaacctccatgttacctcctagtcctttttatgactaagaatttaccaggtaaaaaaaatataaccatgcagtccttcctaaaaatgaatccattcatactgtaatcttagggcaatatggtgtcatgctcttctttgagaatataacagcacattgatatctctcaaatatcaatttgagaataagccattacctgacgacctcttggcttagtgttcccttcttagtctctggaattacaatagtatgggcaaagagtaaaaaaatagttggggtgctcatttgaaatctgaaatctaaaaaaagcgttgctatacttaagtcaaaaaactgtgctttttcatctaatgcaacaaaatacacacatgtttactatcaatttttcaatggctcacacttcagagctatttctttccacagcctggaagaacttcctattctccactattatggtaaatcactcagagcagaccctgagaacagaagacacggtcttaaacttaatcagaaaaaaaattaccataaaagcctacttatataccaaggggaagaaatggagtgtcctggtttacttaatcataagaaacgatgactaagtttcgaaaaatcatttaaaaaaataagatacatattattgaaaacagtcaactaaactgaaactttatttggtcattttaaagcacctgacaatttttcaatgcctccaaatcatgagtactacatactccaaccacatgcatgccaccatgtatttacgtggcacatgtaccttcctacttacattttggagtacacaagggaaatacagagtaaaaaaccttaagcccctcaaagaacaacaattatgattcagccttggatacatttaaggacatacagatcaaaatgaaatttgacaagaaatcttaaggaaattttaaaaataaataactctcacttgagaattcaaagtgtgcatgtctttgtcaaaactaatgataagaaggagcaccacgaataagcactagaaccggggtctgcagtcaccttgggactagactcttccctgcacactgcttaaataatgggcagctcctgtcaatttgacattaaacacaaggtgaagatgtgttcttctgtttccagaactctgtcatactcatccctgtattcccagatccatcacagtgcccacctgtcatagcagctaaatgtcgaataagtaaatcaatcaaccaaattttaagtcactgaattctaattacaattcaattctaacatctaagctataggaaaattatctgatatagtactaggcttcctacacactcccaaaagtgtgatttcttctatttagtgaaaacatattggggccaggcatggtggctcacgcctgtaatcccagaactttggaaggccaaggcaggagagctgcttgaggctagcagtttgagactagctgggtgatatagcaagacctcatctccccaaaaaataaaaataattagccaggcacagtggcacacttctgtagcctcagctactcaagaggctgaggtaggaggatcaactgagctcaggagttcaaggttgcagtaagctatgatcacaccaccacactccagcctgggcaacaaagcaacactctatctctaaaaaaatgaaaataaataaatgctgagacaaaaggaaaaaaaaaaaaccgatattgcagtcccaaaactcaagcacacagagagctaataaattaatataaattaatataatccaagatcacatttgttacctacacaaagagaggtatagataaaaggtataggggccttcgaaggatggacagaggattttgggcatgggtttaagaaagatgaaggaaattcaaggggtacaaagaagttttatggtggtattcttttaagactggataagacttggatgtggaaaatgaataaaggaaaacattccagtctgaaagcataatgtgaacaaaaatacagagtcaggaaaatacaaagtttattcagggaaaaaaaggagaacagtttaataagtccaggtcagcaggttttaattatcttgatttttgtttgtttggggtttttaggggggatgttaatgatatccttttttattgaggtgatcttagcataatgtaaaattaaccatttttaaatgaacaattcaggggcacttagtgcatttaccatgttgtgtgaccatcacatctatccacttccaaaacacttctatcactccaaagcaaaaccactagcccattatgcagttactcccttttcctcttcccctggaccccaggaaccaccaatctgcttcctatctctatggatttacctattctggatatttcatataaatgcaaccataaaatatgtgaccttttgtgtctagcatctttcacttagtataatattctcaaagtccttccaccattgtagcgcatatcagcacttcgttcctttttgtggatgagtcatattctattgtatggatataccacagtttgtttctccatatatccgttaatggacatctgcattgtttccaccttttagctgttgtaaacactgctgctatgaatatgtaggtgcatgtatttgagtacctgaagtgtgagccattgaaaatttgataataagcatgtatgtgcactgaagctagcctcaacttaccatccttccaccccagggcctctatgcgtgaagagactcaggatcagaccatgcatcaccacatctgatacacactgtaaactggtgctccgtggacaggatcaccaaactccccatgacccacaagaaagctcctggcaccatgtgaatacatttcaagaagcaacctccatgccacttctctgtatttgctggagctcagaacacaataccccaaagtataacagcattgcatggcaccatgtgaatacatttcaagaagcaacctccatgccacttctctgtatttgctggagctcagaacacaataccccaaagtataacagcattgcatgttgagtactttcaactgaagcaaccgaaagggcctcagaaatactgtcccactgaccttctcctgccttcctgtctcaagcccctccttgtctcccaaagcaagtcacagaaaccagaattcttcttctccaaggttcatcacagaaactagaactcctcccccaaaggaagctataaaacctaaaaacatcgctctctcccttctcccttgaagacccttattccagagggctcctgcctcacagtaggagaggaatgttatacagagaagccaaaaagaatctggacagacaggccttgctgggtttccccttcagtctatcaccattaggccatacctttttgtcccatcatatttttacaaggctgtccattcttcatcaaaactaagcataaaaacagtcttccctgggtctttatttctttaatttaatttagacaaggtttctctctgtcacccaggttgcagtgcagtggcgtggtcacggctcactacaacctcgacctcctgggctcaagtgatcttcccgactcagcctcccgagtagctgggaatatgggcacacgccacttttttattttttgtagagatgaagtctcaccatgttgcccagcctggtcccgaactcctgggctcaagcaattccacccacctagggctcccaaagtgctgggattactggaatgagccaccgcacccaaccagagccttcatttctgaaggtgcctgtgtcatgtaaaatgttgattaagtaaatttgtcatgcttctctcgttaacctgtcttttgttataggagtgatggctgtgtcctcttatgatgggttagaagaggtatcacacctttccaccccaacagtttctggcacccaaagtggggcagctgagacacctgacttgctctggaacctgcagacaaaatcctggaacaactgacaaaaggcaagcaaagaaaggtaagaagttctttgattttttttttttttttaaacaaagtcagctttcctggatctctaactatagtgcctggtcaagaagagaaggtaaaaatttatctttacatcttccattccaaattcaagttagcaaggaaaatcatttgtttttaaataaatttgttatgcttttctcttgttaacctgtcttttgttataggactgtcagctgtgatccttatgatgagttcagtaaggtatcatgtctccccacccgacatattcatgctaccacattactgaaaacagcctaatatgccatcattttatactgcagccataacccaaaggaggatgttctaagaatagttataggttttgtacagaaaacctattacggctaaagtaatgttttctttagacttgagaattttatttgctaattgtttttaccactaaaatctaaatataatgaaatccctgcctccaacaacataaaagcaacatttcaaaggcttattcattccacaaatatttattattatttattatgttaagcctaagagagtctgtgatgaaatacatattcagtgcctattctcaaagaactcacagtctggtgaaattgtgaaaacagctgtggattatatcaagattcatcgcatcaactgccatcttcccacttactcttcattcatctacttaagattagtccaacacctactatgtgtgaaaaagaaaataaaatgacaatgaagacataagtttgtattccatttctaggcctgaagaagtacaaatagacaaataataaaacttgagagaaaaattaaggccgaaaatgagatgtaaagatataaacataacatatgggaaatgtttgaaatgaaaatcacttaagcaattttactatattccagacatgaacaaaatttaatactcacagatttctagccagatggattttcatattgacaatgaaagccaaagtatttaatcaactcaaaactggatattagtaaatcagaataggcacttccacaactatctttaatcattaggttttacagagaaaatactcaatcacacaaagcatattataaaaactaataaagcggcaaattgcatgaagaaagccccaaatgagttgaattcacaattttggtaaagaggtttaaggctgtgcagggtagcagcaacattaatttcttctcagacaacatttaaactaaaattataagctgactagtttaaatatcaccatatcatcgatttgaaactaatcggtttgtctacttactagagcagccataaagagaggtgaaactctgccctacctggctgatccaagctcacttgattattactagagacatgaaagaagagtagctgtctcagtatttttcaaagcttgggatttctctttaaaggattccagtgatgagtacacacagccactttacatatttggtaaacaactgtattacacctctcagttattactacttgcacatttctagggtctctacataatgaactgcgtgactccaggggatgttattcatataaacttcaagctgatatatctcccttgcttaccattaatatcatatgctagtctctgatttacccagataaaagtcaatacttctaaatgtaagtactgtaagtagatattctgaaaaaaggcttaacctatgaagtcaggagacttcaatcaaaatggaatcttgactctaacatttagtgatctcaagttaacctcttttagcaccattcccacccatttatgcctagtgttccattattggaatgctaagcttgtgggagttatttaaatcctactgctcaaggtcatggccaaggtctgatttttcacaaaaaaaatttgccacctccagcatacatgggttaatagggttgttgtgagacaaatgaaaactatgctctgtaaatagtcaagccttactacacaaatactatttatttccaataatccttctccccaacactatcagctgacctacatgcctttcctgagcttatcttctcaaaatattaacatgtcattttaatcatttgttcataatttcccttggaagcctgtgaatatcttaagagcagggactatgacactgtattccctactggagctcttagtagagtcaataaatacttgaactttattatttcaccattatgttattacgtaaataggaacaacctactctactgtacagtcctgttacacataggctttattatacttactataatacactagattttagtaattcataagctaaaattcaaatctaaaacatccaagtgattgattcccaggatacaggtgaaagactcaaagaaactatggttgttcaaactcttcttgcttgacaaagttaccaccttcccccaaccccactacatcatgagtactctagatatctattagaaagctaagggtttaccaatgagaggcttccccaattatttattctggtatctggtacacactaactagctcaagagttaagcatatctgagagagctgaaggaatctgtatcacatccaccgagaaaaaggatttgtctctgtgtttttaaagatcatcaaataaaaagaatcaatgtaaaaaattaataattataaagagtgattatagtcctcctaaccttttacatacaaatctgatctttcaaataataggatgccactaaataactaataacacaagtattgtgggaaaaaatgtgtgtagtacactctggcattcgctagcctaataaataagtattcttccacttatctttttgttgttttatgtatttctttcccacacagtcatggaaagaacatatgcatcagtgtcagagaggtataaaatcaaatctcagctctattgcttacttgttgcacaaccataggacaaagtgctcaataaataataaatgtagttagggtaaattttgtaaaagctacaagacgatcttattcctgtaccttcttcctattaagctatacaagtatgcaattagcatacagaaagaaaccagagtgtctgtgaagaggttgaagcctcacaggcgtgtttacaatggaatgaagttttggaaagtacggcagaaatggttacatgaaagtagagagcaggacaagaggatctaggaagtagagcaaagcagcatgatgatcagactgcaggagatgacaggttcacagaggagttttcattttcaccacagccttagggttttaaaggaaaaaaaaaagaaataaaattaaatgccttccatgttccctacttgggaccaaaacttcctttgaggctaaaactggctagggtctcagagggcagagtctgccctatccagctagtccagctgaacagcagcaggaaagggaggggtggccgaccccggcctgtgctgtgatgaactctgaaccggggaagggacagagccacaatgggaatggtagtctgcagtatcagggtcagtaactatagctaagccactgctctctcagcaaaggacaccacgactcatacaacatccttggtaatggcaactacgtccatggttttcagttttgtgagccccaaaatctatttttccagtttactcaggcattcaagggaaataattcataccacccacatcagaagaaaatgacatataatcctaaaaatgtgtacatttataataagagaaacaactagcttgagaatcaagttgcatagctcccctgattgacagatcaatttaaaagtcaaaagctctatctgaggactgtttcaggaacatggaatcaaagccacatccacaaaatggatgctcaacagccaagctacacaattcctcatgaattattcttccagactctcagggtatttgttcaaaacacttttgctaaggcatgacaacttctagcctgaatgcctctcttcctactacatacacattttttcaatttctgaggtccccccctttccctttcctgtcccattacttttctgactgcatatttcaaactactgaaatatttacatttattcattctctggttttaaggtttttaaacaacttttactttttttaatagaaccactctaaaaatctaatcaatgaattatattaatgagtaaagagtaatgcattattatagcattgactggcaactaatgaccaaaaaaaaaatgctaaccagtcaaaggttgagcatattccaataagggccacaaaaaaagattcaatttatctttgcaggacaaaaaaaaaaaagtctctggattttcagtaaacaaaagcgcatactaatcaattttgctcagaatagcctttacactggatgtataacgtactaggatacacagaatatgaaatattaagagtgcttcagaaattgataaatatttctactaggtgaataaaagtaattttaaaaaacagaaagccaaggggggaaaatgcctttattattcaaagttttcaccatttagaaaaatgttgcccaaatctaaaatttcccaaatacagagagaacatcaggctcctctcaaacgaaaacagctgaatactttatcatcatgcattgataaccatgaaaaacacgaagtatcttttggatcaatgaaatgaataatgctttattttgaacatagatatgaaacatggacttcatgtattgtgcatcaagaagtagagtcatccctcggtatatgcagggttccaggtataccaaaatctacatgcactcaagccccctagaagaccctgctggacccacctatacaaaaagtcacctaccctatccacagatgtgacattctgcaaagactgtattttccatcagtgtttggttgaagaaaatctatgtacagagtggacccatgcagttcaaacccatgttgctgtagggtcaactgtgtcagtgatatgaaatatatgccctataaatcagcctacactcccatcctcagtcagctcttgaacagccaagtggaagttctgctgcctgacatccccagctaaatacattacacagttttgagagttcatcacttcacctctagaaagaagaaatgagtgaagttagctataatttcagagcagagagaaagactgtcccttttatttagccaccaaggttgtaagctgaggagcacctctgccactgaggacaaatctagatccaataagggagaaagagtggtaaacatgtggagatcatattaacttcaagttgaatggaaaccagggagaaaatatcttcctaaagctgtgtataagacaaaaaaataagaatatctaaaacaaataaatttaaaccagtgaatcgaggaagaaaatacagagtcactttctcttttcctctgtcattctgagaaaaattccttatcaataatcctctcaattatgacattgatccattcaggtcattcaggaaataggctctaatatgaaaatctcaaaccacccacccaaagctggatatgcctagagaaaaacagagtgagggggtgagagaaggaaaattaatccctaaaatggtaaaatgtaagtgaatcagagtaaaagatttataatacaagctatttccagttgaggaatttctttaaacctttactctatcacaatacatggctttatatgagcagacctttccttccccttgtgaatttaaattataatatatgtcactaactagtgctactctgtcactacataacaaaatcatctaatccttaaaacctatcattccaggacactaacaaagagttccatccttctctatatcttagctatccacatttcagtgaagagaaggtaactcccttcaaggaggccccaaataactagtgttgcaagatttgaaaagaattgtaacccttttaggatttgaccctccaaatccttgataatattaacttttgctgaaatgttaacatctccattctgtacttttgaatgacaaagagggaaaaaatgaagagtttaacaaactcttttacagattacactctgtatacagagtgtaccacactacaattcaaaattagtccacagtattaatctatttttaatttatcccactgtactgatatcataatttaaaggatagaagagctttggaacgatgagaataaacagctgtgtactatagtaaaatatcaataaaataaaattagtattgtcaatactcacccttaagagagtatcattctaataaccaagagacgcacctgctcattttgaccccattccccttgttgcttcagagatggaatcgcccagatgctcagtttccctgagaagtgaatggctgccaggagcatcccatctggagaaaggctcatcttaaaaattccatcctaaataagaatcataaggtcagggcaaaggacttatggtcaaatgtaaataactcagaagtaaatgacactctttagaggtgccaagttataaatgatctttagtaattaagagttctgccagcttcctatcattataaatgtacttcagcatagagaaaaagtcctcctgaccttaaggagtttgttacctacttcagagttataatttacatataacccaaaaccaaaaatttggttatatttacatataaccgaaaaatatgtatgcattataaatatatttcttcacatatcaattaccatgaattctcaataccttttaaggttggtcttgactagattgtcaattccttaaaatttgggcccagatctttacaagattttatatctacacagtgtctgaagtatgctatatatcataaataggccaaaaattcatgccacggaaaagaaggaaaggagtagaaaagagctagagaaagagtgcaagaatgatggaaacagaagaagataaagaggaagaaaatggtccttaatttaagaaatgctatgaatgtttacaattttctagatttgctgccaaattatccagtttaaggaatgtgttactacagaacaaagaaattttgtaatgactgatttcatatagtcaaccgaaaggtacacagaggaagagttatccttccagtccttcttgtccaaataacctctctgtcttttcctttctcagatgacacaaaccatatgagcagaaatcatatgagcagagacatcacctgccaccacctacgatacactcagaagacctgaacaaacattaactggacagctatttcccattcaggcatttgttaagaacagggtccaaggtagcctgcccacaaagaataaaacagagaccagaaaacagcagcccacaaccatatctcttctgaacatttagaaaatctggcaaaacacagcccacatccccagatgacaacagaacttggtagcagatgacctcttagaagagtcataaactttccagttagtcaatgcccacacctttctctattattgctccagtattggggtcaaatactagctatagaactgaaaatgaaacatgactatactgaaaatcaaaattattacacttgatccaattcactaaattatattatcagcctggcctctgtagacatttaagtcctcaagtctcaaatgactaaggtgccttagccatcaaaaccagaacaatttcaggaggtcaggaacactgttgaatgagtacatagatgaaaagattagcatcctctaatcactttactaaagactaaaattactttaactagatataacaggttaatcccagaatcccacaattaaatgtaagattgaaatacaaatgcttgaaaaaagagaaataataaaagcaaaagtacttcaaagcaaaattttaaatctatcacatcccttcctctaagatgggatcagggaaagaagtacaagacaaagggcctgatgtcctccctcctcaaatttaaagtcaataagctccatggttttgtataaggcaggcctcagaagcacagatttttaccagccaaaagaactctgcccatctttcagatttcacaaaggaagagattaaagtcctgaagggcaaagacacttgcccatgatcactcaagtgtgcagagcaaaatctgaactagaatgtggatgttttcaatcccaaccagggcacgtccatgagccaggactatagtcctcacctggaccctggcctagtttctagtagtcacgagcatgcccctcagcagaaattatggtcaagtataatttattgttttgaccacctgaataattagtcatgtgtgatctgtacggtaattcccaggtattataaatgttccattatacaactccattgaaatgctctgaaagcaagaaaaaagtttatgaatctctttaacaacaaaagtatactgaataacttcacaatagcaatatgaccgaaagcactgaataaatatatagtattttttaatttttaaaaaacttcttccctcttgatagggttcaggacatgctaccccaaaatacagaataagtcatgttagcatctgagaaaacatcagaggcaggaaagtcattcccaccttcctcccacccttcctccatgaagcaggtcataaaatctaggaagaattttctaaccttttgctaaaagcaagtcatgatcctcattctggaggtgccctccccaaacctggaagaaaagaacatcctcatctctgaagacagagtcacagggagaatgtgaacaaacaggccttgctaagttcctcccaatttactgctattaaatcatacttatccaaccatacttccacaactatccatttctcttcttcaaagctagcattaaaaatacacaggttggccaggcgcagtggctcacgcctgtaatcccagcactttgggaggccgaggcgggcacatcacgaggtcaggagatcgagaccatcctggctaacacagtgaaaccccgtctctactaaaaacacaaaaaattagccaggcgtggtggtgggcgcctgtagtcccaactacttgggaggctgaggcaggtgaatggcgtgaaccaaggaggcagagcttacagtgagctgagatcgtgccactgcactccagcctgggcgacagagtgagactccatctcaaaaaagaaaaaaaaaaaagaaaaagaaaaatacacaggtttacccatttcttcgaatcttcatttccttatgaaagctcccatgtcacataaaatttacattaaatctatcagtatatcttgctaatctgtgttttgtgataggagcctcatctatgaatctaagaaaggaaagagaaaaggtactgtttctcctctacactcacttctttctttccagaaagttaaacaataaattgtattaactagaatgttcccacttgctttcatatggtggatacttgatccccttagtttcattagatgccatggtatccacactgtaaatgtagtatttctttcttgaactatcttattgtagaaattttcacttacacacaaaagtagaaattacagtataataaatatccacatacccaacctgcttcaacaaatattaacattttttcaggcatgtttcatttacccttccccagtcaccaccatgccagaggattttaaagcaaatcccagtcattattttgcttataaatacacatcaagtatgcatttctttgaagtcccaagttatctattgaacgttcatgcatagtaagatgatagagttattagtagtaattggattgtagccactcaagattctcaagacacttaggttatgttggaaatacagtgttttccttctgaaataaaactctgctctttatttgtagaaacctttatgtatttatttatttctgagacaggatctggctctgtcacccaggctggagtgcactggcacgatctcggttcactgcaacctctgcctcccaggctcaagtgatcctcccacttcagcctcctgagtagccaggactacaggcatgcaccaccatgcctggctaacttttgtattttttgtagagggtcacgggggttcatcatgttgcccatgctggtctcaaactcctgacctcaagtgatctgcctgcctcggcctcccaaagtgttgagattacaggtataagccactgcacctggtccgtagaaacatttctgaattcctatataacatgcaagggggttctggcccagggaataattcattatcccaacagtaactgtggaccaaaatctcaagtcacagttagaaaatccacgctaaattctatgaacagagtctgtggtatttgggagtctgagtgtctgttggtgagtaatatggtttggctctatatccccacccaaatctcattttgaattattgtaatccccatgtgtcaggggagggacctagtgggaggtgactggatcatggggacagattttccccatgctgttctcatgctagtgagttctcatgagatctgatggtttaaaagtgtgcggcagttctgccctcgttctatctccttcctattgccattaagacctgctttgtttccccttcatcttccgccatgattgtaaatttcctgaggcctccccagccatgtggaactgtgagtcaattaaacttcctttctttataaattactcagtcttaggtagttctttatagcagtgtgaaaattgactaatacagtgggcaagggagagaataccagagtttgtgccttggaaatgggaggataaaagcaactacatatcacaataaaagtatacctcggccaggtgcagtggctcatgcctgtaatcccagtactatgggaggccaaggcaggtggattacctgaggtcaggagttcaagaccagcctggtcaacatggtaaaaccccatctctacaaaaatacaaaaattagccaggcatgatggcaagtgcctataatcccagctacttagaaggctgaggtgggagaatggcttgaacctgggaggcagaggttggcatgaaccgagatcacgccattgcactgcagcctgggcaacacagcaagactctggctcaaaaagaaaaaaaaaaaaaaggtaaacctcaaacatttaaaccatgattcttcatactgtattaagatttctcagcacaagtaaataataatcttgttctcttctttatttgaattaagcagttgtaaaagcaataaaatttatatgtagctgcaattttctcttttttttttttttttttggagacagagtcactgtctcccatgccggagtacagtggtgcaatctcagctcactgcaacctctgcctcgagggttcaaggattctcctgcctcagcctcccacgtagctgggattacaggcacctgccaccacgccgggctaatttttgtatttttagtagagatagggtttcaccatgttggccaagctggttcaactcctgacctcaggtgaactgcctacttaggcctcccaaaatgctgggattacaggcatgagccaccccacccagccacaattttcactttggttaaagtaagtcttaaatttctttcacattcctcgtttttattttaatcatgaatgtcatttttattttaatcatcatttcaacagctgaaattttggtcaagaacattaaacttggctctgccactagtagttatgtgaccacaggcacattagttaactatcataagtaacagaggctttctctctttttgaaataaaaataacaacatctacacattataaggttgccccaaggataaaattagaatgtacgtaaagtcatttaatgcatttatcatataactcaactttctaaatatagaagttagtatgaagattggattctacctgaatccataataacacatcttaatcgtaaattccaacaacatgtctcattcatttggcactcttcacttgcaccttagtaagatcttttatattggaggaatatattgatatttaattcttctaactagtactttacctagtctcactaaccactttatatgctccctgagtatagaaactccatccacattatataaatgctagaatacaagagctgaaataagacaataaagagtgatgttcccaaaaaaggagggtatcagaatcacatggacacctgctccactcccagcacttaggataaatagaaatctaggctggaaaaacataggcatatgttctttgaaaaaactcccagatatctctgatgtgcacctccacttgaaatcttccactttaattctgcatttttaccccccttttttcattttgctgaggaggcagccaaagcccagacactcatgtggcatgctccagatgacctgacaagactctgtggcagcaatacaataactctcctaacacgcagggaacatctcttggcattcacaataggcaatttcttcaatgcattgcacagaaaatggtgagtagtctcttgccaaaatgctgaccaggcacttgataaatactgttcacataaatggaaactgggggaagttatgcacactccaatagcaggagcgtgacaagagatcctggagcaatcggcactctataagctctcaaaactaaccggcctgcacccacttgtacaggggaagtcccatactaatgtcatcaaaaacagatacgatcctcttgataaaagaaggcactaccacctatacagttttctgcctttaaaagcaaacaaaaaatctgcatgatctttaaatccaactactaatttataagaatacatggacacaaaaggacaaaagaataaaggaaacaccactataaagatgcaatgagtaaaatgaaaaaacagtttcttcaacaaataatttttaagagaaaaaaaagatgatatggaggacagaccagcagatagagaaaaagagacttaaaacacatagttttttttaaaaagccatattgttagagatgaaaaattgcatgataaaagtataaataaacagataaacctaagccagaataatggctgcttgtggagggagggcgggaactgtgtttgtgacagggtccatagaaggtagctggcagagtcctgtttctgccctagataatggttataaggttatgtaccttttcaacttcaaacaagaaccacttcacacctactaggattactagaataaaagataataacaagtgttggcatggatgtggagacaatggaaacaccatactctgacattaggaacagaaaatggtgccgccaccttggaaaactatctgacaactcctcaaatggctaaacacagttatcataagactcagcaattccactccaagaaaaattcaatgatatttccacaaaagaacttgcacacaaatgttcacagcagcattatttataatagccaaaaagtagaaacaacccaaatgtccaactgatgaatggataaataaaacactgtgtgtgtgtatatatatacacacacacatacatatacagatacacacacacacacacacacacacacacacaatgggctattattcagcaataaaaagaaatgaaatactgatacatgcaacaacatgggtgaaccttgaaagcatcatgctaagcgaaaaaagccagtcacaatggaccacatattttataattctattcatatagaatgtccagaataggcaaatttatacaaactaaaagattaggggttgcttacgagctggggagatggagtgttgcaggtgataattaagggatgcagggtttttttccagagcgataagatgtttaaaattgattcttgaaatcattgcacagttctgtgaatatactaaaaacctctgaattgtataatttaaatgagtaaattgtaccacatgtgaatatttcaataaagctgtccccaaaatggttattaaaccacatatttgtttgatgcaatttcctacatctgtattatatttcacaataaaaagcttaggaaggaagaaagcatgggagagagggagggagaaggagaggcaaggaaagagggagggaagaaaggaagaaaagaaggagggagagagggaggaaggaagaaggtgcaaaaagaagctagcaggaatctgatttaatttcttgctgcaaaggaggttatcatctaatacacctattctattccaggcacttttctaggtaaaacagatgtgaatctagcttcatggagccatgaaaatacagattaggtatacaaataaactaacaaataaatctacattacaaactttgattactgctatggaagaaaaatacagagtgctctaagagagaataacaataggaactgtatttaaattgaaggactataagaggagtctgaggatatgaaaaatagagctgatgcccaaagatgagaaaaaattaattaatgaggacaaataaggtaaaaccattcccaatagaaaaaaaatggaatctacaaagaaaagaacatggcacccttgatgagctgagataaggccaacataactaaaagagaatgagccagtggcatgagatcagtctgcagagacagtcatgggccagcttatgtaatgtctttttggataatgttaagcatttgattctgtcatcattcttagttcaacagaaagccactgacggctttcttcaagcaagaaaatgagcttatctgatttacattttttaagtcactaaggttgctaggggaactgattaagtatctgctaatgtaggagagatgacaaattatacaatggtgatagccacacaagaaaaaagaagtagaaagattctaagtacactctgaagatgatactggtagcaaaggtgttagattagattagatggggggatgaaggactggctagtgtcagcaataattttcaggtatctccctttggcaaaaggatggattactgaggcaatcaagtctaaggtagaaagggttagggaagaaaaatgagaagctatcagagttttgttttggaaatgtttgatttaaaatgcctgaaggctatcctactgaagctgtcaagtaagcagcagggtatacaaatctgaagtgcagaggagaactgggctacagatgccagtttaggacttcttgggatctgaaaggtattgaaaatctgaaaatactcatattttatacattaagaagtatggaatatattgatgttgatagcatcccaaagccacagagcacacatttaatttgctcctagtaacacctatgagtaggtattgaaattacttttaatgatgaaaaattagtaaaatatttccttgtattttactatagtatactcccatgtcatctataataactgagaaccatctctatcaaaagatatgtttttaaaagcttatctaacaaattattaaaggaactaaaattttacaactttttcccctagatacactatacctttcctccactgattctccgtaactaatctgcctgcaaaatgggtgattagtaaaaacatttactgagtgtataaagtacatgtaggggtatacagaaacgggaagtagctcacccattctccactaagttatttcaactttcctctctggagggcccataaaagaatatggcagcaatgtagtatcaaactaccacagatgctagagttccacttgctataaaacctcacttagtttttctaatctgattctaatctataaaatttggataatactataccttttgagttgtgaagtttaacagataattaaaatatatatttatcccaataaaaaaaatatttatacatacatacagtgtctggcatacaaacatttaaaatgggactattcaaaaaataacatgctggcgaggttgtggagaaaaaggaacgcttacacactgctagtgggagcataaattagttcaaccattgtggaagccagtatggcaattcctcaaagacctaaaaacagaaataccattcgaaccagtaatcccattactgggtgatatggtttggatctgcgtccccacccaaatcccatgtcaaattggaggggcctgatgggaagtgactgaaccatgggggcggatttccctttgctgttctcatgatagtgagttctcacaagatctgatggtttaagtgtgtggcacttccccattcgtgctcgctctctctctctctctctctcctgctccaccatggtaaagatgtgtttccttcctcttcaacttccgccatgattgtaagtttccagaggcctcccagtcatgcttcctgttaagtctgcagaactgtgagtcaattaaacctcttttcttcataaattacccagtctcagggagttacttttttttttttttttttgagacagtcttgctccatcgcccaggttggaatgcagtggcgcgattcttggctcactgtaacctctacctcctgggttcaaacaatcttcccacctcagcctcccaagtagctgaaatgacaagtacgtgccaccacacccagctaatttttgcatttttagtaaaaatggggtttcaccatgttagctgggctggtctcaaactcctgacctcaagtgatctgcctgcctcagcctcccaagtgctgggattacaggcgtgagccactgcgtccagcctcaggtagttcttatagcagtgtgagaacagactaatacactggggaatataaatcgttctgtcataaagacacatgcacacatatgttcactgcagcactatttacaatagcaaagacatggaataaacctaaatgcccatcagtgatagactgaataaagaaaatgtgttacatacatggaatattatgcagccctaaaaaagaacaacactatgtcctttgcagcaacatggatggagctggaggccattatccttagaaaactaatgcaggaactaatggaggaacaaccaaataccacatgttcttacttataagtaggagctaaatgatgagaacacatagacacatagaagggaacaacacatactgaggtctatgagcaggtggagggtgggaggagggagaggatgaggaaaaataactaatgggactaggcctaatatatgggtgacgaaataatctgtacaacaaaccctcatgacacaagtttacctatataacaaacctgcacaggtacccctgaacttacaataaaagttaaattttttaaaaaagtaaaaatttaaaaagtaaaatgagactattttaaaacgttttgagaaggcatagtgatatttattaaggaaaaccacatgaattgttaaaatatgaacacaaagaaattgtcatgaaatacggcttgatagcaaagagtatcactagtatctgctgcaatccactctattccactagctccaatacccatttgttctttcttcattaaaaatactattaaatccttctactactggcagcaatatttggagaacgagttgtactttctctcaaacattgcagtaaaacttcctaactaactgtcctttccaagacagggtttttaagaatattaaacatcagacctttgtactgaaatcaatcacctgtcatctaatttaatagaattaaaaatgagtgatttactatttcctgtaactttcaaatatacaaactgtattaaaaataaagtagttttctagtgcatacattcgaaacattctgaagtactacatattcttaaagaaaaaatactcagatcaataaaaggcaaatttataagtgctgctcttccaacattccacaagtatttattgaatattatatattcaataataaatattaggtgccaggcattgttttacactgtaggaagtcagcgttgaacaaaacaaacataaatccccaccctcaagaagtttactagatattctacaccattatattttagaagtctcacacacacacacacacacacacacacacacacacacaaaattagaaatctatccttcaaatcaaacaaagtcagcctcaaaagcctgtgacaaaaacactgtaaatgcatgaaggaaagaaaaaaaggcttttgaaaaataaaaaaaaaaggccaggtgcggtggctcacgcctgtaatcccagcactttgggaggccgaggcgggtggatcacgaggaacattctggctaacacggtgaaaccctgtctctactaaaaaaatacaaaaaatcagccgggcgtgggggcgggtacctgtagtcccagctactcaggaggctgaggcaggagaatggcgtgaacccgggaggcggagcttgcaatgagcctagatcgcgccactgcactccagcctgggtgacagagtgagactgtctcaaaaaaaaaagaaaaaaaagaaaagatccaagccaatatccttgataaaagaatataaataattcttattttaacatactcttttaaaagataatactggccaggcatggtggctcacgcctgtaatcccagcacttcgggaggccgaggccagcagaccatgaggtcaggagacctagaccatcctggctaacatggtgaaacctcatatctactaaaaatacaaaaagttagccgggtatggtggcgggtgcctgtagtcccagctactcaggaggctgagacaggagaatggtgtgaacctggcaggtggagcttgcagtgagcccagcctgggcaacagagcgacactctgcctcaaaaaaaaaaaaaagataatattatatgccagacaatgagaagttattttttaaagccacgtaagtttgggtataataaaccacaattcaaaaagaacctgtggactactaattattaattctataattcaggatataaagaaattaacagagataacagcagtcaccattacaccactattatttgctgagtatctgcaatatgacaatcactgtcttggctattttatgtatattacctctaatactatacaatctcagtgttgttagagtttcataagtaaatttttaaatgaactaaatatttttttttttttttttttttttgagacggagtctcgctctgtcgcccaggctggagtgcagtggcaggatctcggctcactgcaagctccgcctcccggttttttaaatgaactaaatattaataatatggttatacaggaaagcaggcccattttgtaaagatattagtagttaagaggaacttttttttttttgagccagggtctcactctgtcccccaagttggagtgcagtggtacaatcatggctcactgcagcctcgacctcctgggcttaagtgatcctcccacctcagcctcccaaagaactgggataacaggtgtaagccaccacgccaggctaagaggagcacattttaagagaaacataattgctgccaaacttgagtagtaaaatagataattctttctaagatattaagtaatttgtcatctcagctactttgaaacacatcttagtttctgtttcttccaaattaccaactaaaggtttaagacaataaccaaccagaagtggtgaaaacaagcactggatcacaaaccaacagaagaccaaacacatctctgacactggataagtgagtttaggcacacatttctcttgaggccttaatctcttcatcaataaaaagcaggcatcataatgccagtgtaggtaatgcaaacttcctgtgagatcctgtgaaaatacttgtcaaagtgttcatgataataagaaattattagataagccctatgagctctttcagctctaaaattatagtacagtcatgtatcacttaacaacagggagatgttctgcaaaatgtgtcattaggtgatttcgtcgttgtgaaaacatcatacataacagtgcagttacacaaatctagatgggatagcctactacgcacctaggctgggtggtatagcctattgctcctagggccatgaacctgctcagcatgctactctactgaatactgtgggcaactggagcacaatggtaaatatttgtgtatctaaacacagaaaaggtacagtaaatggtataaaagataacaaatggaacatgtgtatagggcattgaccatgaatggagcttgcagaactagaagttgctttgggtgagtgagtgtgcgagtgagtggcaagtgaatgggaaggcctaggacaggacattactgcacattactgtagactttagaaacactgtacacttaggctccactacattcatttttttaaactttctttcctcaataataaattagccttcccttactgtaacttttttactttataaactttgtatttttttacctttttgacttctgtgataacattagcttaaaacacaaacatgctatacatacatctgtattaaaaaaatttctttctttacattcttgttctacaaacttttgtattttattttatgcttttactttttacacatttttgttaaaaactaagacacaaatacacacatcagcctaggccaacacagggtcaggatcatcaatatcaccgtcttctacctccacatcttatcccgctggaaggtctttagggatggtaacactcatggagttgtaatctcccatgttaagaatgcctttccgtgcaatgcctgaagaacattcctaaggctgttttatggttaacttttttttttagtaagtagaaggagtactctctaaaataatgataaaaagtacagtacagtcaagccttccatatccacaggttccacatcctctgattcaaccaaccatgaattggaaatacagtatttgagggatatagaatctgcagatatgaaggcctgacttttcatatcagcaggtcctacagggaaagaaactgaagcagtgaaaaagattagattatttgattttcctccaagacaggagtatgatttgattcccccacaagacaaaagtatgatttgattccccagtgtaggtcaagactcttgtgaaagtcaaacagagaaacaaatgtaaccacctcacagaggcagttcctaagtatcactgatattcatctggatgaaaccgtctaacatccttgccatggatccatactcttcctgctaagtaacaagacagtaaaacaatggtacttaaaacctagggtcaggaggcacatttcttcttggagcatcagtaatctcagatttggggaagaattttttttaatattaagccaaaaaatgatatattatgaacaataatacaaaattcacaagatttgtaaagataaaatatgaaattcaaagatatgtatataatgtttctaggagaattccttgagctatattcccagatccccaagagggctgggtatattctctataattatttttcttttaagataaggttgatacacagtaaaatataaaaatcttcagcaccagctctatgaattcttactaatgcatatagccacatagtgtatatgaatacactcagatgaagatacaaaaaattcgaggttcattcagctttgaccttaaaggtacttcagggtaaaaatgtttgagaagcccaccatagttaagccaatttgtgttacctgttcttgtccctggcgactgtaaaacttgacacttaacatccttaataatcccagtgtcttcggtacctgcaaaataaatgcatcatatgaagaaagattactgaaatgacttatcgttgtaaaatgtccctttataatgaaatgaaaactatagcaaatctagtatttttttaattgattaaagaaaatcaccaagaaggtgtcaaggatcttggtgagattttgtttttgtttgggaaaaaaaaatccaccaagtggtacaatcttacaaaagacatccatgatcaaatgcttttttaaatatataaccagtaaactttatgcaaatcaaaatccaccgcaagctcttctcaagtaaggctgcccaaggttgccattttatcctaacatcagtatagaaaaagctaaaacttcccaaagcaatttcatctattaacaattgattctatgcttgaaaaacaccaaaaaagacttcatcattagaaatcagtgcataaaataatttaatataacacatgacaattttttgtctttagacttagaaactatattttttcagtggaaaataacattgttgaggatgtagggaatctggaaccctcatacactattgatgggaacataaaaccgtacagccactgtggaagaagcttggtggttcctcaaaaacttaaacataaaactaacatacgacccagcaattccatctgagatctatacacaaaagaatgaaaacaagcattcaaacaaatatttgtacatgaatgttcacagcaacaatattcacaatagccagaacttctgagttgaaaacattagggatggccttgatacacttctccaaatactttctccaaaaaaatcaagaacaagaaagggagataaatctacacaaaaaccatactctccacttagcctgaagatagagaataacccaaactttacaataactgtaagcaaaaagaaagaaatcaccaaatcccaatgtgtcatctccattgctcctgctaaaacctatgtccccacttactccattgtgacctgccacaaggtgtggtggtgagcaaaagcaaattgaaaaacacccagggaggacagaggggagctagcaaaaatggctaaggtccatctaaaaccaaaactaccaccaaaaagactaagtccactctgagtgaaaatactataaaagcatccaggttaatcagacatggcctacagggaagggacctaagtgtgggcatgatatgaagaggcaggcttccaaacacagagcttctgagggagaaaaatggcaaacaggaagaagtgccttttgccaaaggggtggtaaaggggaaaggaagcaaaggggcaaatgtagtgtgcagcaagacaatagacaaccacaacatcagaggatccacgccccctcctgccaccaaaacaaaaccgaaaaaatctgctaaggtatttgaactttgctatactgacaaaagaaggcaccgttaacctaccaatcttgtaaagtattccaatatcataaaaatgaacaagaaagagattcacaatagtttgcagacatgagaagacaaaagtcaacacgtgtcaacaaagggaaattatggctgaaaaaacaaccacgaagcaaaagaaaactttaacatagcactccaaacagaatgaaatatagtcagacaagcatttgagaatgtggacaacttgaaaaatcaccttaaatcaaaaattcagtaactgaaaatagaactggacaagaagagtgaaaaagggttaataataaaaagctcaataaattcaggaaataaatataagaaaaagagaaaattatctaaaaaataaagaataaattacaaggtactcaaggataatttagtaaggggctttaaaggaagacatgaaaacaatgaaaaaatgaaaatgagttaagaagtgaaaaggaaatgagataaaagggagaggtaaaaagagtaaagaaaaactactggaaagagaagatagtaagaagcagtaacatttggattgccagagaatctgaagaagataaacaaaaccaaagtacagaatatttaaaattataatccatgaaaactttacagaaacagaaaatggaaaaaatagaaatagaaaaaaatctgaatctacacactaaaagaaccaatgcatacccagaaaatttaaactcagcatgatcaactccaatatcctaggaagctatcagatttcaaagataaagaaaataaagacctgtaagaaaaactgactaataacatacgaagggcaaataatttgattgcatcagacttttaaaatctcacatacaaagcaaaacaagagtagcattttttaaaagtgtagtgaaagagaaggcgaaccaaggattttacatccagacaagtttcccctcaaatttgaaggttatggcaaaacagttttgaacataaaatacaaaaacttaagaaactcatcacctatgagaccttctcaaaacatactgtaatttcatccaaccacaagaatgactgggaaaacttcagcaaaagaactgagtaagcattttaaaatacataaatagatgactaaagaaagctgggaacaaaagtagacaccaatgtacaaatattatgtatgtgacaatgcagaaacaaaacaacaaaaaaaagaaaaaagaaagcagaataagctgatttttgtataagcaattagtagaaatgaaagaatacgaagaaaacaaactcgtaaaatgctggaagacattgataacatcaataagaatagtttctgtgaaatgatggagggaaatctccattcgagtgaattcaagagagaatggaaggagaggaattggaaacaagtacagacaactcttgagcattgtaaggaaaggaaaagaaatgggatggtagctagagggcaaagtggagtctgaagagtttttgtgaagggaaaaataaaagcatgctacatgctgataaacctaagaggtaacaaaattcctgatgtaagatgaatatccttcaataaacaagagtgggagatctagtggacaaacacagggcttggccttagcctgagcaaggacagttcctctgtctgaacaagagaaaagttacagtacacaggcacagctgctggcagggtgtgggatcctacagaagtattccttctgattacttctatttttttcagggaaataggatttctcgtggaaataggatttcaaaaagtctatgttctttccacaacaagcttctatattgaaaaagcagcagcagcagcagcaataataaaaattcagtcaactttgttcattctcatatagttttccaaaattttgatcttaaaaactcagacaacaataaataattaacactgtagatcatcttacagtttatcaaatgcctttacatatattacttcatttacatcctggcaaaagccttagtagacagtggtaagggataaggtggaattcaaacaccagccttctgactccacagcctgggtccttcctttgtcccagctactgaattctaatctggtacctgttatagctcattgcacttatttgagacatagctgttcttcccatatgcagcgaatcccttgagggctgccaccagtatttttacattcctaatacctggagcagtgattaaatgttgaataaatgaataaataaaactatctcacatagatgacactaacattaatttggaaacttgggtcaatacacatattgaattttgcacagtctgttttacaacctagcagccttgagagagactacgatgtatgtgtcagcagcatttttcagtcaatacctacaccaagacaacagcaaccttaaacaaacagtaagaggaggttcgatgagaacaatatctgctgcctgacaaaaggaactaatcccataacctcaaattattgtgaggtaagggaaggctatgcagaatgatttcaagtttagctgcaagacacagccactaacataattaaaatacacttgcagcatttcaagaagttaatcatacagcagagcattccatttgcaattcaatatttttcccacttattttgtcagcgcacaagcaattttcttttaaaagacttcaataccgaagcctcaggccacaaggagatcaggaccatacatagcagagtagattccaatacttcagtaaggtgcaaagggaaagcacaggagaattcaaagaaactaaggtgaaaaaaggttccctggtatgtgacttgccacttgcttgcctactgggtcccaaataaacacttgattacaccaaaccaaaagggactttcaccacttacccacgttctctccttatatcctctatacacatccattttccttttttcctcaaccctattttgacaaatttcacagctacagaaaagttgaaatgattgtacaatgaaacacgagtatacctctcacctagctagaccagttattaacattttgtcacatttgctttatctctatgtgtgtgtctatgtatacagacacacataatttaaaatttttttttttactgaatcatctgaaagcaaggtgcagacttggccgggcatggtggctcacgcctgtaatcctagcactttgggaggccaaggcgagcggatcacctaaggtcaggagttcaagatcagcctggccaacatggggaaatcccttctctactaaaagacaaaaattagccgggcatgatggggggtgcctgtaatcccaggtaatcgggaggctgagatgggagaatcgcttgaacccgggagacggtggttgcagtgagccaagaaagccgcagacatcatgcttactttagacagagctaagagaaacttcttcagactctaagatctaccctgaaacatcttgcatataaaactagaagctggatatgacctaaatcagagagataaacacagctaaattcctacagatatgaactaatgtgtctaatatgtacgagtaacttctacctcactttactttttatagattatgggataatcatcatagcatatattagtgccactgatatggacagaatttcatggggtggcgggtgcagaacagaaactagatctggcccatctcatgcctctatgttcagttattatgctctatggtgccttaggctccttatttgtgaaatgtggccaataatacaccaactgttctccttactaggtcctgcagagagaataaagggctgatagactaggtagatggacaataaatggaaggaaaggcatatccacagtactgcataagctgttctacacatacaaactggtttaatgtctggtgccatataaaccagtaagttgacttcatttaaagaaaaagaaactactactttgttgggttaaatcacagttacacactgcagtatatattaaatgctaaaaataaaattcacagaggattactattattgctaaagatttcttttcaaaagtacatcttcattagtttattttcaacactaaaatctttaatagtttgttgttttagaacataatttgaaatcaatatattttttgacaaattcattatcaaaatgaacacatatcatgtttgattatgttgtgtttcaacttttctagatttcttccctcactgaaaaaatatttgagtgcccactaggtaacatggtaaacccaagctgcataattttggccaagtgctcacttcctttttttttgagacggagtctggctctgtcacccaggctggagtgcagtggcacaatctcggctcactgcaacctccgcctcccaggttcaatcgattctcctgcctcagcctcctgagtagctgggattacaggtgcacaccaccaggcccagctaatttttatatttttagtagagacggggtttcaccatgttgctcaggctggtcttgaactcctgacctcgtgatccacccacttcggcctcccaaagtgatgggattacaggcgtgagccaccacgcccggcccaagtgctcactttcatacagtttacacaaataactaagacatgcaagactgcagtgtggccaggatggtaaacataattagtatttaccaatacctagtttttcacatctttctggacacatagaaaactatttcccagcccctttgaagctaggaggggccataatacaataaatgaactgtaagtagaaccaatgtcacttctggtctaagacagtaaaaagttccacctattatctctcccttcccttcctaagaccataaacggagatagtgggaccccaaaaggtcaccattctccatggatcttttaatcatcacttaaaacaagctgcccaggagagtcatgatctcaacatcaggctttgccacaaaataaggaaaaaatatgtatatgataagccacagaaatttcaggactttgcatttgctcatttgattgcttgaattatcaaaatagaacctagcctatgctgactactacagccccaaggactgcctgacacaaaatagaagctcaataagtaagtatagaatgaatggatggatggatgaatagtccatgtaaatatggaacaacatggaaatctggactctaattctgccatttgctagctggatgatcagggcaacttacttaactacacctcacttaccacctcatcaacagactcgggccagtaacaatatttacctcaaagggttacttagaattaaatgagttagagcatataaaaagcactccaaatagctgccaacacattaaaaagtgcttaatacatgttttcatctaaataagcaaatacaaggaatgggactactgttaggttgtttttctagtatctgaaaatgtcactactaaaaattattccaagttaaatacaatatgcctcagttgaatttgttatttgaaagaaataaaattataccagcattaattcactgtcctcattcaagatgaaattatttcttcctctatatcttacaaaggacttatttgtctaagacaaatagcacagtgaaatgacacatagcaaagtgaagtgccataactcatacttactgcagtaaccccgtctccaccattagtaacctgcttataatacggtgatcctgaaagaactctccaggcagaaaggccacagctagaagcttttgacatgcctacttcagcagtttcacatccaccaacaagtaaaagtctaaaaaggagaaaatttttaaaaatcgataaattgcaaatataaataagagcaaaacaaagagagcagaaacagtcaccttgagaaagaaaatttaccaagtactattaatatatgttaaacctagaaggtaaatatttcagaggaaacaatcaaaagaaaaccaaactgtttttcaattagaatttcaccatatactaaggcttaaatattcaggcacctgaaatgcaggtgggaacttagaaatgaagaaaaaaattaaggctagcaactgaatataaaaaaactgtctgtatcaacaccaataaactttaatagatgtgtagcctcacccagacacattatgtattaattatggcaatgtatctgatgcaatgagggagccattacagaaagctagaaagaaatgacacccaggagagactgaatgggaaagaaccacagagcaataattataccaaaacaagactggttggtagtttagctgcacactatgagtggttcacttttctgtttgttacactccattcataactggaggccagttaccaacagggcaaacagcctaacatatactaaaagttagaagacattactgtgtaaccactatataaacaaagctaattaataacgaaaccccaacagtcacaatttttaaagctatgttcagtacttctggcagggatctgtataacagacatcacagttatctgtctaaagaaagaaaaaaagtctgacagttccgtttacctccttcttggccatactcatagaaaaaccaaatcttgaaaaatttatgtttctacatagaaattgaaaagtcaaaaaaacataaagttatttagagttggcatatcagactaactcagttacaatttatgtcaactaaagctaactttaaatgttataaaataaatatcagtacctcatgacataacaccatgagctctcaatacggacccttcaagaccagtggaggtgtatgcccactggtagtagtcaaaaagcactatattatggtagaaagcaacacctgccttctgttaattttgttcaccttgtgtggcaggcaacacaatggcccccaaaagatgtccacatcctaatcgctgcagtctgtgagtatgttctattacatggatttaaggttgtagatggaattagggttgctaatcaactgacttgaacttagggagagtatcctgaattattcaggtggccccgaagtaatcacaaggatccttaaaggtagaaaggggcagcagaagagtcaatgtcagagtaatgtaatgtgacactcacctggccaccgctggctttgaaggtagaaggggccacaagccaaggaatctgggaagcttctaaaagccggaaaaggcaacaaaatagattctccccaagcctccagaaaggaacacagccctgaggatatgtttgattttagcccagtgagacccatttcagacttctgagctccagaactgcagggtaagtttgtgttatgtcaccaagtttgtgattcatagaaaatgaatatataccttttttctttcccagtcccaaaactcagatgacctgtcacactctaatgccactaaaagccctcttctcatttgacaacccactttctaaagtgtttctgaactaagctaacaataacaattaaagaactcatctctaccatatactcttagatctaaatttttcaaaactatacaaaatccttctaggtttaattatggaatgtagcccaactcaaaatctcaaaaaccataaagtaattcaaatgcactttcttcacagaaacacagcttgggcctacacacaaagccttttccctactgcctttttatgcagctctaacaaattttcatctcagcaaattggaagtaaaaaactttgagacgatgccttgaagcaacctattttggttgttcctaccctaagcaaatccttagagctaacacgtaattaaccctgctcaccagggcaaaagagactgtggtccaaagtcaggctagtattatgagtattacttgcccagagcattcattcttctcaaatgattctattacagtaaaatatttcacaaaaaaaggagtatatctagtgcagataaaatcatattatccctcagaatctaactctcaatttggagaaaatattgatgaaaaaagaaaaatactttaaacaacactacaaagatgcaatcaacaaaaactagacagtgagaaaatacaaaataaatggcctgggttttttttttttcagaacccacacacacataatcaaagcaaaagagcaacagacagaaggaggatatggagagcagatcaatgaattaaaagaaaacataggttggatgcagtggctcatgtctgtaatcccaaaactttgggaagacaaggtgggaggattgtttgtggccaagggttcaagatcagcctgggcaacatagtgagatctcatctctacaaaaaaaaaaatcagccaggtgtagtcataggtacctacagtctcagctactcgggaggatgaggtgggagaatcgcttgaggacaggagttctgaggttgcagtgagccataattgtgccactgaaccccagcctgggtgacagaatgagtgagaacctgtctaaaaaagaggcaggggagaacacagtctggatatttgaagatactgacagattactgttaattattttagatgtgctaatggtattatgtttatattttagagtctttattttgtagaaatacacactgagatatttacagataaaataatatgctgtccaggatttacttcaatataatccagggaagggtggatagggaaatggctgggtatacaggtaaaatgagactggccatgagctgattgttgaaactgaataacaggcactaaggagtcagtatactattctacttttgtacatgcttcaaattttccataaatttatttctcaaaagtccatttgataggaaaaaaatcctctgaataaatagaaatataaggggtaatctggaatatccaaagttcagaatttaatcacaacgttttttcaatccaaaaatatgtgattcataaaacatacctttaaaaactagtaacctactatttaaaacagtaacctctattgaacctctatttgaaaacaatatcactatttaagaattcaataaactataacaatatcactacttaagaattcaataaattcccaaagtccattataaaacagttccttgataactgaaataatgtcactttgatcaatgtccaatatatatatttgtattaaaaacatataatatagtaaacattaatgtatttataatatataatttctactaattaaatttatgttaacatatgtctgaaactttaagttggctgactactgaaggagttacagacctaagtgataatccagattttttatgtcctgggtattgcaagacacttcctctctatgaattctgataactagcatagccatgcatagataaaactgtctacaaaaggttaagatcccctaagaacaaaagggattcagtatctgttcccagcctttcctccgttcatgccagactgaagaataaggggaaaagcagcagaatgatgaaacgaatcatgtgttgttccaatcagacagatagcagctttaggacactgatgctccagctctaagaatgcatatgtgttcacacatccaagtaggcacgggtcctcaggtatgtttaaaggggaagaaatggagataactgaatcaacatcttcacaaaactggcagctgctgagtgcagggcaatgtgcagggcactgagtgtacaaagatgaacaaggcatgtgctctgcatttaaaagctcactctctaaaacagaaaaaaaaaaggaagaacacatgggagcatgaaattagtggcacaaaagatgacagaccaatctgaagatgataagcaaatctaaatctactgaagggtttttcttcagttatacatgccaaggggccagcctggaaaacatgtctctacaaaaatacaaaaattacttgggcgtggtggtgcatgcctgtagtcccagctacctggaaggcagaggctgcagtaagccaagatcgagccaccacttcagcctgagtgatggagcaagactttctcaaaacaaacaaacaaacaaaaaccccaaggggtatcaaccccaattcaagactccattactttattattcaataagactcacaatgttgacgagaactaatctacaagtgattaagaaaataaaaataaaacaggcttatggtgatgattggccaagtaaataaacacgctccatcatcatcacagtgttcagaacaggcttccagggcaacactggccagaagtgaggagaaataaagttccactggtaaaaccatgtaacttaaaaaaaaagccagtcaatggaagagaagagtctgaaactcagcacaatatactcaataaatgtttgctgaggggctgtgaattgaaagtccacatttctcattaggaagcacagagtgaagaaggtacaaagagacccatcttcttactgcttgtcttcactctatgtttcagcagtaagatatgatgagataaggtggggagaagggaagggtcacggcaatggaggcagggaaaggtggggtcacactgtttaaaacggacaaaacaatgctaagccaagaatttgatatttttaaggaaacatcgagaagaaaatttcaagcttgtgagagttacatgaatgaagacggagagatactatcttctttggtgggtattttaaacatgccaattcctcttaatttacaaattgaatgcaatttcacataaatcctgtaagaatttttcatggaactgaacaaactgatttaatgaaactagaaaaacacagaattcccataagaaaataagttctaagaagagccaactcagttcatgctcatcaagctttcacttatgagctgggctttgtgcatcttgacctgtaaacattttcctaccctgccatcattaagacattctcactcaaatttgaccatattaaaatttaaaatttccatccataaaatgaagactgggcttgtaatcccagcactttgggaagcccaggtgggtggatcacctgagctcaagagttcaagaccaccctgggcaacatggtgaaaccccgtctctactaaaatacaaaaaattatccaggtgtggtggcgtgcacctgtagacccagctactcaggatactgaggcaccagaatcgcttgagcctgggaggcagaggttgcagtgagccgagatcgctccactgcactccagcttgggctacagagtgagactccatttcaaaaaaaaaaaaaaaaaaaaagactgggagaagttatttacaacacacagaactaacaaagtattagtaggcagaatttataaagatctcccaaaaccagttcaaaaggaaagtagacaaaggataagcaacagcaaatcacaaaaaaagaaatccaaaagccaataatgcagattaaaacaacacagatttacaccaatcaccctctagaatgtttaggggcctagtaactcttaaaaactactagcgagattgcaaattgaagcaatcattttggagcaacttgacaatatcaaataaatgcacacaactaactatcccacaaactgctccaaggaaactatagagaaattcttgcacaggtatattcatcttttggccaaaaaaaaaaagtttagtgtgaaacttgttttgttttttaggtttttttacttttattttaggtttagaggtatatgttcagggtttttatataggtaaattgtgtgtcgcaggggtttgttgtacagattatttcttcacccaggtaataagcatagtactcgataggtagttttttgatccccacagtactatttataaagctgaaaaattagaaatatttcaaatatttaaaagggatggacaaataaccaaattgttcaggaaaacatatacaatgtgaagggaacaaatacaaaaatatatattggaaggtcacacaccaaaattatgacagctgcctctagagggaagaaagtgagacaaaataatggaagtagggaattttgtttgtattattgtctttgatatttatatatgtctgtgaatgtatacacacacacacacataaacatacatcttaggtcaaagaaagacacatttaatatttgttaagtgcacgtagtaggtacgtagttttacagatgctccttgacttatgatcagataatcaataaacctattgtaaatggaaaatactgtaagtgaaaaaagggtgttttatacatgtgatgggatgtcaaaacacacaacacaatatccaaaacatgctggcaacacagtacatagagtatcgtttgcttgcctcatgacctgatcacattaccctcatggttgcatggtagactgggaggttcagttcgctgccatacccagcatcacaagaatatcctacacatactgctaacccaggaaaagatcaaaatgctaagtacagtttctactgaatgtgtattgcttctgcaccatcataaagtggaaaagtcttaagttaaaaaaatcacaagttggggaccatctgtttattacatcattctctgtacttctccttctctctcccttttttttaaacttaaaaagaagaacatcaagatacaatgtcccaaattatgcacataaatttctctagttaatgaagtctaggggaaaaaaaaaaaaaaaaacagtgaattggctttaacacgttgcatcaacccacaagtgtagtgaaatactcaaaaggaaattatcatataatttgccttgtggtattttgaggttgtatatgcattaatgattatatcttaagtattctgggactgggacttactactaaaataattattagatttttttaagaaatctagtctataaaagctaacattgtagcaaataatttatatcattagcgttatttgtttttgcattaaattccttcacctggaatatttacatgcagtggtaaccattacatcctcaaatatacagaatatttgacttttaagtgcttaatttcaaaataacattttgaagcaaatattttcaaattatcctatgaagatacagtaaaatggaatttttataatacaaattaaatcctctacactaaagcacacaacatgggaatgaattagcaaaactttacttccccttaacaaaaacaagagagagaaagagaaagaaaaagattatattacccaataatctttgtattagtccattttcacgctgctgataaagacatgcccgagacttggcaatttacaaaagagagttttattggacatacagctccacatggctggggaggcctcataatcatggtggaaggcaaggaggagcaaggcacatcttatgtggaatggcagcaggcaaagagagcttgtgcagagaaactcccatttttttaaaatcatcagatctcatgagacccattcactatcatgagaagaacatgggaaagactcgcccccatgattcaatcatctcccaccaggtccctcccacaacacgtggaaattacgggagctacaagatgagatttgggtggggacacagagccaagccatattactcttcaacctcaaattttatggaaaatagcaggaaaatgatgggtctagaatcagaagtatcaagttcaactaacctttgctaaaaagaaactatataatcttgagacattcctttcacccattaacatttactaaactgcatataaccaataaggaatatgctaagccactgaagaaacatcttagtaaactacttctaactttttggaaatcaatgttcagcataactcttaactctcacatttgtccagtatcacatacggtgtgccggttagggggcttgcattccttctgtaccttccttttctcaaacaaccagggatatgaattcatatagaggaataaatatgagcagaatccaccacaagttctcatttagttcaacttcttcatttctttattttttttttaatttttgagactgggtctcactctgtcacccaagctggagtgcaatggtggcgcagtcacagctcactgcagtgtacctcccaggttccagtgatcttcgcaccctcagcctcccaagtagttgggaatacaggcacatgcatgcctggctaatttttttctttttttaaacttttgtagagacagggatctccctatgtagcccaggctggtctcaaactcctaggtgcaaatgaccttcctgccttggcctcccaaagtgctgggattacaggcatgagccactgtatgcagccaagaatttgcatttctaaccatttccccagtttttctgatgctgctggtcagggaccacattttgagaaccactgctttactttatgtttgaatctgttatatgatctctaaaagatatactttactataggtcaaattatgaagcatcagactatttagtcaacatgtgcttaagaataatcacagaaaactgattatattgaatgattaattattaaagacaaaacatgggaatttttcctggacttcttagttcactaatgaaatcattccctggcaatttgataactgggcatcatatttaaaactgagtggtactcggctataattttttttaaatacaatttagagtttaaaatcaagaagtatggaaaggccaggcacagtgacttacatatgtaattccagcactttgggaggcccaggcaagtggctcacttgaagccaagagttagagaccagcttgagcaacatggcaagaccccatcgcttcaaaaaattaaaaaattagctggatgttgtgacatgtgcctgtagtcccagttactcagaaggctgaggagggaggatcgcttgagcccaggaggtagaagctacagcaagccaagatcacatacatcactgcactcaaatatgaaagacagagcaagaccctgtctcgaagaaaagaactacgaaaaaatctacgaagttcaatacgccttactttctacctcccaaacagaactagacccatactcagacagactgttggatgacataaaataggggccagaaaacattctgtgtaaaaggccagattataaatattttaggctctgtgggccatatggtctcgcacaactactaacttatgtcagagcataaaaaaaaaaacagacaatatgtaaaacaaaaaaaagtgtggctatgttcctataaatctttctttataaacacagaaatttgaatttcatatgattttcatgtatgataaaatattcttttgaggtttttttcaacaatttaaaaaatataaaatctatgcttaaaaacaggccacatttggcccacaggccaaagtttgccagagaaaagcttactgggcatgggaatcaaagacatgaatttaccactcaacagtcatgccctcttaagaaagttgcttaagcctctaggagcttaggtttctctacatacacaatagcagttatgaaaccatctcatgttgtgatgagtaggattcagcatatataagtatctggtcatcagtaaaagctctataaagttaatttcatctattataaccttaacttcaattgaagtcaattcaatgtcaattcagaaagtgtctaaaacttgcaaggtgctaatctagcagtgtaggaaatactgtgtaatgaaatcaagtattccctgcccttgtggagttaacaatcttatggcattactatattattaactgactgcaatcttaacagtaccttcttcgacccagctggcacagatgatcccatcttatagcaacatctattctgattcgttggtcaccctgaagagatgtgaccaaagaaacactggtgaaattacagtctcactcaactgtaatttcaccgaagaaaagtttggaaaaaacctgttttagacattccattcatacagttgttccacctagctcttacgttttaattcttccaaagtcaggctttcatttatttactgagaaatatttattgagcaccaattatgtgccaagccctcatctaaaagctgaaaatagagctgtaaataacacagatggaagtttctgccttcatggaacttacattctagtgtattagtattgctttctctctttatatgctttgacaaagtcaagtatatttaataatttaactaaaatctactgacaggtactccatgcaaagcaccgtgctgctgagactaatgatacagttctaagacagggtgtttggctttaaaaacaacaatgacattttgagatatacagaaatttacacatgcctagagttatctagaccaggagccagcaaactccagcccctcaaatcaaattcagcccaccatctatttttgtaaataaagctttatggaacacagccatactgtgaattttatatgtagtcatgtctgctttcacactacaagaggagagtttagtagttatagcagagaccatatggcctgcacagtctaaaatatttacaatctgcccctttacaggaagtgtgctgaccgttggcacagagcaaagaaaacatgagagggtgtaataggaagctagacagattaaaggccaaaccacaaagggcctttaatactaatctaagaagttatatatctatcccaagggctaaagaaaatcagaggatttttaagtagagaagtaaatgatcagagtagtactttaagacctgtaattctttctgacaacagaaatgaaaagaaattagaggaagaggaaacaacttgataagtaaattgggtcagaagtaatgagggtctgaagtataaggatggcactagaaatggggaggaggaggcatactaaagaagaagaatcaataaggcttgaagatcatgagttgagaattatctaacataaatctcaagttttggcctggtggaaatattatacatcaagatatgggaatacatgagaagaagcaggtttgaaggaggaaaatgatgaacacagaatataataagtaggaggtacttgtgagctatccaggaaaagatgttcagtaagcgagtgaataaatagctctgtggcctaggagtaacttctgggatacagacttcaaagatattacatatgcattcaagtggttaaaaaccattaggtctggataaggctgcctataaaaatatatagaataggtaagggaaaaaaatatggccaaaagattccattaaaacaccatgagaattaataaccaagtttaacgtaggagcgatatgcagttgacccctgaataccacagggttatgggcgccagcccccaagcaggctaaatccacgtataacttttgactgccccaaaatttaactactaataggctaatgttgacccaagccttattgataacaaaaacagtctattaacacgttttatatttattacatactatattcttacagtaaagtaagctaaagaaatgaaaatattaagaaaaatcataagactaaatacatttacagtactgtactgtatttatcaatactgtatgtttacatagtctgtttacaagatcgatcatctatctgaaacggtgcgcaccacagctgcagattcaacctatggcacatatcgagcaattcaactttttcttgtcatgtcatgacttttccctgcttcctgggagcacttccagcatcactagtgacacttcgtatgggtcccatggcattattcaaggtttacagtactgcactaaacacaatgaaaaatacatgagaacctcgagagattactttttactatgatacgcaatttcccggagagactaactgctcagtcagccttccatagccatgggttctgcacacgtggattcaatcaaccacagatgaaaaatattcaggaaaaaaaatggatggttgcatctgtactgaacatgtatagactttttttcttgtcattctctaaacaatacagtatgacaactatttatagagcatttacattggatgaggtattacaagtaatctagagatgatgtgaaatacacaggaggatgtgcatagattatatgcaaatactataccacttcacatcagggacttgagcatttgtggattttggtatgaacgaggggtcctagaaccaagcctccacagataccaaggaaggactgtgcaaaaataaattgtatttctataggccaggcgcagtggctcatgcctgtaatcccaacactttgggaagccaagatgggcaaatcaccagaggttaggagttcaagaccagcctggccaacttggtgaaccgctgtctctactaaaaatacaaaaattagctgggcgtggtggtagacacctgtaatcccagcaactcgagaagctgaggcaggagaatcacttgaacctggaagacagatgttgtagtaagccgagatcacgccactgcactccagcctggggaacagagtgagattctgtctctaaataaataaataaataaacaaacaaacaaactgtatttctatctactaacagtgaacactgaaaaaaggtaactaaggtaggaaatatatctcaaacttcagacactagtgtacttctttcaaatgattttttggcatattaaaggcatcatttacatcatcttatttgttcatttatttaaaggtagcacataaaagctaaataactgtgctttatcataaccactactctctgtgacaccacagattttttacacaaattaaattaaaaatatctgtgcatgtaaaacgtaaagccatcatgctgccctattcgggagacacgtggtgaatggaaaaagataaaataataccagaaatggagtgacttcctggctgccaagatgatggtggtggttcctaactgtgctatggggtgcaagatgccccacacaggttttgcaaaggcagatgttcttgagtaaatgtgatgatatagattgtgtgcctgcacttattacatgtcccggtccaaactggggtctgactggcatgttgtaggcttccaaggaagtcagaataaacacacatgcatacacatgctcactccatgcagacagacaagagaagatggatatctagttctgctacttctacacctatgtcaaccatcaatcttagctccttatgggcccagttttttaggcagctataatcaatggaagggagacgacaaccaaatgaaatttattgctatccctcattagggcaacttcaaagcaaggaagatatcctagtcattatcccattgatcctattaaatctcccagagcttagcacaaggatttttaactggagggaaggacacctgatcaagcctttgagggtaggacctaggtatgcatttttttttttttaattctcaacaggtaattctgatgtccataccttgttaagagccattggcctggcacagaatgtcaacacaagtactaatgaataaattaacttaaagttcttggacactcttgcctgtttccttccctcaacccacagctgatgctaaagaacatcagctgaagacttaattccctcttgatccttaaggtggatttaagcaacttcactgcaaaaacacaatatattcagcatctacctatatggcttattccacatctaccttttatccagatttaaatgaccgtccagtttctgaaaccaaatttccaatttccatcccaataccagcaatttaatttttgaagtcttgctcaaactggttctcccaggagaagtaagtcttgtctctgaagccggctgttgcctgccaggtatccctgacaatgaatcttcccacaacgcctgctgttaaactctccaccacaattttcctctgtgaaatgctacacagtagtctatactgaccctccttggtgcttgaagaactatggtctgtgcccagtacagtgccagaaaaatgtggtccagaaagagtaaatgacttactttgagattacacagctagaaagtaggacaaccaagaacagaattcagggttcctgtctcctaatctggtacacactctattaaaaaatatttttaaaattttctatagatatagaaccaaccgtagtagtggtggcacaactctatacatttagtaaaaatcaatgaattatatactggaactcagtgtcaaagggtcatcaaggaatttgaacatgagtggcttttcaaaagtacagcttctcccaagaaagtaggcatgttctctgccttttgactttgttgaaatgtaaattagggtctagaagtagttaccttcaaacactaactaactttttgtagctatcaaggaaatattggaaatacaacaaaatcagatgttgcttataaaaattttcaacaaaattgaaaacaaaaatagtaacaaaatcataaaaattaaaaagttatatactactgaaagcagtaagtgccacttaaaaatctatacataaagtctttgatctgaacctaactcattaagtgttaatttgggactgtgtgattcccagatagggtataaactcctacaggacaggtactacatttgaatctccaccagcaagcacagtacccaccgtgagcgaaaggcttaatgcatctcctctaacaatgcagagatcagagaatcttctcagccagaattaggctataatctatgctaaaacctacagagcaaagagaacaataagaatagaaaaaaagatggcagcgaggtgttggggtaggttgaagaaaggaagcaagactggaatgagatagtctgcgtgtttaaggaggacaaaatacattcattaggctgtgagttaggatatataaaaaagaaaatagtcaaaatccacatattcatagagcttatcccaaagcttctcaattaatttttgtttcatatcaccaaatttaccacctcagtttctcttcttcaacaatactcacaacattaggcaaaacgatgaatttcataaaatcctgtttgtatattaccaatttatccaaattcaactctggctgatttacttcacatttataaaatctttgtggatgataaacatcacaggcccacattactagaataactgaaaataaataaaaatgtgatgaatatttcagcttctttcatttaaaaaaaaagaccacataatggaaaatataaacaacctagcaaaatttttgtcatgcacaacaggccacttacacatactccttgctttacaacaatcttcattcagaaacaataatgtagttatccatctccaaactgactgccaccaagagatgtaaatgattgtacaaccaacaaaaggtcctccttctgtggtttgataatatatcaaactttccagatgttcttatttaaatggagactgcccctcaaaaataccctcaattgcttaaatcctgaatcaaaaagtaaacatcttaaaagtaataagtataatctgacttaaaagaaatttatcccataataattattcagtgtgtaatcatttcaatcctacggtcccacttaccttcctgaaataatgccaggaaaaaagaaatcaaatattgacttttgtaacaaatcaagagagtggagtagtcagtatgaaataaacaatcaaacaaaaacagtccagcattaagatacaaaatacccttcttttaaaagggacaagagaaaaaaaaaaaacacagaaatgtggggtatgaagaagaaaacaaaatagaaaaggagaaaaaaggaaaagtcaaaagaaagaaacataaattttcttttctactcaaaaaataagagttacttattcaaggtgtcctcagagccagagctcatatactatttgctgtgggttttacaaaggtatacagtacatattccttgccttcaagtagctgatagtctaattggagatatgggatatgtgaccatctgtttgtactaccataacaaaatacctgtgactgagtaatttatgaagaacagaaacctattttctcacagttctgaagactgggaagttcaagaccaaggtgcagtgaggttggttgtctggtgggagctgctctccacttctaaaatggcaccttgttgctgcatctgccagaggggaggaacactgtgccctcacatggcagaaggcagaaagacaacgcgtggagcctcttctatcagggccttaaacgcactcatgagggagaagtcctaacggcctcatcatgtcttaaagccctcatgtcttaatgccgtcgcattggccattaagttttaatacatggattttggagggcagatgttcaaactatagcaggatatattcatcaaaatagaaaaaaattaacaataaaatgtggtgtatttaaacagcgcccaaactgtggtacaaaaacagtatagcagtaacatataagataatgagtaggtgcttgttacgtgtggcgtgaaccagtacctgatcatctaagagtcacccagcctctagtatctccctatggaatcaacattcctcaaaatacaaatgatcatatttcctcagctcaaaaatttgagtcccttaaagaataagctgcctcttaccactcccaattaatgggcctcaacctgcccttcccatgtcctatctcccaccaccactatcacctcccttgccctcagacacacactctacagtatcagccaagctacaccacttacaatttcccaaaactacactatgacttcttttcccttgccactattaacattgtcactttatctagaatgtccatcatatccggattgtatccattcaccaaagcaagcccacgtgctacctaccatgcttccctgctccttcaagcaagtagtagctcctttatctggacccccacatcactgtatctgcatccctttaaggcgcttattttctagcttgcattctagtttacatatatagatttttaatatatttttatatatatgtacatttacatatacaatatgaatgtttatattatttatattatgtttatataatatatatttttaatatatatgaaatatatttttatatattatatatgtttagatatgtaaatgtatatatatacatatatacacacacacacacatagaacatgcagtgaaagaaatgtattttagacatcagtaaaatatatatgcatacactggccgggcgtggtggctcacacctgtaatcccaacactttgggaggctgaggcgggaggatgacctgaggtcaggagttcaagaccagcatggccaacactgtgaaacccagtctctacaaaaatacaaaaattagccggacctgatggcaagagcctgtaatcccagctactcaggaggctaaggcagaagaatcacttgagctggggaggcagaggttgcagtgagctgagatcttgccattgcactttagcctgggcaacagagtgagactccatctcaaaaaaaaaaaaatatatatatatatatatatgtgtgtatatatatatacacacacacatatatatttcctatctaagaatatgagatcttaggtcagaattgctctccatctttacatctcccccaaccgctaacatggtgcattccacaaagctagccgcaataaataagagagtcatggaaagcaggccagataaagatagaatggactttccacctcatcaatcttcctaataccaacaacttctgtaactgaacacatacgctttttaagaaacatattcgaaaagtatatatatatgtgctgaggaagtgaggtattaataactacactttaaaacaacaaaattggcagggcgtggtggctcatgcctgtaatcccagcactttgggaggctgaggcaggtagattgcttgagctcaggaatgcaagatcagcctgagcaacatggtgaaaccctatctctccaaaatcaacagccaagtgtggtggtgtgcacctgtagtcccagctactcgagaggctcaagtgggaggatcgcttgagcccaggaggtcgaggctgcagtaagccaaaatcacgcactggactccagcgcgggtgacagagtgagaccctctctcaaataaataaataaaataaaaccaaaaaatcaagctgaactaaacccaaaaagactttaaaggaagaaacctcacttaaacaataaaacgggatcccaaaggaaatgttaacataaacaagaggtcaccctcaacagaaatcaaactagcaatcagagtgccatgggtactgtatatgcagtatcaaggcttggcaaaatttcacaacaaagaactgagcatgtcacagcaaaacaaagtctatcccatttctaacagcaaaatttaaattcaagacaatgtgaagctaggtgcagaaaatacaagatctaacatattaaccattgaaaggccagtctttatataagaatttgacaaaaaatcaaaatggcatgattttataattgtaatatgtttattttataatcgaaagtgttttgttaaaataaattgtgtaattatttgcagcatatatgattacattcaatattataaaatgtaaagacctctaacttcacatatcaacattcaactatatccaaaataaaacacaagtctattatttcagattacctactgtagttaatatttttaaatttttaaattttttcagttagctagatttttgaaactgattatcaaacttcttaaggataaacaactaactcttaaacacaggagccacacatatcaaaaggagtaagttaacagtattatatttattcaatactaaataataacttcacctatcatttcctgaatacctactatgtgctgaatatttaaccctcaaaacaccctggggctcactaaatactcatttcaactcccttttctctttccttaagaaagatttttaaaagaactaaagagaacttctataaatgaaaaatataacaataaaatctaaaatcacaataactaatttaaaaaggagatgcagcacaaaagaattagtaaaataggaaatatatcagcaaaaattaaccagaatatagatttttcaaaataaaatcatatgtatcaataatttaccaaaacaataatttacaaaaataatttacaatttataaaagatctcaaaaagcatttcaaactactttcttcaataagtacatgtatttatacagaaaaaattaaactaatattttacttctcttttttccacaaaaacaaaggaggggaaacaggagagagtgaaaaaaattacaggtcattctaagagaccctacatctagataacagaaattccagagaattaaaagaaaaaaaaatgaagaggaaataatccaagaaataattcaaagaattttcccaaaagtgagattactgactatctaaagtgaagggccagcactgtggatattaataaacctacgccaagtcataacatggtcaaatttcagaacgccaggggaaaaaaaaagaaaatcttagatctcagagaggaagacgacaaaaagcagagaaagaaagaaagaaacatggattttatattacaatgacattctcaagataaacactactagaagctagaagaaaatagaacaataccttcaaaatttaatggaaaaagtatttccatcctacaattctatccggtcaaatgatcaattaagcacatgaagataaaataaagccattttcagatatgcagggcttcaaaaaaatattatttcccatgtactgtttctcaggaagttacaggaggttgtgacccaccaaaacagttaaataaaccaagaaagaaaaaaacaaatctaaggaacaggtcacgcaaccaaagagaaatagggaagccatcttctggataacggtgaagtgaaattccaagacaatagctatatggcaggtgtcaaatccaaactggagtagatcagaaagttctgagatctccatccatggccgtaccaccctgaatgcacctgatctcgcatgatctcagaagaaagttctgagacctcttcaagatgatcaaacagcacacctaaaaggaggtttacactatgggggtgagtttaggggaaagtctgtgataagtacatttcaaaacgtggcaaattaaaaagaattattaactacaaggagaataaataagtaagaagttaccaggtgggtcttactatagcatacgaggccctgcatgattcagcactcaccacgctctctttgacctcaccttattactctgtgtcactatctgcttcagcctaactgtcttcactgctgttcctagaaaatgccaagcacacttctaactcagggcttttgctttggctattcctgctgatagaatactcttcccccagatacctaaaaactagtaataccctcacctattccaagtctttgcaagtcaccttcctcaatgagggtaatgtggccaccatatttcaaactagaacttgccccctactctcccacccttccattctccatctctgattatttttttcccataatacttagctcctcatgtactttatattcattgtttgttgtctgtcactccctcgaaaagttccacgaggaagatataccctaagcacctggaacagtatgtggcacagagtaggaaatcaataaatgcttgttgaatgaataaatgaataaataaaaatggaaaatcactgaaatcatgaaatatggaaaatcattgaaatcatgaaatactatacaagcttcttttcttacctgtaagtatcagctacataaccataataataatcatactataggacaggcatggtggctcacgcctgtaatcccagcactttgggaggccgaggtgggcggatcacgaggtcaggagatcgaaaccatcctggctaacatggtgaaaccccgtctctactaaaaatacaaaaaattagccgggcttggtggcaggcgcctatagtcccagctactcgggaggctgaggcaggacaatggcatgaacccaagaggcagagcttgcagtgagccgagattgcgccactgcactccagcctgggcggcagagtgagactccatctcaaaaaaaaaaaaaaaaaaaaaactataaaattatgatataacaggatttaacatataacaggagaacaaagtgaaaattctttgtgcatactcgtggtagagtaagaaaactaaatatccatcttccacaaagggaagtaaataaacattgtgtaaaattggaatcaagaagtacaatgtaagctttttatttaaatgtatgaaaacaatcaaaagaatcaattaaaatagctaaaagtggttacctttggaaagcaagaagttgggtggaggagtcagtttttaaaactaaacacttgaaattatgtgcaaatacaactcataaaaattaaatgtaaatataagaaaaaatttttaagaaaagtcacatcttggtaaaaaaaaatactcattatgcatataatagactaagaattaatatctagattatataaaaatgtcaacaacaaaccccctatcaaaagaaaagaaacaaaaccagcatttcatagatgagaaaacatgaatggccgataacatatgaaaagctactcagtttcatcagtaaccagggaagtacaaattaaaaccagagtgacatgttcttttacacctaccaaacgagcaaacatttaaaagtctcacaccatcgagagcactaacgagaatgtgaaacgagagacactttcataagctgctgttgggactgtaaactggcacaaatactctggaaaacatttgacattatctagtaaagttgaagatgtactaacctgacaatccagcattggcactcctagttacatatcctatagaaacttttgaacatatatatcagaagaatgcataattatttctaccacagtactatctttataacaaaaaatttagaaacaaaccaaattttcatctataggagaatgaataaatatgttgcaaattatttgtaaaatgaaatgtcctaaatagtagttaaaaatgaataaactaaagcaaaacgtgcaccaaaaaggaagtcacgaagtgagacttgtatgtcttctgtgtgattccatttacgtgaagtcaaaacagcaaaactaaatatgaatgagtgataaaactataaagaaagcaagaaaatcatatacacaaaactcaggacagtaatcatctctagaacggagacgatgggattggggaagagcacaaggaggacttcggggggtgtgcgtgtgtgtgtgtgtgtgtgtgtgtgtgtgtgtgtgtgtgtgtgtgtgtgttctagtataaaaatttcataataataaagtcctgaactaaacacagacatatgactgaatagaatacaaacctgcatacatttccaaggaaaaagacttaagtatactgagattccaagttaaggacttgtcaataaacacagagtaaatctcaaaattcaaaaactcaagttatgtttgtcttattcaaaatatgatactcttcccatttatgaaaccaaacatttagcttggctatcctataaaacgtatatggcttctgttctcaaataacaaaattaaaggggagaaatcactggaagtagaaaatgccataaggtttctagtaagcctcaatgtagatgcaaatacacagaaaagtggcatatgtgaatgatgggacacagttgctggaaggaactgtgcaacatcagtgcagcggtaactagcaaggaaagaaagaagggaagtagcatctactgaggccgttctgtgtgagggcactttatatatagcactagttctctcactaattctcttgagttatgtatcatacccattttacagatgagaaaaataaggtccgggggttaaaagaggagaataaattcctcattgaatattcccagtgccccatctggctcagaagagctcagtgagccagatagataagcatgaataatcagatgacaacagtattatagatattaaagataactacgcacaagaggaggaaattaagaagtcaacataagaatcagaatagtttcttctatctgaatctatgccaacatttctatgtcccactaaatatgagaacaaatggttacttacctgtgaccagggtggtaaatagctgtgttgattccatgaggataatgactactgaagctgaaacagtgactttcttggtagctctgatttgttccaacactaaatttaagagggtatgaaagaagtaaataccattaaaccacaatgaatatcactaaatacccaataaaatgtttagaatttaaaagacagacaataccaaatattgctgaggatataaaacaaccagaactcgaatacgtcacaatgagaaggtaattgataaaaccacttggtaaaaagtgtagttttttataaaaataaactatgtctcccctatgacccagcaatcccacttgaagatactgacccaagagaaatgaaaatgtatatccataaagacttgtacaagaatggttgtaacagcattatttgcaggggccaagaactggaaacagggttctatcaatagaagaatggatttctaaaatcatgagctattcatacaataaaatactaattgtaagtaaaaagaaataaactagtgatgtatgtaaaaatgtgaatgaatctcaaaatatgatgaatgaaagaagacttagataaaagagtacatactacagtcattcctaggcatccctggggaactggatccaggatgctcagaggataacaaaatctgtaagtgtttaagcccttgatataaaatggcatagtaggccaggcgcagtggctcacgcctgttatcccagcactttgggaggccgaggcgggcagatcacaacgtcaggagatcgagaccatcctgactaacatgatgaaaccctgtgtctacttaaaatacaaaaaaattagccaggtttggtggcgggcacctgcagtctcagctacttgagacactgaggcaggagaatggcatgaacccgggaggcagagcttgcagtgagccaagatcactcaactgcactccagcctgggcgacagagcaagactccgtctcagaaataaataaataaataaataaataaataaataaataaataaaaataaaaaaataaaataaaatggcatagtattttcatataacccacacatatcctcctgtatactttgaatcatctctagattccttataatatccaatacaatataaatgctatgtaaatagtagttatactatattgttcagagaatgacaagaaaaagtctgtacatgttcaatacagacacaatttttgaatgttttcaatccacagtatcaaatctacaaatgcagaacccacagatacagagggatgactgtatattattccattaacgtaaactattagaataggcaaaactaatctgtgattttaaaaaaattttaaacactagttgttctgggagtgggtatggaaagagatttactcggaaggggcatgagggaactttctagcatgatggtaatgttccgtatcttgacagaggtttgaactgcacagatgtacgcatttgtcataactcaccagctggtataatcaagatgtatgcatttcactgcatgcaaattttacctcaaaaggaagaaaactataagcaaatattaaactctaataatatgcatgctaaagcatttgagtactgatatgtccaacttactacgaaatgattaatagccggatagaggggtggatatatgaatagaaatatgatatagcaagcacagtaaaatcctaattgtagaacccaagtggaagtaatgggtgttcaccacaccactctttcaaattccctattatatttgcaatttttcataatagacagaaagcaaaaaaaaaaagaaatatcaaaatctgacattaaaccagagaaataaacattatttcaaatatggcttccaaagcacatttttaccttacaaggtaacttctaagttctcctcggtaattgatgaccaggagttctgcagaccactgtgcacttgctttatattctaaaaatatcaacccagcaatggcatagcttaagtcacctataaaactagatgcctacagaagagggggaaattaagttactaaaaaaaaaaaaactagataaaagttaacacatgcataattagagaatatctgatacactggcttcaggtacactttatgtaagataacttcagaattgctctgtatactcaagaatcatgcaagtcagaatgcctagagctagacacccaaatctagaccagccctctcagacccaggctgaaaccacagcagcccctttgaagaagatgttcacctacataggaaatttctattcaaattgtatgtcaattgcagaaaaaaaacaaagataatgccaccattcagcctcaaaaaactctaagagcttgtttaaagatagaagcttccaaatgttaatttccactgccagcagtagcctgcggtaaaaaagtctccagtttccatttgcctaatcagcaacctaaaggaaactacacatgaaatactcactcagtgttaacctttctccattaaccaaataccaggctaaactgctaaagatttgaaggcctgtacatcttgggaagcacacaaaataaagtttatcacccatgaaggggattcgaatatgccgacccaaaatatgccactttggcataaggattattttgagctgaaggcaactgagaatcaacagacgcaggaaaaattctttgccctccccttaactgcctaaaaacaaggcaaaaatttatctttgtgacagtgctcctcagtaccaggaggaggagatggactcatccctggaaaccagaagtcataccaagatgagtctgtgtaaacagaccttattaaaatccctttcttccattaatttgtcccatgcatttcttagtcactttcccacaatttaccacctcaaaaagccaaaattccctttcctttgtctagtcacatctcaacaatttatatccctctattaaaatggtatataaggctggatggggtggctcacatctgtaatcccaacacattgagaggccaaagtggaaggaccacttgaagtcaggagtccaagacccagcctggacagcaaagcaagattctgtctttacaaaagtttaaaagattagccaggtgtggctgcactatgatcattatcattacaccactgtgctccagcctgggcaacagcaagactctatctttaaaaaaagaaaaaatggtatataagcctgagtctaaccacttctttgagctttcacgtcttttctgagaagctccctgtacatgtaaaaatattaacatcaataaaaactgtacaacttttctcctgctaatctgtcttttgtcagtttaatttgcaggcccctagctgctaaatttaagcaggcagagaaaaagtttttcctcccaatcacccctgaatggttcctcattgtctagaaccacacagtcaacacttgatacacggctagtccaaattgagatatgtcataaatataaaaataccatcaaatttcaaaaatttaaaatcaaagaaagagcataaactatcacattaataatgttttatattgattacatgttgaaataatattttggatatattggatgatataaaatacagtattaaataaatttcacctgtttcttattttagcttctcattgtagttactattaaataaacttcacctgtagttattgtatatgtgaccaaatataaaattacatttgagcacacatacagctcatattgtatttcttttagccagaaatagtctagaaaataagaatccagactccttattttggctaagattcccagaatatgagcacaacacacgtttttagtttctccactcattatttctgaaaaaaaaatcattatctatatcattggttttcaaccctagcttctcactagaatcagctaaaagcttataaacaatattaatacccaggccccacaaagatcaaatgaatcagaatctctgtgagtagcgcctgggcaatctggtaatttgtttttttcttttccttataaagctccccaggtgattctaagatacagccagagtgagaaccactgttctatctgaccctgtatctcgttcagttgatgaaggaggatagaaactaaaaagcactatattcctagaagagacattattcacggaattgtcatacaaaagtcattttgttcccactcaatcttagttttctagacaaaatgagaacatctgcccaacctactcaaagggctgttatgaatataaaatcataatatatatcaaaggcattaataaagaataaaatagtatacaaatacaaattactactaccatttgtttttctctactcgccttttcaatttctatttcctgtagggtaacgaattccaactcctcttgaagttgttcctgttgtgacagaccactgacttctttctgtcactagagctttatcacaactttctgtacctatatttagtgtttacttactaccacgtggtttacatctggatagtgtattacaaaatacaaggaataactattgcatgcatacagatttctaactagattctgggcgtcttaagtccacagcttattattctgatttatatttgtattatcccccccttcacactcttttattcaagtacctatacatacatgacattgaaaaaactatgttttcaatttaagctatgtacataccggggaaatgacaaagagttcacttcccatgagatcaaacaccctcacagttcctgtgctttcggcataggccagtagggtacaatcgtaactccatgctacccgtctccactggggtttcgggtctttcggaactagaacaaaagaaaacaagaggtgcttctaacaatatattacaaagatagttaatgcttttagtaactgcaactaaagtaagtattcaagtacaataattacgtcatctcctaaggatctctaataaagcttccctcaataaaaaagagcagtttccagaaacacacttcaagtaagagtgggaaatacaaaccactgcaactatgccctatttattttagaagcaaagtctactgatgcatggtctgatgaatgctgagcatcccctggtctggtaaaggcccaggaataatacacctcaaaatatctgtaatactcagagagatctaaagcatacagaatgggtagacaataattctaatccaatgagttccactcctctaaaagcaaaaaataaaaattgcaacttgatcttttaaatacatcaaatatagaagccaagatacaaattgggactatgctaacattgtattagaaaggggggaaatatatatatatatacacacacacacacactcacacacatatacatacacacatagaaagaggcaggtaaatcaagaactcatgagtcaatcacacaatttcaagattttgataatcaacaacttaataattctaataactcagcaactgaatttttttctgttctgaattttcagtaaaatagagagaaaggctatcagctgcaaaagaagaaaaagaggatgtgaaactctatgttagatttgtttgagattttttattgtttcgtttgcttcggtttcatcttattggaatctcagaactgaagagttaggtagatagacaagtgttcttcctttcccaacaagaattcaaaatgagtaggagactcaaggtgtcaccttgagtcaagagtagaacaaaacccagaacatcagcatcctgtctttccatgcagtgcaggtgtcattacaacacactgcctctccaccagagccttacaattgcctcaaaaatgctccagaaacgtatggccttcttttgatgcctctgccactatcccagctcaggtctcaccatctcctgcttggcctactaacaggtcttctgccatctgtctcttcccttctattccttcctccatactatcagacgatatctttctaaaataacaagataaacagatcacattcttctgccactttaaaagtcctgaaggttctccatttccaacagaatcaagtccaaatgcctcaatatatatgaaaggcccttcccaaaaggccccattgtagctttccagttttgccttctaccacttcctctgtcatatacctaataacccactcataccacgacaacctggcaaatgagcaaatatatgccttttgttttgttttgttttttgtttttttttttgagatagagtctcactctgtcacccagactggagtacagtggcgcgatctgggctcactgcaacctccatctcctgggctcaagcaattctcctgcctcagcctcctgagtagcttggatacaggcgtgtgccactaagcctggctaatttttttgtatttttagtagagacgggatttcaccatgttggccaggctggtcttgaactcctgacctcaagtaatccgcccgcctcagcctcccaaagtgctggaattacaggcgtgagccaccgcaccccgcccatacgtgccttttatacatattgctgctctacctagactgttcatctccaatcttactcatccttccaggtctagtttgttacctcctccttccttgacacccttgaaaactggctgctctgtgccaccaaatattctgtacatacctctttcatagcatttatcacatcatattgttgtttacctatttgccccacaagtctctgagctcactgaaatcagaaacaatgtcttattcaacattctattcccaggacctggaattcaaagtgattaatgtttcactaacgagtgacacctatgtctctcagaaaaaaaaatctctattaacagggcaaggtaatggtaagagttcaccatccctccaggactaccaatgaaatgtgaattctataacggaagtcatctatctacctaaaagaaataatgtgtagagttcagacttcccttaactttgtaatacatattctagggaatatatggggaaagtacaccaggcatcaacgattttcttcattttgattatttatcaataggttaaaagtatacaaaaaaatcccggagaggtcattcagcatggataagtctaattaattttattaaagcctaacaagatactgcatacattctggaacagccatttttgtaagtgggaataattttttctaaaaaatcaattccctgtctttagactgctaaaataaaaaatcaaacttcacgggagggaggtgggggggtcagccccccgcccagccagtcgccccgtccgggagggaggtgggggggttcagccccccgcccggccagccgccccgtccgggagggaggtgggggggttcagccccccgcccggccagccgccccgtccgggagggaggtgggggggttcagccccccgcccggccagccgccccgtccgggagggaggtgggggggtcagccccccgaccggccagccaccccgtccgggagggaggtgggggggttcagccccccgcccggccagccgccccgtccaggaggtgaggggcgcctctgcccggccgcccctactgggaagtgaggagcccctctgcctggccaccaccccgtctgggaggtgtacccaacagctcattgagaacgggccatgatgacaatggcagttttgtggaatagaaaggggggaaaagtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctcggcctaggaaaaccagagacctttgttcacttgtttatctgctgaccttccctccactattgtcctgtgaccctgccaaatccccctctgcgagaaacacccaagaatgatcaataaaaaaataaataaataaataagataaaaaaaataaaaaaaaaatcaaacttcaaagcaggcacaggtgcaaaataacaaaagaataaaaaattgacatatgcacagatgctacataaaaaccagcaagatgacaattttcccctgaaaatatttatgtgctaaggaaacactaccatgtgataacagatttttcctcttatttcattttgataagataaacagattctatgcactgcattgcatctgcaagggatttgcttttatatgctagttacaaccagtaactccagaaaactcagcaggtgttttgacctagataaaaatattttttcattacaaggtaagatttcatataacaatgtgaaaataaagactttatcactggatttttccagttgctcgtgtggcttgggaaaggaatgaacagtacagatttttacaaagcaagagtcaatgaagttgtctgaaaagtatgcaagaaacactgatggtaaaagttaaccagcaaattgacaactgacacatgcatggtgaaatcaagtctataccccccgactcatattttcatcagctgtagctcctcaaatctgcccggttgccaagctctttcccatctcacagcttttgtggatgctattttctctgcctggaacattctttccctaacactccactggctttttttcatctttcaagcttcactttaaatagcacttccttagaaggcattctgtgaccaccctaagtagcctctgagccccattattttccaccagtccaatgatttcatgtccttcacagctcttacgccaaataatcatacatttgtttgttatatcagtccgttttcatgctgttgataagacatatctgagactgggcaatttacaaaagaaagaggtttaattgaatttacagttccatgtggttagggaagcctcacaatcatggtggaaggcaaggaggagcaagacccatcgtgcatggatggcctcaggcaaagagaatgaggaagatgcaaaagcagaaacccccgataaaaccatcagatctcgtgagacttattcactatcacaagaacaatatgggtgaaactgccacccatgattcaatcatctcctactgggtccctcccgcaacacgtgggagttatgggagtacaaatcaagatgagatttgggtggggacacagagccaaatcgtatcatttgtcagacattttattgtctgccttatttgttaatctataaattccaaaatgtcaggagctgtgtctattttgttcataatgtttatgaccagtgcctagtactctggtgggacataacaaacacccaaattctcaaggagcagacttcaatccagtgcccatttacccaaactagcaatggaaatgagcaaggatttaaaaataataaacactgggttcttgtctcagtgctaccacaagacacctgggtatgaccctgggtatggtctcagtttcctcattttcatagtgaattcaatgaacaatctctcatatatatacattctttacttccaagtcaagtcaagaaccagtgagcaagggcaaactagtgggagtggaaagacatcagagaagccaaatatgtaaatgttaatagtgtcgccagaagaacacaagagaaaaaccttaacaattctacaataagaaaggcctaaatataagaaactctgactttataaagaaaaaaagtgacaaatggtgaagggagggaggaaggaaggcgggaaagagggaagcagggaagggaggaagggaagaagggagggagggaattctctatgggaaaagatgccacaacaaatttaaaatcaattggataaaaacaataggcataaactttgcaaatttgaagaaatctacaaaactgcttatctagaagcttaatgaacttaaagcaggataaactcaaaagctatcaaggcacatgataatcaatgtctgacaaacaataataaagagaaaattttaaagtagacagaagaaagaaacacaccttctatccaagaaaacaatagcaatgactcccaatttcttgtcaaaaacaaaacaatgacatctttaaagagctgaaagagccaggctcagggctcatgcctgtaatcccagcactttgagaggccaaggcgggtggataacgaggtcaggagttcgagaccatcctgtccaaaatggtgaaatcctatctctactaaaaaatacaaaacttagctgggtattgtggtgcacgcctgtgatcccagctgcttaggaggctgaagcatgagaactgcttgaacccaggaggtggaggtcgcagtgagccaagatcgtgtcactgcactccagcctaggtgatagagcaagactctggctggcaaaaaaaaaaatatatccaatacccgcgctatacccaagaaccaaattcttttaaatgtgaaacattcatgaagacagaatatatgctaggccataaatcaagcctcaataaatgaaaaaggttaaaatcatgttgtttatgttctctggcaacaaaagaattaaattagacgtaattaacaaaaagatgcttatattagaataggcttaatttatatatgaaaaaagtttaaattcagtaatctaaatttccaccttccatctataacaatgagagcaaattaaatcctgtatgcagaagaaaggaactattaataagggcaaaaatcaaggtaagcaaaaaaagaaatccataaaacccaaaattttttcttgaagaatattaacaaatggacaaaactctggcctgactgatttaagagaaaagggaaaaataccaagtacaaatctcaaaaccgatacaggggacgtcagtacagatcctacagacagaagggtaatagggaatattataaacattaagccaataatttctacaatttagggaaaaattccacaaaaactgaaataaaaggaaaccaaaattttaaaaagccttattaattactagtattttaactaaactcaagatttaaaattggttaattaaaagactgcttacaagaaaactccaagtttcactggtgaattccatcaaacatttaaggaagaaataattcaattctacacaaattgtttcagaaaataaaaaaggagggaacacttgccaacccttttcaaaccagcactactccaataccaaaccaggaagatgttacaaaagagcaatctaaataccaatatccttcatgaacgcagatgcaataatctgctatgttttacacaattatctgcataaatgcctgatgatgattttcccttgctggtggaatcaaatacaatatctagtggcttgctgctcagagatcaagtttataagcatttcctggattgtctggatagctgggagacctatgtcctaacacctaagacgctattcagtagaaatgatcaaaaaagataactctggaaagtgcttcttaaacttcaacctaaaaattactcttttttaacaacctatctttaagtgaagaaatcagatcacaaaacacttattttcatagaacatatctacagtaacaggtacaggaaaatgtctgaaacaataaataaaatgttgatagtatttatctcttggtggtgagcttatttttcttttcttttttctcacttttagtttctaaagtttctacgaagaatgtgtattatgttttcaataggaaaaaattacttcatctaaacttcccaaaaaagggcaaatggttatcatataatctgaggatcctgaatcacaattctggaacaaaatgcttcatttcaaagtctgggtgtttcagtcgggcatggtggctcacgcctgtaagcccagcactttgggagaccaaggcaggtggatcatttgatgtcaggatttcgagaccagcctgaccaacatggtgaaaccccgactctactaaaaacacaaaaattagctgggcatggtggcaggtgcctataatcccagctacttggagtctgaggcaggagaatcacttgaactcgggaggtggaggttgcagtgagcctagatggcgccactgcactccagcctcagtgacagagccagactccgtctgaaaacaaaacaaaaaaaacaagtctgggtgtttcaaatagtctatccttcccaacctttttcatgtcaacacacagagaaaatcatatttgtatggcatctaacagtaaactgatgaggctgctggaagccagaggcaaccaggagaagttcaagctgtcagagtgcccacccagccactggagggctgatgggaccttaccatacctatagtaggcaagctgttgcgtacagttaggaaactcgcatttatggtatcccaaaatcaaaactatgaaaaaatctgttgactaccatagtacaactctttttaaaaactctaatttcgtgtgctatttttagttcattattcaggtagaaagagaaaactgaattcctatttatggcctaacagagccaaaacaagttacaatccacatttaaaacattctcgaatggcatgtattttataaaacaataattgaaaaatatcagagtagaaccaaatagctcctatttcagtttgtagactctgcaatatgtagtttcaaaaatgcattaacaacaatctggctccttttctgcaggcacacacatgaaatatcatttggcatatgggagttattcccataaagatgagtcagataacaagcaaatgatcattacctcacattatgtgaaatggaaagaagccattaatgcagtattaaggtcataaattcacacacacagaagccaacaaaataaaacattagctctcaaagcattattttcttatccttgctgccacattaaccatacacactaaaaactctgacaaatattataatttgtataaaatacagaagggtaaagcttcccatgttcatgttaatttgtagatttctcgatttacctactggctaggagcaggtatctaatgccgaagctcaaaagaaccctgtatatctgaatcactccaacactctaagcacgctcctcagaaacctatcttaggccccccaagctctcacccagtgaaagggctgcactgggaaaaaggcaattgaatacccaccaaattattcttctggcaacttcttgacctttacatattatttaagcaaggcctggtctactctaaagcactggtgaggaaactacagaaggtatattcaaaaagggctagagccccaagctttagatattcatacttaaacactacctccccaaaaggattaggcaaacaggtcttcttatccacccttattgctctattcatgctatgtgtatacatgtatacataaggaataaaaaatattaatgccatgacagttttccacaaatttatacatggatctctataatatgtataatatagacagtattatatataataaatacatgtacacttttgtgaatttctaaagttaaacaagaaacaggcaaacatactttgttggtatattcattcatccataaaaatcatttgaatagttcccaagtgccattacccacttgatacggtcaaaaattgtgtgcctacgatgtgtcaggcaccgtgctaagcacgaaaaaaaaaagttatattgggtgagatatggcccctgccatcaaataatttacaatctaattgggaatccgacaagcaaatcaacaattaaaaaagaaatcaggcaaggcacagtggctcatgcctgtaatcccagcactttgggaggctgaggcaggtggatcacctgaggtcaggagttcaagaccagcctggccaacatagtgaaaccgcatctctatcaaaaatacaaaaaaatgccgggtgtgatggcacgcacctgtaatcccagctacttcaggaggctgaggcaggagaatcacatgaacctgggaggcagagggtgcagtgagctgagatcgcaccactgcactccagcctgcgcaacagagcaagacttcatctcaaaaaatatatataaattaaatcaataaaaaaggaaagcaggctaagtaagtgctgtgatataggcagaagcaactagatgggaaacatgaagatgtacaaatggtgggagcgaacacagggaggagagccgatgcttgatctaaaatatacaagactaattaattcaatacaaaggtaggagcttccgagaaaaggaaccatctgtacgtgaaggcatgaagaacacaatggggttagaaaattgcacactgttttgtactagaacataagacatatagcaggagactctcacgggatagacaggctgattgcgaaaagtcttttatcgtaaattagaaaaaatgaactgtattccagtcaatagcaaacaactgacagatttcaggtagaattatagtaacagtaattataacaatagcttaacatctcctaagtattcatgatgtgtcagacactatgccgagagttttacatacattaattcatataatctttccacaactcaatttataaaattatgcccattttacagataatgaaactggggctcagagaggtaacttgcccgaggttaccagaaatctagaaagcagttaagtcagatgtgaagggttacctgctagaatagtgtttttttaatgatcaatttgccaaggagtataaagtgtggattactagagggcatacagaagaaaactttgtcagcagactgttgtaagaaaccaagtaaaaaatgttaagagcctgaactaaggctgtgatggtggaagtacacaagtggaataaaagagctatttaaacaggctgagcacagtggctcatgcctgtaatgtcagcactttgggaggccaaggcgggaggatcacttgagcccatgagtgcaccaggctgggcaacgtggcaaacccctgtatctgtaaaaaacacaaaaaaattagctgggcatggtgacacgcacctgtagccccagccacctgggaaacgtagatgggaggatcacctgagcccaggaggttgagtctgcagtgagccatgatcatgccactgaactccagcctgagcgaaagactgagaccctgtctcaaaaaaataaataaataaataaaattactatataaataaataaacaggctcccagggcttggtaaaattaagttaaaggtgattcttctccatcatggcacttaagtacaagtacagtcattatctgttatctctctctcaaaggctgggcacagtggctcacacctataatcccagcactttgggaggctgaggcaggagaactgcttgagcccaggagtttgaggctagcctgggcaacaaggcaagaccctcgtctctacaaaaaattttaaaataataaaaagttagccaggcatgctggtgcatgcctgtggtcccagctactcaggaggctgaggcaggaagatcacttgagcccatgaggtcaggctgcagtaaaccatgatcacaccactgcactccggcctggcaacagagtgaggccctatctcaaaaaataaaaataaaaaaagaacagcatttccatgagggagtgggggaatcttctgtattaccacattgtagctctgaaaactaccagtgcctcccacctccttgctctctattgatgtcaaatacatattttatcctaatactgttttaagataaaatatttatactgctttatttccattacacaagaaaatcatgtaaagccctaaatacagtgccaggcacacagtaagaacactataaatgtttgtcatcaacacaatgaccatgtttaccattattatacttcctacaacaattacactgttaaactaacacaagatcagacagatggaactgtaggtcctgtaaataaaacataggtaatagatgcatttacctaataccaccctttttttctcctgtaaggttccttctttctgtcttttctttttttttttttgagacggagtctcactctgttgtccatgctggagtccagtggctcaatctcggctcactgtaaactccatctcccaggttcaagtgattctcctgcctcggcctcccaagtagctggaattacaggcatgtgtcatcatgcctgggtaatttttgtatttttagtagagacggggtttcaccatgttggccaggctcgtctcaaactcctgacctcaagtgatccgcccacctcggcctcccaaagtgctgggattacaggtgagagccactgcgtccagactactctttcttaaagctgctttccaaaagtcatttttctttctcagccatctcatctgacacccccgattaagaaatctcatgggatttaatttttccttaattagatttgtcaaagtttgtaattatatatttgagcatctatatgcttcatgagataaaggagcaggtctttttgctcacaatcattcctcaagcaaccagcaaaacagcacatacacgtaaattacagtcagtaaatttttgctgaatatatttaaaaaatggccaaatcctagacttcttactagtctgtatctaactcttgacttatacctatttatttctgcatttaatccaaaataaaaggctacagttaaaaatacttcatcccataactggcttagacttttttagaacccagtttccaaatctcactaaaatgaaccattttaaagcaaaatatttaagacagtaaaaaaaaaaaaaagcagtttttaaaaattattttaatagtcatgataatccttgttaataaatatttaatatctattctaacttttaagaaacattggaaaccattgcgcatttgaaattttcattctttaaatattttggaaactcttaccttgacatttcccaataatggatgtaaaatcatcttttgcagacctgtaaaacatgcaaaatcaaggcaaaagttttatcgtaacactgtatagaaccataaaataccagatactgtggactagacagcctctatatacaatgctcaatcatatctcctctcagacatggttttgtggctcaattatgacccttttgtcagtgacaatattttcttccaaccttattgcatcagatacggagctacatcgttatggagacatatatatggaatatagtgacacagcctaagtgaatttaccgtggtcttttcatacaatagagatgtctggtccccatccccaaaggttctgaatcaagaaatgtgggatggggcccaagcaaaaatatttttttgctggatacatcattcctaattaagaaccactggtctgtatcatattacaaagtttgatcacttaggggaaaaagtcttattttgagaaatcaaacagccttaataggtcaccatatttaaatcaacaacctattttaaatctgtgatcctgaaatatataccaagtagaataattattataaaatatgtttaaaaatgaaaactggtaaaccttctagaaaataatttaataacaattatccaaaaccttcatgtctgtagcatttgacctaacaattctatttctataaagttatccccaggaaataattacagatacatacagatatcaaaaaaactggtatggtctcatttataaaggagaaaaataatacccagtataaagagattaaactttgctatgtgcacccaatgaaatattatggaattactatagtcgacccttgaacaacacaggtttcaactatgcaggtccatgtctatgtggattttcttctacctctaccactctgagatggcaagaccaccttctcttcctcctcctcctcctcagcccactccatgtgaagatgacgataatgaagacctttgtaatggtccacttccacttaatgaacagtaaatatattcctcttccatatgattttcctaataacatttcccaaagaatgaactcatttttctcagttgctattgttgctatttctttcataactgatatactgtttaaaaataaaacacctgaaaagtccagcttagagatgtcttttagatgtgtatataataccactgaatgtctcaagaggacagacagcataattggtctcaagtaatacgtaacctaggtcatttgcacactcatattccatctacagttttgtaccaacagagaaaaagcatacctattttttttttttttttttgagacagagtctcgctctgtcgccaggctggagtgcagtggcacaatctcggctcactgcaactagttctcagctcactgcctcccaggttcaagcagttctcctgcctcagcctcccgaatagctgggattacaggtgtgcgccaccatgcccagctaatttttgtattttcagtagagacggggtttcaccacgttggccaggatggtctcaatctcttgaccttgtgatctgcccgcctcggcctcccaaagtgctgaaccatccctactcttttacaccttcctgagtttctgtttagctaatatagcagtaaatagtcacacaacagtgatttccagagttctggaggataggcctcatttactgagaaagtaaaacttcttaagaggcaacggaatgatctggggaaggagaaagataagcatataactctgagaaagcatccttaattttttaactggcgtaagttggtgtttgacactcacaaaattaagtgagttaataataaaatccttttaaatatatcccctataaaaatcttagtttccatttatagagtaacaaatatttctcaaaggaaatcttgaatatgaataatattaacaattacctgatttccacacactgatcttgaacagcagccaaaagctttccattgcttttatggagaagaaagagggggaagaaaatctattatgaatatctatagcagttttcagcacagatggaattatttaataagttaaaaatcatttttaaatttgttcacatgctttaattatccatcttttgaccttacaattagatgaggatacaggtacaaaagcacacaaaatgatttaatacagcatgaattaacatgtttaagctctctctcccccactctccccatctctctccctctctccccctcgctccctcccactctctctccctctccttctctttacctccctccctctttctctctctccctccctccctctctccctccctccctctctccctctctctctccctctctccctcttcctctctccctccctccctctctccctctctctctccctctctctctttccctctctctctaaaaagtttaaacaatactaaatatttgcaacaaagaaatttacacacaataaaaatcaagactgaaagccacaagcattccaaaattaacgtccataatgaaatgtaaaagctaatccagacagaaaaacattgaatttcacacttccttaccttgcaagtaccaaatgccagtttatctgtttattaaccaagcgaaccagtccatcagggagcaaaaaaggtgccgggctgaaatcacaacacattagttagcttaaaatctaatcatgaaaaccacatatatgcagacaaatagcacatatacttatagagagagacacagatttttttccattagaatataaaatttgaatattagcaaacccaaaacccaaagttactatttggtagctgaaatttgaccatatatatttctctatttccaaaaaacacagtgatgtgttcaaaggtataaatgttatgtacttcccaggtaacagacatctagcataccaatcacagagcagagtacacttataccaaccctttctgctctaactacctaggaactctggctcaactgtaacaaaaacaaattctagcatagagttaaactcacaagaaagaaagataaatttccaagtactagaaatgaaaaagtcactgaaagctagaattgggcacagggtaaagagagagataagaactcaaaacaggacttagcacacgagataggaaatgagctactgaaccaaagagaggacaggagttggaagtgagactcctgcaaaggccaggatgctcaaatgactgcaccaggtcattgaaagaactagaaacacctcaccataggcccagggagactaaagactctcttctctccctggaactatggttctgtggaggataagaataaaatctcctatgaaaaagtaaaagtccaagtctgtactatatgtaagatcagattacaatttcactttactcatgtgatgcaagaatctgcaagcataagttcaaaataaaaccattcacaaaagacacgaaactactcatcataagtgagtaagcagacacagcaaattagaggattaatacccgaagaaatcaagaaaacagatggaaaagaagaataaagaacataatttcatgaaatagaaaaaaaataaattatggaaatcagaaaacacaaaataggattccaaaatgttagtggccaggcacaatggtatgtgcctatagtcgcagctacacgggaggctaaggcaggaggattgcttgagcacaggagtttaaagctacagtgtaccatgatcttgcctgtgaatagccactatactccagcctgaccaacacaataagaccctctcttaaaaaaaaaaaaaaaattagtaatatacatgtagtacatttacgctcattttttaaaacacaaaataatatcaaaagacagttacaaaaatataatgaagatacaaaacatgtatgtgaatactacctatatgaggatgataatttcctctagaagggaagggaaaagaaaaagggaaaggacttgagatgtaacattttgcataaaaacaaaaagagctagctgatacaggtttattatattgtcaataattctcagtatgtttatatttcataattaaaagaacttttttaaaaaaagaagaaaaagtcacttgaaacaaatactgaccccaaaacctttgggtttaattaccataaactcaagagcacaaattgaactataatctttttgaaagcagcatatcatgagacagatgaatcacttaatggtgcatttgcaacctgtacaatgattcaaggaaaaaggcttctcaggaggaagggagacaaaaagatacctacttctgatgcctgatcataaggttctcacacagaggacagggcttgtagcagagttaactttttgagtcttccttctcaataaataaaaaaaagaattatcaagcagcaacctgaacaagacaagcttgacacctcatccaagggtgttcaggactaacaagctgtcgcctagagaagtcagaaaacacagcccacctcccacactcctatcctctccttccactctctcttcctactcattgctctatcctatcatatcccacacccacaaaaaaagtgacacaattaagtatagaaattgtaaatatgcatacatatatacatgtatgcacatacacacacacatacatagagtaaaagcagaaagacgttggagcaagtcctagagaacgccaaaggtctcttttatggaactatattatctctggaactttacgacaagatatcctcaacgaagaagcaatctatgtaaataattctataaaacaattcctacacatgtatctaaaagcagaattataacttttttgtcataataataatttctttgttctttctaaagctggaaattagcatcatccctgcaaatatacttaacactcaaggaattaaaaaatatacaagaactgaaacctaaagaaccttctctgatatacagcagttgaatattaaccacaagtgagatgacatgacaagaacaaaaatgtattttaaaagatatgcaggctacagatgcttcatatggacattcaagataagcctgagaatagtcatcagaggaagcagaaattgtcatgagacattcttaatagtaactaagggaacaaaaactaccctaagtctactgagatatcttgtcagattctacctaaatgtttgaaatgtctcatactgagtttgcctgaatgtcagcaactttatcatgatctagaattcaattatgaaaacaaatcatatatagaacaatattgtttatatttgatgttcatactgtttctctgaagaaccgaagactcacctgtaccagatgtattggcgtaaaaataataaacgatctgtaatcaaaagaaatggcaaagccaaatataaatcagctgttaagaatcattttcaaattagatttatagatgagaaatctaaaatatactacagagcgagtcattaaaaaaaataaagaactcaagtcttaaaatgagagactaaatataacctaatatacactgtaacatttacagggtcatatacttattaaattccatgtttgtgtgttattcaaaagtttcaagtatttcctaactgttcaagaaataaaagcagtttgagatgttaaatttaatctaagaagctttcatgaaaccatggactagaagttataataatcaccccttagaaaccaaaatatttgtataaaaaattaaagcaagatatattttacactttatagcaaagatttttaaaacagtaatacctaaaatgggaaagcccacggaaaacaaaacctctaacacgctataaaaaacaatgctttctatcatcctaaatgtacatgtatgtgtgtacctgtgtatgcagttaggtatatatcaatggaaaaatatctaaagaataacagattctctctaggtggtatgaggacaaatttttttctaatttgtagttatctatagtgtctgtattttctacaatgaatttttattatttgtacacattttctaaattctcaaaatttaaaagcatttgtcattatgaaaactgaatatgctagtgcttcttgtatcagaagataaaattaactataattaactgtaattttatcagaagataaaaggataatcagaagattacagttaatttcaagtacttaacttctgtgaaaatgaattttctctttataaggaacttaaattcactggtataaggatggactttgaagccagaaagacatgcagtcaaattccaaatgaatgaccttgagcaagttttcttatctaaaatcataaaggagtaacggcacctttctggtctgataaaaggactctattaatgaatatggtaaacccgtcatggcaccagctcagtaaacctagtgctcaatcctttctcagactcttgttagttcatacgtaaaatttgtcaggagttaaatgaataccctggcttatcaaatctgtaatttgagtatctctgaccagatctatctgaaacaccacatagacctcttaaaatagtctctcagtgtattttcaccttcaacatccactgactttctgagactcatactggctttgaccttcattccttctagaacagcgtcccccaacctttttggcaccagggactggttttgtggaagacaatttttccatgcaacctagatccctcacacgtgcagttcacaatagggtttgcacttccctgataatctaatgctgccgcttatctgacaggaagtggagctcaggtggtaatgctcactcacccatcgctcacctcctgctatgcagcctgtttcctaacagaccacagactggtaccagtccatggcccaggaattgaggacacctgttctagaatacatccataatggttaaaccaaagctatatactttagctctaagctgcattagagctaaaaacgtgcatgcgtaaatatacaaatgtatacatatacatacatatgtgtgtatatataaatatatatataattaaactcagataacacacattacttttattaggctccacatcagaagtctaaagaacacattttaactgttaaccatatcattactgtagagaaataagctatatttacctcgaattgctttcgtgatgataaaggatgcaccatgtttttggttgcctctaggctggaatttaaaacaaaaaacacttacatttgaatcttctagtagtattagaccagtattacttatacaatatgtaaacttatttttatttactaatactcagagttttgggcacagggaagcagtgtcttaaaactacttaaagactggatgttcaggtgcagtggctcacgcctgtaatctcagcactttgggatgccaaggtgggctgactgcttgagcccaggagctccagacctgcctgagcaacgtggcaaaacctcatctctacaaaaaatacaaaaattggccaggcatggcggtgcatgcctatagtcccagctacttgggaagctgaggtgacccaggaggttgaagctacgaagctacagtgagccctgatcatgccactgcactccagcctgggtgacagagtgagaccctgcctcaaaaaaaaaaaaaaaaaaaaaaaaagtagacacaggacgcgggacaataggagaaaagtgagcatagcagagctacaggcacatgtcaggactaaccttgcaggaaagaacaaggattgaagctggaaactgtttccaaatcaaaaaccaatccaaagacaagagaagtcaaggccaaagaccatactggttgccagttcagcatactctattgaggctgtaagttttgctcacaggaaaagtggtcatatctccaaggccaattcattgactatctgttgtgtatctatacagacaatgctactaacaaaacatacacagatacgtaattgctatattaaataattccattccataagtatagactgaacacaccgtgggtaggttcatgacgctaggcactgcataagatgcactaaagtgctgtcaagaaaagcacaatggacatacagtaagtgtagacagatttttttaaaaaacacagaaaagttatttcactcaataaacatgaattgattgttggattcatgcaagacacaatttggccctgggaagagatataaagatgaatcagatgtctgccctccaagagcttataattcaacagctgaaatcaacagaatgcagaaatcgatagaatgcagaaatcaattgaactcccccacccccaacacacaaacacaaaacaaagtgctaagggtttcaaagtaagttaattctgtggttacttttttggaatcaatttatggtaagcattctgaaacattactgcaattaaccaatgagtgttaaggagtggaaacttatctaaccagctgcctcagcaacagcttcctagctgcataacccaaaaaatattcacattaagacaaactaagtacttgaaattaaacagtaatatatgcagatctctacccgtctacaaaataaattattcatgataagcacaaactgcagtgggaaggaggctacagaggaaaaaaatacaaactttgggctgaaaaatgagtcgtttctccagcaaagaaacactcagaaaaaatgtaagataactcacatgggctggactacataatctttaataaaggttcttttcgatctggctgcttcctctgggtctaaaacagtaactggcacgtgttaagcactcaataaatatctgttaaataaacatggatccaaaaaataataataataaaaaataaaataaaataaacatggatccatggttcctactcttcatcacagacccgggaggccttcactaccaaacaactgataatcccaagatccagtccataaattatcaacctctataacccttctgtagcggagatcccaatcccagtcagcagctctttactctgcacttccgtggcattttgctcacatcgctaactatagcgcataaaacgctaggttatgaaaaacgtttacgggactgtctcccctctagacgagaagctccacgaaaacatattcatctctgtatccttagcacctagcacagcacctgtgacaccgagacagacgaacggacacgcacacccttattaaatgctcttttattgaaacacacaagacctggcgcgatccagcccccagtatgggtaaaggctcagattctgcgctctgcaccagcctggcagatgctgcagactgtaaggtcctggaaaattctcccatcgcagttgagcgtcggcccagactagccctagccagaccgcgagaagggaccactgagggtccagataggagaaaggaccctcgagtccagcgctgtgccttcccctcctaatacagagagcgacactaacaatcccctctcctcccaatacagagagcgaaactgagaaccaaagtgggatcgtacgctccccagagcacgaagttccagcccccaacaaccgaattctgagcccaggaagaatctcagggaccaccaccccaccccgccctagacccccgctagcccaaggtgccgttgccaaggcgaccgcacaagccaaccggccctagtcccccacccacccgtctccactcccctacgtggctcctgctacgtggctctacccacgaagcgcccgcgccaagctggctgctgctgtagatgggcctggttcacctgtacttcagtctccggtggccactcggtgttgaccaacaagtcatagagaatcgtctcctcctcaccctctgcagtgcctggactcaaagccggccctgactcgggggccgccatgttcgccgaggactcaggcagcggaggagtgtctctacggaatc

SEQ ID NO: 2613 - DNA, 394441 bp, Homo sapiens; identical to SEQ ID NO: 2612
  source 1..394441: mol_type = genomic DNA

SEQ ID NO: 2614 - DNA, 15351 bp, Homo sapiens
  source 1..15351: mol_type = genomic DNA
cgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgagtagctggtggagggcatcccgtggggggaatacgggagggacagcacggccacccttgcagtcccagggccaaccagctccagtgaggactaacggggcagggtcttgggcacctggtccctggtctttgagcctggatctacccctctgatccctgggaagacagttcccttggacccgccctgggccccagccctttactgtccccgcctgtgtccccagccaggccctcagccttagccaggagtcctctttctgctcccctgccatggccaggcagcccagcgctctctcaggtccgaggcccactcctccaggaagccttccctgactagcccagctatcagagagtggccctcccaagagggaggcctggaaactaaagctctctctctccccagctgcctgtagtgtcagttagagtcttatcctctccagtagggtgacaccatgacaggggccaatagagtcctcccatctgtccccaaggaggctggacaaatgcctgctcagacacacaagtccactgggtcccctaatcccataggaaggccagggaggaactacatttaggaaattgaagcttgtatggaacatttagtcctatgtgccaagacctttctcttttttgttatttttttgttttttgagacagagtcttgatctgttgcccaggccagagtgcagtggcacgatctcagctcactgcaacctccgccttccaggttcaactggttctcctgcctcagcctccagagtagttgggattacaggtgcccaccaccacgcctggctaatttttgtatttttagtagagacagggtttcaccatgttggccagactggtctcaaactcctgacctcaagtgatccacccacctgggcctcccaaagtgctgggattacaggcatgagccaccgtgcctggcctgtttttttgaaatgaggtctggagtgcagtggtgcgatcatagttcactgcagcctcgacctcccaggcccaagtgatcctcctgcctcagccccttgagtagctggggctacaggcgcacaccaccatgcctggctagtttttaaaatttttgtggagatgaggtttcactatgttgtccaggctaatcttgaactcctcggcttaagcaaccctctggtctcagcctcccacagtgctaggattacaagcgtgagctaccgtgcctagtcacttttctccttttctttgtaactttcagttttgaaatttcaaatttacagaaaggctactgggtgtcaaaacggtaccagtcactccaatagtctttcactcaccttcatccacacctctctttctggggatattttctgaattatttgagagtgagttgaagacgtgtttctttacctctaaatactagttgttgggcatttcttaaaatcaaggcattctcttacataatcacaacacacgtgtcaaaatcaggaaattaacatggacaaaacaccattatccacccacagactttactgaggtttccccgattatcctgcttgtcctctgcagtgaaaacttttttcaggtctaggatccagtcaaggatcaatgtcatagcctttaaccttctttaatctggatcagtcttttttctttttctttttctttttttggacacggaatctcactctgtcgccagactggagtgcagtggtgcaatctcggctcattgcaacctctgcctcctgggttcaagagattctcctgcctcagcctcctgagtagctgggaatacaggtgcgcgccaccatgcccagctcgcattttttggtagagacagggttttgccatattgattctggatcagtctttttttttttttatgagatggagtcttactctgtcacccaggctggagtgcaatggcacaatctccactcactgcatcctccgcctcctaggttcaagcaattctcgtgcctcagcctcccgagtagctgggattacaggcatgcgccaccatgcccggctactttttgtatttttagtagagacagggtttcaccatgttagccaggctgatctcgaactcctgacgtcaggtgatctgcccgcctcgacctcccaaagtgctgggattacaggcgtgagccaccgtgccagcggattctggatcggtcttaatcagtctttgtcttttgcaactttgatgttttgcagagagcagaccagttaccttgtagaatgtcccttagtttgggtttatcttcattagattcagtttgtgtatccagggcagtggatcttagatgcaattctgtcttctttttaatttttttgagagggagtctcgctctgtcacccaggctggagtgcagtggcacaacctcagctcactgcagcctccgcctcccgggttcaagcaattctcctgtcccagcctcccaagtagctgggatcacaggtgcccatcaccactaccgggtaatttttgtgtttttagtagagacagggtttcaccatattggtcaggctggtcttgaacgcctgacctcaggtgatccacctgccttggcctcccaaagtgctgggattacagacgggagccaacatgcccagccttcctgcccctcccgtcccctcccctctcctcctgtcccctcccttcccctcccctccccacccaagctggagtgcagtggtgcaatcatagctcactaaagccttgacctccaagtctcaagcaattctcctgcctcacctggggccacaggtgtgcggcaccacacccggacaatttttgtgtttttagtagatatgggggtctcgctatgttgcccaggctggtctcaaactcttggactcaagcgatcttcccacctcggtactaaaaagtgctgggattccaggtgtgagccaccgtgcccagcctaggtcctacttttatctccaatttacagatgagtccatttgagagaagctgaccctcttgccctgggtctcaaggctggggcgtggcagcacttgggtccacgtttgtgccctttctgcaatccaggacaaccgcaaagatggtcctcaccccaatcctctgggcttcctccagtgggtagtgggatcctgggtgcacacagcaaagcctctttggaggctgaatggggtcccccgactctggctttcccccaggtgtacatgttcctggtgaaatggcaggacctgtcggagaaggtggtctaccggcgcttcaccgagatctacgagttccatgtgagtgtggggacggaggagggacagggacccaccgttccagctccaccctttgggaaggaccttagcccaggtgatggggaaactgcagaacccagaatcccctcccagaccacagttaaaggggatttatttatttatataaatttttgtgacagggtcttgctctgtcaccactctgaacacctcatgttctctgattacaggcatgagcccccacgctcggccttttaggtggttttgagaggtatttaggtttgcagtgcaggggcgcaatcatagctcactgcagcctcgacctctggggctcaagcgatcctcctgcctcagcctcctgagtagctgggactataggtgcgcatcaccatgtgtggctaatttttgtattttttataaagatggggatctcactatgttgcccaggctggtcttgaactccagacctcaagtgatcctcctgccttggcctcccaaagctaagggggcattaaaagaaaaaaacatttttccccctgaaacatttaagtagtcttactgaaaacaataaaacacagaaacaccagattctcattttaaagtaaaacagacaggatctcccagaaccttcctagaatggaaccattcttgtcgcttttgaaaaacaaagccaagttctagatcccaaataaatgcacctgctggtgaacattctccttgtggttctcgtccctatgttagttattttcctaaattttacatttgtacctttttaagaatgagttatcagtttttttatatttgcttttcttttgagatggggtcttgctctgtcacccaggctggggtgcagtggtgcaatcacggctcactgcagcctcaacctccagggctgaagcgattctcccatctcagcctcccatgttgagatcacaggtgtgcaccaccacacctggctccttttcctgatttgttttttgtagagatgggatttcgctatgttgcccaggctggtctctaactcctggactcaagtgatcctcccgcctcagcctcccaaattgctaggattacaggtttgagcccctgcacctggtcaacctgagttttaagaggatccctttggcgactggattgaggacagacaagagtggacgggggacacaaggaggccattttcgttatccaggcctggtagtggctagggccaggagggtggggttggtgggaagcagtcagatcccaaagagatttggggattggaagcaaaaggatttgctggtgacttgcacatgggagggagagaggtcagtgcctctgctaatcaaggaatccagattgccaccgaaatttctaggcccgagatatttaggtagtgtctcactctgtcacccaggatggagtgcagtggcgccatctcggctcactgtaacctccgcctcccaggtttaagcgattctcccacctcagcctcctgagtagctgggattacaggcatgtgccaccactcccggctaatttttgtatttttagtagagacggggtttcaccacgttggccaggctggtcttgaactcctgacctcaagtgatccacccacgacagcctcccaaagtgctgggattacaggcgtgagccaccatgctcggccttttaggtggttttgagaggtatttaggtcacttccaatctcgtgattttccaagtgttgtaaactacaaatattccttcacgtcttcttgtctttttaatgtttagaaaaccttaaaagaaatgttccctattgaggcaggggcgatcaatccagagaacaggatcatcccccacctcccaggtgagcacggggctgagccgcctgtcagggggtcattggcgggggctcacctgccctcccagcccctctcgggcttgacctcatgttctctggtgccagctcccaagtggtttgacgggcagcgggccgccgagaaccgccagggcacacttaccgagtactgcggcacgctcatgagcctgcccaccaagatctcccgctgtccccacctcctcgacttcttcaaggtgcgccctgatgacctcaagctccccacggacaaccagtgagtgaacttttcaccctgccaggtgggagagggaaggaggggtgggactttctgtgttttgcagatgaggaaaccaaggctcagagagggaaagccaccttcccagagccacacagccagaaagaggaggcaaattccacctccggcccctgtgaccccgccaagcctccaccttaatctttcacacctcagggcactgggggaagcactcggggctggaggttcaaagtcctgggtcctcatcctgacattatggccacctggccatgggacctggagccagtcaccactgctctctgaatgcaggttctccatttctataatgggcagtgaggatcagatgaagcattgggtgtcttgcggagccccccagaaggatgtggggttgatgcctctgctaagtgctgagcatgtctggggtctcctgtacccaggaccctgtgtggaaggcacctgagaggctgagggagctccaggcaggctggggaagtccccttctccactcctctctggtcactgaagctcgaagtggggagcatgaggacaggacgttaccccttgtcaaggcacccaggctgccaagacagagacaagcagcattgctccggccagcacttattgacgcttgaaggtgtcccctggcccaaggaagggcagttatcatcagcccgggaggcgggggaaggatggactctgcagtggggtccgctcctcattgcctgctctctcagggctccagaaggaggaagaggccgggcacagtggctcacacctataatcccagcactttggaaggtcgaggtgggcagatcacctgaggttgggagtttgagaccagcctggccaacatggtgaaaccccatctctaccaaaaatataaaaatttagtcaggcatggtggtgtgcgcttgtaatcccagctacttgggaggccgaggcaggagaatcgcttgaacccgggaggcagaggttgcagtgagctgagactgcgccactgcactccagcctgggtgacagagcgagactctgtctaagaaaaaaaaaagaaaagaagaaagaagatggcctgggagcccgcaagagcattttccaggcttagggcatcctttgggtctgcagaaggctatgcagtgtcctcctcatgtccctcccttgggctgcccgagcagatccgcccgcccccatcacttcctgaagcccttcctcagccagtccagttgctgtcttctctccgcagtgccccttccctttcccgggtccctcttctcttgggaagttcttctgcaggtctacccagtgcctcttcttcctccatgggaagccaagggtctcacccagactgttctctcctcaggacaaaaaagccagagacatacttgatgcccaaagatggcaagagtaccgcgacaggtgagaggacggggggcagccggcgggggggggacaccctgaggagacccagagtgttcagggaatggagcaggggctgggagcaggctgggagggctcacagctaccctgctgaagaattgggtctttgggccgggtgcggttgctcatgcctgtaatcccagcagtttgggaggccgaggcaggtggatcacttgaggtcaggagtttgagaccagcctggccaacatggagaaaccctgtctctactaaaaatccaaattagccaggcgtggtgacaggtgcctgtagtcccagccacttgggaggctgaggcaggagaattgcttgaacccggaagacggagtttgcagtgagccgagatcgtgccactgcactccagcctgggcagcagagccagactccatctcaaaaaaaaaaaaaaaaaaaagaagaattgggtctttggaaggtccctggagactgaaaggagccctttgcaggtggcagtgcagagaccagcgcagacccttgctactggcagccgggggagtgtttgcggctgaatgaatgaacaggttttggagggcagcgtggccttcagaggcgatgcagggctgtggcagtttctaatacttattgcacagtcactgctaataacaataataataataatacctaacattaatggagtgcttactctgtgccagccactattttgtttttgttgttttcagtgacagggtctcgctctgttgcccaggctagagtgaagtggtgtgatcatagctcactacagcctcgacctcctgggctgaagcgatcctcccacctcagcctcccaagtagctgggattacaggtgtgtgccaccatgtccagctaatttttaattttctggtagagatggggtctcactacattgcccaggcggtcttaagctcttggcctcaagcaaccctcctgcctcagcctcccaaagtgctgagattatagacatgagccactgtgcccggctttttcttcttcttataaggacacgaggcctgttgggttagggcccactctactgacctcattttaacttaattacctcttgaaacgtacttaagagtacctttctcttaatacacccacactgtaaggtactgggtggttaggacttcaacatatgaattttgagaaggcggatgtcagccaataccaaacagcatcagcacctccacggttggatgaagggctggtcagaaatgcacactcaggtcccacagtggacctactgaacaggataggcattttagcaaaatcccaggtattcgggtgcaccttaaagttaggaaaaggtcaggcactgtggctcatgcctgtaatcccagcactttgggaggccgaggcggttgaatcacctgaggtcaggagttcgagaccagcctgaccaatatcgtgaaactccatctctactaaaaatacaaaaattagccaggtgtggtggcgggtgcttgtagtcccagctacttgggaggctgaggcaggtgaattacttgaacctgggaggtggaggttgcaatgagccaagattgcaccactgcactccagtgacagagcgagactccatctcaaaaaaaaaaaaaaaagttgggaaaaggccaggtgcagtggctccacgcctgtaatcccaacactttaagaggctgaggtgggagaatcctttgagcccaggagttcgagaccagcctgggcattgtcccaagaccttgtctttacaaaaaattagccgggtgtggtggcatacgtctatggtcccagctattcgggaggctgaggcagggagattgcttgagcctaggagtccagggctgtagtgagctgtgatcacgtcactgtactctagcctgggcaacagagcaagactctgtctccaaaaaagaaaataaagttgggaaaggctcactaacttcatcagatgagaacaaggacatgtttgaagtgtgaggccgaagcctggagaacgctatgcgcccaggaaatgcagggcagcagagactcaagatgccagcgcctgttctggaggcccagatgggccctgcaatgcccactcaccctgccctccctcttgccccagacatcaccggccccatcatcctgcagacgtaccgcgccattgccaactacgagaagacctcgggctccgagatggctctgtccacgggggacgtggtggaggtcgtagagaagagcgagagcggtcagacctcccaccttacggggctccttcccctggtgctcaggaacccacagccacaagccccctgccaaggctcaggcagccttgcccctgggaggactccggctctgttaggggccctaaatgtcctccccacactgtgggtcgccttctgtcttagtgtgcaccctgtggtggctgtgggcatctgtgcttggcaggccggggcggggcatgtctgcgtgttctgtctggatgggtatgggaccgtctgttcattatgaagtgggctcagagctgtgattctgtgagcatgtgtgcatgcatgcatgtgacctcattgtccggtgtggtgaaggtgacatttccaaatctgagcattggacatcagtgtgtctgtgtccctgtgtcctcaccatccctgatggctgcagggagccgctgggccctgcccctcagtcacattcccgcacctctggcacaggttggtggttctgtcagatgaaagcaaagcgaggctggatcccagcgtccttcctcgagcccctggacagtcctgacgagacggaagaccctgagcccaactatgcaggtgccccctgccctccgaggctgtaggggtgtgggagaaaggggcaggcagggctcagggatattgagtgactgctttggagtctgggctggttgctggcttggcagaaaagtcagggctaagatctcatcgactctggcttgggggccctggcaggttgtgatgcccttggtctggacagggaaccaggaggaggagcagacgactggggagagtgggaggccagtggtgtctgtggatatgtggccaggttcagtgggaagctgaaggatgagcagaccttaggctcaggaaggagggctgcctggaagtgggggcatcatcactgaccagaaagggaaaactggcagtgccagggctggatggggcctgcattgagcttgaaaaaaactataatagaattggttaccattttattttattatttatttatttattttacttttttgagatagagtctcactcccttgctaaggttggagtgcggtggtgctatctcagctcactgcaacctctgcctcccaggatcaagtgattctccagcctcagcctccccaagtagctgggattacaagcatgcaccaccatgcctggataatttttgtatttttagttgagacggggtttcaccaggttggccagactggtctcgaacttctgacctcaggtgatctgcctgcctcggcctcccaaagtgctggaattacagatgtgagccactgtccctggcctggttacccacattttaaaatggagtgatttcacccttttatgtggatttacagcttgttttttttttttttttgagacaaagtctggctctgtcacccaggctggagtgcagtaatgcaatctcagctcactgcaaccttagcctcctgggttcaagcaattctcctgcctcagccacctgagtagctggggttacaggcatgcaccaccacgccaggctaattttttgtatttttagtagagatggggtttcgccatgttggccaggctggtctcgaactcctgacctcaggtgatccgcccgcgttggcctcccaaagtgctaggattacaggtgggaaccacctcgcccagcctgtggctatcgtttaaacactgggaaggcctgcagcccccaggccgacagttagctgcagctgagcagttcccagtgccaggtagacggatgctccagccacctactcatggctgatctcttgtcatagtgaagtgtctggacagaccttcatcgttatgggatctctggtccccagagtgggtggcaatgaatgggagtggacaagctcacctgggtgtagggggcagagggccgaagtccagagtgtacccccagagtgggtgccagcaggagcttgccgagggatctgggatggagcaggagggtggagggaggagacccagaagagggggaactgtgggccctgggtgggtctggagtgcctggaggaaggccaggcgcagagaggagaagatgggatgggtggcgagccccaggctgggccgacctcacactgtgctctgtgcccctgccgtggaccaggtgagccatacgtcgccatcaaggcctacactgctgtggagggggacgaggtgtccctgctcgagggtgaagctgttgaggtcattcacaagctcctggacggctggtgggtcatcaggtaggagggcccctctccatccagagcacccatctgagtcagccccagccaggacggggtgtttagggatctggggtgacttgtccctgggactctgggtaagccactgcccctctctgggcttagtttccatctcagtagcagggaggaatgagcccacccttgcctgtcttgtggggatccaatgtccttgtccaagtgggtgcatttctcctttgtgatttagggtctcttcccaaccatctattattattccttctctggcaacatggtgaactgttgtataaataattacattcctagctaggcgcaatggctcaggcctgtaatcccagcactttgggagcccaggacaggacgatcatgtgaggtcaggagttcgagaccaccctggccaacatggcaaaaccctatctctactaaaaacacaaacatgagccgggtgtggtggtgggagcctgtaatcccagctactcgggagtctgagacaagagaatcacttcaacccgggaggcggaggttgcagtgagccaagatcgcgccattgcactccagcctgggcaacgagagcgaaactccgtctcaaaaaaaaaaaaaaaaaaagattactttctttttatcattcctttatcttttaaagctttcttgcagtcaggtgcagtgtctcatgcctgtaatcccaacactttgggaagctgaggtgggaggatcactcaaggctacaagttcaagaccaacctgggcaatgtagggagacctctgtctctacaaaaaaaattaaaaaatagctggatgtggtagcacacacctgtagccccagctactcaggaggctgaggtgaaaggatcacttgaccccaggagttggaggcagcagtgagctatgactgcaccactgcaccccagcctgggtgatggagcaagaccctgtctcaaaaaaaaaaaaaaaaaaaaagcttccattgcaattcccatctgtttatcctccaaatgaatgcagaaatactaattatcttttttctggttctggggaacacagaattctagcggcttgtggagccatttccctggagccatggggcctcccaggtcctttcctgtgtcttcattttttacgaattttttcattttttgagacaggatcttgctctgactcccaagctggagcacaatcatcgctcactcaagcgatcctcccacctcaggctcccacgtagctgggactacaggtgagcaccaccacatctggctaatgttttttaatttttttgtagggatggggtctcactatggtgccaagactagtcttaaactcctggcctcaagagttcctcctgccttggcctcccaaagcactgggattacaggaatgagcctccatgctgggcctttgctggcgtcttcagagccctaggtcacagggccagcctggcgccctgccgcaagcttatcttaaagctgggaccacaacatgcatacctgcagccgggcccggggccagagggctttgaggcagcatttctcagccttttagacacacactctgttaacccccatcctgtgtctctgataatcttcttgtgatcctcccaccagccaagaattgggttttatgtgaaccttgtattatgcaaagttttcttttgttttttttttcactcccaaatataatattgagaatagaaagaaagtcgtttcaacaaatggtgctggaacagatggatttccatactggaaaaaaaaaaaaaagagcaaaaaacaaacctagaccccttcctcacactgtacacatatgtttacttcagatggatcacaggtttatcccagagtaaaacctgaaactaaaaaccatttggggctggacagggagctcacgcctgtaatctcagcactttgggaggctgaggcaggtggatcacttgatgtcaggagtttgagaccagccatgaccaatatggtgaaatcctgtctctactaaaaaaatacaaaattaaccaagtgtggtggtgcatgcctgtaatcccagctacttgggaagctgagacaggagaattgcttgaacttgggaagcagaggttgcaatgagtcgacatcatgccattgcactccagcctaggcaacaagagcaaaactctgtcttggggttgggcgggggaaaagcatttggaagaaagcatagaatttggtggcttggaggtaggcaaaggttcgtaggagacagaaggcagttaacataaaagaaaaattggcaaatataatccgccaatgtcttcttttttctttacttttttcgggaggtagagataggggtcttgctatgttacccaggctgatctccaactcctggcctcaagcgatcctcccacctagatccctcaaagtactgggattacaggcgtgagcgaccgtgccctgcccattcttgccaatgtcttatagcaaatacctgtcccctgcggtgacctggatctgctaacctccacccctgcctagactgtggaaggattgctggaagggtctcagttgcacagaccaggaaactgaggcccacagaggcaggtgtccggttgtttgcaacctctcagcctgtgctaaccccaattgttcagagagagccctgaaaccctctcctctgggcgcccccaggtgactgccccagcctcaagggctgcctctgttgcaggaaagacgacgtcacaggctacttcccgtccatgtacctgcaaaagtcagggcaagacgtgtcccaggcccaacgccagatcaagcggggggcgccgccccgcaggtaagcgggggtccccggggctgggcggggtcgagcggggcgcaccacgggttcgctctgtctaggccatagcttggcagtgccagggcgggggctctcagcctggcaggagaggcaggaccctcacgggggaaaggggctggacgcgcctggccgcggtgtggggctggcacgggggcggaaggaaagcggcgatgcccgggggctttggggatgggcagtccaggggggctccccggagagggggacgacagaccgaaggctggtgaggggcgtggaaaaccgcccaggctctgctgcagggcaagggtccttgtcgtgacgggggcagccgcctcttgtcccgccggggtcgtgcagactaccggccccctactgccccccacttcctcggaccaggggtgcccatctgagtccctgggggcaggggcgccctcgggctttgacgacgccccgtcccgctgggccaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcggtgagtgcagcgggagagggcaggaagggcaagccgtagaggcggagtcagcgggagaggcggggccagaggtagggccagagtagcggggcgggaccagagggcggaatcagagggagaggcggggactggaggcggggtcagaggaggagccagcgctagggggcggagcgatccctaagaggcggagtcagagggagaggcacaagcgggaggcgaggccagagcgcggagcaggagttggagaacgcggcggggcgaggccagagagcgctgtgggcggggccagtgggcggggcggggcgtctgactcggccccgctctctgcccgcagaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtgga

SEQ ID NO: 2615 - DNA, 35043 bp, Homo sapiens
  source 1..35043: mol_type = genomic DNA
tgaaaaaagaaaacaaacaagtttatttgtatatgccttatgagtaacctataaggttacttcaagccttaagagccaattacagtaatggttcagaaacaggaatatttgtacttactccttgggcctggacttgggtgtcttgtttttgtaagatgctaggtttttttttattgtggtatgacacagaaaagtgcaccaaatgtacagcttgatgaatgtttacagtgtgaacacagctggctagctagcactcagagcaagaaacaggatcagtacctggaagactctctcgtgccctttccagacacttccatccacttttcctctcccctaactcctccattcacctgtccccatctcctcacccactgtgccccaggaaatcatcctgggtactcacatcattgtctagtaggttaaattttaacagggaataaatagttaacacttccaaactgtaatgtctcagtacagtatacagcagaagggtgctaaatcttacaaacaagtaatagggcttcattttcttcagctttgtagtttgtgaaacatcctagacttctctccgagtgctttccaaatctgtagttgcgcagtcttcaacaaaaactttggggaaaatgcccaccttccctttgcactccccttccagccattcttcattcactgataaaaggaaaagtacacatggatttctaaaaccactgtaggaagattaccctgtctggctattccacacagaatttgttatctgtcacccttccccacccctaattgtgatcaacagggaaaagacagtattgcaaagtggtttgagagtgaacacagggtttaaccatcttattgatctgtcttaaacatgataatgagcaaaatgaagaaggataaattatgtttttcaaaaagttaccagatagagaagaagggtcaaagaaattgaacaacgaatccttaaatagaatttctgtcctttccccacccccaaccttgacagggtctcactgtcacccaggctggagtgcagtggcacaatctgggcttactgcaacctctgcctcctgggctcaagtaatcctcccacctcagactcccaagtaactgcaactacaggctgtgccaccacgcttggttaatttttgtatttattagagacaggatctcgccatgttgctcaggctggtctcaaactcctgggctcaagtgatccacccaactcagcctcccaaagtgctgtggtgataggggtgagccaccgtgcctggcccaattttttaagagaggagagaattttacctgcgctttgttgggaatctttgttttgactacagaaaagggacatgccattggttaaatatattaaaaatgaaagttctttagtaaactttcttcttttcactgaactccattaaacaggtgagctggagctagtgatgggttagtacatgtttgttaaatataaatattttaatagctcctactcagagcctttaatagagtgcaggcattgtacttaaaaaatatattcagacttcataataacttgtaggtatccatattttactaaggaaaaggagacccagagagatgaatagtttgttcagagccattctgccagtaaaaatcagacaacttaggtatgatctccaaagcccacctacctgaccacacagccagttcagaagtttgtctttgtacatctagatcagacattaaggcactggtgcctggatcctgcccccagaaattttgctttaatgtgtggtgtgactgggcagcagttttttcaaaagttcccttaggtaattctaactgcaaatcactgtcttgattcttcttacagggtaggtcgtggactggaagcatattagaaatgaaaaatcccagatccaaaccagagtcagaatccatttaggaagattcgcaggtgattcacatgcacattaaagtttgagaaacactttgtagatgagaccatctcataacttgaatgcaattgaactcccctctgtcctaccctgaccgctaaattctgttttctgttgaagtgctacaatatgggtatttcctcaacttagacttgtacagataggtcatagtaagacgcatactggcttctctccatatctacccaaaaggttgttttagtgtgttctttcattgtattcctgctccctctcccaaactccagacaattgagctggttggttgatttaggcacctttaaagtggcacttggaggtgttcaacccagttcttcccactgagttaccattctctcttgttggaacactctgcttctatattactactactcatatttttttttttgagacagaatctcactctgttgcccagactggggtgcaaaggtgcaatcttgactcactgcaagctccatgtccctagttcaagtgattctcctgcctcagcctcccaaggagctggaactacaagtgcacgccaccacgcctggctaatttttttatttttagtagagatggggtttcaccatgttggccaggctggtctcaaatcctgaccccaagtgatccactcaccttggcctcccaaagtgctggggttaccagcatgagccaccacgcccagcctatactactcatatttttaattaattgctacacacttgttgtatactctctctacccccattaactttttttttaattttaatttttttgtttttgtttttgttttttttttgagactgagtctcactctgtaacccaggctggagtgcagtggcacaatctcagctcactgcaacctcctcctcctgggttcaagagattgtcctgcctcagcctcctgaatagctgggattacaagcacctaccactatacccggctaatttttgtatttgtagcagagacagagtttcaccatgttggccaggctggtcttgaactcctgacctcaagcagtcagcccacattgacctcccaaggtgctgggattacaggcataatccactgcacccggcctatttttattttttttaagacagagtctcgctctgtcacccaggctggagggcagtggtgcaatctcggctcactgcaacctccactcccgggttcaagcgattctcttgcctcagcctccctagcagctgggactacagatgtgcatcaccacgcccagctaatttttacatttttagtagagatggggtttcaccatgttggccaggttggtcttcaactcctggcctcaagtgatccaccacctcagcctcccaaagtgctgggattacaggtgtgagccaccaggcccagcctaccctcattaactttaaaatttccccctctctttgtctgttggattttctgttataattgatggtagtttttcactgctttgcattggtagtgcacagactcagcgtatgagcagggcttttatgatgggacttttttgtgtcgaggtagagaattaggctggcaaaccacgagttggaatggtgcttcttaagagtgtaggcagtagaccagcatcacctggaaacttggtagaaatgcaagttggtgggccccaccccagacctgaatcagaatctctggagggtgggcccaggaattgatttaacaaactcttccagggattcttagaactctccacttttaagaggtgggtcttgctgtgttgcccaggcaacagccttgaactcctggcctcaagtgatcctcctacctcagcctccctagtggctaggattacaggcatgctgtttcaatttttagtctgttcattacaaacagaatcaagaaagtcaccagagacacaggatagttctgaatagctggtttttaaggcaaaatttacctacttttctctttgaaaagtacattaattcaaagaactatggtttgcagaaggtcatacagcttgatgcaaaggcaaagtgattccagcccaatttgttacctctgggaatgagaatccatggtttccaaagcatactcctctttaataatcaagatgtttatcgccggccaggtgcggtggctcatgcctgtaatctcagtactttaggaggccgaggcagttggatcacttgaggccaggagtttgagaccagcctggtcaacatggcaaaaccccatctctactaaatacacaaaaattagctaggcatggtggtgggcgcctgtaatcctagctactcaggaggctgaggcaggagaattgcttgaacccaggagggggaggttgcagtgagccgagattgtgccactgcactccagcctgggcaacagagggggactctgtctcaaaaacaaaaacaaaaacaaaacaactcagcttcttgttgctttcctggctactagagcaatagacagggaaagtctgagtgctcaactttgctccctccagctagatgctaggaagggggttgaaaacactggctaaagttttgtttgtagattattgatattttcttctctctgcccttgaccttgtttctgctaacatgtaaatttgtttctatagtcttggagtagcacttaccctttgataacaccaggattatatccccttcctgaaactccaggtcctctggttgggtagcctcataactgaagagtgcctccacttggctgcctttcttaagctgaggttctgttgtctggttattagcatcagctttttcactttccttgggttcatctggaaagccttggtcaccctgaaataataaagggcctgttaattttcccaatttcctgccaagtgaacactgaacatcactaaaggaaacagcgaaatgtcaaagtagaacctgggatataaactcataaagtttgtgatcagtgccttgtgtagagcttatatgctctttatgaatactggatggttgggtaaatcagtccccaacctttttggcacgagggaccagtttcatggaagacagtttttagatgaatggtggtgggtggtgggttggggggtggtttcaggataaaattgttccacctcagatcgtcaggcattagattctcataaagagcatgcgacctagatcccttgcatgcacagttcacaatagggttcacactcctatgagaatctaatgctgctgctgatctgacaggaggcagagctcaggccagtatacctgcagctcacctgctgtgcagccctgtgctggcccgtggcctggaggttggggacccctgggataaatgaaaccaaaaggtctgcaaaatcatatacagtcttaaaatatcttactgaaaccttacaataatcttgagacaggtagaatgggcattattatttctttacagatggggacagagccctaagtcaaaactggctttcttagcatcaactctaacagcaacactagggaccttgttagaaatgcagactttcaactccatcccaaaactactaaatcagaaactccctgaaggtgaatcctgcaatctgtattttaagtcctctagggaattctgatacttgctaaagttcaaaaaccactgcacaatgccatacttgttttatctgtaacaacatttcttatacatcttagacttatgatcttagacttcttccacattattgtcacttttgcttcacaaatgaaggagaaggatgcggtttctacagatgtgaatcatagaatttaacaaatcaacattagaaatgctgctaggcttgtatgtaccgagcattataagttctagcttcttaatgttgtttgttgaacgttggtatatttttattgagaggcaatacaatgaggtggaaatggccctagagagtccacagagaaaggtttgtatcccacctccactgcttaccagctctgtgtccctaagcaagcagtgtaacttctcagaacctcagttacctcacctgaaattgaggctagaagaattcaatgagatgacatacaataatagtagttgacatttattgaacacttactctgtggcagtactcttctaaatatgtataaatatttagacttggttaatggtaagtgttcctgcatagagtagatgcttaataaatgttagttcattttatttttctttcttttcttttcttttttttttgtatttttagtacagatggggtttcaccatgttggccaggctggtcttaaactcctgacctcaggtgatctggcccatctcggcctcccaaagtgctaggatttcaggcataaaccataccaggcctcttttttttttttttttttttttttttttttttttttttgaggcagaatctctctgtcacccagactggagtgcagtggtatgatatcagctcactgtaacctccgcctcctgggttcaagcaattctgcctcagcctcccaagtagctgggactacaggtgcacaccaccacacccagctaatttttgtattttcagtagagatggggtttcaccatgttgcctcagcctcccaaagtgttggaattacaggcatgagccactgcgcctggttttctttctcctagtaagtgaaagcctgctttgttgcctccaaaagtaatggatagtgataaagaacattcaacagtgactcctgagcctggattaaattgcaaaagattgtggggagttgtaagagggttggctatgtgcagccaccaaatagattgaagctgctgtcaaaggaaaaaattttaattaaaaaaaagtttaagtgaagtagttcacatttagagcagaactccttctaggaagaatcttttaaaaaagatgctgaaggggttagtccaaagacagacagctggaaaacctagagtgacttttcagacttccaagagaccccttacactcacactcactcttacccccaggatcctggggccttttgtctcagccagagacaccagggagtctcatccccagtggctgtatttcctgaaggcaattttctgaacggggaagataccttaaacagctttatacactgcccttttctaggctcattctctttcactcttcttctcccagctcatgtctgtaatcccagcactttgggaggccgaggcaggtggatcacaaggtcaggagttcaaaaccagcctggccaagatggtgaaaccccgtctctactaaaaatacaaaaattagctgggtgcagtggcaggtgcctgtaatcccagctactcaggaggctgaggcaggagaatttcttgaacctgggcggcagaggtttcagtgagccaagatcacacccagcttgggcgacagagtgagactccatctcaaaaaaaaaaaaaaaaggtgaagaatggctatgagctgagccttaagctatgatatgacttcattccaaccttgcttgacagtaatggatgggatgtttgacacagtcaggcagggagctgatggaggggcaggaggctttctgtgagctcctgccctgctgggcctgctgttctcttgtgggaaactctctccctgctgcaaatggggtgaggatgcaggtaaaagggaggcagagctgtgacttattacacaccatatccccaacaccacatatagtgcctagtacacagaaggtgcttgataaatttcaaattgttgaggaagtggctcagtggaaatgtaactttagatgcccctcattgcactcaccactgtgttctcacaccacagagtcaggcagtagtttttcacctggccccaggcatccttcatgctgtcttctgaaaggggcaccagctcattgctgtcccgaggccgatagctgggtggggataatgagtaagaatccagtcaaagaacatcatcacaaaaaccatcctcctcttccctcctccaggccagcacaaggttcccactgtacccctcacagctgcctgcatggagctcacctcagcttagtgtgttccagccggagctccagtttcttagacaccatgtcccggacctggctgtaggggagcccgggctgagtcttcatgactaccgtgtacttgtagtgcaccttgagtgtgtagggcatgggaacactgagcttcacttcctgagtggggaggaaacaaagggaactcctgagtgtctgaggctttctctcaacatcctggatcaccgcagtttcgtgatttggcacagggggtacccaatacagcaggggagaggccagtaagtaactggtttcacagtagcctaaaaggccttcagaggtcctttagcccaacccttgcttggacaggaattcctactgagtaagatctggcccactagcttgggtagtaggaagtgtgtgcatgatagtggaggaggctattaagaaggtccctagctcatggactctgtaaggtagcaactggttcgaccctccctttggggctcttcctataatccagacagacatgtctgtggttgatagcccaagctatcccatcttctaccacttgaaacagtatgagggaaaaatgttaccttaggctcttctttttgtttctggcctgaatggaaaaagtagggagtaaaacaaaagaagatggtgaatgaacatccttggccagcccctgccacacacagatgaaacctcttcaaatagggcccccaacctcttaccctttaatttgtggggcaattattaaccttagtaaactgtggggaaaatctcgccctggggaagcatgaaggtcatgaacacatgaacaaactcagtctctgcttctagggagcctataggtaattaccaaaggaccagcatatcctcaccaacccacaaggttagcagggatcccaaaggtcaattaagcccacgggatccaaagcaatgaaaatcggagtgcaaggtgagccagaggccacaggaagaagtattagaaccactgatcctcaccttattctttatttttgtgtatgtttcctaaagtttattaatttaatctaatctattaatcaagcaatctaatattaatctaatttatgtaagagtagcatgcataaagatatttactatagggggtacatgatcagagaaggccactgatctcaaacctagctgatcattagaatcacatgggaagtttttttctaaaatacaaattcccgagccccattccagtcctaaaatatcagagccagtagcctaggactctgtattcacaaaatcatcctaggtttatatgtgatccttgatgagcctctagacaaaagataacaacaaaaaacctgtcaaggacattgagcaggagcaacgggagaaatttgaatatggaatatacattatataatactatcatatgaatgtttagtgtcctagataccatgattctattgtgattatgcaggagactgcgtttttgcagctgtgtagggtgaagtgtcacgagtctgtaacttttcaactggctcgggggagaaaaatagaatggagcagggcgagttcatggtgcaaaatgttaacaattggtgagtttaagtgaaagatattctgatgtttattgtattctactgtcagcttttctgtaggttggacatttttcaaaataaaaatgggggaagggacatcccgagtgattctgatgatcaggcgcgtgtggcaatcattgatctagaatctggccaaccactcactctgcgtctctaccaagcgcttatccagaatctgcttcaagtgcacttcccaagacagccctctccacactaggaaacagcctttcagagagaacatttccatttcacatctgcccattggttctttgttcatcctcagggctccacagagcaatttcttttccagatacagtgcctcagacatttgaaaacagccactccatgcccctcagagataagcaggtatagttacttcaacttttcttcctgagacatcgtttccctacctaatgatcaaggggtttggtgactacgtgagtcactcaggaaccagctgcattcacccaagccccgtgagtgttctgcagaaggcagggagagagggcactgatttcatgtttggggtgggtggtgcaggaaagggggattctggggctgcgtggtcattagctgagtgacatgttgggagaagaagaaaccagaatttcctggaaggcagggagaggaactcaggaagcagcctggcatgctgctgcacccagacctaggctgtggctccaggaccactcacctggtgacagctggggtcttccaggggctttggaactaggaggagctgggatgtcggactgcggagagctttcctcctgaaggcaacagggagcgacggtcagaaccttcattcaaagttcccaggcaggggtggatgtggggaaacacccctacagagaccccatgtaaaggagccacatgcagataacgtcctaaaagttggaatggtagtgacatttggggaagacgaaggaaatgttggccaaaagaggaggtggagttggcctgatgaaaatgaaaatcacagtagaaagaagaatcctaacccgctaaaacgcccttgccgctttagcaactctttcagccatattggaaatccactggccgtggggcaggactgagctcttgtctccactgcagagggcattgagaaaggaaaaattccacttctcatttgcaaggcatttgaagcttttcaaagcatttggatatggtgactgaccagggagggctgagctcatatacaactggttgcacagtctagagacagacagtctccactgccattgagtcacttacagggatgctcagatctgacaaagacagctctctaggcctggcagaaggacagacttttgaagtgtgagggagggagtagcagcagtttagaagcagtggctggcaaggcccactctgattcaaagctctaaggcagatctcattttattatttttatttgtatagaggtggcatctctctattttgcccaggctggtctcgaactcctgagttcaagtgatcctctcacctcagccttccaaagtgctaggattacagccatgagcaactgcagctggcctcattttctttctaatggcattgtaccagccaacacattgactactcttccacgtgaagcagacacacttgggaagacctaacccactcatatactgtaggctttgcttcccaagtgacttctgaccaggaagagtcacagaggtgggtgggcccaatgggacctacagatgcctccaacttagcacatctgggcttttttcccctcattcccaggttcagctctgggtagctggtgccatctcaaggcgggctcaagactagtgaatctttctccaggggtcctgacaacacctcttttacactgcttttctcccctccagggagagatccctaaagggtgagaggaaatgggtcaggccttggcatcacattacctggggctgctgctgagggtggatccgcagctcaactggttcaaggtagttgcagggaacaagccccttctgcagtgcagcaccacagaatcagaaaggaaaaaataaagatgtgctcatcagtacccacaccacagaacagcccagagtcctggggaagggatgacgaacagacaaaagaacttggctggtctgcaaagaaggcagcagatactgctccacagagactgcatttgctgccaggatcccatgcccatcgcaccagcccctgatcctctgcatacctgcccgttgaacatgaccgtggcccagttatcattgcccttcttcaagacaaagacaatgttccctggcatgacctggagctcttcttttgtctcaggcacaaacccaaatagcacacggtgagcctccccttccagagccctgcagaggatagacacaagatccagcccccatcccctcacatgatgccatggcgcaaatacactgaacttggagccagggacttggctccagcctggctctaactccacatctaactgcaactgccgagatgacactgagcctgcctgggctcccaagaggtctcagcaagaaactggtgtacacctgctcataaccatatatgcagaggggcaagaataaagcaaaaaccccacaacactagatagtgaggacttacaatccttgccctcccttctgctctgaggaggaaggtccctggctgtgtcatcttggccagcacccaaggctgggctggggtggggtggatcaggtgactgtggtcaggggaacagcacaaagcagaagtcaggtgagagccagctgggccagaaagattggtgggagaggaggaaggagaaaccacctagaaccagtgttgggccaggatagagagaccgtgagcagggtaggtgacagggagcgtgagggatgcacatagagggctctgaggctgcccagctgccgtggtgcagtgtcggttcccttaagtctgacttcatgcttttaggctttgaggctctgattggcatcactttggaacgtgtgactgagaggctggtgttcaggtttcaggcttccctccctttactccccactctgttactttcccctcggcccatccttgtttccagacatcgtgcctactcctgtagggaatacaggcccttccagctgacagggagcttaggaatgagctcatccagccccctcatttttgtagttgctttggtacttttgtcacttttttttttttgagacggaatcttggtctgttgcccaggctggagtgcagtgacatgatcttggttcactgcaacctccacctcctgagtgcaagtgagcctcctgcctcagcctcccaagtagctggtattacaggcacatgtcagtcaccacactcagctaattttttcatgtttagtagacatggggttttgccacgttggcccggctggtctcgaactcctgatctcaagtgatccgcccacctcagtctcccaaagtgctgtgatttcaggcatgagccacacacctggccaatcactttttaaaacctcctttttgggtgggaggaccaggcttgcttcatcactttgagagaattcttaagaaagctgtaggttatgtcaccctttgtttttcatcttacagaagaaggacttccttttcttcagtccttcctctttacttcttcagaaagcatgtgccgatagggagtggaaaacatccacacaggaaaaaggacgtcattctagattcctgactccagagagctctggcctgcccccgtcagaggggactgcagccagtgcgaaaccgatctccaacctgaggtcagcatcctggtccccagggtagctatgttccacagaacaccactgcccctcagcaacaaccccttgccatgtgggtggctgtgcacgtggacagagggccaatgggacaccacgtagctgcagccaagccctgatggccagccccaccacagtcaagactcccatccccatcatatcattcctttctagcctgacattctagaagacattcttctaggcattcctttctagcctgacattctagaagaagcctgacattccagaaaattcaacaagatttagaccctgaccccaccttcatcttcttccctccctttcttgccatcagctcaggcttggcgcttggatattctatttatggatttgaatctaacttacctgaagatctctggggttttcggtctgggtggaggctcagctgcctattgaacattcaggagaagtgaaaacggaaaaggcaatgagggaaagcaggggagagacaacaaacggctaatggtaatttgagcattcttccagaccagaaaatcaaataacgcatttctgactgatgagaacactgtctaggaagagggcacagtcaccctgactaaacactgggaaataacacctcccaccagctccccaggtacaggtttcactagcacagcaattcattttgagccagagctagtttctggaggttagcagtcacacagcaacatggtgtcacaagaatgctttgaccttgagctctgtccttttcccaggacagtttccaaaagctctgttctgtaattaatgtctactatgtcacatgacacttctgagtatttttaaattaatttaaaaaaaattttttttgagatggagtttcactctgtcgcccaggctggagtgcagtggcgcgatcttggctcactgcaacctctgcctccctcattgaggtgattctcctgcctcagcctcccatgttgctagaattacaggcatgtgccaccacaccctgctaatttttgtatttttagtagggacaggggtttcaccatgttggccaggctggtctggaactcctggcctcaagtgatctgctcacctcagcctcccaaaatggtgggattataggcgtgagccactgtgcctggccacttctgagtatttaaaattgacacaggatccactgactgggcaagaatctcctcccctgttctacactgaataccatggaatccagttacctgggctgcattcccctcatggcctctggctgaactgaagctcaagggacttcagcaaggctttcatcagctttattgtgaagaaagagatcaaggaatctagatctggaacatacctgcccctgctcagaaaaccgccctctgctagtgctgaccaacactcttgcccatcacaggttcattgccacagagttcgtattttccttaatgtgttttcccctctttccttcacaaggaagctctgtgtgcatttctagatccactatcatccagttcatctgagctcacctctccaagcccagcttgggcagaaaaagggttcactctcagtgcgctgcctgtgttcccgaaggaaacccctgcacatgagcagatgggtagagccaggagagcccaaacctcaggcccaggccccacagggttccccacttgcccctgtactcaagaagaggctttgttaataagccttccatagcttgtgtttcagcttcctgagagaatagttgaggcttcagagagaggatcagcagatctctttagagatgtgaagaccggcatttgtggggaagcaggagagttagcttcagaggacttggggtgaagcctgacactgccttatttcctcaccagccatggaaaccaggactgagagagggcaggcagatccctcagctgcactgagggccacttgaaggagcccttacaatcaggcaactcagcacacatagtctctcgaattgaatgcttcacagaaagctctcgagacctaggtccatggagaaggtcaggactgccttacctgtggttgcagaggggcaaacccagagaaactgtcttgatccaccacagatgccacgacctaaaatcaaggacaggagggtgtgaggctctgccagcactgtttccattcttctgggtctccctctttgctcatgccctagacctgttcttacgtgagcctggtttcagacgtggacagtaactaaggattagattcctgagcctctggattaggatttcagcaactgaagaaacgagcattcaccccacccctgctaacacaggcttgctttcttctctcttaaaaaagaaatgtttttaattgaggtgcaatttgtataacatcaaattatctttttttttttttttttttttgagacggagtcacgctctgttacccagactggagtgcagtggcgtgatctcagctcactgcaacctctgccttccaggttcaagtgattctcctgcctcagcctcccgagtagctgatattacaggcacccgccactgtgcccggctaatttttgtattttcagtagagacaggttttcaccatgttggccaggctggtctcaaacttctgacctcaggtgatctacccatccagcctcccaaagtgctgggattataggcatgagccaccacgcccagcccaaattaatcattttaaagtgaatgattcagtggcatttatcacattcacaatgctgtgcaactactgcctctctctaattccaaaatattttcatcacctcagaagaaaatgctgtacccattaagcagtgtgtccacactcccctttcccctaaactggcaacaaccggtttgctttctgtgactgacttgagccctcttctctgagttttaaaaatcagatgtaaagctagctttattcacaaatatgcttaaactatagataattttcatcattcattcatataatcaaaacatttttgctgagagctgttatgtgtctagcactgtgccaggctgtgaggactcagtggagatcaagcagacatggtctctgctctctcagtgcttagaggctgcaccagatatttcctataaacggaattgtacaacatgtggcctttcgtatctggcttccttcacatagcataatgttttcaaggtccatccatgttgtatcatgaatcatactccattcctttttatggctacgtagtattctgttgcatggatatatcacattttgattactcattcatcagttgatagatatttggagggcttccactcacccaggctttcttgacctctgctgctatgctagacccagctacccgaccactgggcaactttagccctatgaatgtgtcaagtcaaatgtggttttggaagggcactgctgactcacttcagaccatgtctgaaagaatttaagacttggatttattattattattactattttgagatggagtttcattcttgttgcccaggctggagtgcaatggcatgatctcagctcactgcaacctccaccacccggattcaagcgattctcctgcctcagcctcccaggtagctgggattacaggcatgcaccgcagcacccagctaattttgtatttttagtagagatggggtttcaccatgttggccagcctggtcttgaactcctgacctcgtgatccacctgcctcagcctcccaaagtgctgggattacaggcatgagtcaccatgcacagccaagacctggatttagaagaagtccaatttaagacatagtctaaacatagggctgtggaagtggggaaagactcctcagcccactaaaacgtgaactacaaggagcattaatccaagaggatcccatgctgatctctttccctaacatgttctcttcatatttatttttattttttagaaacagagtctcaatctgttgcccaagctagagtacagtggtgcaatcatagctcactgtagccttgaactcctgggctcaagtgatcctctcacctcagcctctccactagctaggctggtctcaaactcctggcctcaagtgatcctcccacttcagccttccaaagcactgggattacaggcatgagctaccctgcctggccctctcttcacatttagtgagctcctcatggctgtgttttccctccattggctcagtccctaagactcagcatcctgtgagtaaccctgtggctctcacccagggtcgagctggaagggagaaatgggagcagcttggagaaaataaactagacatggttgcctatctttcagccaaacctctgtcctataaacaagtctctcattgccatcccagggacagagccacaaggaggctaccctcttctcaagagtccctcccaccttgctccacatggcccgggccacaggagactcaggggaagctgagcaatcccacctaccgtcgccttgcctaggtaatccttcttggccagctgagccacttgtctctcatttggtcgaaacagcttgcccacagggatcaccactggctcatatagcttctgcttctgtaacacagaaaacgtagcattcccttatgtgaaaatgggggtgacgatgcttgtcctgcctccctcagtgaatagatgcaagaattcattgagataaccacatagaagcccttttccaaatgagtgttgtcattcctctagggtgttaaggtaggaacccttggtttcaataccaccttctgctgcgaggccacatggacattgctgctatttgttgctattcagcaccctcttttcccagaggaactgctcctctcccactctgtgtgctgtccgtggggttctctcatggtgtagagggcaccaccacgacaaggctggcccgggatcaagcaaggctcatgacagtgctcccttggatgggtgtttgctgatgaggatagacatataaagactggcttgagtcctcttctctgtgttttaaaaatcagatttaaagctagccttattcacaaatatgcttgaacgataaatagtttttatcactcattcacaaaatcaaaacatattttaggcaggtgcggtggctcatgcctgtaatccctgcactttgggaggccaaggagggcagatcacctgaggtcagcagttcgagacctgcctggccaacatggcaaaaccccgtctctattaaaaatacaaaaattagccaggcatggtggcatgcacctgtaatcccagctacttgggcggctgaggcagcagaattgcttgaacccaggaggcagaggctgcagtgagctgagatcacaccactgcactccaggctgggcaacagagcgagactccatctcaaaacaaaacaaaacatttttgctgagagctgttatgtgcctagcactgtgccaggctgtgaggactcagtggtgatcaagcagacatggactctgccctctcagtgcttagagtctgtgcagcactgctccagcatccaatatcctgttctcctgcattgccaaggagccccactccaagggtggtgtgatgccagggctctgccatcccatactctaggcctcagcttctcagcacagattcaagatcttaagtggaactataccctaagatcagtgttacccagactcacagaaagtaaaagcaccacttttatggcttctcaatggcatgtcctctgagacaaatgagaatccagtgacatcctctcaacacctgcatcaccaatacgcttacccagacacactccatcgccttgtcgattttggaatgtctgggctcagacttcatgctcgtggccaatgctaactgttcttcagcttttttccattcctccttcttggcatacatgaaagcaatgttatataacacctagaaaagtacagaccgcaacataaaacttgagactactccaaatcaaggtgccagggaaaggctcacacgtatactctgagaatgttgcctggtagcctttctccctttctcagctctcctgggaatatctaaaatatagtgcaattagtcttgctattgagttatgtcaaacacaaacatggtgttaagaaaacaccatggaatgcgtaaatgcaacatcatttgtactcttccaacaacgaaataggtcaggaagggacaagaattattgtatacagtgtgttcaaaccaggttaaaaaaaagaagaagaattgttgtgttgttttagtatgagttgctttagtaaaagagtgacttgctcaaggccccttctagaggcagacacagggttgggaataaaatacaggtgtgtggtcttccagtccacctcctgccactgtacctaggctgaaacactggacaggtacagagccggaagatggatcaagatgcaacctcctgtaccagcaccagcagaacctggcccagaccatgtgagtaacaagactaatgtagcaacacaggccaggcgcagtggctcatgcctgtaatcccagcactttgggaggccaaggcgggtgaatcacttgaggtcaggagtttgagatcagcctggccaacatggagaaaccctgtctctactaaaaatacaaaaattagctgggcatggtggcaggcacctgtaatctcagctacttggaggctgaagcaggagaattgcttgaacccagaagacagaggttagcacagaagccaggggcaccttcacctcaggtggggggggaatggtaaatgcaacagtgtcatacttttccaggtcttgagttgggctgtggttcttgagtgtctattttactattgtgcttcacaatttacacacagaatcaaataatcgtttggatgcattaccaagatctaaaaaatggcccgactgaaataaattttttaaataggatattatggaaattagggggtgtgacatttgaggctagattataaaagacattgacactgtcttgctcttgggtcacttgctctcagagacgccagctgccatgtcatgacaagacttaggcagccctagagagaagttcatgtagcgaagaactgaggcctcctgccaacaatgacgtgaacttgccaaactcagacaggtggaaggattgatgtttctgtggcattagtggctggtgctgaatggtgggggccaggatcaaccccggaagtggaaatctggactcctttcagtcctatttctgagattcaatgagctactgccttctgaattcgttggcttctccagcccactcctgaccttgtgtgcagaaagaaagaactcagatcgtttaaaatttcctatttggttctcagccaccttctcttaagacatttctctacaatcagtttttatgaactaatgatgagaaaaaccttgacactcttcaaaaataatgatgtgattctcagaagccagggtcataccacatcaggaagagaaggattataagtagggaaatgactggaaggtcccatgtgacaaagagggccttagaccctgaaaagttcagctttacttgcagagagggccactcagccagtattttctgtcctctcagggccattttaaccccaactccaggggaaacattcctcccatggaactgtactttgatgctgctgtgacataatcctttttctagagccacttgtcccccaactttctaatctgtataagtggctgtcattggcttattagcaatgtctggagggattttaggttgtcacattgggtggggagtggtggtggcagtgctagtagcatctaaaagctagagatgccgtcaaagttcccacgatgcgcaggacgcaccacaacccctctctcgcctctgctacaatacaagattgtctggtccaacatattaacagagctacagctgagaaaccttactcgagaagttggtcgaatggcagccaattccaactgcaaagccccatcttctcagactgtgagacgtgaagttagttgctagcctgctgcagggttgggatggggccatatgtccccaggggccgagggcggctacagactctattattagccctgagcgaccctgggaacacttgacttcttgtgcctgagaaactaaagcaaggggacttttgtcagtgatttttctaaagaaaggtctttgacatttacaggaattttggttttcaaaactgctagtatatatttggaagtgggaggggtgggaagggccaaccggaaaaagtaaatgaacctgcaaagtcaaagccagtcatgtctctcccttttgataatagagaaaagaagttgttttgcagaaacctttacctaaatatgtgccttgagctgttctttgagcaagaggggacagatttatgccaaattatcctcagtctctctttaggtatcaatcaagtacatggggtaagaaccatggatagtaaagagtgtggtctataaacttgggaactgagcaagcttctggcaggtcctgcacggacaatgaactcatgattttggatttgctagcaaaatgctgaacaaatagcttgtcaatctgaagtgccaatcaaaacatgcaaattatcatgaatatttccacaagccaacacactcgtgtccagcctcccttcagagagcccggggggctcatttttgcatggtcctttgcgcttcacattaataaaatgtatgcccccaggtaactgatgacaatgccttgatgagcctgaaataatccatctcagtcttttcttcaaggaaaatctgagtctcaaggcagaggaggcaaaatggcttttccaagctcctggaggtgtcaacagatcactgtgcatctgaactgtcagccatccatccagccatgatcccctcctgcccaggccaggccctgttctccttacctcacaggcaaacagcttgaactggagccccaggatcttatagtctatcagctggttccctcgaagctgaatcaaggcttctttaaggtctttgatagccaaatcatatctgcaggacagagggagaaaatacagcagtctagtggatggagaaataaatgcagcataaaatgtgagtctgcttctcccttccccatctatttcactgggacaagaagcctttcagttccttttgacctgttctagttttcagcaaccctgagtccaagtattctatacaactccttgggaatggtgttccccccagggctgtgcctcaaagcaaccctgagtgcctcgtcttggacagtcacagggagtttcttctctattgactgcatacaactgtcacctttctgacaacctgacttgtcgctttccgatgcagctctcattctctcttgagagctccaagcagagccagcacctgccccctgcctgtgtccctgcagagtgttcagagctgatttggaatactgctcactcctggctcccaccatcaggccaggccagcctggcacagcttggaggggccccttcttatagctgccaccatcaccctcctgcccactgccttcgcccatggcttcttttgagttcaacttagagcttggttttgtggtcttctttgtttcctcaccgcccgccacttctgcctcctccctacactttggaaaagaaaaaaaaacaaccacttatgctatatagtatttcctccttttttttttctttttttttgagacagggtctcactgtattgcccaggctggagtgcagtggtgggatttcagctcgctgcaagctccacctcccaggttcaagtgattctcctgcctcagccacctgagtgggactgagctgggactacgggcgagcgccaccacgcccggctaattttttatattttaagtagagaccaggtttcaccatgttggccaggctggtctcaaactcctgacctcgactgatctgcccgccttggcctcccaaaagttctggaattacaggcatgagccaccatgcccagccccagatagtttttctaatgctgctcccactgccttgtgctgctggattggcgtggagctgactggctcgatgtataccagggctgctgtcctgggacttgtagcagagaatgggagctgaccacatcaatagggcccacaggcatgtaggtgggacctggacacacacttctgaggatgctggcccaggccttgaccatgggctccacagaggccctggtgggagggagccattgctgggctatagggggtgggagcagcaggcataagctacgccagcctcactccactcagtcccctgacctggcaggaacaaatttggctgcctggttgtggctcacacctgggcaactggactgtaagtctgtaagtccctaggccaccatctgacccagagctaccaacccggcttctcttggagataagcctggaatgtggacacaggctggcaggaatcctcaagaggcagtgtgatgtagtaaaggggccaggagccagagtccagatccaacagctctgccactaactgggggaccctagcaagtcactttcctggcctgaagttccacaccaatattatggcagcatattgtatacagggacatattatatgcaaagaatgtatcatatagggagcttgccagcatatggatcccacttctggagtcaaaaccacctggtttgagtcttggctccgtcacttactatctggtgagaaacggcaagttacctagcttccctaagtctgtttccccatctttagaataagagaataataaggccgggcgcagtggctcacgcctgaaatcccagcactttgggagaccgaggcgggtggatcacgaggtcaggagatcgagaccatcctggctaaaatggtgaaaccccatctctactaaaaataaaaaaataaaaaaataaaaattagctgggcatggtggtgggcgcctgtagtcccagctactcaggaggctgaggcaggagaatggcatgaacccaggaggcagagcttgcagtgagcagagatcacaccactgcactccagcctgggtgacagagtgagactctgtctcaaaaaaaaaaaaaaaaaaaaaaaaaagagaataataacagcatatacctcacaggttcattgtgagaactaaaggagatgaagcatttgggtacttcagacagtgcctggcacacaccataatttttttactattgtttttgttgttttattttctttagctctaacactctaccaattaatccatacatcagccacttattacgtgtttacttaaagctccgtgccatataagctattatcaggatattttaaaaatacatggcatagaagctggaactctgatctcatggaagtttagagctgagcacaagggctggttggccaagagagtcataaggaacgggtgccagtgtggctgggggagaagccatcaccattagggttgaggtaagtcacacatggtagcagtggctatgcgggaaataaaagaagagagcttgggtttgaaataggaggatggctttctctagtatccctgttaataaagatggttgtaaaacctactaaatgcatgcaggccattctttaagtagcaatggggcctttcatgtcttttccacgcatctttctgggttcctggaaagaggaagaaggtacccagaagtacgccagaaatcaggttccgctttctaagccagaaggtggggtaactagcttcaattcactgagcctcttccatcgcgaagaggacaggcagaagcagaggtttcctgtttcctggcagctgcaatttccactgtgttctattgcctgtttgggagctcgctgaaggtctcagagggcacacactttaactgccgtcagcatcaacctaccaacgtgccttcctccctgctgagttggctaagcagatggatttcagctgggaagtgacaccacctgggtctatctggcattgcatgagcccagcaaaatcctcctaataattccctagcccatcaagatgtctacagaggcccggtgcagtggctcgtgccggtaatcccagcattttgggaggccaaggcaggcggatcacttgaggtcaggggttcgagaccagcctggccaacatggtgaaaccccgtctctactaaaaatatttaaaaattagccgggcgtggtggtgcgtgcctatagttccagctactcaggagggtgaggcaggagaatcacttgaacccaggaggtggaggttgaaatgagccaaaaccatgccactgcactccagcctggttgacagagcgagactccaactcaaaaaaaaaaaaaaggtgtctacagatttgggcctggtaggagagagagagaaagaactgacaaattattcagagggtttgctttgttttaaagacagggtggacccgcctaggcaatatggagaaaccccacctctactaaaagtacaaaaaattagccaggcatagtggtacgtgcctgtagtcccagctacccgggaagctgaggttggagaatcacctgagcccaggaagtcaagactgcagtgagacatgattgcaccactccactccagcctggacgacagaatgaaatcctgactcaaaaaaaaaaaaaaaagaaagaaagaaagaaagaaaagaaagtccaacaaccaaaaaaacagggtggggccaggggctgaggtttgagcctgcagttccagctactccgccagaggctggggcaggaggatcacttgagcccaggagtttgaggccagcctggacaatatagtgagaccccttctctaaaaaaaaaaagattacttattttatttattaattttgttatagagacgggggtctcactatgttgctcaggctggtctcgaactcctgggttcaagcaatcctcccacctcagcctcccaaagtacaaagactgcaactgtgagccactgcacagggcctaattaattaatttttaaaacggggaaggggcatccttgctaagtgttttttttttttgagacagagtctcgctctgttgccctggctggagtgcagtggcgcgatctcggctcactggaagctccgcctcccggttcacgccattctcctgcctcagcctcccgagtagctgggactacaggcgtccgccaccgcgcccggctaattttttgtgtttttagtagagccagggtttcaccgtgttagccaggatggtctcgatctccttacctcgtgatccgcccgcctcggcctcccaaagtgctgggattacaggcgtgagccacctcgcctcgccaactaagtgtcgtttttaaacatgtctctgaaagcaccggcctgcttcccagccccctcgttccctgctgcaggcctcttttcggcctctccacttgtttacccagagctgcagccctgaagggggttccgctttgacacacagctcttttcccattacacaggttcgcaataatctcagtatgagaatcccaaaatagcattcagcgctgtgtgccagtgggccgtgctgcggcagcccccgcctccctctagcccttcttcagcggttctcttcgtggccatttggaagcatcccccaggaggcagccaaggtgctggcagcttcctgcagggctctgctgggctgggcatgggtgctttcttcacacccacacttcagtgacaccccttggggcgccttggctgcactggacccaaagcccctcccctcccaggcaggggatccaccagctgaagcagcaaccttgccatagcttttcacaagctccaggcttgagagagtttataatccccatttctgtaatactcctgggaggtttcttagtaacctgcttgttcccatgctgccagtgccccatgcgtccagagtccacagctcatacacctgcacccaggacaatggaatctcagcaagctgaaagaagtcaaaacttcaggcatctttgggatgctgcagtggctgctgtgacagaggtttgggcccactccctttcctgtttccaagtcagcaggaagaaggctttgctatggagcctctttaagccagctccatggaatgggtctcacccttattgtcatgccctaagattcataaggcacaggatctgaaagacagcttcgagcccctgtgcctttcagatgacaacgctggggctagagaggcgagacagcttggctgttatccctgagactctgcttgccttttcagaaatgtgctctaactttgttctgttggaactttataatgacggaagagcaacacaaaaacatacgaaagtggggaaaatagagggaaatagagggggaaaaacctccatccataacattatcagccttaaacaattcccttttgtaatctgagggaattccttttttttttattcagacagaatcttgctctgttgcccaggttggagtgcagtggtgttatctcggttcactgcaacatctgcctcccaggtccaagctattctcctgcctcagcgtcccaagtagctgggattacaggcacccaccaccatgtgctgctaattttttgtatttttagtagagacaaggtttcgccatgttggccaggctggtttcaaactcttgacctcaggtgatccgcctaccttggcctcctaaagtgctgggattacaggtgtgagccactgtgcccagccaatctgagggaatttctgtcccacacattaagaagtaatttctctagcccccatcccgcttacttaaaactacctcttacagcagttacccacttctgccttgcattacagttactggtgttcttgacttgtttcccctttttaatttataagttccttgaaacggagactatattttgctcacttttatttaatccaacactcatttattgagtaactactatgctagatactgaaatacaagcatgagtaagtaaagatttcttacgaaattcgtagagtagtggagaagacaaatatatacaggaagcaaatatctgtcacgggccagacatattacaaaaggaggctcaaaagagggagcagacgctgccttagtggttgggcatggctggggcaaaggcacggaggatgcatgagtgggtggcagcagctggaccacataggaacaggcaagggaatttggcctttatcttgcagtcatggaagccactggaagttctcacagagattgctttttttaaatttttttttattttacaagatcactctggaatatgaatggaggggacaagagcagtggctggaaaatcagtttggaagtgactgcagtagtcctggtgaaaaatgagggtctcaaccaaggcagtgctagtggggatggagagaaataggtggatttaagaaatatttaagaggtcaacctgatgaggtttagggaaagagacattccctggatggatctcaggtacagattctgtgagaaatggaggccagccatatgggagagggtggccttgcccaggaatggatcctcaaggttcacatacggacttcatatctatagcccctgaattgtacataaacgaatgtgtgtgcttgaaagtgtatttctggaaacacattttgccatttaacaaccactgctgcagttgtaaaagggaaaagggtcaagaacagaacttcaaagggaataccaacacctagggaattgcgcaagagggcctgcttgaggttgagattagtgcctcatttgtataatttcctcattgttgaattacagataaaactcggtagatttttctctcaggtgtaactattaatattaccaatcacagattaattgaatcctgggtcttacttttagaagtttccaagatctttctaatcactcaaaaccgtggccttccagatcctgggactcacgggcattttttggaggaaattctttctgggagccttcactcttttgccagttgtatctcttctttatagactattagaggtcactaaggaatgaccttagagtttgcgttttgagatttaagatcggctgaaggatttgttgttaggcctccctgcatattctatagtctggagacggggtaagggggagtgagaaagagaaggatgttaagagcggggacaggcagttagaggcaagacgtcggtcaagataaacacctgctgtaccaaaatatctcatgtgtcccataaatatatacacctactgcatacccacaaacattaaaataaaaaattaaaattaaaaaaagaatttataaagtcacaataaatatgtcacactaaatatggggggaagagagagctaaatgcctggatatcttctcccaatcccaggctctctttctccccagattgccattgtgtctgtggtttttcttttagaaaagacttcacttctactttcacttcttcaggtaactaactgcatctacatctttaaggtcctttgagcatcttgtggttgcccttagcaacagctgcatacatgggttttacaggctctgtttctgaccaaaccataggatcaaagcctttcagggtggcacaggatcagagcccagccctctctctgatgtctggacattgtctacaacctccctgctgctccatccacgcccggcctcaccctcaccccacccacaccatgcacagatcattttcactgtcagaaagttctttattaggctgggctcagtgactcatgcctgtaatcccagtactttgggaggccgaggcgggtggatcacaaggtcaggagttcgagaccagcgtggccaacatggtgaaaccctgtctctactgaaaaatacacaaattagctggacgtagtggcgggcacctgtaatcccagctacttgggaggctgaggcaagagaattgtttgaacgtggaaggcagaggttgcagtgagccgagatcgcgccactgcactccagcctgggtgacagggcgaaactccgtctcaaaaaaaaaaaaaattcttcattagcctgagccaaattcctcttccctagaactgatgcacactggtggaacagtttctacaaagggtcagtttcccatgccccaaaacatttgaaattatcacttagaatttttttcctttgttatttgttatgaggtatttgtgcaggatgagagggaggaggaattgagattaactttcattttgaatttattaatctttgtactaattattccatgttgactataaacaaacctaaaaatgcagacagggtgatagaagaaaatggattttcctataatcccaccatccagagagaattattgataacattttgatctatggccttccagactttattctgtgatacagaaatgggactatgctatatgaactgttttgaaatctgtttttaaatttaacatctggctgggcgtggtggcacatgcctgtaatcccagcactttggggggctgaggtgggcagatcacctgaggtcgggagttcaagaccagcctgaccaacatggagaaaccccatctctactaaaaatacaaaattagctgggtgtggtggcgcatgcctgtagtcccagctactcgggagggtaagccaggagaatcgcttgagcctgggaggcggaggctgcggtgagctgagatcgagcccttgcactccagcctgggcaacaagagtgaaactctgtctcggaaaaagaaaaaaaattaacatctactgcaaactttttctgtataagtgcatacgctacttacttatctgtagtaatttattcttatacatataatgttaatttgtattatcatttttgcagctgaagtatatttcctcaaatggattaaaccaggttttggaaatgcattttgctgggatgaagccaggttttgatgcagtttcatgatcatccccattctgtgacagctcagtacctcataggagacctacatgggtgaccccatcagggacactggtggggtgtcacaccagctgagtatcaggcccatggtggttacctaggctcattgtgcctatgacacagctgatttataatctggtggcagacctgccttgcctccccagtgagagcttctgcctcacctgctgatttattgcataactgtccccagaagggccagtcacatttcccaacagaggttgggaaggtactgctcaaacaccaagcccgcaacactgagaccccttgggtttctctctgaaatcctccagttggtgcaacattgaaccacttacttctctgtctggtagtagagcatccctcgttggaagtaagccactgccaagtgcttgtctcggttaatgcttctggtaaaggcctgaggagagaagggtccagacatggccatgatgcaaggcagtgaggaggtgtgagatgagccacggctcacagagccctagctccctgtggtgcccagctctgctgtctgccctcgtcggcacctcgaggcccaccctgtgctctcacggtgcaccccacttcgctctcacatttagaagctgaagtctgggacaatggtgtgcattccttgtattgtcattccagttctgctgtggatctacaaaacattcctggagccatacatataccatctgatttctgcttttgttagtcatatatggcctagaaaagctacacaagaatccaataattcccaggtgcggttgctcacacctgtaatcccagcactttgggaggccaaggcaggtggatcacttgagcccaggagttcaagaccaacctgggcaaaatagtgagactccatctctacgaaaaatttaaaaattagtcagatgtggtggcacatgcctgtggtcccagctacttgggggactgaggtaggtcaatcgctcaagcccaggaggtggagactgccgtgagctgtgacggcaccactgcactccagcctgggcaacaaagtaaggcaccctgtctcaaaaaaaaaaaaaaaaaaaaaaaaaaaaaatccaatgatacaaataaagacaaagtggactataagggtgcagacactaatggattatcaccaacagaaatcttagaagaaaagaaacactaaagcattttcccaaaggagctcatcattttaaaaatggacttgacaatatgaagcgccttctttgtaactgtctctgaccttctctgagactagaattcagaatagataatttagacatttacctgatactaataaaaaatacatatctatatttaaaatatagttagttatatttaatgacctcattcccaagttcctttttcattagtgtagctttcatttctattatcgctgttttaataatatgatttaatatgattagatagaagctttgagccagtagacactatgttactaaatcagtactttaaaatctttggtcttctgtctttcattcatatgaatttaactgctgtttgctctaatttctttgagttctcctagtttgagtagagtacaattttactgtgaaacaatgcagcgagactgtgctatgaagtgaaggtagagtttttggaggtgataatgatgtcaaacttaaagatacaattcctatccaacacaacagagcaccttgtccaggagagtagtaattactatttattgctctgtggaagataaaaaagatagggaaataggagaagcttctttgaaaaatgaaacatcattagacgggcttggtggtgcatgcctgtaatcccagctacttgggaggctgaggcaggagaatcacttgaacccaggaggcagaggttgcagtgagccgagattgcaccactgcactccagcctgggtgacagagtgagactccatctcaaaaaaaaaaaaaaagaaagaaaaaatgatatctaatgtaataatgaaattttaacccttgttgcatttcttgtattcctatgaatgtattgaacattcagtttaaataaataataaaatttattgcaaatgaaaataattaaaatattatataaattgttatatttgtttactatacaaacttatacatgaatagtatacaattaaaatgataatgaataagaatgcatataaatgctagtaggaagggctcaagcaggaaaacaaagaaaggcagaaggaatgagaaggctagaagcagaggaatgccaggagaaacagagacatgtgggcctgaaggcctgggagctgagaagtgagtggtggcccacacaaccttgccaaggatcccatatccaggccaaggcaggaggctacagtccctgctggcatagctgtgcccagactagctgccaatctcttctcctggacaatgtgcactttgtgtccatcagccctcagaatgtgtggtgctgttcactcagcccctcagcaggcccctgagaggaggtggggccatgtccttcctccagccagaggtggggggtcctgccatgctctgccttagagcctgagattgacttgtcaagctatgtgagaacatttcagtcacttctctgtcttcctgtcaggagggtgtggctgaggcttgtttacctactgttggagtgtggaagggactgattctttaagggacctggggagtcaaccactgccacaccttgcaaagactggcagtaatcggtaaaaataataactaactcttatacagtggtgtgaagttccacgagacattaatagtttggcatctcacttaattttcatgatatttagaaactcaggaagctgaaagccagatgtctacataggctacatagcttgcttaagactaaaagtccagagagagacagaggctaggattcgatcctagatcttctccttccaaactccataccctttccaccttaccacaaccaatcaaaaaaataattatcgagaatgcttaactccatactatggtatttgagtgagaaaacataacgaaaaagatgcgagacatcccacaccatgcccccagcagacatcactagtcaatcacagtacaatttcctcttgccagcctcagcatctttaaaagagtctcctttataattgatcagaattgtcacttgggataaaagctattttttgtaagtgcctcccttaaatctcttgagcaggcaaagtcgacacacatgaaagtcttggaaagccaaaagaggtgccttagaatcaataatcaggtgtaaagcgctgggatagatagagattctgtgcccagaaggagttctgtgtagaagaaagtacgactaggacagccttcacaaaggtgttaaagacacttgtagaatgattttaatttagaagatggagaaagaggcaaccctggctgcccctcacctgctctccacctggagagcttttaaaactggctgcctggggcccctcccagaccagttaaatcaggctgtctaggggtggagcttgggcaacttttgttcttttcaatctccccagaggttaggtttccgaaatgcaatggggttgagaatcataataacaaatgcacagaggaggcccggaaagaggcacctccactcaccttctctgcttcagtcatgttcttcaggatagtgtacatgcagccaatgttgaagcaaatccgggagtgggggtcctggacggcactgaaggcatccagggctcccttccagtccttcttgtccgctgccagcaccccttcattccagaggctgatggcctccaccagggacatgattaggtagaaactaggaggccaagagagctgccaggagacagagagaagacaggttggagcgtctcccctagcagggctgccttagtggcccccaaggtgttcactttctgggccagatgagtagaatggggcccagcctcccttaagataacttctcagtgttgcaaatgcatcaggaaatgtccccaccttttggcaactgactcataaccctaccatgagagagaaaaggaaagaagcagagagagagagggcgagtaggggtggagtgt

SEQ ID NO: 2616 - DNA, 35360 bp, Homo sapiens
  source 1..35360: mol_type = genomic DNA
tgaaaaaagaaaacaaacaagtttatttgtatatgccttatgagtaacctataaggttacttcaagccttaagagccaattacagtaatggttcagaaacaggaatatttgtacttactccttgggcctggacttgggtgtcttgtttttgtaagatgctaggtttttttttattgtggtatgacacagaaaagtgcaccaaatgtacagcttgatgaatgtttacagtgtgaacacagctggctagctagcactcagagcaagaaacaggatcagtacctggaagactctctcgtgccctttccagacacttccatccacttttcctctcccctaactcctccattcacctgtccccatctcctcacccactgtgccccaggaaatcatcctgggtactcacatcattgtctagtaggttaaattttaacagggaataaatagttaacacttccaaactgtaatgtctcagtacagtatacagcagaagggtgctaaatcttacaaacaagtaatagggcttcattttcttcagctttgtagtttgtgaaacatcctagacttctctccgagtgctttccaaatctgtagttgcgcagtcttcaacaaaaactttggggaaaatgcccaccttccctttgcactccccttccagccattcttcattcactgataaaaggaaaagtacacatggatttctaaaaccactgtaggaagattaccctgtctggctattccacacagaatttgttatctgtcacccttccccacccctaattgtgatcaacagggaaaagacagtattgcaaagtggtttgagagtgaacacagggtttaaccatcttattgatctgtcttaaacatgataatgagcaaaatgaagaaggataaattatgtttttcaaaaagttaccagatagagaagaagggtcaaagaaattgaacaacgaatccttaaatagaatttctgtcctttccccacccccaaccttgacagggtctcactgtcacccaggctggagtgcagtggcacaatctgggcttactgcaacctctgcctcctgggctcaagtaatcctcccacctcagactcccaagtaactgcaactacaggctgtgccaccacgcttggttaatttttgtatttattagagacaggatctcgccatgttgctcaggctggtctcaaactcctgggctcaagtgatccacccaactcagcctcccaaagtgctgtggtgataggggtgagccaccgtgcctggcccaattttttaagagaggagagaattttacctgcgctttgttgggaatctttgttttgactacagaaaagggacatgccattggttaaatatattaaaaatgaaagttctttagtaaactttcttcttttcactgaactccattaaacaggtgagctggagctagtgatgggttagtacatgtttgttaaatataaatattttaatagctcctactcagagcctttaatagagtgcaggcattgtacttaaaaaatatattcagacttcataataacttgtaggtatccatattttactaaggaaaaggagacccagagagatgaatagtttgttcagagccattctgccagtaaaaatcagacaacttaggtatgatctccaaagcccacctacctgaccacacagccagttcagaagtttgtctttgtacatctagatcagacattaaggcactggtgcctggatcctgcccccagaaattttgctttaatgtgtggtgtgactgggcagcagttttttcaaaagttcccttaggtaattctaactgcaaatcactgtcttgattcttcttacagggtaggtcgtggactggaagcatattagaaatgaaaaatcccagatccaaaccagagtcagaatccatttaggaagattcgcaggtgattcacatgcacattaaagtttgagaaacactttgtagatgagaccatctcataacttgaatgcaattgaactcccctctgtcctaccctgaccgctaaattctgttttctgttgaagtgctacaatatgggtatttcctcaacttagacttgtacagataggtcatagtaagacgcatactggcttctctccatatctacccaaaaggttgttttagtgtgttctttcattgtattcctgctccctctcccaaactccagacaattgagctggttggttgatttaggcacctttaaagtggcacttggaggtgttcaacccagttcttcccactgagttaccattctctcttgttggaacactctgcttctatattactactactcatatttttttttttgagacagaatctcactctgttgcccagactggggtgcaaaggtgcaatcttgactcactgcaagctccatgtccctagttcaagtgattctcctgcctcagcctcccaaggagctggaactacaagtgcacgccaccacgcctggctaatttttttatttttagtagagatggggtttcaccatgttggccaggctggtctcaaatcctgaccccaagtgatccactcaccttggcctcccaaagtgctggggttaccagcatgagccaccacgcccagcctatactactcatatttttaattaattgctacacacttgttgtatactctctctacccccattaactttttttttaattttaatttttttgtttttgtttttgttttttttttgagactgagtctcactctgtaacccaggctggagtgcagtggcacaatctcagctcactgcaacctcctcctcctgggttcaagagattgtcctgcctcagcctcctgaatagctgggattacaagcacctaccactatacccggctaatttttgtatttgtagcagagacagagtttcaccatgttggccaggctggtcttgaactcctgacctcaagcagtcagcccacattgacctcccaaggtgctgggattacaggcataatccactgcacccggcctatttttattttttttaagacagagtctcgctctgtcacccaggctggagggcagtggtgcaatctcggctcactgcaacctccactcccgggttcaagcgattctcttgcctcagcctccctagcagctgggactacagatgtgcatcaccacgcccagctaatttttacatttttagtagagatggggtttcaccatgttggccaggttggtcttcaactcctggcctcaagtgatccaccacctcagcctcccaaagtgctgggattacaggtgtgagccaccaggcccagcctaccctcattaactttaaaatttccccctctctttgtctgttggattttctgttataattgatggtagtttttcactgctttgcattggtagtgcacagactcagcgtatgagcagggcttttatgatgggacttttttgtgtcgaggtagagaattaggctggcaaaccacgagttggaatggtgcttcttaagagtgtaggcagtagaccagcatcacctggaaacttggtagaaatgcaagttggtgggccccaccccagacctgaatcagaatctctggagggtgggcccaggaattgatttaacaaactcttccagggattcttagaactctccacttttaagaggtgggtcttgctgtgttgcccaggcaacagccttgaactcctggcctcaagtgatcctcctacctcagcctccctagtggctaggattacaggcatgctgtttcaatttttagtctgttcattacaaacagaatcaagaaagtcaccagagacacaggatagttctgaatagctggtttttaaggcaaaatttacctacttttctctttgaaaagtacattaattcaaagaactatggtttgcagaaggtcatacagcttgatgcaaaggcaaagtgattccagcccaatttgttacctctgggaatgagaatccatggtttccaaagcatactcctctttaataatcaagatgtttatcgccggccaggtgcggtggctcatgcctgtaatctcagtactttaggaggccgaggcagttggatcacttgaggccaggagtttgagaccagcctggtcaacatggcaaaaccccatctctactaaatacacaaaaattagctaggcatggtggtgggcgcctgtaatcctagctactcaggaggctgaggcaggagaattgcttgaacccaggagggggaggttgcagtgagccgagattgtgccactgcactccagcctgggcaacagagggggactctgtctcaaaaacaaaaacaaaaacaaaacaactcagcttcttgttgctttcctggctactagagcaatagacagggaaagtctgagtgctcaactttgctccctccagctagatgctaggaagggggttgaaaacactggctaaagttttgtttgtagattattgatattttcttctctctgcccttgaccttgtttctgctaacatgtaaatttgtttctatagtcttggagtagcacttaccctttgataacaccaggattatatccccttcctgaaactccaggtcctctggttgggtagcctcataactgaagagtgcctccacttggctgcctttcttaagctgaggttctgttgtctggttattagcatcagctttttcactttccttgggttcatctggaaagccttggtcaccctgaaataataaagggcctgttaattttcccaatttcctgccaagtgaacactgaacatcactaaaggaaacagcgaaatgtcaaagtagaacctgggatataaactcataaagtttgtgatcagtgccttgtgtagagcttatatgctctttatgaatactggatggttgggtaaatcagtccccaacctttttggcacgagggaccagtttcatggaagacagtttttagatgaatggtggtgggtggtgggttggggggtggtttcaggataaaattgttccacctcagatcgtcaggcattagattctcataaagagcatgcgacctagatcccttgcatgcacagttcacaatagggttcacactcctatgagaatctaatgctgctgctgatctgacaggaggcagagctcaggccagtatacctgcagctcacctgctgtgcagccctgtgctggcccgtggcctggaggttggggacccctgggataaatgaaaccaaaaggtctgcaaaatcatatacagtcttaaaatatcttactgaaaccttacaataatcttgagacaggtagaatgggcattattatttctttacagatggggacagagccctaagtcaaaactggctttcttagcatcaactctaacagcaacactagggaccttgttagaaatgcagactttcaactccatcccaaaactactaaatcagaaactccctgaaggtgaatcctgcaatctgtattttaagtcctctagggaattctgatacttgctaaagttcaaaaaccactgcacaatgccatacttgttttatctgtaacaacatttcttatacatcttagacttatgatcttagacttcttccacattattgtcacttttgcttcacaaatgaaggagaaggatgcggtttctacagatgtgaatcatagaatttaacaaatcaacattagaaatgctgctaggcttgtatgtaccgagcattataagttctagcttcttaatgttgtttgttgaacgttggtatatttttattgagaggcaatacaatgaggtggaaatggccctagagagtccacagagaaaggtttgtatcccacctccactgcttaccagctctgtgtccctaagcaagcagtgtaacttctcagaacctcagttacctcacctgaaattgaggctagaagaattcaatgagatgacatacaataatagtagttgacatttattgaacacttactctgtggcagtactcttctaaatatgtataaatatttagacttggttaatggtaagtgttcctgcatagagtagatgcttaataaatgttagttcattttatttttctttcttttcttttcttttttttttgtatttttagtacagatggggtttcaccatgttggccaggctggtcttaaactcctgacctcaggtgatctggcccatctcggcctcccaaagtgctaggatttcaggcataaaccataccaggcctcttttttttttttttttttttttttttttttttttttttgaggcagaatctctctgtcacccagactggagtgcagtggtatgatatcagctcactgtaacctccgcctcctgggttcaagcaattctgcctcagcctcccaagtagctgggactacaggtgcacaccaccacacccagctaatttttgtattttcagtagagatggggtttcaccatgttgcctcagcctcccaaagtgttggaattacaggcatgagccactgcgcctggttttctttctcctagtaagtgaaagcctgctttgttgcctccaaaagtaatggatagtgataaagaacattcaacagtgactcctgagcctggattaaattgcaaaagattgtggggagttgtaagagggttggctatgtgcagccaccaaatagattgaagctgctgtcaaaggaaaaaattttaattaaaaaaaagtttaagtgaagtagttcacatttagagcagaactccttctaggaagaatcttttaaaaaagatgctgaaggggttagtccaaagacagacagctggaaaacctagagtgacttttcagacttccaagagaccccttacactcacactcactcttacccccaggatcctggggccttttgtctcagccagagacaccagggagtctcatccccagtggctgtatttcctgaaggcaattttctgaacggggaagataccttaaacagctttatacactgcccttttctaggctcattctctttcactcttcttctcccagctcatgtctgtaatcccagcactttgggaggccgaggcaggtggatcacaaggtcaggagttcaaaaccagcctggccaagatggtgaaaccccgtctctactaaaaatacaaaaattagctgggtgcagtggcaggtgcctgtaatcccagctactcaggaggctgaggcaggagaatttcttgaacctgggcggcagaggtttcagtgagccaagatcacacccagcttgggcgacagagtgagactccatctcaaaaaaaaaaaaaaaaggtgaagaatggctatgagctgagccttaagctatgatatgacttcattccaaccttgcttgacagtaatggatgggatgtttgacacagtcaggcagggagctgatggaggggcaggaggctttctgtgagctcctgccctgctgggcctgctgttctcttgtgggaaactctctccctgctgcaaatggggtgaggatgcaggtaaaagggaggcagagctgtgacttattacacaccatatccccaacaccacatatagtgcctagtacacagaaggtgcttgataaatttcaaattgttgaggaagtggctcagtggaaatgtaactttagatgcccctcattgcactcaccactgtgttctcacaccacagagtcaggcagtagtttttcacctggccccaggcatccttcatgctgtcttctgaaaggggcaccagctcattgctgtcccgaggccgatagctgggtggggataatgagtaagaatccagtcaaagaacatcatcacaaaaaccatcctcctcttccctcctccaggccagcacaaggttcccactgtacccctcacagctgcctgcatggagctcacctcagcttagtgtgttccagccggagctccagtttcttagacaccatgtcccggacctggctgtaggggagcccgggctgagtcttcatgactaccgtgtacttgtagtgcaccttgagtgtgtagggcatgggaacactgagcttcacttcctgagtggggaggaaacaaagggaactcctgagtgtctgaggctttctctcaacatcctggatcaccgcagtttcgtgatttggcacagggggtacccaatacagcaggggagaggccagtaagtaactggtttcacagtagcctaaaaggccttcagaggtcctttagcccaacccttgcttggacaggaattcctactgagtaagatctggcccactagcttgggtagtaggaagtgtgtgcatgatagtggaggaggctattaagaaggtccctagctcatggactctgtaaggtagcaactggttcgaccctccctttggggctcttcctataatccagacagacatgtctgtggttgatagcccaagctatcccatcttctaccacttgaaacagtatgagggaaaaatgttaccttaggctcttctttttgtttctggcctgaatggaaaaagtagggagtaaaacaaaagaagatggtgaatgaacatccttggccagcccctgccacacacagatgaaacctcttcaaatagggcccccaacctcttaccctttaatttgtggggcaattattaaccttagtaaactgtggggaaaatctcgccctggggaagcatgaaggtcatgaacacatgaacaaactcagtctctgcttctagggagcctataggtaattaccaaaggaccagcatatcctcaccaacccacaaggttagcagggatcccaaaggtcaattaagcccacgggatccaaagcaatgaaaatcggagtgcaaggtgagccagaggccacaggaagaagtattagaaccactgatcctcaccttattctttatttttgtgtatgtttcctaaagtttattaatttaatctaatctattaatcaagcaatctaatattaatctaatttatgtaagagtagcatgcataaagatatttactatagggggtacatgatcagagaaggccactgatctcaaacctagctgatcattagaatcacatgggaagtttttttctaaaatacaaattcccgagccccattccagtcctaaaatatcagagccagtagcctaggactctgtattcacaaaatcatcctaggtttatatgtgatccttgatgagcctctagacaaaagataacaacaaaaaacctgtcaaggacattgagcaggagcaacgggagaaatttgaatatggaatatacattatataatactatcatatgaatgtttagtgtcctagataccatgattctattgtgattatgcaggagactgcgtttttgcagctgtgtagggtgaagtgtcacgagtctgtaacttttcaactggctcgggggagaaaaatagaatggagcagggcgagttcatggtgcaaaatgttaacaattggtgagtttaagtgaaagatattctgatgtttattgtattctactgtcagcttttctgtaggttggacatttttcaaaataaaaatgggggaagggacatcccgagtgattctgatgatcaggcgcgtgtggcaatcattgatctagaatctggccaaccactcactctgcgtctctaccaagcgcttatccagaatctgcttcaagtgcacttcccaagacagccctctccacactaggaaacagcctttcagagagaacatttccatttcacatctgcccattggttctttgttcatcctcagggctccacagagcaatttcttttccagatacagtgcctcagacatttgaaaacagccactccatgcccctcagagataagcaggtatagttacttcaacttttcttcctgagacatcgtttccctacctaatgatcaaggggtttggtgactacgtgagtcactcaggaaccagctgcattcacccaagccccgtgagtgttctgcagaaggcagggagagagggcactgatttcatgtttggggtgggtggtgcaggaaagggggattctggggctgcgtggtcattagctgagtgacatgttgggagaagaagaaaccagaatttcctggaaggcagggagaggaactcaggaagcagcctggcatgctgctgcacccagacctaggctgtggctccaggaccactcacctggtgacagctggggtcttccaggggctttggaactaggaggagctgggatgtcggactgcggagagctttcctcctgaaggcaacagggagcgacggtcagaaccttcattcaaagttcccaggcaggggtggatgtggggaaacacccctacagagaccccatgtaaaggagccacatgcagataacgtcctaaaagttggaatggtagtgacatttggggaagacgaaggaaatgttggccaaaagaggaggtggagttggcctgatgaaaatgaaaatcacagtagaaagaagaatcctaacccgctaaaacgcccttgccgctttagcaactctttcagccatattggaaatccactggccgtggggcaggactgagctcttgtctccactgcagagggcattgagaaaggaaaaattccacttctcatttgcaaggcatttgaagcttttcaaagcatttggatatggtgactgaccagggagggctgagctcatatacaactggttgcacagtctagagacagacagtctccactgccattgagtcacttacagggatgctcagatctgacaaagacagctctctaggcctggcagaaggacagacttttgaagtgtgagggagggagtagcagcagtttagaagcagtggctggcaaggcccactctgattcaaagctctaaggcagatctcattttattatttttatttgtatagaggtggcatctctctattttgcccaggctggtctcgaactcctgagttcaagtgatcctctcacctcagccttccaaagtgctaggattacagccatgagcaactgcagctggcctcattttctttctaatggcattgtaccagccaacacattgactactcttccacgtgaagcagacacacttgggaagacctaacccactcatatactgtaggctttgcttcccaagtgacttctgaccaggaagagtcacagaggtgggtgggcccaatgggacctacagatgcctccaacttagcacatctgggcttttttcccctcattcccaggttcagctctgggtagctggtgccatctcaaggcgggctcaagactagtgaatctttctccaggggtcctgacaacacctcttttacactgcttttctcccctccagggagagatccctaaagggtgagaggaaatgggtcaggccttggcatcacattacctggggctgctgctgagggtggatccgcagctcaactggttcaaggtagttgcagggaacaagccccttctgcagtgcagcaccacagaatcagaaaggaaaaaataaagatgtgctcatcagtacccacaccacagaacagcccagagtcctggggaagggatgacgaacagacaaaagaacttggctggtctgcaaagaaggcagcagatactgctccacagagactgcatttgctgccaggatcccatgcccatcgcaccagcccctgatcctctgcatacctgcccgttgaacatgaccgtggcccagttatcattgcccttcttcaagacaaagacaatgttccctggcatgacctggagctcttcttttgtctcaggcacaaacccaaatagcacacggtgagcctccccttccagagccctgcagaggatagacacaagatccagcccccatcccctcacatgatgccatggcgcaaatacactgaacttggagccagggacttggctccagcctggctctaactccacatctaactgcaactgccgagatgacactgagcctgcctgggctcccaagaggtctcagcaagaaactggtgtacacctgctcataaccatatatgcagaggggcaagaataaagcaaaaaccccacaacactagatagtgaggacttacaatccttgccctcccttctgctctgaggaggaaggtccctggctgtgtcatcttggccagcacccaaggctgggctggggtggggtggatcaggtgactgtggtcaggggaacagcacaaagcagaagtcaggtgagagccagctgggccagaaagattggtgggagaggaggaaggagaaaccacctagaaccagtgttgggccaggatagagagaccgtgagcagggtaggtgacagggagcgtgagggatgcacatagagggctctgaggctgcccagctgccgtggtgcagtgtcggttcccttaagtctgacttcatgcttttaggctttgaggctctgattggcatcactttggaacgtgtgactgagaggctggtgttcaggtttcaggcttccctccctttactccccactctgttactttcccctcggcccatccttgtttccagacatcgtgcctactcctgtagggaatacaggcccttccagctgacagggagcttaggaatgagctcatccagccccctcatttttgtagttgctttggtacttttgtcacttttttttttttgagacggaatcttggtctgttgcccaggctggagtgcagtgacatgatcttggttcactgcaacctccacctcctgagtgcaagtgagcctcctgcctcagcctcccaagtagctggtattacaggcacatgtcagtcaccacactcagctaattttttcatgtttagtagacatggggttttgccacgttggcccggctggtctcgaactcctgatctcaagtgatccgcccacctcagtctcccaaagtgctgtgatttcaggcatgagccacacacctggccaatcactttttaaaacctcctttttgggtgggaggaccaggcttgcttcatcactttgagagaattcttaagaaagctgtaggttatgtcaccctttgtttttcatcttacagaagaaggacttccttttcttcagtccttcctctttacttcttcagaaagcatgtgccgatagggagtggaaaacatccacacaggaaaaaggacgtcattctagattcctgactccagagagctctggcctgcccccgtcagaggggactgcagccagtgcgaaaccgatctccaacctgaggtcagcatcctggtccccagggtagctatgttccacagaacaccactgcccctcagcaacaaccccttgccatgtgggtggctgtgcacgtggacagagggccaatgggacaccacgtagctgcagccaagccctgatggccagccccaccacagtcaagactcccatccccatcatatcattcctttctagcctgacattctagaagacattcttctaggcattcctttctagcctgacattctagaagaagcctgacattccagaaaattcaacaagatttagaccctgaccccaccttcatcttcttccctccctttcttgccatcagctcaggcttggcgcttggatattctatttatggatttgaatctaacttacctgaagatctctggggttttcggtctgggtggaggctcagctgcctattgaacattcaggagaagtgaaaacggaaaaggcaatgagggaaagcaggggagagacaacaaacggctaatggtaatttgagcattcttccagaccagaaaatcaaataacgcatttctgactgatgagaacactgtctaggaagagggcacagtcaccctgactaaacactgggaaataacacctcccaccagctccccaggtacaggtttcactagcacagcaattcattttgagccagagctagtttctggaggttagcagtcacacagcaacatggtgtcacaagaatgctttgaccttgagctctgtccttttcccaggacagtttccaaaagctctgttctgtaattaatgtctactatgtcacatgacacttctgagtatttttaaattaatttaaaaaaaattttttttgagatggagtttcactctgtcgcccaggctggagtgcagtggcgcgatcttggctcactgcaacctctgcctccctcattgaggtgattctcctgcctcagcctcccatgttgctagaattacaggcatgtgccaccacaccctgctaatttttgtatttttagtagggacaggggtttcaccatgttggccaggctggtctggaactcctggcctcaagtgatctgctcacctcagcctcccaaaatggtgggattataggcgtgagccactgtgcctggccacttctgagtatttaaaattgacacaggatccactgactgggcaagaatctcctcccctgttctacactgaataccatggaatccagttacctgggctgcattcccctcatggcctctggctgaactgaagctcaagggacttcagcaaggctttcatcagctttattgtgaagaaagagatcaaggaatctagatctggaacatacctgcccctgctcagaaaaccgccctctgctagtgctgaccaacactcttgcccatcacaggttcattgccacagagttcgtattttccttaatgtgttttcccctctttccttcacaaggaagctctgtgtgcatttctagatccactatcatccagttcatctgagctcacctctccaagcccagcttgggcagaaaaagggttcactctcagtgcgctgcctgtgttcccgaaggaaacccctgcacatgagcagatgggtagagccaggagagcccaaacctcaggcccaggccccacagggttccccacttgcccctgtactcaagaagaggctttgttaataagccttccatagcttgtgtttcagcttcctgagagaatagttgaggcttcagagagaggatcagcagatctctttagagatgtgaagaccggcatttgtggggaagcaggagagttagcttcagaggacttggggtgaagcctgacactgccttatttcctcaccagccatggaaaccaggactgagagagggcaggcagatccctcagctgcactgagggccacttgaaggagcccttacaatcaggcaactcagcacacatagtctctcgaattgaatgcttcacagaaagctctcgagacctaggtccatggagaaggtcaggactgccttacctgtggttgcagaggggcaaacccagagaaactgtcttgatccaccacagatgccacgacctaaaatcaaggacaggagggtgtgaggctctgccagcactgtttccattcttctgggtctccctctttgctcatgccctagacctgttcttacgtgagcctggtttcagacgtggacagtaactaaggattagattcctgagcctctggattaggatttcagcaactgaagaaacgagcattcaccccacccctgctaacacaggcttgctttcttctctcttaaaaaagaaatgtttttaattgaggtgcaatttgtataacatcaaattatctttttttttttttttttttttgagacggagtcacgctctgttacccagactggagtgcagtggcgtgatctcagctcactgcaacctctgccttccaggttcaagtgattctcctgcctcagcctcccgagtagctgatattacaggcacccgccactgtgcccggctaatttttgtattttcagtagagacaggttttcaccatgttggccaggctggtctcaaacttctgacctcaggtgatctacccatccagcctcccaaagtgctgggattataggcatgagccaccacgcccagcccaaattaatcattttaaagtgaatgattcagtggcatttatcacattcacaatgctgtgcaactactgcctctctctaattccaaaatattttcatcacctcagaagaaaatgctgtacccattaagcagtgtgtccacactcccctttcccctaaactggcaacaaccggtttgctttctgtgactgacttgagccctcttctctgagttttaaaaatcagatgtaaagctagctttattcacaaatatgcttaaactatagataattttcatcattcattcatataatcaaaacatttttgctgagagctgttatgtgtctagcactgtgccaggctgtgaggactcagtggagatcaagcagacatggtctctgctctctcagtgcttagaggctgcaccagatatttcctataaacggaattgtacaacatgtggcctttcgtatctggcttccttcacatagcataatgttttcaaggtccatccatgttgtatcatgaatcatactccattcctttttatggctacgtagtattctgttgcatggatatatcacattttgattactcattcatcagttgatagatatttggagggcttccactcacccaggctttcttgacctctgctgctatgctagacccagctacccgaccactgggcaactttagccctatgaatgtgtcaagtcaaatgtggttttggaagggcactgctgactcacttcagaccatgtctgaaagaatttaagacttggatttattattattattactattttgagatggagtttcattcttgttgcccaggctggagtgcaatggcatgatctcagctcactgcaacctccaccacccggattcaagcgattctcctgcctcagcctcccaggtagctgggattacaggcatgcaccgcagcacccagctaattttgtatttttagtagagatggggtttcaccatgttggccagcctggtcttgaactcctgacctcgtgatccacctgcctcagcctcccaaagtgctgggattacaggcatgagtcaccatgcacagccaagacctggatttagaagaagtccaatttaagacatagtctaaacatagggctgtggaagtggggaaagactcctcagcccactaaaacgtgaactacaaggagcattaatccaagaggatcccatgctgatctctttccctaacatgttctcttcatatttatttttattttttagaaacagagtctcaatctgttgcccaagctagagtacagtggtgcaatcatagctcactgtagccttgaactcctgggctcaagtgatcctctcacctcagcctctccactagctaggctggtctcaaactcctggcctcaagtgatcctcccacttcagccttccaaagcactgggattacaggcatgagctaccctgcctggccctctcttcacatttagtgagctcctcatggctgtgttttccctccattggctcagtccctaagactcagcatcctgtgagtaaccctgtggctctcacccagggtcgagctggaagggagaaatgggagcagcttggagaaaataaactagacatggttgcctatctttcagccaaacctctgtcctataaacaagtctctcattgccatcccagggacagagccacaaggaggctaccctcttctcaagagtccctcccaccttgctccacatggcccgggccacaggagactcaggggaagctgagcaatcccacctaccgtcgccttgcctaggtaatccttcttggccagctgagccacttgtctctcatttggtcgaaacagcttgcccacagggatcaccactggctcatatagcttctgcttctgtaacacagaaaacgtagcattcccttatgtgaaaatgggggtgacgatgcttgtcctgcctccctcagtgaatagatgcaagaattcattgagataaccacatagaagcccttttccaaatgagtgttgtcattcctctagggtgttaaggtaggaacccttggtttcaataccaccttctgctgcgaggccacatggacattgctgctatttgttgctattcagcaccctcttttcccagaggaactgctcctctcccactctgtgtgctgtccgtggggttctctcatggtgtagagggcaccaccacgacaaggctggcccgggatcaagcaaggctcatgacagtgctcccttggatgggtgtttgctgatgaggatagacatataaagactggcttgagtcctcttctctgtgttttaaaaatcagatttaaagctagccttattcacaaatatgcttgaacgataaatagtttttatcactcattcacaaaatcaaaacatattttaggcaggtgcggtggctcatgcctgtaatccctgcactttgggaggccaaggagggcagatcacctgaggtcagcagttcgagacctgcctggccaacatggcaaaaccccgtctctattaaaaatacaaaaattagccaggcatggtggcatgcacctgtaatcccagctacttgggcggctgaggcagcagaattgcttgaacccaggaggcagaggctgcagtgagctgagatcacaccactgcactccaggctgggcaacagagcgagactccatctcaaaacaaaacaaaacatttttgctgagagctgttatgtgcctagcactgtgccaggctgtgaggactcagtggtgatcaagcagacatggactctgccctctcagtgcttagagtctgtgcagcactgctccagcatccaatatcctgttctcctgcattgccaaggagccccactccaagggtggtgtgatgccagggctctgccatcccatactctaggcctcagcttctcagcacagattcaagatcttaagtggaactataccctaagatcagtgttacccagactcacagaaagtaaaagcaccacttttatggcttctcaatggcatgtcctctgagacaaatgagaatccagtgacatcctctcaacacctgcatcaccaatacgcttacccagacacactccatcgccttgtcgattttggaatgtctgggctcagacttcatgctcgtggccaatgctaactgttcttcagcttttttccattcctccttcttggcatacatgaaagcaatgttatataacacctagaaaagtacagaccgcaacataaaacttgagactactccaaatcaaggtgccagggaaaggctcacacgtatactctgagaatgttgcctggtagcctttctccctttctcagctctcctgggaatatctaaaatatagtgcaattagtcttgctattgagttatgtcaaacacaaacatggtgttaagaaaacaccatggaatgcgtaaatgcaacatcatttgtactcttccaacaacgaaataggtcaggaagggacaagaattattgtatacagtgtgttcaaaccaggttaaaaaaaagaagaagaattgttgtgttgttttagtatgagttgctttagtaaaagagtgacttgctcaaggccccttctagaggcagacacagggttgggaataaaatacaggtgtgtggtcttccagtccacctcctgccactgtacctaggctgaaacactggacaggtacagagccggaagatggatcaagatgcaacctcctgtaccagcaccagcagaacctggcccagaccatgtgagtaacaagactaatgtagcaacacaggccaggcgcagtggctcatgcctgtaatcccagcactttgggaggccaaggcgggtgaatcacttgaggtcaggagtttgagatcagcctggccaacatggagaaaccctgtctctactaaaaatacaaaaattagctgggcatggtggcaggcacctgtaatctcagctacttggaggctgaagcaggagaattgcttgaacccagaagacagaggttagcacagaagccaggggcaccttcacctcaggtggggggggaatggtaaatgcaacagtgtcatacttttccaggtcttgagttgggctgtggttcttgagtgtctattttactattgtgcttcacaatttacacacagaatcaaataatcgtttggatgcattaccaagatctaaaaaatggcccgactgaaataaattttttaaataggatattatggaaattagggggtgtgacatttgaggctagattataaaagacattgacactgtcttgctcttgggtcacttgctctcagagacgccagctgccatgtcatgacaagacttaggcagccctagagagaagttcatgtagcgaagaactgaggcctcctgccaacaatgacgtgaacttgccaaactcagacaggtggaaggattgatgtttctgtggcattagtggctggtgctgaatggtgggggccaggatcaaccccggaagtggaaatctggactcctttcagtcctatttctgagattcaatgagctactgccttctgaattcgttggcttctccagcccactcctgaccttgtgtgcagaaagaaagaactcagatcgtttaaaatttcctatttggttctcagccaccttctcttaagacatttctctacaatcagtttttatgaactaatgatgagaaaaaccttgacactcttcaaaaataatgatgtgattctcagaagccagggtcataccacatcaggaagagaaggattataagtagggaaatgactggaaggtcccatgtgacaaagagggccttagaccctgaaaagttcagctttacttgcagagagggccactcagccagtattttctgtcctctcagggccattttaaccccaactccaggggaaacattcctcccatggaactgtactttgatgctgctgtgacataatcctttttctagagccacttgtcccccaactttctaatctgtataagtggctgtcattggcttattagcaatgtctggagggattttaggttgtcacattgggtggggagtggtggtggcagtgctagtagcatctaaaagctagagatgccgtcaaagttcccacgatgcgcaggacgcaccacaacccctctctcgcctctgctacaatacaagattgtctggtccaacatattaacagagctacagctgagaaaccttactcgagaagttggtcgaatggcagccaattccaactgcaaagccccatcttctcagactgtgagacgtgaagttagttgctagcctgctgcagggttgggatggggccatatgtccccaggggccgagggcggctacagactctattattagccctgagcgaccctgggaacacttgacttcttgtgcctgagaaactaaagcaaggggacttttgtcagtgatttttctaaagaaaggtctttgacatttacaggaattttggttttcaaaactgctagtatatatttggaagtgggaggggtgggaagggccaaccggaaaaagtaaatgaacctgcaaagtcaaagccagtcatgtctctcccttttgataatagagaaaagaagttgttttgcagaaacctttacctaaatatgtgccttgagctgttctttgagcaagaggggacagatttatgccaaattatcctcagtctctctttaggtatcaatcaagtacatggggtaagaaccatggatagtaaagagtgtggtctataaacttgggaactgagcaagcttctggcaggtcctgcacggacaatgaactcatgattttggatttgctagcaaaatgctgaacaaatagcttgtcaatctgaagtgccaatcaaaacatgcaaattatcatgaatatttccacaagccaacacactcgtgtccagcctcccttcagagagcccggggggctcatttttgcatggtcctttgcgcttcacattaataaaatgtatgcccccaggtaactgatgacaatgccttgatgagcctgaaataatccatctcagtcttttcttcaaggaaaatctgagtctcaaggcagaggaggcaaaatggcttttccaagctcctggaggtgtcaacagatcactgtgcatctgaactgtcagccatccatccagccatgatcccctcctgcccaggccaggccctgttctccttacctcacaggcaaacagcttgaactggagccccaggatcttatagtctatcagctggttccctcgaagctgaatcaaggcttctttaaggtctttgatagccaaatcatatctgcaggacagagggagaaaatacagcagtctagtggatggagaaataaatgcagcataaaatgtgagtctgcttctcccttccccatctatttcactgggacaagaagcctttcagttccttttgacctgttctagttttcagcaaccctgagtccaagtattctatacaactccttgggaatggtgttccccccagggctgtgcctcaaagcaaccctgagtgcctcgtcttggacagtcacagggagtttcttctctattgactgcatacaactgtcacctttctgacaacctgacttgtcgctttccgatgcagctctcattctctcttgagagctccaagcagagccagcacctgccccctgcctgtgtccctgcagagtgttcagagctgatttggaatactgctcactcctggctcccaccatcaggccaggccagcctggcacagcttggaggggccccttcttatagctgccaccatcaccctcctgcccactgccttcgcccatggcttcttttgagttcaacttagagcttggttttgtggtcttctttgtttcctcaccgcccgccacttctgcctcctccctacactttggaaaagaaaaaaaaacaaccacttatgctatatagtatttcctccttttttttttctttttttttgagacagggtctcactgtattgcccaggctggagtgcagtggtgggatttcagctcgctgcaagctccacctcccaggttcaagtgattctcctgcctcagccacctgagtgggactgagctgggactacgggcgagcgccaccacgcccggctaattttttatattttaagtagagaccaggtttcaccatgttggccaggctggtctcaaactcctgacctcgactgatctgcccgccttggcctcccaaaagttctggaattacaggcatgagccaccatgcccagccccagatagtttttctaatgctgctcccactgccttgtgctgctggattggcgtggagctgactggctcgatgtataccagggctgctgtcctgggacttgtagcagagaatgggagctgaccacatcaatagggcccacaggcatgtaggtgggacctggacacacacttctgaggatgctggcccaggccttgaccatgggctccacagaggccctggtgggagggagccattgctgggctatagggggtgggagcagcaggcataagctacgccagcctcactccactcagtcccctgacctggcaggaacaaatttggctgcctggttgtggctcacacctgggcaactggactgtaagtctgtaagtccctaggccaccatctgacccagagctaccaacccggcttctcttggagataagcctggaatgtggacacaggctggcaggaatcctcaagaggcagtgtgatgtagtaaaggggccaggagccagagtccagatccaacagctctgccactaactgggggaccctagcaagtcactttcctggcctgaagttccacaccaatattatggcagcatattgtatacagggacatattatatgcaaagaatgtatcatatagggagcttgccagcatatggatcccacttctggagtcaaaaccacctggtttgagtcttggctccgtcacttactatctggtgagaaacggcaagttacctagcttccctaagtctgtttccccatctttagaataagagaataataaggccgggcgcagtggctcacgcctgaaatcccagcactttgggagaccgaggcgggtggatcacgaggtcaggagatcgagaccatcctggctaaaatggtgaaaccccatctctactaaaaataaaaaaataaaaaaataaaaattagctgggcatggtggtgggcgcctgtagtcccagctactcaggaggctgaggcaggagaatggcatgaacccaggaggcagagcttgcagtgagcagagatcacaccactgcactccagcctgggtgacagagtgagactctgtctcaaaaaaaaaaaaaaaaaaaaaaaaaagagaataataacagcatatacctcacaggttcattgtgagaactaaaggagatgaagcatttgggtacttcagacagtgcctggcacacaccataatttttttactattgtttttgttgttttattttctttagctctaacactctaccaattaatccatacatcagccacttattacgtgtttacttaaagctccgtgccatataagctattatcaggatattttaaaaatacatggcatagaagctggaactctgatctcatggaagtttagagctgagcacaagggctggttggccaagagagtcataaggaacgggtgccagtgtggctgggggagaagccatcaccattagggttgaggtaagtcacacatggtagcagtggctatgcgggaaataaaagaagagagcttgggtttgaaataggaggatggctttctctagtatccctgttaataaagatggttgtaaaacctactaaatgcatgcaggccattctttaagtagcaatggggcctttcatgtcttttccacgcatctttctgggttcctggaaagaggaagaaggtacccagaagtacgccagaaatcaggttccgctttctaagccagaaggtggggtaactagcttcaattcactgagcctcttccatcgcgaagaggacaggcagaagcagaggtttcctgtttcctggcagctgcaatttccactgtgttctattgcctgtttgggagctcgctgaaggtctcagagggcacacactttaactgccgtcagcatcaacctaccaacgtgccttcctccctgctgagttggctaagcagatggatttcagctgggaagtgacaccacctgggtctatctggcattgcatgagcccagcaaaatcctcctaataattccctagcccatcaagatgtctacagaggcccggtgcagtggctcgtgccggtaatcccagcattttgggaggccaaggcaggcggatcacttgaggtcaggggttcgagaccagcctggccaacatggtgaaaccccgtctctactaaaaatatttaaaaattagccgggcgtggtggtgcgtgcctatagttccagctactcaggagggtgaggcaggagaatcacttgaacccaggaggtggaggttgaaatgagccaaaaccatgccactgcactccagcctggttgacagagcgagactccaactcaaaaaaaaaaaaaaggtgtctacagatttgggcctggtaggagagagagagaaagaactgacaaattattcagagggtttgctttgttttaaagacagggtggacccgcctaggcaatatggagaaaccccacctctactaaaagtacaaaaaattagccaggcatagtggtacgtgcctgtagtcccagctacccgggaagctgaggttggagaatcacctgagcccaggaagtcaagactgcagtgagacatgattgcaccactccactccagcctggacgacagaatgaaatcctgactcaaaaaaaaaaaaaaaagaaagaaagaaagaaagaaaagaaagtccaacaaccaaaaaaacagggtggggccaggggctgaggtttgagcctgcagttccagctactccgccagaggctggggcaggaggatcacttgagcccaggagtttgaggccagcctggacaatatagtgagaccccttctctaaaaaaaaaaagattacttattttatttattaattttgttatagagacgggggtctcactatgttgctcaggctggtctcgaactcctgggttcaagcaatcctcccacctcagcctcccaaagtacaaagactgcaactgtgagccactgcacagggcctaattaattaatttttaaaacggggaaggggcatccttgctaagtgttttttttttttgagacagagtctcgctctgttgccctggctggagtgcagtggcgcgatctcggctcactggaagctccgcctcccggttcacgccattctcctgcctcagcctcccgagtagctgggactacaggcgtccgccaccgcgcccggctaattttttgtgtttttagtagagccagggtttcaccgtgttagccaggatggtctcgatctccttacctcgtgatccgcccgcctcggcctcccaaagtgctgggattacaggcgtgagccacctcgcctcgccaactaagtgtcgtttttaaacatgtctctgaaagcaccggcctgcttcccagccccctcgttccctgctgcaggcctcttttcggcctctccacttgtttacccagagctgcagccctgaagggggttccgctttgacacacagctcttttcccattacacaggttcgcaataatctcagtatgagaatcccaaaatagcattcagcgctgtgtgccagtgggccgtgctgcggcagcccccgcctccctctagcccttcttcagcggttctcttcgtggccatttggaagcatcccccaggaggcagccaaggtgctggcagcttcctgcagggctctgctgggctgggcatgggtgctttcttcacacccacacttcagtgacaccccttggggcgccttggctgcactggacccaaagcccctcccctcccaggcaggggatccaccagctgaagcagcaaccttgccatagcttttcacaagctccaggcttgagagagtttataatccccatttctgtaatactcctgggaggtttcttagtaacctgcttgttcccatgctgccagtgccccatgcgtccagagtccacagctcatacacctgcacccaggacaatggaatctcagcaagctgaaagaagtcaaaacttcaggcatctttgggatgctgcagtggctgctgtgacagaggtttgggcccactccctttcctgtttccaagtcagcaggaagaaggctttgctatggagcctctttaagccagctccatggaatgggtctcacccttattgtcatgccctaagattcataaggcacaggatctgaaagacagcttcgagcccctgtgcctttcagatgacaacgctggggctagagaggcgagacagcttggctgttatccctgagactctgcttgccttttcagaaatgtgctctaactttgttctgttggaactttataatgacggaagagcaacacaaaaacatacgaaagtggggaaaatagagggaaatagagggggaaaaacctccatccataacattatcagccttaaacaattcccttttgtaatctgagggaattccttttttttttattcagacagaatcttgctctgttgcccaggttggagtgcagtggtgttatctcggttcactgcaacatctgcctcccaggtccaagctattctcctgcctcagcgtcccaagtagctgggattacaggcacccaccaccatgtgctgctaattttttgtatttttagtagagacaaggtttcgccatgttggccaggctggtttcaaactcttgacctcaggtgatccgcctaccttggcctcctaaagtgctgggattacaggtgtgagccactgtgcccagccaatctgagggaatttctgtcccacacattaagaagtaatttctctagcccccatcccgcttacttaaaactacctcttacagcagttacccacttctgccttgcattacagttactggtgttcttgacttgtttcccctttttaatttataagttccttgaaacggagactatattttgctcacttttatttaatccaacactcatttattgagtaactactatgctagatactgaaatacaagcatgagtaagtaaagatttcttacgaaattcgtagagtagtggagaagacaaatatatacaggaagcaaatatctgtcacgggccagacatattacaaaaggaggctcaaaagagggagcagacgctgccttagtggttgggcatggctggggcaaaggcacggaggatgcatgagtgggtggcagcagctggaccacataggaacaggcaagggaatttggcctttatcttgcagtcatggaagccactggaagttctcacagagattgctttttttaaatttttttttattttacaagatcactctggaatatgaatggaggggacaagagcagtggctggaaaatcagtttggaagtgactgcagtagtcctggtgaaaaatgagggtctcaaccaaggcagtgctagtggggatggagagaaataggtggatttaagaaatatttaagaggtcaacctgatgaggtttagggaaagagacattccctggatggatctcaggtacagattctgtgagaaatggaggccagccatatgggagagggtggccttgcccaggaatggatcctcaaggttcacatacggacttcatatctatagcccctgaattgtacataaacgaatgtgtgtgcttgaaagtgtatttctggaaacacattttgccatttaacaaccactgctgcagttgtaaaagggaaaagggtcaagaacagaacttcaaagggaataccaacacctagggaattgcgcaagagggcctgcttgaggttgagattagtgcctcatttgtataatttcctcattgttgaattacagataaaactcggtagatttttctctcaggtgtaactattaatattaccaatcacagattaattgaatcctgggtcttacttttagaagtttccaagatctttctaatcactcaaaaccgtggccttccagatcctgggactcacgggcattttttggaggaaattctttctgggagccttcactcttttgccagttgtatctcttctttatagactattagaggtcactaaggaatgaccttagagtttgcgttttgagatttaagatcggctgaaggatttgttgttaggcctccctgcatattctatagtctggagacggggtaagggggagtgagaaagagaaggatgttaagagcggggacaggcagttagaggcaagacgtcggtcaagataaacacctgctgtaccaaaatatctcatgtgtcccataaatatatacacctactgcatacccacaaacattaaaataaaaaattaaaattaaaaaaagaatttataaagtcacaataaatatgtcacactaaatatggggggaagagagagctaaatgcctggatatcttctcccaatcccaggctctctttctccccagattgccattgtgtctgtggtttttcttttagaaaagacttcacttctactttcacttcttcaggtaactaactgcatctacatctttaaggtcctttgagcatcttgtggttgcccttagcaacagctgcatacatgggttttacaggctctgtttctgaccaaaccataggatcaaagcctttcagggtggcacaggatcagagcccagccctctctctgatgtctggacattgtctacaacctccctgctgctccatccacgcccggcctcaccctcaccccacccacaccatgcacagatcattttcactgtcagaaagttctttattaggctgggctcagtgactcatgcctgtaatcccagtactttgggaggccgaggcgggtggatcacaaggtcaggagttcgagaccagcgtggccaacatggtgaaaccctgtctctactgaaaaatacacaaattagctggacgtagtggcgggcacctgtaatcccagctacttgggaggctgaggcaagagaattgtttgaacgtggaaggcagaggttgcagtgagccgagatcgcgccactgcactccagcctgggtgacagggcgaaactccgtctcaaaaaaaaaaaaaattcttcattagcctgagccaaattcctcttccctagaactgatgcacactggtggaacagtttctacaaagggtcagtttcccatgccccaaaacatttgaaattatcacttagaatttttttcctttgttatttgttatgaggtatttgtgcaggatgagagggaggaggaattgagattaactttcattttgaatttattaatctttgtactaattattccatgttgactataaacaaacctaaaaatgcagacagggtgatagaagaaaatggattttcctataatcccaccatccagagagaattattgataacattttgatctatggccttccagactttattctgtgatacagaaatgggactatgctatatgaactgttttgaaatctgtttttaaatttaacatctggctgggcgtggtggcacatgcctgtaatcccagcactttggggggctgaggtgggcagatcacctgaggtcgggagttcaagaccagcctgaccaacatggagaaaccccatctctactaaaaatacaaaattagctgggtgtggtggcgcatgcctgtagtcccagctactcgggagggtaagccaggagaatcgcttgagcctgggaggcggaggctgcggtgagctgagatcgagcccttgcactccagcctgggcaacaagagtgaaactctgtctcggaaaaagaaaaaaaattaacatctactgcaaactttttctgtataagtgcatacgctacttacttatctgtagtaatttattcttatacatataatgttaatttgtattatcatttttgcagctgaagtatatttcctcaaatggattaaaccaggttttggaaatgcattttgctgggatgaagccaggttttgatgcagtttcatgatcatccccattctgtgacagctcagtacctcataggagacctacatgggtgaccccatcagggacactggtggggtgtcacaccagctgagtatcaggcccatggtggttacctaggctcattgtgcctatgacacagctgatttataatctggtggcagacctgccttgcctccccagtgagagcttctgcctcacctgctgatttattgcataactgtccccagaagggccagtcacatttcccaacagaggttgggaaggtactgctcaaacaccaagcccgcaacactgagaccccttgggtttctctctgaaatcctccagttggtgcaacattgaaccacttacttctctgtctggtagtagagcatccctcgttggaagtaagccactgccaagtgcttgtctcggttaatgcttctggtaaaggcctgaggagagaagggtccagacatggccatgatgcaaggcagtgaggaggtgtgagatgagccacggctcacagagccctagctccctgtggtgcccagctctgctgtctgccctcgtcggcacctcgaggcccaccctgtgctctcacggtgcaccccacttcgctctcacatttagaagctgaagtctgggacaatggtgtgcattccttgtattgtcattccagttctgctgtggatctacaaaacattcctggagccatacatataccatctgatttctgcttttgttagtcatatatggcctagaaaagctacacaagaatccaataattcccaggtgcggttgctcacacctgtaatcccagcactttgggaggccaaggcaggtggatcacttgagcccaggagttcaagaccaacctgggcaaaatagtgagactccatctctacgaaaaatttaaaaattagtcagatgtggtggcacatgcctgtggtcccagctacttgggggactgaggtaggtcaatcgctcaagcccaggaggtggagactgccgtgagctgtgacggcaccactgcactccagcctgggcaacaaagtaaggcaccctgtctcaaaaaaaaaaaaaaaaaaaaaaaaaaaaaatccaatgatacaaataaagacaaagtggactataagggtgcagacactaatggattatcaccaacagaaatcttagaagaaaagaaacactaaagcattttcccaaaggagctcatcattttaaaaatggacttgacaatatgaagcgccttctttgtaactgtctctgaccttctctgagactagaattcagaatagataatttagacatttacctgatactaataaaaaatacatatctatatttaaaatatagttagttatatttaatgacctcattcccaagttcctttttcattagtgtagctttcatttctattatcgctgttttaataatatgatttaatatgattagatagaagctttgagccagtagacactatgttactaaatcagtactttaaaatctttggtcttctgtctttcattcatatgaatttaactgctgtttgctctaatttctttgagttctcctagtttgagtagagtacaattttactgtgaaacaatgcagcgagactgtgctatgaagtgaaggtagagtttttggaggtgataatgatgtcaaacttaaagatacaattcctatccaacacaacagagcaccttgtccaggagagtagtaattactatttattgctctgtggaagataaaaaagatagggaaataggagaagcttctttgaaaaatgaaacatcattagacgggcttggtggtgcatgcctgtaatcccagctacttgggaggctgaggcaggagaatcacttgaacccaggaggcagaggttgcagtgagccgagattgcaccactgcactccagcctgggtgacagagtgagactccatctcaaaaaaaaaaaaaaagaaagaaaaaatgatatctaatgtaataatgaaattttaacccttgttgcatttcttgtattcctatgaatgtattgaacattcagtttaaataaataataaaatttattgcaaatgaaaataattaaaatattatataaattgttatatttgtttactatacaaacttatacatgaatagtatacaattaaaatgataatgaataagaatgcatataaatgctagtaggaagggctcaagcaggaaaacaaagaaaggcagaaggaatgagaaggctagaagcagaggaatgccaggagaaacagagacatgtgggcctgaaggcctgggagctgagaagtgagtggtggcccacacaaccttgccaaggatcccatatccaggccaaggcaggaggctacagtccctgctggcatagctgtgcccagactagctgccaatctcttctcctggacaatgtgcactttgtgtccatcagccctcagaatgtgtggtgctgttcactcagcccctcagcaggcccctgagaggaggtggggccatgtccttcctccagccagaggtggggggtcctgccatgctctgccttagagcctgagattgacttgtcaagctatgtgagaacatttcagtcacttctctgtcttcctgtcaggagggtgtggctgaggcttgtttacctactgttggagtgtggaagggactgattctttaagggacctggggagtcaaccactgccacaccttgcaaagactggcagtaatcggtaaaaataataactaactcttatacagtggtgtgaagttccacgagacattaatagtttggcatctcacttaattttcatgatatttagaaactcaggaagctgaaagccagatgtctacataggctacatagcttgcttaagactaaaagtccagagagagacagaggctaggattcgatcctagatcttctccttccaaactccataccctttccaccttaccacaaccaatcaaaaaaataattatcgagaatgcttaactccatactatggtatttgagtgagaaaacataacgaaaaagatgcgagacatcccacaccatgcccccagcagacatcactagtcaatcacagtacaatttcctcttgccagcctcagcatctttaaaagagtctcctttataattgatcagaattgtcacttgggataaaagctattttttgtaagtgcctcccttaaatctcttgagcaggcaaagtcgacacacatgaaagtcttggaaagccaaaagaggtgccttagaatcaataatcaggtgtaaagcgctgggatagatagagattctgtgcccagaaggagttctgtgtagaagaaagtacgactaggacagccttcacaaaggtgttaaagacacttgtagaatgattttaatttagaagatggagaaagaggcaaccctggctgcccctcacctgctctccacctggagagcttttaaaactggctgcctggggcccctcccagaccagttaaatcaggctgtctaggggtggagcttgggcaacttttgttcttttcaatctccccagaggttaggtttccgaaatgcaatggggttgagaatcataataacaaatgcacagaggaggcccggaaagaggcacctccactcaccttctctgcttcagtcatgttcttcaggatagtgtacatgcagccaatgttgaagcaaatccgggagtgggggtcctggacggcactgaaggcatccagggctcccttccagtccttcttgtccgctgccagcaccccttcattccagaggctgatggcctccaccagggacatgattaggtagaaactaggaggccaagagagctgccaggagacagagagaagacaggttggagcgtctcccctagcagggctgccttagtggcccccaaggtgttcactttctgggccagatgagtagaatggggcccagcctcccttaagataacttctcagtgttgcaaatgcatcaggaaatgtccccaccttttggcaactgactcataaccctaccatgagagagaaaaggaaagaagcagagagagagagggcgagtaggggtggagtgtggaggagagaggaagtacatcagctgctgcctgaaggatcagttccccaaaatgcttctgctctgtcacccagctcctcttctctctcccacccctgttctgtggcagcttctggccaaagttctgcttctagagccagggtaaccttggcaggtagaggcacctccctggtgataatgacaggaggcagccaaatgcctaggcagataggggcaggtccctggtgaaaccccaccttcaagccaaaaacagcctgaaggctgaaagactaggctactggtcccaaatgaaacccgtgacctagagtgagaacttct

SEQ ID NO: 2617 - DNA, 35043 bp, Homo sapiens; identical to SEQ ID NO: 2615
  source 1..35043: mol_type = genomic DNA

SEQ ID NO: 2618 - DNA, 35043 bp, Homo sapiens; identical to SEQ ID NO: 2615
  source 1..35043: mol_type = genomic DNA

SEQ ID NO: 2619 - DNA, 17030 bp, Homo sapiens
  source 1..17030: mol_type = genomic DNA
ggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagaggtgagtgccggggtgtggccgcccccgggccttctcactgctcctcataggccttagggacaaaggccagtccttctgcagtccctgatcaacatgagaggctggggttgagtcagaacccaaatactcagaaatgcaacctctcagaactgctttaacgaaactttgagctgtggctcaccaccctcagacacaaatgagaacactgaggctccaagagtgggagtgacttgcccacggtcacacaacgagtgaccggcagtgtctggagaggaatgcaggtgtcctgggtcccaggctggggccctttgcttcacatggtgatcagcaatgactttccatcttctgcgcaaacagaattcacagaatctggcttgttcttccgctaatcagggcttgcctcaaatgtcacctcctccaagaagccttcctgacagcccctacctcattgctgtctgaccctttgccctatttcccttttctgcctggttcttatattacaggaataatattatatgctcatttattattttttcttgaacgttggctcccccatgagaagcaagctccacgaggctgtgtccgttttgatcgctgctgtatcactaggaggtagctcatccctattgagcaccaggaccaagggctcaataaatgttgctgaatgaatgaataaatgaatgaatgaatgggtggatctttgagacggaaaaggtcttagattcttctagtccaaccttgccattgtacagattggaaatctgaggcccagggaggataagagacttactcagggtcacagagagtgactggcaaggttggggcttggagcacggcctcaccagcatctagcctcgtcgcttgggaagcattttcagaatttttcctcagtagccaggtctgagctctaagctgcgggggccctgaggacgcaaagcctggcccctgcaccccctggattggaacagcaggtgacctctgttacctacgtggaggccactcagggggtcaccagagacaggccaggctggtgtgtgcctacgcggggaacagaaggcccatgttggggcctggggctggaagtagaacctgaagcgtgggttggggcaagggcagcagaagcaaatgcctacaggggagtccacgtggccttcctgagcctcagagcggggtgcaggagctgggtaaggctggccgacctgaattccttcctcccctcacatgctcctgggggacccagccgcacgcaaactcgaatcttccggaagcagcagctgtttgaggcttgggcacttcctgctttctggggtacagggttcaggggatgacacggagagctgaccagcaggactgtgcactccctcccccactccctgtcccctttcagctgccttagccctcagagggggagggactgcttttcatgaggccttgagccaggtactaggggcatgggggctccctgtacctcgaaggtcttatctgaaagcgagcctggattgttctgcttaaggtcaaagcagagagtacaaggagagggcgcaggttcgcgcagcggggactttctagaaccccaaggtgagacatccaaagatggggagggctgccttaggggtggcaagttcggttccaacagacatgttttgagcacctactatgtgccaggtgccagaaaacctgccctggctgccctccaagggttcttccaacctcggcctcccccagggcaggctccaaaacctcccccaggccaggctccaaagtctgtgaactgtgcgagtgtgtcttgagccagaacatcccggcccagtagggcctgggtgaggtccccaagggagcggatattccaggggacttccggttgggtttgctgctcttcttgcccgccccacaggcagccaggccattctcatgctgcccatcaaaaaactctataattgcagacgacggtagtggccgtgtattgagcagtactgagcacctactgtatgccgggctctgttctgggcactgggatgtagggtgagcagagtccttgccctcatggagattttagggctgtgtttgttacagatgggactgcatgaccacccggagacataagtacttctcctgtccccattttacagaggagggaaggagcggagcacagctaggaatcttcccaagggagcttgatcttcttgtccccagtgctgcgcctatgcctcgagcatctgccaatgtctgtcctgcttgactccttcctcagcccccaccaccccagggaaaactcgaggtccctctgcgaggcatcaaggcacctcgtgagcgggccctgcctgtctctccgactggtctctcatcacgttccacctcctgctctgtgctccagccatgctcagcaacctgcggttccctgaactgagcagctccatccagggcacatgttgactttgtttacatctgtgacccagggcctaggacagggcctggtatggagatgtttgatgccttattcccaggtgaatctgtgcaattgacagcaatgtgttagactataatttggctattgctatatggtcaccagcttcccattcctacactcaatatggccaccagcttcccattcctgcactcagtatggccgccagcttcccattcctgcactcaaggcctgggctgtgtcttgttatctccgtattcccagggtcagtggctggacctggcctgggaaggggtgctgagagacgaatgttggcttcacaacattagtttgctttgcactctacctcatacccggtgggcccacaaaacacatcagggtgataagcaggatctcttttcccctccttcgcacagtgactttgaacagcttccggatgatgttgccatctcggccaacattgctgacatcgaggagaagagaggcttcaccagccactttgtaagacagactcctagtccttcacccaacaacctctgaacttccacccagctgacctctgaaccttgccctctgacctctgaacctccaattctctgatctcttaacttctatctcagtggttctcaacaggaccgattttgcccatttgacattaccctgggagattctgattattgcatcttggggcaggtctactccacatctagtgggtagaatccagggtgctgctaaacaccccactgtgcacatgacagccctgtccccagtaaagaactgtccggccccagcataatactaagattgagaaatcctgatcgcgtcctttgacctcagaacctccacctggagagtcgggggtgagggactttagtgttgcccccacaacacccctgtcatattcagacacagatggagggggcatcctgcacccacagcacagccaggggcaggttcactctgcaccatgacctccaaggcatggctcctcatttcttgggcctgaatgtgtgtttggcctatttccaagggctcttgcctctaacactaggtctcacttcctctctttttccagttttttttttcttttcttttctttttttttcgcaaagctcgtctgcttctggggcgccagccttttgacttgacaggggtctccttctccagagacccttctgcatccttatcctcatcatcttcctcctcctcctcctccccttttcccttccacctctttttggcttgtgctcctggcccctgagccctccccacaacctctgtcctccttaggttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccaggtaggcggccactcccgtcctgctgctgcagagctgctgactctccttccttccagggcccctgacactgttctgtgatttgatctcaaccccagtgaaaactgttcatgtagtttatagcccccactcccggcagttacaggctgccaagccctccctgcatggctccccctgcctcacgccatggcttccaccccaagcactctagcctcacagccccggagctctgatgaccatcgtggccactcgctcctgctgtccactaccaggaggccacagtctggagcacttcagcacctggcctcccttcctcagagacaggaatcccccagtctggtccctaaacacactgactcacctccctgcccaccctcagcttcctcccacgagaccagccctctgacttcatggtcttggcttccagcgtccctgtggctctccttcttctcctgtcccgccaggaagctgggtggcctcaagcctctgcttgcaaacagtctccccgccccctggcctcctggtccttcctccccagctggatcctaacgcgcaccttggacagcgccaagcccttagctgctcagcacctgccccgcaggaggaaaccccatcacgaatgggttacacgggggtggtctcagcggcgcccttcgtgccctgcaagttagagacagggacaattgtctcccttccccaagcctcagggacccttccccaagctccaaccccatctccagtttgttttttctgtctctgtttctgtctctctctgtctcagcatatgaccccgctccttctcatccagccccaccaaggaacttgaagctccccctaggagtcttgcctactctaagccagcctcccctctcaggctccatcattttccctcctctctcttttggggctctctcctgacaatctacccctccttttccttgtatattcatcttcctcttgatataccaactccctctgctaagcgtctccacagcctcaaccctcttctgtctttaaacaatcctgagccatgaaacagcattcttacaagcctccctgagcctccgtgcccccagggcccccaaagttctctttcttcttcctttggcatcaaattcacgcactgtctcaccttggcatggccatcctctccttaactcctcagcttggtttagctctgactactccactgaaattcctctcggtgaggtgggccatgacccatcaattctggcttccatggccagtgccaagcctcatcttcacacccccactccttcctctgttaagctttctccaacctcctgaggcaccagtgtctcccaatccccttcctagcttactagagactccttcagcttctctgttacagaatcaaccttctctgctgctccttggaaggtggggatcctctgagcagacatcctctctcccctgccttgtcttctcattccaaacactcaccctggcaaactgacccatgtctgggacttaattgtcacgtttttgctcctaactcccaatgtctagctctagcccagaccctcctaccgccgccgccatcacctctgtccatctcctggacaccaggagccaggcaggtttcagacttgcttcctcgtaggggttctcttggtgaatggttccaccagtgcgcccacatgaaggcacctggaggggacatttgtctcttggtagcccgtcatatttccttttcctccagaacatctgccttgagcttgaggaattgttcattcatccacttaacaaatgctcattcatctgggcatgattctagacccatggttcttaactttggtggtatgtggacgtgccttgagagatggaaagaatcctggttcctgagtcctgcccccggagattctgatttaattgctctggggcaagtgctacacagtgagatatttacaagctccttgggtagcttgaatgtgcagccggtgttgccactgtcctgggtgatgggggtacagctgtgagccaagcaggtgaaaatcctgctctcttagaactaagagtcgtgtgtgtgtgtgtgtgtgtgtgtgtgtgtgtgcgcttggatgaacaggcagtaaataaaaaagtaagacaagaaaaatatcagctggtgatagcacaactgagaggatgaaagttggatggtgccagagtggccacttcagtgctgtgaaaagataacagggaagaatgctgagccatcgggaaggggctctggccagggttcctggcctgtaggggcagccctgagccccggggccatgttgggccaggctcctaggacagctctttgtctcttctcagccaaagtctacgtgggtgtgaaacaggagatcgccgagatgcggatacctgccctcaacgcctacatgaaggtaccagtgggccttgccaccttggcacgtggaagggcatgcagtattggtgggggagcccacgtaccatccctgggtatggctttgggaactggggctggctctctggctctgatggccccatcttcaatccctaaaggcctggtctggggagtaaaacaggatgcgtccttagggttccagagataggagcaggagcaacggagaaggtaaaagagccacactaggaattgacaagtcttcatttaatgctccaagccccacaggtgaatgtctatgccaggagttaaaatacaaaggtgaattccatccagtgtctgcccccaaggtacccactgtcctatgggaatgccaacaggtggatcataagatcacacggagacatatgtgtgcctccatcatgggggtgtggccaagcaggccgcaggttgctcatatagcatctttgtgcaaactagagtaggcctcctctgggacaactcactcccttacgtgaacatgggctggattttagctacactcatgggtcttggctgggggcccttgtgtattctccgacttgcaaactctgcatctctatgagatgggagcgtagaggaaggagcatcttaaaggcagaggccaaggtggtcaggaaaggacttccaccagccacagccatccaggaaaggggcagtgttcctcatgaggtggcagtgagtgcaccgtcgctagagacctgatagtgacctcaggaagctggcaagcgaagccctcctcccagcccagcggcatcctcacagctggagagcgctgggctaggatcctttagtcttgactctgacactgactggctgggtgatttggggtgagttgcccatcctctctaggccttggttttcacacttgtgaaatggggcagtgccctctagtatcacaggagtgaagttgggatctgtcgagaacaggatgagaaagtgctttgtaaactgtgaacctgcttccagaatgtgagagatcttgactcctgatggagggaaggagcagatggagggcagaggaggtgggaggaaggaggagagagcaggtagctgcaggaatcctgggctctgagcagggaagagggagggaggggagctgggtgggctccagctgctccttcagggtggctgaggctccacccttctccccctgggctagaataggggagtgggctgtgaagggagggagggagggaaggaggaagagaaggcaggaggcgaggctggggaactggggctcctcattccacacctggtcttagcaaccagcagcccagaggatccatctctgcctctttgtgtccaattgggttcctggaagccagagatcattcagggcaggaatctctgccatggccaccccatcctgtgcttgcataccctcagagatggggagctcactaccactccgccctgacccaggctgcctgtcccattgttgggcagctatgagaaaagcccaactctctgtaagtcctacccactggtctcaccccgccctcatgaagaatgtgaatcacatgataatgacaactgcctggaactgcgtgaagagctttgactggcaaccaggagactcttgatacacgtttattgataaatgaataatcttatttaatcccctcaataacttgtgagttaagtgtgacagagcagttaggtaggtgggatgagatttgaattcacatctctgtgactccagggtttgagctcttacccactgtgcctcgttgtaatgaaaatcacagtaacaatgatgacatctaactttgatgggcacctggtatatgcctggtgttgttctaaggattctgcatgtatttactcatttaattctcacacaatcccacgagggagaggctattattgtccccattttattaatgaccatctggagccaggtttgcccaaagccacccagctggtgacaggcagagctgggattcgatcccaggagcccctggctccttaaacacctcccaggctgtccccatatgacagccttttccgggctctgcatccccagttcctctcggacaaagttccccgaccccacctcatcctgctgcccccatgggatcctctgcagggctctgggtgcctctggagcctcagcacccaaagccaaccctcagtgtccccagacctgtgcgcttggagtttggtgagatgaccccgccaggctctgggtgctcgcgtcctcacagcttcaaagtctttgcatcgtggtgggtgtaaccagcttggatgaaacaaggacactagggctcaagtccgggccctgtcacttagctcggctcctctgggccaggtactttccctctccaagcatcagtttcctcaactatgatatgagataaagtatcaggaagcattttgtaggctataatgccaccaactgttgttaatttgggttattttgggagccccccacccccgccaactgttgtctcaccttaagctttgggtagcctttagtggcagatggctctgggtgccccagctctgtcccttgctaggctttgtggccttgagcatatcccttcacctctctgatcctaactcaagggatgtcatgagatggagcaagggcgcgcatgtgatacccacctggtaaagtcaccgccgggtcatgttagttgtcatcaccattactgctgtttctggagaactttaagtcttttccaaatggactcttctcaagcccctggtccctctcctgaccttggacccaggagcagagcttgtgaagtgttaccttcagcatgctgagttttcttattcttttaaacaacgcatttctgttatcaggcatcatgcattagtaaagagaggagggctgatgtcagggctcggggacgggacatctaggctggggtgtccagatctttctgctgactaccccaccggttctgctgtctcacccacacagagcctgctcagcctgccggtctgggtgctgatggatgaggacgtccggatcttcttttaccagtcgccctatgactcagagcaggtgccccaggcactccgccggctccgcccgcgcacccggaaagtgtaagtgaccagcccctgggcttccacatggccagagccctgggtccctgctggaaaagcatctcttttccctgaaaggagagaaggaaaatacagatcagccatatccctggacactccaggatgatttgatttattagatgggtttagaaagtcatgttcaggcttggagggacagagggtgtgtgcctttcaatgtgataataaggattggaagacgaggactgggatattgactccagagagtttggtgccacagcaactactggggatagcccagaagctctgggtgcctggaaagaattgggggcagagaggagggaaaagctgccccatccacaaacattctctgagcatctctgggaatgccttctccctggtgtgttggagctccatggggccagctatggctctagttgtatcatgctggcctccagagcacactgttcctcccttattccaaaaagcccatccttcccaccaaaaattcaagccactcgtagactgctgggcttccaaagcccaggttgctgctactaagaattctgggaaaagcaggacggagctcctgagctccccaccagctcctccctctgcttcctcccaccaatgtctccaagggtcctctccatgcctggcatctcccctgtgcacacaggcaggtgtgtcttaattccagctgtgccatgtggcagccgcaggccccagagcaaggcacttcacctctccaaccttcagtttccctcagctgaaaaattagaaacagtcacatttacatcagagcttggttgtagggagcagaggaacaaacacatctgaacactttggcaagtgaaaggcaccgaatgagcgtgtatccccttccccacctgctttctgagcctggcttcctggtccataaagaagggagaacaatcccacctccaaagaggttgtgaggatttggggacaagtgtgcccgcccagaggagcaattgcagccacatttcagcatcttctgtctcctctgccttccctgctccttgcaaggggctcctctggacacaggagcaggaagctgggccctgagagaatcacagggctaacaagcccctcttctctctccacagcaagagcgtgtccccacagggcaacagcgttgaccgcatggcagctccgagagcagaggtaacccccgcccccacgctggccaggctctcacactgtgggcatctgccttggcccacctgccagccactgggcctctcctgctgggtgctgctgtgtgcctgggacagtgctgggcaccaggaggaaggaaggggttacagcctcagcctctgccactgggggtcccccgagcccagctaaggggagggcatgtgaccagcgtgcggagccagaggagaatgcttccatccctacgctcatccggacagtttacctgggcctcctctgagtcagccctgccttaggcatggaagctgcagagatgactcagacaaggcccagcccacgatgaagcctggggaccagggtgggtgctcagcccagagagttcgaacccttccctgtgtgctcacccccaccaggtttggaaggagcacccatcctggagtcagggagacctgggttcaattcccagctcctccactaaaaaatggggtggcctcagagaagtcgcttattctccccaagcctcagtttctacatctgtaaaatgggagactaaagtatgtaaggcacttctataggaactcagtgagtgttctctccttccctccttactgcacgcttctcctcaggctctatttgacttcactggaaacagcaaactggagctgaatttcaaagctggagatgtgatcttcctcctcagtcggatcaacaaagactggctggaggtgagttcagaagtgaggatggaggtgagattgaaggtgaggttggagggaaattaaaagtgaagatagaggtgagggtggaagtgcaattggaggtgaggatgaaggtgagggtggaggtgagattggaggtgaggatggaggtaagagtggaggtgaggatggaggtgagattggaggtgaggatgaaggtgagattggaggtgagggtggaggtaagagtggagatgagattggaggtgaggatggaggtgagattggaggtaaggttggaggtgagattggaggtgaggttggaggtgagattggagatgagattggaggtgaggatggaggtgagggtggagatgagggtgaaggtgaggatggagattgagggtggagatgagggtgaaggtgaggatggaggtaagggtggacgtgaggatgggggtgagactggcagtaaggttggaggtgaggatggaggtgagattggaggtgagggtggaggtgagactggaggtgaggatggaggtgagattggaggtgagattggaggtgagggtggaggtaagggtggaggcgagagtggaggtgaggatggaggtgagactggaggtgagattggaggtgaggatggaggtgagattggaggtaaggttggaggtgaggatggaggtgagattggaggtgaggatggaggtgagcgtggaggtgagattggaggtaagattagaggtgaagatagaaatgagaatggaagtgggattggaggtgagtttagaggtaaagatggaggtgaggatagaggtgaggaaggtgagtttgcaggtaaggatggaggtaagattagaggtgaggatgggggtgagtttggagttgaggatgaaggtgaggttggaagtgaggttagagatgaggttggagatgaggttgggaataaggatggaggtgaggttggaggtgaggatggaggtgagaatgcaggtaaggttaggctgagattagaggtgaggctggaggtgaggttgcttcaggcattgtatgcttcagagactgaggatggtctcagaaggcctcagggaagagatgctatctgaggatagccctggagatccaggcaggttggggagcctgcgggaacaaagcctttggggaggcaggtgttcggtggcagcagaacattcttggagctcatgctttggttctgaccctgaaaaatgggttgcttagggcaagtaagttaacctactgagtttagtttcttggtctgtaatgggtgtctcagcaggggcactattgacattggggccagatggtcccttgtggggttgtcctgagcattgcaggctgttcagcaatatccctggcctctccactagatgccagcagcactgctaaattgcaccaatcacatggctctccagatatttgctcctgaggggtgaaatcgcaaccacttgtgtaatatgggacaacagtacataccttgcccacagcagtaaaagctgctgatgaagagtgtgaactcagagtcagcctgtttgggccatttcctagctctgtttttcactagctttgtggacctttggaaacttgctcaaacttgcggtttccttttctgtaaatgtttcttcatcggcttcctggaaagggtaaaggaggtggtagatggccagggctcgccccagagcctgggtgtgcggcgcctggccaggtactagggtcattaggagacttaaatgaaacttcaaagccagggactttcccagtcactgctttgtccctgtgtggcccacagaagggctgtgttctgactcagtgagtggaggtgggaagtggctgtgttgggccttggcctgggaccagccttttgtattaggtcctgtcttcagacttagtgctcctgtggggagtgttgaaggaggttctgggacaggcccagaggcagggtcagcccccaggggtcccaggacctttaagagttgggttgggtccctagcgtccaggccctggagaggagctagtagtgaccactggtttagccagtttagcagtttccattttaccctaatcatagatctccatctcaggaactcagggctcttacagaggcctgaggagtatctctgggccactttccagaaatagaaaacatgtattgccttcctgttttccggaaagtcctacttatcagtatgctggctaacttctggcctcaggttgaaggtgggggcagaggggcagggaggggaccactttgagccttggttaatatgtttgtaaaatggcatgtaaataatccatgttccatagggtcgttgtgaagatgaacagaacacgtgcccaaagcccaggccatggccgggtctgggtctgatttctggctacttggtctagagtagaggcacagttgtatctgatgaatgaatgagtgagtgagcgggatcagcagcaggcccttcctcacccctcatcctcttcctcccctgttctattttcctctgtaacacctgctgccatctgactcactggataggtcattgttcacagcgcgcacagcgtgtcattccccatcatactggaaactccgtgggggcaaggacttattattatttttttattattattttttctttgagacagagtttcactctggttgcccaggctggagtgcaatggcgtgatctcggctcactgcaacctccacctgccaggttcaagtgattctcctgcttccgcctcccgagtagctgggattacaggcccgcaccaacacgcttggctaatttgtatatgtttagtagagacagggtttcaccaagttggccaggctggtctcgaactactgatctcaagtgattcaccagcttcggcctcccaaagtgctaggattacaggtgtgagctactgcgcccggcccaaggacttttatctattttgagagcccagagcctgtcacgtggctggttctcaagaagcctttgttgaatgaataagtgaatgagtgagataaaagcagctttctatataaatccagattctggcatattgtaaaacccaaatataagccttcttagaagtgaccagctcagcgaacttcctcgctttccctcctccctctacagaagaagacccggacctcatctgcctttccccatcactagaacggggctgagggctctgaggcgtggctctgctgcctctcctctcaccagcatggcatcccttctcttcctctgcagggcactgtccggggagccacgggcatcttccctctctccttcgtgaagatcctcaaagacttccctgaggaggacgaccccaccaactggctgcgttgctactactacgaagacaccatcagcaccatcaagtctgtggcctgggagggaggggcctgtccagccttcctgccatccctacgaccactgcccctcacatcaccttctcatgggtccctctcccactccaaagcccccagtggctcccagatgagccacaatgctgtaacaagccatcaacgtccagggtggcctggccagcctcattcccctttcccccaccccacaccccacttccagcctgatgcctccttactccagcctgtcacccccttagggacatcgcggtggaggaagatctcagcagcactcccctattgaaagacctgctggagctcacaaggtgaggggctgggaatggggctggggagttagatactctggagaagagagcgcagggagaaatgttaagcactagtattaaggtgctggggttttgcgtgtactttgtcttctctttttatccgcagcccagccctgcaggttaggcagcatctccccactttagagatgagcggggaagctgcagagaggttaggggaactggttgagctcacgcaggttgtgggtttagatccggatctgcagctggagctaaagtctctctggctaaaagccttggacttgaaccatccactctcagggactcactacccccccaggtccaggacattgctggacagttattttacagaatggtaaccgcattgctacatttctgactataaaacttgtaccaactcattatatattaaaaaagaaatgtcagtaaccatgtcagaaagatacaaagaagtgaaatcacctcatatttttactcccctcgttatgtgacgtacactcagatttcttcagtacttacaccccacacacacatgcacacacaaaagtcactttggctgcacaaaacctttcagtggctacatcattaacatggccatgcgcttttgctggcctcttaggatttcttctgcttttttactactctaaacaacattgtacagaccatcttagttaacctatttgatgacttatctgatcatttcctttgaatgattttcaagaagtggatttggggattaaagcatttgcaagtctcataggcttctggcccacactgtgaaattactggtagaaagctcagatcaatttctacgtacaccagccaagtagaaggatgcgcatcttcccgcacccaggccagacagttcctgtccttacaaggttctcctcaatagcctcacacaggtgtctctctgaggctttatacagccccactctgtgcccagtcaaacccactcttcttcacaactcttaatcctttagcacatttatacacgagacatttcaggctgtgccactaatttccgtgaaagtctcttctccttctcctttttttttttgagatggagtctcactctgttgcccaggctggagtgcagtggtgcaatctcagctcactgcaacctctgcctactgtgttcaagtgattctcctgcctcagcctcctgagtggctgggatcacaggtgcatactacctcgcccagctaatttttgtatttttagtagagacagggtttcaccatgttggccaggctggtcttgaactcctaacctcaggtaatctgcctgcctcggcctcccaaaatgctggaattataagcgtgagccaccgcacccagcctcttctcccttttaggcctcgatatccccatctgtacaatgggaggttagattacttggatgacacgggcttgtatcaggctctgactttttcttactcctggcttcaggacataaaacccttttcaccccctctccctacccctaccttacgcttaggccctttgattatccctgacttttcccatgcaggcgggagttccagagagaggacatagctctgaattaccgggacgctgagggggatctggttcggctgctgtcggatgaggacgtagcgctcatggtgcggcaggctcgtggcctcccctcccagaagcgcctcttcccctggaagctgcacatcacgcagaaggacaactacagggtctacaacacgatgccatgagctgacggtgtccctggagcagtgaggggacaccagcaaaaaccttcagctctcagaggagattgggaccaggaaaacctgggaggatgggcagacttcctgtctttgaggctaatggacccgtggggcttgtaatctgtctctttctactatttacatctgatttaaataaaccattccatctgaaaggggca

SEQ ID NO: 2620 - DNA, 17030 bp, Homo sapiens; identical to SEQ ID NO: 2619
  source 1..17030: mol_type = genomic DNA

SEQ ID NO: 2621 - DNA, 15680 bp, Homo sapiens
  source 1..15680: mol_type = genomic DNA
cgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtgaggcctccccgcccgtgagctccgttctctaaggggaactctcggatcggccccgccgcgaccgccactgtctcccttctggttcctgctgcccctctgtccccccaccctgtaaatcctctttctttttcgttcccacgacagaagttccccctttgcctggacctgaaggtcccttctcccccgcagcacgtcgtgtcgcttcactcccttctctaggcctcttcctggacttcgagcctgaccctctcccactttgtccagatgtctcgtttttcccacaaccccagccacccaccccacagtcgaaaggaacaggtgtgaaagttagctttcttcctcgcgtttagactttttgagacgaaagcaatcttgttctgtgggtgctgtgcggcgcttaaaaggtggatttcttatttcttcctctgttgattacatcctaagtctgtgtccccctgccttgcctcaggttttttttttttttttttttttaatcagtaaagcaagaataaggtaggatatgggtactcttaactgtgaagaccctgaagtaacaattcaaggaacttttggcatttataatgtacttaagtgtttgctgatacgcgttcatttactgatacatggctttttagttggtcaagccctaaaatgcaaatgcctgtatataactatgactgtgccttcccccaattcacattgtttttaaggatcctcaaaggagaaactacagctgccccacactgtgggcacacaaatgacctgctgatgttaaattaactgacccgtgtatgtcataaggtttctctcaattctgttcacactcttggaaaaatgcctcagaaagttttcttagcccagcacctgtgtattaaccaattagtaatatacatacaggatatacaagcagaagtgtgatcacctgtgcaaccagaatctggcaaatctaaggtcaaacacctttcctttgaccaagttttctctcttttagtgtcactgtcaatggcgctacatggactttgtaataaccctttgaggcacatagctgggtgccatgtagaacatgtatctgttacgataagtgtgtgcccaagaaatcagaagaatggactttaatctcattttagaaagtatgatattaaatgatttacccaagccatacttcaggttaatgacacgatagaagctagtacctgtgtctctcaaatttttctaacactttttatcttccgatcaggtttgtgcaggggaaactcagtggagaggaagatatatatccccttaaataaaacagctccctgtgttcgcctgctcaacgccactcatcagattggctgccagtgtgagttgagatggattcatgtttgtggacattgatatttgtctgtgccctagatactaagtaacatccatgtcctgcttaggagatttgacacttatattggactgtatgtaggcagttacagataaccgtctgtcaagctaggcaagataattaataagaactaacatttagtaaatgctgcataccaagctttttacatgtgcatctcatacaaccccaaccacaaccccacaaaataggtcttactgttattgtcactttataaatgatgaaactaaaacttaaagaagttgagtaactttcccaagatcatactggtaataagtgatgatgccaggatctggtggcccgagcactaagctgagagaccttttttttttgacacggagtttcactcttgtcccccaggctggagtgcaatggcacgatctcggctcacggtgacctctgccttctaggttcaagtgattctcctgcctcagcctcttgagtagctgggattacatgcacctgccaccatgcccagctaatttttgtatttttagtagagatggtgtttcaccatgttggccaggctggtctcgaactcttgacctcaagtgatccacccaccttggcctcccaaaatgctgggattacaggcgtgagccaccgcacccagccgagccagcactcttaaccaccctattatactgttttttaaggagaaaaaagtctcatattctatggtgtccagttatcacttgcactctgaactttttggaaccaaaatgggctaaaggcaatgaactatctgaagagaaggcactgaaaatgccaaataggctgggcgcagtggcacatgcctgtaatcccagcacttcaggaggtcaaggcgggtggatcacttgaggtcaggagtttgagaccaatctgccagcatggtgaaacccccccatctctactaaaaatacaaaaattagccggctggctgctatggcatgcctgtagtcctagcttctcgggaggcggaagcagaagaatcccttgagcccaggaggcggaggttgcagtgagctgagattgtgccaccatactccagtataggtgacagagtgagacactgtctgaaaaaaaaaaaaaaaaaaaaaaagaaaatgctgaataattgcaagaggaattagtgaagcattctatttatccttttttaaaactttttttccttaaattcaactgacaggccgtttattttcacactttgtgtgttccaaaagaaggttccatgacactgtggctttaaaaactatcaaaatcatagggcaggaaaagtagtaatctaaaggctaacctgctgtcttcagattttgtttcccatggacaatagctctgtcagaatgtagttttgcagataagcaggaaacttggggtctgatactggcttcttcatcatcaaattgatcacctctgaatttcagtttacccctggaataatggttggagtacttgcataaagctgaaagtcaaatacctcttaatagttgtttattgatgacgctaggtaaatagggtggtctcaaaagtgctgtataatttcctgaagccttcttcccatttgataagagaaaactgggacactgagaagtgaaggacttgttcgtggaagcagttactacttttttagccatctttccctgagctatagtatctgttaattgtcccatgtccctgctatacaaagcactgggagtaggttgactggttccaaacagccccaaataaagtttttgttgtacttagtttcttttttttttttttgagatgcagtctcgccctctcgcccaggctggagtgcaatggcacaatctcagctcactgcaacttcctcctcccaggttaaagcaattctcctgtctcagcttcttgaatagctgggattacaggcgcgtgccaccgtgcccagctaattttttgtatctttagtagaggcggggcttcaccatgttggccaggctggtctcgaacccctgacctcgtgatctgcccgccttggcctcccaaagtgctgggattacaggcatgagccaccatgcccagccctctggacttagtttctgaactggtttgtaggtagaagagagctaggtccagggtgggctgagatcagactgctggtcttgctggaacctcactataaagtacagaaggccaggaccccaacctcttgtaactaggctctaagaaaactcctttgggaataagtcattctactctatgttcttaaaacagctctgtaggaagcaaagcctctagaggtaaagccacgtgccagtacagagaaacaagagggggtaagcgggactgtggccacttcctcattaagatcttggttccttttcaacctacttatttccaaatcttacttcgtcatatctgtcttttctgagcaggctccgccctttttaattagtgtagctaacatgataaaactaaggagaaaaaagtgatacccagatttgatttctgattataatactctgcttctcttagacgctttaaagttctcaaagggggctttaaataggtttcttttccctccctccctccttctatcctttcttccttctttcgtctgtccccacagtatgagatgaatagaggtagaaaacctcattgaaggcgcagagaaaataagcaagttacttaagactacaccattactagttggaacccagattagaatccaggtttttttcagtccagtatcatagtttgtcttcctgtcctcgctggagttgaagttttggggtgtgtgtgtgtgtgtgtcagagtctcactatgtcacccaggctggagtgctgtggcacaatctcagctcactgcagcctccgcctcccaggttcaagcaattctcctgcctcagccttctgagtagctagcattacaggtgtgcaccatcacacttggctaatttttgtatttttagtagagatggggtttcgccatgttggccaggctggtctcaaactcctgacctcaagtgatccacccacccacttcggcctcccaaagtactgggattacaggcatgagccactgtgcccggccgaagttatatatgttttagttgccacactatctgttccttttcccatgttttaaatgctgtggcaagggccgggcatggtggctcactcctgtaaccctagcactttgggaggctgagtgggcatttaaagtgatgctgatatacagccagggctgagaactactggtctaaaataattgatgaataacatatccaattttctgtagggagaagactcacagggagaccctaggatatctccacacagatcactggggacttaaggagtattacctaatgccttgaattatgtagaattcaaagtattctggactctgggtcatccatcctctaatacagtgcttcccaatctttatcatgtcatgagacacatagaaaatgttatttgtatagcatcctggcacatagagaaatgggtgatattttcagggcatcctggggtaaatgataagtaggctcctggctggaggtgactttggaaaccctaggtttcctggaatgaggagaaccaatgagagcacatctctgatccattcgaggcttatcaattgggaagctctgttttagaaacctcagagttcttgactaacctcatctaaaaccggccagaagcaagtaaagtcattcccaaaaagggcaaaaggaatgacgatccaggaaagctcctgaggccaagggcatgtatgcatgtgtttttacaaaggaagattcaaagctaaaaccctgagctagagatttagtggcatttcctagagaaaatataggtttgaaaactttggtgtctattgttgtagaatcttatgtatatggctaaataaggttgagggcagagggcaaaaaaatgaagttcacagaacctttctggcatataatgagtcctcttgtgctcttttatattccattccctcctgataaccttcagatggagctggggcaacagcttttcagttcaaatctagaggtgcctgtattcacccaaatatgttgtgacatctttaggggataaaagatacgcagaatcagtgaggcaaagtcagaattgttaactatgggagctttaatttgactcattctgtcctggcagcttcaattagtggagacacaggggttatccacgtagtagagaaagaggaggacctacagtgggtattgactgatggccccaaccccccttacatggttctgctggagagcaagcattttaccaggtaagaactagatgtatctgctgggaaaacatccatagagggaaagtttcagtgaacagtcctcacacttattagtgaaaacttcccttggctgccctggtctggtcaggggagagggcagggtggtcctcagaaggaaaggtgtaccatcaaaagaaatgatcttgagcttagggctaaatttcacctacctgtccctgagtaaccctgggcatccctcccctccctccctggggtccttactcactaaagctctactttttagagcagatcattgtccagactcagaatttagagactgaaagggaagaaataagtcaacagtttgattcccctagttccccatttgtttccatcctgcaggcagaatgtcaggctgtctgataccttcctgtgttccttcatggaattcctttcctattccagggatttaatggagaagctgaaagggagaaccagccgaattgctggtcttgcagtgtccttgaccaagcccagtcctgcctcaggcttctctcctagtgtacagtgcccaaatgatgggtttggtaagtgtcccaaaggatcaggagagcctactgtcacctaaggctcactgttgcttcggtcttacgtctttgtgagggatgtatatgtgtttgtgtctgtgtgtagtgtcagtaactgactcccaaacagggggtagtgtttatttgtctttgctgctcatcccttccctctcctgcttccccttcctttgccttacctggcattatctctttttgtcacgtgttcacatccctaatcttacagcctaagactccctgataccattgtctttctattttagtgtggatggtaatagacttcatgcctacttctttgagtcaccacctccttttgaactcttagtcccaactgaaagattcttctgccgtcacctggttcctaagtacttggtgtcccagtaaccagtccccctattccccatccttcccttcaggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcaggtaatgacactgccagctcctagcaattccagttagaaagaagattatttttctagccaggtgtggtggtgtgtgcacgtagtcccagccacccgggaggctgagacaggaggatcacttgaggccgggaggcagaggtttcagtgagctgagatggcaccattgcactccagcctgggtgacagagcaaggccctgtgtcacaaaaaaaaaaaaaaaaaaaggattattttataggctctcctatttggagggtggctcattcttctggtacacctgctgaaagacggttgctccaaaaagaaccaagacgttagttcttctcacattctttccccacattttgctcctacctgatattacagcattaaagccttttagactagaagaaaatataaagaatatctgaaagagtaatatgaaacaaggtacacagcccaggttaagaaccactagtatcgttaaaaaaaaaagcattggattagagattgagaaattcaatttggtaatttctgagcttctttttagctctaatatgccttaattctggtctagtatttccattttgactcatagagtagttaagagatttgtccaaagttgtatggtgagttgatctccaagctgtgtcatatctgatttcctatctctagtttggtgctctttgtatcagaccacactgaatcttttcagtggctgaagcttcaaattgggccaggccatctggaatgggatagtttcatctccagctaaaccactgagtctgcaaccctttgtaactcttgatgagtttttttctttgaccttatagatcctatggtggttctaggataactatagctcagggataaatgtctccgaaaagggtgtggctccatcccaaaaggatggaactgggccctcctccttctgggatgtaagggagggcctccacaaactagctgtctcagtggggtccatctcccctttcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccaggtagggcagatccgaaccatgagggtaatggaataaggggcagagggagagtggaaccaggccagggaatgttagagagactgtaatagggaaggagtagacaccatgaaggagctctgcatgggagaactagaaacaattctgaaaaatttaggcagcttgttcctaaagtggatagtggcagagaagccaacctcggactgttggaagtagagaaaacgacttagagtccgtggggcactggtcagagatttccaatgttgcctttatagctaccttctcctttagccttgttgatctctcattgtttgtgtcctgcttagaaatcgtctgtgaccccctgtctgattacaatgtgtggagcatgctaaagcctataaatacaactgggacattaaagcctgacgacagggttgtggttgctgccacccgggtgagtgttggcttctgatcaggatgggcagggctggcacaaaaagagctggtaggccccgctctagcatatcagatttcaaagttgctaaattgggaagcctcaaatggggaggaatctgggctgtgggactcctgggttgtctccattgccacaggacaggtatattctcttgactggagcaagaaaggaggtttggggccagttttaaagtatatatcccctgacttttcttctgttgtacctagctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggtaagggctctttggctggggtgcaatggcagggaagaaagaggatagtaaagatgagagtggctactggttggagaagacctcagcacttgacctaagttgttaaccagcacagagcttctggatgtgtctacatgtgtctcccctttagattcctccattttaggaagcttagattccttctttttaggaagcttttacaccctgaattggtatgtaaccagccccctctttcccccactgataagatatattggaggcggccttttacttttattctctggactcctttactgctatctccatccaggagccgttaggctcctgactctcatcactaggaccacagcagaataagggaacagcatctgtggctgagtcactggaggtgggggaccgttaagaatcagacacataatagctgatgttcatcttagacctttactaaggctactttccccatttctgggcttcagaagtcttgtaatacatatgagggatagtcacagctgggaggtggggccaagagaagccgaaagtcacatgactgtaagctgactagcagttgaggtgacctgagatagtcgtcttacctacagctttgatgatctggccgccttcgaggctctcctaaccctttggaatctctgttccccctcccacctacctccatctctcaggaaacttttgactacattggcagctcgaggatggtctacgatatggagaagggcaagtttcccgtgcagttagagaatgttgactcatttgtggagctgggacaggtatgtggcatgtcccccagccccttcctttttaattaaatcttcctcctttgttgttctgcggtcttaactgcaggaaccaccgcctcttcccttgacttctatcccctaggcatggcccagaacaggagactgattctaagtgttgtttcttcatcctccccccaggtggccttaagaacttcattagagctttggatgcacacagatcctgtttctcagaaaaatgagtctgtacggaaccaggtaacctgagcatctcccctcatttcctattcctacagctcagaatccagaccccaacccctgccctgtttccaccaacccccagggcctgtgagacagggtaagagacaggattggattgggtgttggccaaaggatgaacaccacagctgttgttgctgctgggaagaatcaggaactcagtgacattccattggttccctggactgggtagttctctgatcatttgttgcctagcagactaccactgcccattaaggataggtgagtgactagctcccttcttgccttgctgccccatggatccaattgtcaaggctgctctacccaagtcctggctgtgtcacactcgctgcccaacttgtcctccactttcctcattgcttgttcaaaaccttcccttccctctaggtccacctttaggcctgcttttttccaggtggtcctctttctgcaattccagccttcagcatcatccctgctctggactcctgtagcatttaaagaattggttatctgtttggcattcagcacgcagttttctattattatttgctcccttcaattctgcacaataaataataagtgaagcatccactgaggataaagcagagtcttgaagacagtagaatttacttataaatatgaaaaaaaaggtctcttctttatgccccaattttctaactctaaaaagaatggtggaagctacaggaaattcagagagccttggtcccaaaaggcttgagggataaaggtctactagagatagggtagctccccaagcagggaacttgaagtatagagcatttcaggcctaaaagagacctcctgcttcccatcccccagcctcccatcagttaatctccctcgtaccccccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaagtaagaatcacttggccctgcaccctcttcattcttgaagagagtctattctgcagtctgggaggaaggtcactgccctccgctttcccacactaccccctccagaacttcaggtccatctgtattctttgctcagtggcgttttcacatctgaactgaaacccttatttgtttgactggatattcatcttagaaactcatcctcacccttagccctttactgtcaacaatccttggttatggttccactgctccctagctctccagggtcctgagttcctcagggttgccagcagagggcatcatctcaaacacaagcatgggaaggatggtgggggccctttggctagaagacagaaagcagtccttctctggaactcacccagaggtgccagaaacagtattcatactctgtgaaatgtaccatgttcttgccatgtggtagatggccatggttcagtgcgagggtaaaagtgcctcctatagctgatggggctccagagatacaaagggtaactctgggttaccctttaactgctcctaacttgaggccttggataacaggggacttcttactcaggctggattgccaagcttcccgagggccaaatgagtttcgtagtgaaaatgcttgagctctatttctgaccccagccaagtagcaccttctcattcatttaggggagtgaccgtcctagcacttagggtcagctgtcttctctaaagctatccttgtaccactttggggcaagtgaagattcatcatttgaacacattttggatttgattatgtagctgacttgactttgtgtgggacagggatttactgatggtaaagactgtggagctcagcctctcttttaagatctatctccttggggctccataaggatcatcatggtgattttatcagtgtattcttatatatcagtgagcagacctgatcctaagacctgctaatcacctcctgctcccagctaccctaaatataaatgttcattggaacagttatacaactgatctcatgatacatggcagagttctctgaaaatcatcttagccatcccccatatctccagcccaaatgatgtagaagagtctctcctttgtttaaagatctgagctcattcagcttttctaccttgtctgtcaggaaagtctttaattttcactaaccacctcaccctcactcctacctccctgttctccacaccttctgcaatatgggatcctgattgtctctcacccctttcttctgatgctgaaaatgagatactgagtccctgcataaggagcatttgagggaggaaaggggcagagccctggctaaatgtagccaaggctcatgccggctttcctggcagatattaccagagtatttacgacactgctgagaacattaatgtgagctatcccgaatggctgagccctgaagaggacctgaactttgtaacagacactgccaaggtagcactgagccaggctgggtgggagcctggggcacacagtgaagatgctagcatttgaggataggagaggtgggccattcagccccctcctcacctaccacaggccctggcagatgtggccacggtgctgggacgtgctctgtatgagcttgcaggaggaaccaacttcagcgacacagttcaggctgatccccaaacggtaagcagatgggccctagctccttctttctatttacacagcaagctgtccctatcctcccttgccctagtgtcccaaaccttggaattccacatgactgttgatgccggtgagaatgcctcatgccccagagagctcttgggtgggcctcatctgcatcttatgagccagctactgtctcccaactccagtctatctggccagtctggttcctgccccatgactgggtctccactgataattctttccctgggctcccttcaagtcacagggttttctctctttactgttccaatcctaggttacccgcctgctctatgggttcctgattaaagccaacaactcatggttccagtctatcctcaggcaggacctaaggtcctacttgggtaagcatctggtgtgggaatgggacccttagctgaggaaagggatagagaaaaagtcttttggtttaacctttattattttttttctttttcctctctgtttttcttaccccctgttttcctttctttcttctcatatttgatggatccttttccattgcccttctttctggctgctgccaatcttgggcttttcctatttcacccaccatccacccaccaaatcttcccttccctttggtctgcactcaggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatgtgagtggtggtgggtgttggaagtgccctggggcccctttcccttgggaaagttggaggttcttctagacctagttagacccaggggattgggatggagaggtggagagatgcagtcctcagcaattgggtgttgaaaagcctgggtgaaaatggaccatctgaagggtaaagggacagcagccagttagctcaattggttagagcatggcactgatagagggtagagggaacgagtgagaagaggatcaccctagccgtgtgttgtggcgcatcttctgtgcagctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgaggtgagatggggcaggggcataggtggcagggatctgtttgacttctttctctgctttcttgtgtcatatagccctttccatctcccatttgccccacatttgtagcaaaagcctactgcaaatctgtccctggtcagccagcatgttcccttaggaggccttttttttgagatggagtttcattcttgttgctcaagctggagtgcaatggcacaatctcagcttactgcaacctccgtcccttgggtttaagcagttctcctgcctcagcctttcgagtagctgggattacaggcatgtgtcaccacacccagctaatttttttttatttttagtagagatgggtttcaccatgttggtcaggctagtcttaaactcctgacctcaggtgatccacctttcttggcctcccaaagtgctgggattataggcgtgagccactgcacccggccaggaggcctttcttcacagatagtttgagtaggtgttcattctggagagcccctgtggatcccagaactctttcacagcttcaactcccggctggcattccccatctggcacagctgggatgagtcagtctaatgtaccgagctcctgtcacaagtcagtaatgtaagtgccgcaagggaaccaaagccatgggccctcctttcaaaatgcctaaaatctaagtaatacaagatggaagcaagaacagagatgctttacttctcttttcaaatggggagacaaagtctgtaggctggagagatgttgcccatgattattccatagttggtgcttagagccagcatccgaattcccatggctccaaaccccaaacagttatccaaaaaactgcactgagttctgagaatgcctttgtcctttcctgccctccctccccctgcagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatcccacacga

SEQ ID NO: 2622 - DNA, 138701 bp, Homo sapiens
  source 1..138701: mol_type = genomic DNA
agattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgaggtgagtcaggctgtggggggtggggcgtgggggcggggagacagggagacagggagacagggccaggggaggcgaggggtccccgtcccgccgggggcggctgagccgcgacccccatggcttctttggccggagcgggcagaggccgaagggatcggggtgacggtggagggggcgggcggagcagtggcggcccctcccccgcggagccgccggccgctcggggcccagattccgtcggcccccggggctctgcggcaccggtcgcttctagccgctctcagcccgtccggccccgccaggctccgcgagccgccggccccggcctcccgggctcggggatggccccagactgggccccgcgctggggccaccgcgatcggggcgccgcgtcttctcttaccgggaccctcctccccagcaaagttgcccccaagcgggcggcgtggcctggagccggttctgagtgcagggtcaccattttcctccctttccagcttgtttttgcgccgtcgttccaccccctctccctccggcctagtccactccctccccatgttgggacagcccccctcgaccaggcgttcttcctttcctcgtcatcttcttgctggaaagggcccgatggaaagggcccgaattttcttttctttttttttctcttcccacctccgtggcattctaattacttctcccttctcctttacaaagatgggggtgccctctctggattggttttattcctctcctctcccaggaggaccagcccaggcacagacgctgtcctttgagaattttctctgcttttccgttcaagggctggttgcagggagggagctcaggcagagacttttcatttaagaactcttttggctaaggcctgcaggggattcccagcatctgaaatattagcactggagctgatccctactcaggtgaaattcctttactggacaccacaagaatgtgtcagaacaggttccctgtgcaaggggcttcaaaaccaaaatattcccactgcgctctttacgctttttaaaccaccgggagggggcaaaagacataactgggttgttaactattcatttcaccgtgtaaaaaaaaatgtaggtgtttcttctgcttttggtttgatgtatccatccatttgcttattccaccccctccaaaaaagggacttcaccttcctactagtgtatctaaattgtttaagtgaatcagagtgagatggtttactctgaaaggtgctggactttacagactgaccattgattttgtacacagagtcctacttagtaattgtagccactgtctgttgctccaatgactttagttggcagccaccatcctgtaggatgtttttcgggcaacattacctgaggtactttagaaatattgtagttttgaatgtcaaaaaaaaaagagacatatcaagagatgattcttagagcagggctaatgtgttagaattgagtgctaaaaatagccaagacattaacaccatttggggagtaatcatcagataattttccatgaaacatatactttatgaaaatctaagtttagcttcgagaccaatgtagagacaattcagcctcttttgcggggaatatattcacaaatatgggctttagcgcttaaaaatacactgcagttggccgggcgcagtggctcacgcctgtattcccagtactgtgggaggccgaggcagttggatcacctgaggtcgggagtttgagaccagcctgaccaatttggagaaaccccgtcaccccgtcactactaaaaatacaaaattagccgggcgtggtggtgcatgcctgtaatcccagctactcgggaggctgaggcacgagaaccacttgaatccgggaggcggaggttgcggtgagccgagatcgcaccattgcactccagcctgggcaaaaagaacgaaactccgtttcaaaatgtatgtgtgtatatatatatatgtgtgtgtgtgtgtgtgtgtgtgtgtgtgtatatatatatatatatacacacacacacattgcagttatataagagatgtatgctatccttggcatttttttcctcattcagcataaaaagtacctaatgctttttgtgtttttcagattctctgaagttacacccatcacagaattttcatagagctggactattggaaggtcagcaaagtaccattttaaagcatattgtgttagtatgcaaaggctttctctgaaatggagtttaaatgggaaagtatgaaactttgcaaactcacacaatgtagttttctcctaaagagtctgatccttcttttagagcagctgaatgtttcaatgggttttgttgctgcgtttgatgtgcttgttggctgttctatctgctttgagaaacattgaaaaaaaaatcattttaaattatgtgttgagtgttctactttagaattccagaccttcattttagctttttatacacaaaatagaatgtgaaaaggcccaaacattaacatgaatataaaagagtgacaccaaacacataattagtttgaaaattcagaatttagaacatttatatgctgagcatttcaaaatatgttaattatttattgcaaaagcattgatgccattgttattgcattatacttaagggtaaggaaagccaagtaatagcgatgatgattgagctatgcttagaagaaaggggtttagaaagttctggaaatgttaatagagtctgtagattagtttaaacagcttacacttactttagaaaacttttggctttgtgtgtgtgtgtgttttaacattttaagacataaaatagtcttgtgtttttgtagattttgaagtgatttcacatatatcatctttaaatctttataattttggaattggacagcaaaggtactaatttccccattgtagagaagagaaactaaggctgaaattaagaaaccaaaaaaaaaaaaaagtcccacagtagaagaaataatactttctgcgtttcagttagtgctctttatgcaaagcggccaccgtgaaatacacatgtaaccagtaacaaacattttatggtctactttaaaaaggccctaaatatttaagtttgacttgagaagatttttgcctcccttggaggtagtccgggatagtggggggcaagtgggttttgtagttgagcttaaatttgaataccaacttagctccttattagttctgtgacttcgggcaagtgattttacctctctaaactttaatattcttcctgttaaaatgtagctgtctcttaaatttagtgagctaatgtgtattaaattgcctagcatagcgtctagcttaataaatgttagttttttcctttagtatcagctaaatttttttaacagtataatttagagcatataaaatgttctcaaataaataattggttaaatttgttttgtacgtgtaagaagcccatagatatacattagtatgaaaatcaaatatttttaaaactacaatttgaagtgagaaatttttagcagtgtttcttagtgaagcagatttctggtttttattcatattcaatttgtgaccatgttgtagagacatatttgtctgtacaaacccatctcatttcctggacaacaaaccatagagtgtcataatcatagagatgatcagggaggagaaagacatgaagaaaaaaatgagtgttaattatttaagcaaatatttttagtgagctgatggaaatacagacaaccatttagcatgtttatttacatgtttatgcctaaatactttcgttaatttttcattttagttaaggggattctcatttaaagtaaggctacccttttagaaattatatataaaatataacatgtataagtatcaattctgtcatgccctttaaaatgttttgagacagggtgtcttaaaaaagttgtttgcttctgtaatgaagtgtctaatctgtgccacctcattgctatttcttttttattattgacattttaaagaatacataaaagtagagagaataaaataagccccatatacccatcaccacagtttaaccagtatctaatcttgcttcttttatcccttcttctctctcaagctggattattttaaaacaaatatcaaacatcagatcacttcatacataagtatttctgtattacagtgactttcttatattaattattattgatataatttaattgttaatataattattgtattaatttttaattactctgtatagtttataaactatttcttggaatattctagtttatttcagcaaagtctcttgtgactctcctgccctcttttcaagacagagtgctgcaggaggctaccgcttctagtatatagtatatcctataacctatgttgaaattgtaggccatgctgctagattggagttcatattgttgctctgacatttacttgtatggccttagcctaataatttaatcttttttgcttcaattttctcatctttaaacgggagcaataatagtgcctcatcctaggtttttgtgaagattatttgaggcaaattcgtgtaaagcatttaatttagcacatgctaagtgctcagtaaatgttagctaaagttaaaaaatttttaaaaactaaatgctagctgtagagtgtttactgtgtgccaagaactttacaaataagaactcctgaggtgggcatatcacttgaggtcaggagtttgagaccagcctggctaacatggtgaaaccccatctctactaaaaaaaaaaaaaaaaaaaaaaaaaaaagccaggcatggtggcatacacctgtaataccaactactcgcgatgctgaggcaggagaatcccttgaatctgggagacagaggttgtggtgagccaagatcactctactgaactccagcctgggtgacagagtgagactctgtctcaaaaaaacaacaacaaacaaacaaacaaacaaaataagaactcagcgaattctcctgactaccctttgagatggttattattatcctactttagagatgagcaattgaaggcataactcacccagagtcacaagctagtaaattgtagaaccagaattccaacccaggtagtctcactttagcctagcctcttgactactgtgctgtactaactcccaatggtatatactatcaagttctgtctagtaatatttatgtatgcatgttttacatcagtagtctagattttcatctataaatagtatttaaaaacttggcccagagtgaggggaatttaagtaattggtgtgatataatttaatttttttatagaacgtacgttttccaaatttaaattttttttttggggggaaacaaggttggaaaacctgcacttgggtattattattattatttattattattatttttttgagatggagtctttgctctgtcgcccaggttggagtgcagtggcacgatctcggctcactgcaagctccacctcctgggttcacgccattctcctgcctcagcctcctgagtagctgggactacaggcgactgccaccacgcccggctaattttttttggattttttagtagaaacagggtttcaccatattagccaggatggtctcgatctcctgatctcgtgatccgcctgcgtcagcctcccaaagtgctgggattacaggcgtgagccaccgcacctggcctgcgcttgggtattattaaactttagaagtagattcaaaatgtctactattcaactgagtttgcatttaaccttcctatcaaaacagtgctagtctttcttgcaacctctttttaaatttaatacgatgattgcctgacaatgggaaaagggtcctggctaattaattaatgttataatacatggccattaaatgatgtttctggtaaccccataattaacatgtgacactcttaataaaataagtaaataaaaattatgctgttacaattatattcaaagtaacttgtgttacaaaaatcctgaacaaaagtatacatcactgattttctatttttcaattctatttttgtattttccatctttaaagaacatggtttatatattttttttaaataaaattgtttgccattagtaagttcaaattcgaaggctaggattcctttttgaagtgcctgggaaaaaaattcagctgcagagaaaaggcaccatttgttgtacattctataatgaaaactattcattttggcaaatgaaaaactaagatagaaatgaaactgaatgaatcattctagaaatagagaaatataagattatagaaaaatcatagataaaacaggaaaaataagagtataaacaaattggaaaaatagataaatataaacaatagatttaacaattttaatgattttaaaagcatgagttaagagattatatatcaaatgaaagaactggttaaataagagctaaatgctgatctgatataatctttgttatttatttatttatttatttatttttgatacagagtctcactctgttgccaggctggagtgcagtggcatgatctcagctcactgcaacctctgcctcctgggtttaagtgattgtcctgcctcagcctcctgagtagctgggactacaggcgcgtgccaccacacccagctaatttttgtatttttagtagagacagggtttcaccatgttggccagggtggcctcgatcccttgacctcatgatccaccctccatggcttcccaaaagtgctaggattacgggcatgtgccaccgcatccggccacaatctttgtttaaattaaacatttaagaccggaagatttttaaaagaaaatgtgaaatatgacaatgagttaagagaaaataaactatgattttttttttactactgctaatctatttgatatggtaccatccagaattatacttcatagtgcaaaaatggaaaatcctaaacatagtagcaatgttttattgactttatagaatatttctgatttatatttcttcctagggcccttgttatatcatagatcataaatgcctataatattttatgtacaaagatacctttttggaaaggattttttgaaaacatttaacatgaaaaataatctattgaattcttttcttgtttagtatctaataatctctgtggatccatgtctagtaaactaaaagtattatggaaataatgaagttcaaacatgtcaaaagtcatacctagttcatcccagcttcttgtctttagatccatctctttctgattgcttaccacctgtttttgtgtcccttcctaaactctgctttcattattttcactcaatactggaattctattgcttatttaaaataaaaggatataaattcatattctaatccagtggttcttggcctgattttaatttactcttgactctgattattccaggagtcccctaaaatttcaaagtggtagtacagaaaaacatttcccagtgtgattagtattatatataaaaaacagccactttttttttttttttttttttgagatagagtttcgctcttgttgcccaggctggagtgcaatggtgcaatctcagctcaccgcaacttcacctccaggttcaagcgatttccctgcctcagcctcccaagtagctgggattacaagggcgcaccaccacacctggctaatactgtatttttattagagatagggtttctccatgttggtcaggttggtctcgaactcgtgacctcaggtgatccacccacctcggccccccaaagtgctgggattacaggcgtgagccactgcgcccggccaaaacagacactttttatatgaaaaagttgactcctcagagtatattttatattaagagtaacaggtaactagaaaaaaataaagattattcagtggcataggatatagaccttttaactttagagaggtaaaagacatttttcaatagaaatgttgcttattaatttgtattattgtcttttcttgctgttgctaagattttatttcaagttacgcaaagaaggttgctgtgtcttctgtttgcttttgtgttaataaaagtcaagtttaaataaactaacagagtataagaccaatgataattatgtacttgagtgaaaaggtagagatttcctctatgagttaactacagataatggatctagctttcagaataaataaacttgatgtaataaaggatatatatatttaatcatttgaactaaacatttgttacatgagagttcagttacttttatttgttcttaatagcttttgaaaaatatatacttttctcttttttttttttggtttttgaaacggagtcgtgctctgtcacccaggctggagtgcagtggcacaatcttggcttattgcaacctctgtcacccaggttcaagcaattctcccaccagagcctcccaagtagctgggattacaggcacgcaccaccatgtccagctaattttttgtatttttttagtagagatggggtttcaccatgttggccaggatggtctcgaactcctgacctcgggtgatctgcctccctcagcctcccaaactgctgggattacaggcatgagccaccgtgcccagcccattctcttttatttttaacatttatgtggtaaataggtaatgatcattattgcttcccacccatgaatgtttatcacttctttttcattcaggaaacactgtgattagtcttttactgaatttggtatttagttttgaagatgagagaagaacagaaaagtttctaatagtgagctaagttgttgattatgcttatttatttatttatttatttagagacggagtctctctgttgcttaggctagagtgcagtggtgcgatctgggctcagtgcaacctccgtctcttgggttcaagcaattctcctgcctcagcctcatgagtagctgggactacaggtgcacaccaccatgcccagctaatttttgtgtttttagtagagacagggtttcaccttattggtcaggctggtcttgaattcctgacctcaggtgatccgcccgcctcagcctcccaaagtgctgggattacaggtgtgagccattgggcctggctgattatgcttatctttataaaattagttttacaggaggctgaggtgggaggatcatctgagcccaggacgtcaaggctgcattgagcctgcatgatcatgggatcatgccactgcactccagcctgggcaacagagcaagaccctgtcttaaaaaataataataataaaataaataaataaagcaagagaagaaaaaaatttagttttaataaaaaaaactgtacctgaggcaatctttgtaggacatgctagtcaaaagaataaattcagtgttagtaataattgaaaaccttttttgagcaatttatatgtcaagcagtttatgtttaacaccattttacatatatttttcacatttaactcttagaaaaatcctgcgatgtagtaccagtatccctatttcgtaaatgaacaaactgaggtacagagggatctactaattttcccaagggcacatatctcgtggatgaggctggaatttgaacttcaccagttttaccccagagctgtgagattatattgactgtcttaacagtcagtaagaacatttgaggccgggctcggtggctcacgcctgtaatcccagcactttgggaggccgaggtgggcggatcacgaggtcaggagatcaagatcatcctggccaacatggtgaaaccccgtctctactaaaaaaatacaaaaaaattagctgggcgtggtgggcgggcacctgtagtcccctgaggcaggagaatggcttgaacccggaaggtggagctttcagggagcggagatggcgcctctgcactccagcctgggcgacagagtgagactcggtctcaaaaaaaaaaaaaaaaaaaagaacgtttgaaattggcatttatactttgggccctaataagattacaccattgttcagatggtataaaaagaatagtttgtgtaggattctttactaagcagcttccataaagtaatgagacaaattttataaactacatacaaaaattcataaagaatatgattatgactcttttggggaagattttaatactcaaaattagcaaatcattgcctggctttggtgagtgtctttaacatttagaggaagtgatggctgatcaaaacacctatgttggcctagctcagtggctcacgcctgtaatcccagcactttgggaggctgaggtgggcggatcgcttgaactcaggagttcgagatcagcctgggcaacgtagcaaaaccccctctctaccaaaattagccagggatggtgttacgcacctgtagtcccagctacttgggaggcaggctgaggtgagaggatcacatgagcccaggaggtcaagaaatacctctctcctggctgatgatgggactcagaagtgaaaagtaggagaaggctaagcagaagccaccacctaaggggaattactttagaaatgaaggtgccgtggggctcttgatttctttggcagtagttttatggaagcatggatgccattgttccctatttctgctagtatgtttcagagacaaagtaaattcaagaagagatgagcaacagaagaaatagtactaatgtgagctatgtgaatagtggtattttgcatagagcctttattaatttactttggttctttctgctttgtcttttttaatctgcccctttcaccccgtgtatccgttttctcacggtagtctatacattttgttgttctgctatggcatcttgtatcctttctctatttcccttcttctgaaaacaaacgtctataaaggaggtttgctattgtaaattgtagtttagaagttaaccctccccctgtggtttagtctcttctaataagctataagcaacatgggccagaacctatgtgtaaattcatcttgagtgaatgaataaataacactattatggctaagtaacctatacttgcacatatacatgaaaaatatatggttggctatattatggaataatataggaatctataaaagaacaaaaaatttattacctttatacccagttttaaaaatactgtgttcccttttagaaggttgtggtgcttgaacgacaacaaaaaggtaaagagtacgcactgtatagacccatttatgtgaagttctttaaaagacaaacctatggtaagaaaaagcagatcagtagttgcctggggctggagtgggcaggattaactacaaaggaccaaaagtagctttacggaatgattgaaatgttctctgtcttgaccatgtgattacacaaacatacatactttttaaaaaaactcatagaacatttaaaatgggtgcatttctatacttctataaaggacacgggttatatatattctgccactgcactccagcctgggcaacagaagaaacagtattaatgtaagctatatgaatagtgatattttgctattttgggaagctgaggtgggaggatcacttgaacccaggaggtagaggatgcagtgagcagagatcgtgccactgccctccagcctgggtgacagtgagaccctgtgtcaaaaaaaaaatttttttttttacctgtactgaacatgtacagacttctttttcttgttgttattccctaagtgatgcagtgtaacagctatttatgtagcacttacattgtattaggtataagtaatctagagatgatttaaagtatataggaggatgtgcataggttatatgcaaatacaaaaccattttatattagggacttgagcatctggaaattttgcgggaagtcctgcaacccatctccaacagataccaagggacgactgtactccgatatatagtttctatagttaagcataaaggtgaaaacagaatatgagtttttggtcccttacaagtgagtactatcttgtgcttaactatgtatcataaatactaattttgagtaaaattcagatgtgcccatagtcatatatatactgtattctgatagctagtttgagatattaggcattaaaatgcttttattagcaattcaatagaacacttaaaatttgttggtagaagactgattacataactcaaattatttgtttgaattaaagttttcattacagtcatctaagtcaataaaactcgtgtttaagtgtgtcttatgacagtgaccataagccaaacacagacttaagccaacaaatagctatcctttacaatggagttgtgaatttgttaatgtttttcttttctccagtttataagtagcaacttgttggattgtcattctgaaacactgaaacaaagattttacttgaaaaaaaatactatggtaaaatggaatgaataataaattaattttcccaaatgtcaatattcaacttataaacaccttgataattgacatttgtaagaactttagaaacactataaaagttgcatctgaataagtttttttttttttttgagacggagtctggctctgtcacccaggctggagtgcagtggcgtaatctcggctcactgcaagctcctcctcccaggctcaagtgattctcctgcttcagcctcccaagtagctgggactacaggcctgcaccactacacctggctaactttttatatttttagtagagacggggtttcaccatattggccgggctggtctggaactcctgaccttgtgatccgcctgtctcagcctcccaaagtactgggattacaggcgccggccactgcgcctggccataagttttaataaaattatattgtgaactccaagacatttttctgtattcttttttgtgtctgttattaaattatattctctggaatattgggctaacgtagggtgaatggatgggaaaataaacacagatgtaattttataattatttttaaagaacttttcattttcttagtgaatttttgcctataatattgggtacaggatgagaatttatatgtaatatttgaattatagatactttggataaaatgacttcttaattccttaaaaaactaattattgcttttttttaaaactaggtaattaggtagttgaaagacagaatgtcattaagttaactaaattaccactgtattacagtaaatacaaacaacatacttacagtgtaaactatggtaaataaaaactaaaaaaacacttccttgaaagtattttttaaccaaacttcacaaggatggatagaattaacactataaattctgcacagaaaaaaaatagtgcatactaaattgagaacagatgcacagaagtgctatttttagaaattaaaaaatggtaaagatgataataggcagatcagaagtcccacatatttatcagggttgtaaataaaaacccagttcaaaaacatgcattactaactggctgtgtgatttttaggcaagttacttaacctttctgtgactgtttgttcttgtaaaataggaataatagacttatagaactgtaacgaggaatggatgagttaatatttctaaagcatttggaatagtgcttgacacatagtaagtgctatatgagtgcttcttaaataagcaaaataaaagtatgtacccagaggaaaattacttggcaaacatacttagaatgtagcaagaaaccaggattttattagcataagcttcagaacaactcaagtgttgctaaatttacattacattacatattaatgtaataactattttaatgtaatatgtattttaatatgtaatgtaattacatattaaatatgtatataattacttttaatatgtaatgtaatgtaactacattacatattaaaagtttagggctgggcatggtggctcctgcctgtattcccagcactttgggaggccaaggtgggtggatcacctgaggtcaggagttcaagaccagcctgggcaatacagtgaaactgcatctctactaaaaaatacaaaaaaattagccaggcttggtggcgtgtgcctgtagtcccagctactcaggaggctgaggaaggagaaatgcttgaacccaggaggtggaggttgtggtgagccaggctcttgccagtgcactctagcctgggcgacaagagcgaaactaaaaaaaaaaaaaaagtttaggcatttatagcactgtgttgcgcagggtttatcttcctaaaatacaaatccaaacttatcacttgcttaaataatcctttagtagtatccatgggttttaggatgaaatccaaattctttttatttttgagatggtgtctcgctctgtcacccaggctggtgtgcagtggcatgatctcggctcgctgcaagctctgcctcccaggttcacgccattctccggcctcagcctcccgagtagctgggactacaggtgcccgccaccacgcctggctaattttctgtgtttttagtagagacagggtttcaccatgttagccaggatggtctcgatctcctgaactcttgatccgcccacctcggcctcccggagagctgggattacaggcgtgagctgccgcacccggccgaaatccaaattcttaaaacctgggtcctcattatatttcttaaaaaaattgagaaaaaattcggttaacaaagttcattttgtttgtttgtttgttttgtttttgagacagggtctcactctatcacctaggctggaatgcagtggtgcgatcctggctcactgcaacctccgccttctgggttcaagtgattctcatgcctcaccacatgagtagctgggactacaggagtgtgccaccacgccaggctaattttttgtatttttagtagaggtggggttttgttatgttggccagggtggtctcgaactcccgagttcctttttattgcagaatagtattccattttatggatatatcacattttgtttatctattcattagttgatggatatttgtgtcatttccacattttgactgtcatgaacaatgctgctgtgaacattcatgtacaagtttttgtatagacagatgttttcatttctcttgggtctgtctatacataggagtggaattattgggtcatatggtaactctatatttaactttctaagaaactgccaaactgctttccatgatggctgcaccattttttcatttttaccagcagtgtatgaaggttcagattttttcaaatttttttgccagtacctatctgtctttttaataaagccatcctagtgggtatgaattggtatttcttgtgattttgagtaaatgtctctgatgactaatgacattgagcatcctttcatgtgattactagacagtagtattaatatatctttggagaaatgcctattcaaggcttttgtgaactttttatgatgaaaaaatcttaaaaattatatatttatcatgtacaacatgttgttttgaaatatgtatacattggctaatttgagcttattaatatatgcattaactttttttggtgagaacgcttaaaatctattttcttagtgattttcaagaatgtaatacattgttattaatttttctcactttaaaattgggttattaggccgggtgggcgcagtggctcatgcctgtaatcccagcactttgtgaggccgaggagggcggatcatttgaggtcaggagttcaggaccaggctgggcaacatggtgaaaccccgtctctgctaaaaatataaaaattagccaggtgtggtggtgcatgcttgtaatcccagctgctcaggaggctgaggcaggagaattgtttgaacctaggagggggatgttgcagtgagtcgagattgtgcatctgtactccagcctgagcaacagagtgagactctgtctcaaataaataagtaaataaataaaataaaataaaattgggttgtcgtcttattcttgaattgtaagggggtagtgtcatttgatgcacaaatattttaattttggtaaaagccaatttattttttctttgttgctcatgctttggtgtcatattttaaaaactattgcctagcccagggtcacagaggtatacctatgtttttttctaagaactttataatcttagctcttacatttaggtatttgatccattttgagctaaatttgtatattgtgtgaggtaagagcctaacagcttcattgttttgcatgtgcatatctagttgcctgagcactatttgttgaaaagacttgtttcccccattgaatggtcttggcactcttgtcaaaaattaattgggcatagatgtatggctttttttttttttcttctggactctcagttctattccatttatctgtatgtctatcctgtgtcaataccatattgtgttattactgtagctttgtagaagttttgaaattaggaagcgtgagccttccaactttttttcttcttttgtaggattgtttcggctatttaatgtctcttgaatttttatataaattttaggaacagcttctcaatttctacaaagaagtcagctgtgattttagtaagaattatgttgaatctgtaggctaatctgaggagtattaccatcttaataatattaaatatttttgtccatgaacatgggatgtctttttattttttttagatctttatttcaacaattattttaaaaatttatttataagtattccattcttttttaatcattgttttttaagtgttaataaaattatggaaataatttgaagaaaggtttgtcaaaatttaggaaagctcttatttattaaatttctgttttatttatttaaatttatttattaaatttctgtttttaagggatggggtctcattctgtcaccctggctgctggagtgcagtggcatgagcatgaatcactgtagtcttgaactcctgggctaaagcaatcctcctgcctcagcctcctgagtagctgggactactcagtgtttacaggtgtataacaccatgcccagctaattaaaaaaaaaaaaaaattgtagggatggattcttctctgttgcccaggctgatcttgaactcttggcctcaagtgatcctcccatctcattcttccaaaatgctgggaatacaggtatgagcctcaaggcctagctgagcttttgtatttaaacacaagattatgcatgtgttaagggaaagaaacctagcatatgataaaatctgtaaaatattagaatcagtcatagatctaaagctgcagtaaacaataaagaacatctagtgaagtccagttttgcttaaatagttatactggatggtaagcttcttaagggcattgactataccttgcatttttgtaacacctggcacaaatgctttgtatttgaaaggttcttgatatttattgaatgaaagagtaaatgaatgaatcctacatccagaaaagaaggaaggaagggttttggaagtttgaggattgtgctctagttatatgtaacctacaagtagcaagtttcagttggaataataataattgcattaaaataactgcaaatggggaactaggcctttaaagagttggggccagttgcggtggctcacacctgtaatcctagcactttggaaggctgaggtgggcagatcacttgaggtcaggagcttaagaccagcctggccaacatgatgaaacctcatctctactaaaaatacaaaaaattagctgggcatggtggtgcgcacctttaatgccagctactcgggaggttgaggcaggggaatcgtttgaaccctggaggtggaagttgcagggagctgagatcgtgccactgcactccagcctgggagatacagcaagactctgtctcaaaaacaaaataataataattggaactatttaatctgtaaagataagaatttagataaataagatgaaaattgaggtgtatttgttctgtgtctcttttttttttttttgacagagtgttactctgtcatctggactgcaatgcagtgagtagggtgcagtggtgccatctcggctcactgcagcctccgcctcccaggttcaaatgattttcatgcctcagcctcctgagcagctgggactacaggtgcatggcaccacacctggctaattttttgattttttagtagagacagggtttcaccatgttggccaggctggtctcgaattcctgaccttaagtaatccacctgcctcggcctccctcggtcttgctatatatagcaagacaccatctctacaaaaaataaaaaaattagctgggcatggtggcatgtgcctgttgtcccaattactcaggagcctcaggcggaggatcccctgaggccaggatgtcgaggctgagtgagctatgattgtaccactgcactccagtctgggtgacagagtaagaccctgtctcaaaaataaaatttattttggtggtggatgcacagctgtgactctgctgaaagccactgaattgtgtgctttaagtaggtaaattgtatgatatgtgaattatatctcaataaaatatgtatatatatacatgtatatatattcacaaatataaatgtattggaagggtttaaacagatggcaagtgctgtcaaaacagagtagaatttatgtttttattttttattttttgaggtggagtctcgctctgtcgccatgctggagtgcagtggcatgatctcagttcactgcaacctctgcctcccgggttgaagcgattctcctgcctcagcctccctagtagctgggactacaggcagatgccaccacgcccagctaattattattatttttttttgtatttttagtagagatggggtttcaccatgttggccaggatggtcttgatcccctgacctcatgatccacctgcctcggcctcccaaagtgctgggattactggtgtgagccacggcgcccagcccaatttttttttttttaattgtgtggggctgtctctcataaaagtagttttcttcatgcattgctggtggtaatgtaaaatggtgcagctgttgtgaaaaacaggtggttcccccaaaaaagttaaacatagaattatatgatccagcaatttcacttataggtatatacccccaataattgaaagcagggactcaaacagatactaatgcactaatgttcctagcagcattatttacaatagccaaaagaagatggagacaacccaggtgtctttcaacagatgaatggataaattccaaaatgtggtatataagtacaagggaatattattcacccttaagaaggaatgaagttctgttacatgccacagtatgaatgacccttgaaaacatacgcaaagtgaaataagccagacagaaaaggacaaatattgtatgattccatttacatcaggtaaccagacacatgagatacttaaaataggcagagaaagaaagtagaatattgtctagaaagtagaatattggttaccaggagctgggggttggggaggaatgggaaactatagttaaatgggtacagagtttgtttggagtaatgaaaaagttctggaaatgaataatggtaatggttgcacaatgtcgtgcatagatttaatgccactgaattgtgcacttaaaaatagttaaaatggtaaattttatgtataatttactgcaattaaaaatgctttcaaaaaacaagaaatttttaagagtaagatgcactacttttttttgtaaagtttgtgagacataattgtgtggtatgtggaaaggagaatattttcatttttgcatttaaaagaatatagtgttttagttgtctgtcatttatggttttcttccttctgttttcagagagtgtgaatttctgactttctatgtgggacccaaaatctttagctttagatgtaagtgagatgacctaaataccactgactatgttacatctttgataatcaaaaactaaattttgataagccagactagactacagatgactttgtgaaaaattcatgaggcgtagacatattaaccttgtttagattggaatttttttttttctttttagacggaatctcactctgtcacccaggctggaatgcagtggtgcaatcttggctcactgtaacctccacctcccaggttcaagcaattctcctgcctcagcctcccgagtagctgggattacaggtgcccaccaccatgcctggctaatttttgtagttttagtagagacgaggttttgctgtgtttgccaggctggtcttgaactcctgacctcaggtgatctgcccacctcagcctcccgaagtgctgagattacaggcatgagccaccatgcccggcctcgactggaaaattttttgacttttaatatgcttggttgattcattttgttgatttctggaaagcaaatgtttgtatttaatagtagcaataggattgcagttttctaataaatatcacagaattatggcagtgagccaagaagaagaaaagctgtattagtgaaataagacatacttctatagctatggaaactgtaaaccctactaagtctgataaaggtattctctttgtatttgtattattagacattggtaggggttcatgaaaacccaagataactgctatattaaatctaggtatgattgtattcatcaaaaggcctggttaaaaggcactgttaggtagtttagtatttgttttgtgtgaatattaaagtgcttttttttctttttttttgagacaaagtctcgctctgtagcccaggctagagtgcagtggcgcgatctcggctcactgcaacctctgcctccaggttcaattgattcttctgcctcagcctcctgagtagctggaattaccgcctggctaattttttgtattttttttttttagtagagacggagtttcaccatgttggccaggctggtcttgaactcccaaccctcaggtaatccacccacttcggcctcccaaggtgctaggattacaggtgtgagccaccatgcccggcctatttttcttcaatttctcttctttttttttgagatggagtctggctctgtcgcccaggctgtagtgcagtggtgtgatctcggcttactgtaacctccgcccccctgtgttcaatcagttctcctaccttagcctcctaagtagctgggactacaggcgccgccactatgccgggctaatttttatatttttagtagagatagggttttgtcatgttggccaggctggtcttgaactcctgaccttaagtgatctgcccacctccggctcctaaagtgttgggattataggcatgagccactgtgcccagcctaatttcacttcttatggtcctcaactactaaagcattttctatttgaaagaataatattagattattgccacagctgacaatttatttgagaataaatgagagaataggaatatgactctgtttattaaagttaaattaatcttaaccagtacatttgtttactggtaaaatgcatattagctgtgcacaagtagattttatgaataaattattttaggtataaattaggcactttggtaatttatagtgctttcttttttttttttttttttttttttttgggacagagtctcactctattgcccaggctggagtgcagtggtatgattccggcttactgcaacctctgcctcccaggttcaagcgattctcctgcctcagccccctgggtagctggaattacaggtgcacaccactatgcctggcccgtttttgtgtttttagtagacacaggtttcaccatgttggccaggctggtctccagttgctgacctcgtgatccacctgcctcggcctcccaaagtgctggaattacaggcctgagcctctgcacctggccgcatgattagtgctttcaccaagtaataatttcctgatagataacctgactagcatattagcttaatatcttttctaattataaaaaccaactaactcctgagaatacttaagacaaggtctgtaatcagggttgcctgtatttggtgaaattaatgggctgtttggggtgccaagcttcaaaagagagatgattgctaatcctaaaatataaaggtaacctagagccagaaagatagctactgagtaattgtgttctcaccacacttatttgtgtgtaaatttaaaagtgcatttcctctcaaatttagatatgtcttgttctgctatttttctgtactagaaagtacttcttcagattgctaggctacttaccagaatcatcaactactaactagtaaagaaacaaactgtgttttgggatctcccatatcaaatatatttagaagtgaaatttagcaatcatttattttatgagtaaaatgaaacagaaaaagtgaactatgaggggtagactcctttggaaaaatcattttaggttggaacctataatattgcctagaagagagaacccatccatgttgaaatgccagattagagggaagtttatgaagaaaagaccatgtagaatgatttgaatgtttaccactgtctagttttggaaagaaagaccagggcattacatgcagggtccttcttggtgttggaccctccctcctcttttcctacttctttttttttttttttttttttttttttttttgagatggagttttgcttttgttgcccaggctggagtgcaatggcacaatcttggctcaccacaacctccacgtcctgggtacaagtgattctcctgcctcagcctcccgagtagctgggattacaggcatgtgccaccacgcccggctaattttgtatttttagtagagacagggtttctccatgttggtcaggctggtcttgaactcccaacctcaggtgatccacccactgcagcctcccaaagtgctgggattacaggcgtgagccaccacgcccagcctcctacttcttttttagtagcccgttgtttgtctaacttgtctatcagttggatgtttcagagatcatggatttcagtaaacatagctctttgtaacagaactggatggtgtgtcctatgagaaaaataccgttttagcaatcgaaatgtggatgtgctatataataagacagataatctttaaatgacaataaaacctcaactcagaaactcaaaggataaaatttgataaaaataagagggcaaaaaaaattttagcagttaaaacagctgggaatagacagagtagaaagcagtagccctaagttttatatttgactaaggttgaatagaaacttcaggttgcagtgtctacctcaggatgattcaaatcactttgagtctttaagatatggctcttgaattctcaacccaagaattttaaaaaaagagaaatcctcatttttttgctaagaaacaggaagttatttttcttgaaatataagttatttataattttgtttctcattatttcttctctgtatcttttttcttccatcatagatgactcattgacaccccacgcatctaaaaagttcttaagctggccacagtggctgacatctgtgatcccagcactttgggaggccagggtgggaggattgcttgagtccaggagtttgagaccagtttgggcaacatagcaagaccaacccccctccccaactgtctctacaaaaactttaaaaaaactagccaagtctggtggcacatgcctgtagtcttagctacttaggagactgataaaggagaattgcatgaccccaggagttcaaggttacagtgaactatgatcgcacgactgcactccagcttgggcgacagaatgagaccctgtctcaaataataaaaaaataaataaagctctgcattttggcagttgtgggtcgtctgagtacagacgttgagtcctgagtatcaggtgactaaaaactctagtattgtaaatagatttgtaaattgacaaatcttgttttagacaattttgctatggtatgcaacaaagttatttccaaatacttttaggtttggatatttaaagtgctatttaaaaaactgtattagtcaaagttcaggattttttgcgtaaatgtgatttaaagtataaggcagttctagttctttctttgtatttgtattgttaaaataagactcagttgaatttcagtttgaaaatactggaaaattgttattcatagctactttgtctcaggctagatgattataaggagaaaattaattctaaagtggtttaaaccaaatcatgttttaaatttagtgttatataaatttcaggttgtgttctatatctttttttggctttcccctccctcagcctaacagtttagttgttcaggatagggagatttgtcccatgtaattatttttcagttttgctgaacatatttttaaaatggctacctttcttgggtacagtgtcatgggattccccgccccatctggggtagagtgttgtgggattagagtgagataagagacaaaggagaatctttcaggtcttctaactcaaatcactagaaatttaggcacgatctggaccttaatgtgtgagaggctgtatcattttatttcccaaattgtattttcttttttcttgagactgagtctcactctgtcgcccaggttggagtgcagtggcgtaatctcggctcactgcaaccttcgtctcctgggttcaagcaattctcctgcctcagcctccctagtagctgagattacaggtacatgccaccatgcctggctaatttttctatttttagtagagatggggttttgccatgttgaccaggctggtctcaaacgcctgacctcaggtgatatgcctgctttggcctcccaaagtgctgggattacaggcatgagccactgtgcctggccacaaattgtattttctctaacttctagttggtatgaaaaaagtattaaagagtcccctccccaccccgccccagttttcttactccgaggatgaagatgaagtggaaagctttagatagttggtttttcagcctggccaccatggaaaaattatttactgttttatgaaacatgcaattcagttaatttggaggaagctgtttagtaaggggaaaaggacaggatttctagttaggaaacataatcaagtatctgttttaaactttgctagttttatttcttttcctctttttatcctcatttcctttttatctagcaagattatcgtgaagcttctatgaataattttctacattatgctagtgcctttaaacagtgtttgaatatgaatctctaacttgctctgaatatgttgagaaaaaaagttgatttttcaggataagtaattctttttgggtgttcaagatatttttaacaaaaaatttttcagaaattgaaagttggcttggcacagtagctcacacctgtaatttcagcacttcatggggccaaggcagatgacttaaggccaggagttcaagaccagcatgggcaacatagcaagaccccttcctacacagcccaggagtttgaggctgcagtgacctgtgattgtgccactgcatttcagcctgggtgacagaatgagaccctgtcttgatttaaaaaaaaattacaaaaagtctttccaaagctataaaaactttaagctttattctttctctttttccatgatacttattggctcttttaggtttagtggtaactcctaccaataattcttaaaaggaaaatgataattactttttctttttttttttttttttgagaaggaatctcactctgtcacccaggctggagtgcagtggtgtgatctcggctcactgcaacctctgcctcctgagttcaagcaattttcctgcctcaacctcccaagtagctgagattacgggcacccaccaccacgcctggataatttttgtatttttagtagagacggggtttcaccatgttggccaggctggtctcgaactcatgacctcaagtgatccacccaccttggcctcccagagtgctgggattacaggcgtgagcaccatgctcaatggtaactactttttagggatgatacatggtacttagttgtcactgatttttttttgttgttgttcaaaaattattatagtatctaaaatcttgtgaacatgggaacagattgtgaggagaaaaataaataaaagcttgtgattatttcaaattcttatgatctcaagtcttgactaaaatgtgtgctttacagggattaagattaaagtgaagctgtttttttccctcataatgtttctaacttaaatttttaaggggcattaatacttatgaaattgatagttttctcatcttttgattactcccctcaattcatgcttctgaaaaatgcattctagctaaaaatataagaatgcttattaatcataaaatatattggtacttgtttagtgtagaactaagggatttagatatatcctttaaaggcaaataatacatttgatcattaaatggaataaattgctttcagagtagagtagggtttattcttgggagtttgaagttgagcacagaggcatggatataagaatggattcacatctatttcctgtctgggtgctttaggaatttaatcctttttaaaactggaactattgggaattttattttttttgtgtgaggaatcatgaaaatcccatgtttaagtacatatttttctaattagattagttgcgttagtgtcaaaaatgaataaactagttttaggtttcctacgtgttttgaatattttatgtatatacatactcttactaactatgaatacataaattagccaacaaatgttagtcagaattttattttgattggtcaacttttaaaactgtgacttttactgagtttctgtctttatctttctagatgttatagtgaaatgtctaaggagggaaactgaaatgaagtggtgtctgccaaatgaataactttacttgtggtattgcagcacagttacttcttttttaaaaaaaaatttttttaattttaagacagggtctcactctgtcacccaggctgtagcctccacctcctgggctcaagcagtgctcccacctcagccttccaagttgctgggaccacaggtgtgcaccaccaggcccagctaattttttttttttttttaactagagacagtgtctccctaggttgcccaggcgtgtctcaaacttctgggctcaagtgatcctcctgcctcagcctcccaaaatgctgggattataggcaggagccaccatgcccggcctagttacatttctaacaaagtaattttgagaacacaggtaaaagggatgtgatctgaaaactgtttggtgtgtagaatggggagagaaaaaaggaagcaaattaaattgaaggaggaaatatggtaaatttaatttttgagtttattattggaagaaaacacgccattttgtgcagtataagaatataagcttatcagaatttttaaatattaaggtttgtattttaacccattttcatattagagccatttttttccagatcctgttttcagctgtatctattaatggggtgaatttactccaggctccctggttgttcattaacctagtagggcttgactactttaataggttcaggaaaatgtgcttgttagttgaaactgctcatagctggaattggaacttttctgcagtccttccttgtctgtggggaatatgtcctaagaccctctagtggatgcccaaaactgagcatagtaccaaacactatatatacagtcgtgtgtaactttatgatggggtatgttctgagaaatgcgtcattaggtagttcgatcatgcatacatcatagggtgtacttacacaaacctatgtggtatagcctgctacatatctaggctgtatgatttagcctgttgctcctaggctacaaatctgtacgacatgttactgaactaaatactgtagacaattgtaacacaatagtaagtatttgtgtatctgaacagacgaggtaacacgtggcatgacatcactaggagataggaatttttagtctgcattataattttatgggaccagtgttgtatattaattataatttataagtctttatgtatcttttatatggaaacccaaatgtcccagcaccattgctgaatattatccattttccctacttgatctacaatgtcagtattaagtggcatatagcaggtttctgtatattctgtattatgatcttatggcaccactgtcatatatgtgatccatccttgactgaaacatatgtggcacatgactgtactatgttttttcctatacatacatacctgtgataaagtttaatttataaataaggcacagtaggagattaataataataactattgtattgtcagggttctctagagggacagaactaataggatagatgtatatatctacaggggagcttattaaggagtattgactcacacaatcacaaggtgaggtcccacaataggtcatctgcaagctgaggagcagggaagccagtccaagtcccaaagctgaagaacttggagtctgacattcgagggcaggaaacatcgagcaagggagagagatgtaggctgagagactaagccagtttagtcttttcacgttcttctgcctgcttttattatggttgtgctggcagctgattagattgtacccactcagattgagggtaggtctgcctttcccagtccactgactcaaatgttaatctcctttggcaacatcctcacagatacacccaggaacaatactttgcatccttcaatcaagttgacactcagtattaaccatcacaactattaataaatagaacaatacagcaacatactataataaaagttatgtgaatgtggtctctcaaaatagcttactgttctgtattcacccttcttataatgatgtaagatgatacagtgccgatgtgatgatattaagtgaggtgcatcacgtaggcattgtgacacagcattaggctactgttgaccttctgtattcccgaatctgtgtcagtcattttaggggatcccttgttgctcatgggtttctggtgcaacatattgctgtcagtggagggaaagggggtagctatgaaagattcggtaaaccatgttttctgttcatgtctttcacctacaaatttaatgccttttaaatcttaactaagcacttatcttgctctggctgtaacttttgctgtttgaggtgtggcagcaaaactagcatgaataatttctttttcattctttcgcagttttacagatagaagactcattcttaccgtagatcttagcagcctcagcatacgattttttctttccttattaagaagtttcactttttcacttaaatgaagcacattaaaacttcactttggcatatccaaattgccaaatgtcactactcttccactttggggccattgttaagtaaaataagggttacttgaacacaaacactgtgatactttgacagttaatctgataatccatatggttactaagtgactaaagggtagatagtgtgtatagcatggatacactgggtaaagggatgattcatgtcctggatgggatggagctggactcgcaggtcaacagaaaatttcatcatgctacttagaatggtgttgtatttaaaatatataagttatttaaattggaatttttcatttaatattttctgaacttggttgaccatgggtaactgaaaccatggaaagcaaaaccatggataagggaggactactgtatttaccagatgagttgatttcattttgagaaaagttacttgtaactttagtaggctgacttaacatgttatgataacaggattatttagattataagagactgggcaggcagatattacactagtcttgtactttgctcataattttatagagcactttgatgtatatttatttcatttaatgtttttgacatctgagaggtatatattctcatagataataaaacccaaacgtcccagatgattaagagacttgctcaatttgacactgttagtcattagaagagctagtcttaaaaaaagaaaagaaggccgggtgcagtggctcacgcctgtaatcccagcactttgggaggctgaggcgggcagatcacgaggtcaggagttcaagactatgctggccaacatggtgaaaccccatctctactaaaaatacaaaaattagccgggcgtggtggcacgtgcctgtaattgcagctactcaggaggctgacgcaggagaatcgcttgaacccgggaggcagaggttgcagtgagccgagatcgcgccattgcactctagcctgggcgacagagcaagactctatcttaaaaaaaaaaaaaaaaaaaagtattctgacttcaatccattttttttctctaactgcaaccaagataatttatttactgagtattttcagctattatgataaaagacataaatgtgatttcttccctaattgagcttacttcatagtttgagagtcagactagtaaataattaattaaaaagagtatgttaggtgctctgaaagggaaagtatagtttgatgaggtgggaaacaaagaggagtccctgtgtgccaggggatcaggaagggcttttgatgggaggtgaacttgctatcaaaatcagtcctgaagtcataaaaattagtcatgtaaagattaaagggctatgttggaggaagaatgttccaggcagaggggagaataccatgttagaagttttggaggtaaatgagagcttggtgtattgaagaattgaaagaaattcagtatggctggattatagagctagagaagagggaaggagagggaaaggaggtagctatgaaagattcggtaaaccaaaagctggatatgataaggtcctaaattagtgacaactaggaagagaaaaagagtactgcaggtatcacaggctaaataaatgtgttagaaatattttagccaacaagtgatattttatacagttattttacatatatatatatctcttgcgatttccttgcacggtaaagggcacattatcctaaaagttgaaaataggttaacagtgcactgttcatcatggtgaactctggagatcagttttggctatcagattcttttgctatcattcctagcatgatttctttactctcgcttgttgaggttaattttgctctaaagaattctaaggtgggtcttggacctaatgttttctttttttttttttttgagacagagtctcgttctgtcacccaggctggagtgcagtggcgcgatctcagctcaccgcaagctctgcctcctgggttcacaccattctccttcctcagcctcctgagtagctgggactacaggcgcccaccaccgcgcctgactaattttttgtatttttttagtagagacagggtttcaccatgttagccaggatggtctcggtctcctgacctcgtgatccacctgcctcagcctcccaaagtgctgggattacaggcgtgagccaccacgcccagccggacctagtgtgaatagagggtagataactaagtgaggattacccttgctaggccttagtaactgttgtctagagaagaagatgttagggaaaagcaagggataaagtgggtatgaaggagtgtaaattatgacttgttgctatgatatttagttattggtttaatttttacatgtaagcttgtcattgatatactgaatattaaaatatttgggtgtggtggctcacacctgtaattccagcactttggaagcccgaggcgggaggatagcttgagcccaggagattgagaacagccttatgcaacataacgagaccctgtctataaataaaaaattagcctggcatggtggtgtgtgcctgcagtcacagctactcaggagcctgaagtaggtggatcacttgaggccaggaggttgaggctgcagtgagccatgattgcaccactgcacgccagcctgggtgacagagcgagaccctgtctctttaaaaaaaaaaaaaaaaaaaaaagatatttgggaaagtggccatttattcaatatacattttgtgcccagtgcttgaagtataaaaagactcaccattgttaatagggaagacgggcacacaatatcaacatagtaaaataattgtttcatgataaaaataaacagtagaagataataagttcagtttgggatatgttgaaattgagatgcttatgggatattgaacacctgctatgcaacaagcactaagctatatgctggggctacaaaaagtaaagaaaataaagtccttttcctcaccagttcatattctggtggttggaaacagacattaaagaaatgattataaaaatgtcagcgtaggccgggcacgatggctcacgcctgtaatcccagcactttgggaggctgaggtgggtgggtcacctgaagtcaggatttcgagatcagcctggccaacatgatgaaactaaaaatacaaaaattagccgggcgcgatggtgcgtgcctgtaattccagctactcaggagggtgaggcaggaaaatcacttgaacctgggaggtggaggttgcagtgagctgaaatggcgccactgtactccagtctgggctctgggcgacagagtgagactctgtctcaaaaaaaaaaaaaaaaaaaagtcagggtatgggattgacaagtccatagaaacagaaagtaaattagtggttgccagggattcaaggaatggaggttggagaatgactgctaatggggatggcttttcttttttgaggtgatgaaaatgttctggaattaggtagtagtaatgactacataactttgggcctatactaaaaacactgaatcatgcactttaaaagggtggaactttatgttgtgtgaattatatctcaaaaaatgttgggagttggccaggctcagtggctcacacctgcaatcccagcacttcgggaggctgaggagggaggatcacctgaggtcaggagtttgagaccagcctggccaatatggtgaaaccctgtctctcctaaaaatacaataattagctgggcatggtggcgcgtgcctgtaatcccagctgctcgggaggcaggagaattgcttgaacccaggaggcgaatgttgcagtgagccaagattgtgccactgcactccagcctgggtgacagagcgagagtcagtctcaaaaagaataaaataatgttgggagtgaaaaaaataaagcagggttaggagggataagaaaatggtgggggcactattttgtagagcatgatcatagtgatttttgagcctcatttgaacagacatctaaaggaatcgaaggagtaagcaatggagataaatgtggagttttccaggtggaggaaaggcaagtacaaagacatcaaggctgtgaaagtgcttggcatgttcaagaagtagcaataaaggcagtatacctggagcagagtggaaaagcaggagaattgtaggagagaaagggagagagatattaaggtgctagatcatgtaaggactttgggttttatgctgagatgggtgctgaggagtgatgtcatctgaattaggtttttaatgaattattctggctacagtgtagataataaagtgtaagagtaaaagagaaaatcaattaggaggtaattgaagtagttcaggtgagatgattagatcaggattgtagtattggaggttgttaagaagtggtggaattctcgattagaaaagtgagaaagaaaaagacaggattcatttctctgggaaaaaaaaaaaaacaagatatttcagggacatgaagagaggagtagactaaagagaaggcaacaaaggaagaaaataaacaggaattcctgaaagcaggagtattcaattgtgtcagaaattggaaataaatcaattaggagtttattgataaccaagcaatttgaatggggagtggttggaacagaagccaagtagtagttggttgagtaataaatgtgaatagaggaagtggaggcagctaggaagacaactgtagtactaagtaaggatggttgtgaggggaaggagagagtggaaactagaaaggcatatataagaataggaatcttgtggaatgagggagttgaaaggacaggaattattaatagaggaaagttttggaggagcagtgaagaaaaagggatctagtgcacatggttgcttcttttcttgagcccaaagaggtaaggataatttttacctgggaaaggaagtatgggaaatttatgtcctatacatttgctgtggagaaataaacagtcatttgccaagaatgatagatacaggatagtagccttaagagaatcatcatgaggaactggggagtaaagctgataaggaatactttgaaaaaaaaaaaaaaaaaaaggctcctgagctactttgaggaagatcttgaattcatagtggtactggtccacaattttgatttttctctatcaaaacttagaagctgtggttcaggaatgttgaagatgagtgcttaggatcattcaggattgggtatgattaacaggatgaatatgatcaaaaaataatggggatggggtaaaggaattcttcaagacacaagctcaggcttcgtcttttccttgaaatggcccccattggtcttttctcttttaattttgtacttttctctgctattgctgccttatgtttagtccattagaatttacgcacacacacatacacacacacccttaagcacttaaacatttttttttaaatatggaaaacgacaaaacaagaacaaatcacatgcagtcctgccatatctagatatgaccactgttaatatgttggtgcttattctttcaggcgtctctatatatgtatacatatctacttatttatacatttctgcataagagggattatacatctgttttatttgcctactgatgttattaaatatagatacaatttgtgatagctgcaaagtattacgtggtaatttatttatttatttttgagacagagtctctctctgttgcccaggctggagtgcagtggcgcaatcacggctcactgtagcctcgacctcctgggctcaagtgattctccagcctaggcctttcaagtggctaggactataggtgtgcaccaccatgctcggctaatattttttaaaaatttttttgtagagacaggatctcgctatgttgccaaggccagtttcaaactcctgagttcaagtgatcctcctgccttggcctctcaaagttctaggattacaagtatgagctaccatgccaatcaatgtggtttaaataacaaaatttagttaattagccaatcctttggtgatggactattatttcattttattttttaactgttataagtcattgtaatgaacatagtacaaatgatttccccctgtactggtatgagtactgttctaagtacttaaatttgtcttttatttctaaatttcttctgctgtcatgtttcaaggtgaatccttcagacttgcattcttttagctttctcttgagaatggatccaaatgaataaggctacctgcatattattagataagaccacccccaaaccatcttgtaatctacagtgttgaggttaagtgcataggctttgaagtcagaacagatttggattcacatctttgctctgcttcttcatttagttgtatagctttaaacttcagttttccagtctattaaataaagaacgttgaaagcataaggctttttttttcattgggagaactctataactgagatgaaataatcattatttaaaaattttctagctaattaaaatcctttgtggtacagtttaatgttattttccttttctagattaagggaaagtagataaatcttggttattatcttttttttttttttttgaaatggagtttcactcttgttgcccaggctggagtgcaagggtgcgatctcggctcactgcaactgcctcctgggttcaaatgattctcctgcctcagcctccctagtagctgcgattacaggcatgtgccaccacgcctggctaattttttgtatttttagtagaaatgaggtttctccatattgctcaggctggtcttgaactcctgacctcaggtgatccgccacctcagcctcccaaagtgctgggattacaggtatgagccaccgtgcccagactttttctttctttctttctttttttttttttttgagacagactctcactctcaaaatctataagaaaagattttccagcctaggctggagtgcagtggcacaatcttggctcactgcagcctcaaccttctgggctcaagcaatcctcctacttcagcctcccaagtagttgggactacaggcgtgcaacaccatgctcagctaatttttttgtttttttttttggtagagataaggttttgccacattgcccaggttagtctcgaactcctgagctcaagcaatccacccacctcagcctcacaaagtgctgggattacaggcatgcaccactgctcctggccttggttatcttttttttaaccttcataaatgaaatcctatgttcctattataaatcatgtttatgtattaaatatgtatgattataaatcatgttacatgtattcaaagaatatttaatgatagaaaatattcatgattgtatgttacattttttaaagaaacatatcaaattatgatcctagttttattttttaaaaaaacaggcctatagaaaatagactaaaatgttagaatggtgatctgtgggacttgggatttgaagtgactttttattttccgtcttacacttttaaaaaatttctgaatttttatgatatatcacctttatatctcccttaaatcctttatacatcctttttgtctatcacttttataacctaaagtgtgcaaatattaaaataggaatcttcatgtagtagaacattataactgaaacttttatgattatcttaattttttctcatggattttaatttgcagtgtttatatttatggcagccctctaaatcttcttcaagtttttcatttatatgatgcattgttggagttaaaatagaacatatcagccaggcacggtggctcatgcctgtaatcccagcactttgggaggtgggcagatcacttaaactcaagagtttgagaccagcctgggcaataaagtaagacctcatctctaaaaaaaatacaaaaattagccgggcatggtgatgtgtacctatgatcccagctactcaggaggctgaggtgggaggatggcttgagcctgggaggcagaggttgcagtgagctgagattacaccactgcactctagcctgggtgacaagtcagaccctatctcaaaacaaacacagaacatatttctgtattaaggtctgattctgtgatgtgtgtataattctaggattatcatttcctttgtagatatactaaatagaaaaacttgagatttgaacaatttccttgccagtattatcacatgcagcagcttttgatggtggagagacttaacagttaaaaatttccaacaacattaatttttagctatattatacttaattatataattaattttagtagctaatatttgttttaattctttctaatagcctaggtcagtggattcttggattattgcatttaatcctcagaacaaccatataaagtctagatagtatcattactcctattttacagagaggaaaacagactaaaagtaacttgtccaggggcacatagaagcaagcagcagagctgggatttaaatggaggcaatttggtaccaggacaacgtgcacacacacactccgtacttcctactgtgataaatttctctcttggttgggtgagatttgctgaaataatgtatatttaaaggatctagcactgctcttggtaccttgtaggtgctcaattgaattttcttttataatgggcagagtgatctcattgaattaggtggcatattccacctggtagtcaaataaggaatttttatataggtaaactcggatttgaggtttgttgtacagatagattatttcatcaccaaggtactagacctagtattcaatagttattttttcctgaccctctccctcctacccttgacctccaagtaggccccagtgtctgttcctctctttgtgtccatgagtaggagttcttttttaaaaattttttattgcggtgaactgcacaataaatcaatcattttaaagaaaaccctgttgtgcaaccactacctctatctatctgtctggttcaaagccatttttatcattcccagaaggaaaatcctgtgtccatcttcaatctcccctgcccgccatgagcccaacttatggcatccaccaatctgtgttctattgctatggatttgcctattctggatttacatgtgacctcttatgtttggcttctttccctcagtataatatttttgaggtttatccaccttgtagcatgtacttcatttattcttgtgggggaatactgttccattctatggataccacaatttgtgttacctattcatccactgatggacattcaggttatttccaccttctggccattgtgaatagtgttgctgttcacatcctataatagcatatgtgtacatgtatttgtttgactaccaatttttaattcttttaagtataagaagttttcttttttaaaggaaaatggcctttattggatgtttaaaaattctataaaaatattaattaaaaaagaaagtggaggccgggtgtggtggctcacgcctgtaatcccagcactttgggaggccaaggcaggtggatcacttgagttcaggagttcgagatctgcctggccaacatggtgaaaccccatctctactaaaaatacaaaaattagccaggcatggtggtgggcgcctgtaattctagctacttgggaggctgaggtaggagaatcgcttgaacccaggaggcggaggttgcagtgagccaagattgtaccactgcaccctagccagggcaacagagcgacagtgtctcaaaaagaaaatagaaaagtagtatacagtaaagagtactactgtatacatttgtatcatagcatcttacagggagcatggcttggcgctgggcaaatgtttgttaaattgaacttttggtttttgagaaacttctttctaattctgattttgctatcaactatctgattttggagaaatcctcagtttctgtgccctagtttttatttctgtaaagaaatagactaaactctttaagagtcttttaagttctgtgaaagtctgttcccttttttcttttttttttttgagacggagtctcgttctgtcgcccaggcaggactgcggactgcagtggcgcaatctcggctcactgcaagctccgcttcccgggttcacgccattctcctgcctcagcctcccaagtagctgggactacaggcgcccgccactgcacctggctaattttttgtatttttagtagagacggggtttcaccttgttagccaggatggtctcgatctcctgacctcatgatccacccgcctcggcctcccaaagtgctgggattacaggcatgagccaccgcgcccggcccccttttttcttttaataggaatgttttggtactgtatccttttaccctctggaagataggtacttaccagcccttggctattgtaggcagttctttctcattaaatttgcctctggaaagggctatatgatcaagaaagttgggaccactcactgttctcgtctttaacctcttgcaaggtttcttcaggaaagactcattttccatcctcccatcttccccttccatatcttgcaaaccctagtgtagagactgaagaactcaagtgcctatagggcacagacagcataatatcaattaaagaaattggctgaacggtactttaggtaacttgagagtacactaaaggaggcagctccagttttccttgtggatttagtattgctggatcctgtgattcaagagaagccaaaggtctgagatttttatgtaaaatctgatttttaaatgttggcaattaattttaaatgtttttttaaactgtgcaggcgaaacagaacacttctgcagtccaagtacttactataggaagtacaagacctgtagaaaggaaaactgtggctgggtatggtggctcacgggtgtaatcccagcactttgggaggccgaggcaggtgggtcgcctgatgctaggagttcaaaaccagcctggccaacataatgaaacgtcatctccactaaaaatacacaaaattagctgggcgtggtggtacgcctgtaattccagttactcaggaggctgaggcatgagaattgcttgaactggggaggcagaggttgcagtgagctgagatggcgccattgcactccagcttgggtgatagagggagactgtctcagaacaacaacaacaacaaaaggaaagctgtgtattgtgaagtgaaatcagagtcaccttgaaatgggcatgaggtattcatcagattgcctttggaataaaagaaataatgtccgtggaatatctcagtaacacctcctcattgctaacccttttgagggcagaaattatagtttttatttatgttagtagctccaattaatatattaataatagttctaggtgtgttctacacattattgctagtgcttacaactctacaaggtagataggtattaccactgtattataaatgagacagccaaggcttgctgtgataagtaacttgtccaaggtcacacaaaaaataagtgatacatttatgatgaaacctcagttctgactacctttgttctttcattatgacatgctgcctacctcttatttattataaacaatattggtatactgacacaaggatcagatgctttgtataatggttgtagacttttccaaggaatcttgtgactttcttctttttactttatcccccttaatgcaaaaaaagagagattacaataaatacttgaaatgcgtcctaattatctgttacgtatagtcatgattgtgagtttctgatcaagccaaatgaaaatttatgtgcttttaacaatgatattgacaacctctaatactagaacctttatcccctgagtcttaaccccttaattcttccatattttgtaattggccctttaaagataaataggtgtagaaggatttcttacatacctcttaagcatctgcttctagagcatagccactggcaaatggaaacaactgaattctcttctagagcacatttgaatccatctcactaaagcttctcaacttgtgacttcttctgaaaaatttattttggtcttctcattttctattttctttttctctcatgtcagtggaagagattctcaatttcttttctaaggtactttcaatttcctgacttgattctgtgacatactttttctattttccactctctcttttcattactccctttcatgtgtttgttttcctcacaccagtagtagtcaaactgctgttaactatgatttctgaaaaggtacttctgcatttgatataatttcaaaagggccatggtgcttaaaaagaaattagaaaactaaatgcttatggtagtataatcatgtaacagtgtactagaaaaactactttattggccggtcacggtggctcacgcctgtaatcccagcactttgggaggccaaagtgggcagatcacttcaggtcaggagttcgagaccaggctggccaagatggcaaaaccccggtctctaccaaaaatataaaaaattagccgggtgttgtggcgtgcctgtaatctcaactcctcgagagaggctgaggcaggagaatcccttgagtagttccccacatgcatacatacaatgatcactactcaactagatactctaaggagatcctctatagatctccagcgttctctctgagtgtgtctctcctttccagtactctgcattgagaaccccggccatctgggcttccccagactcctagctctaccacttcaacttaagaagcttaagaagactgctgggtggccaggcgcggtggctcacgcctgtaatcccagcactttgggaggccgaggcgggcggatcacgaggtcaggagatcgagtccatcctggctaacacggtgaaatcctgtctctactaaaaataagtatattgaaaattatctaccaccatgtgaaatagtagttgtcattttagtcaggctgtggtacagtgcaatggcacaatttctgctcactgcaagctctgcctcctgggttcacgccattctcctgcctcagcctcccaagtagctgggactacaggtgcctgccaccacgcccggctaattttttgttatgtaaatataattgttttttcctctaggttgaagaatttaggtaatctggccaggtgtggtggctcacgcctgtaattccagcactttaggaggccaaggcgggcggatcacgaggtcaggagatcgagaccatcctggctaacacggtgaaaacccgtctgtactaaaaatacaaaaaattagccaggcgtggtggcaggcatctgtagtcgcagctactcgggaggctgaggcaggagaatagtgtgaacccaggaggcagagcttgcagtgagctaagatcatgccactgcactccagcctgggcaacagagtgagactccgcctcaaaaaaaaaaaaagtatttaggtaatctgcagaagaaggtggttcaggtctttggttgctgttctttcctagactcttcagaaaaaaatgaattaactagcaatgcttaaagaggtagtaaatacaagccaatccattttcattccagctgcatttcatgcttcagagtaatggctgttagccagaatcacttgtgaagctttatacacatatacattctgtgatcttattccctgtaaacccctattcagtagtcggtctgtgatgaaatcccaggcatcttcattcaggttaaaaaaaatatacatatgtctacatgaaattctggtattccctgttgaaaaccagtcttaagttagaggcattctgcagttgtacggaaagtaagggaaacaaagttaaaatggaaaaaattgaattaagaggcagaagtaatgaatttgatcatttgttcattgccactcattgtagacacttatttttgatctctgtaaacatcagcttatatctcaaagtatgaggtctgaatacttgcttgtgggtgatcatctttgtgtagaatagaaaagacaaagtaggaccaggtgcagtagctcacacctgtaataccggcacttcgagaggccaaggtggtagaattgcttgagcccaggaattcaagaccagcctggacaacatggtgagaccctgtctctactgaaaaaaaaaaaaaaaaaaaaaagaaaaaagaaaatattagctggacatggtggcatgagcctgtaggcccagcatacttgggacattgaagtgtgaggatcacttgagcctgggaggttgaggctgcaatgagcaatgattgtgccaccgcactccaatctggacaacagagtgagacaagaagagagagagagagagagacagatagagcgagtgtcttgttgagttcttcagtgttgggtcaaagaagggaaaaaaattgtgcgtataaatagaaaaaaagaaaactaactttttaaggctttaaaaataactgaaagtgaagaccctgagatatgaaaagtgatttttgttaatcagaaaattggtgatttaggtgataatggggtggaagttggaagataggacgtgaggggacagggtatttggattaaatataacatagaaagataacatttttagttcaggtagtaggatattctggtaatgacagaaaggaaaacaagatgggttttttttggtttttgtttgtctaatatttttgtttttcatctctaagattatggtataaaaacaggaatttatgttttagaattgtttgggtagaatcacttaaggtagatgatttgcttattcattcatttgtttatttattaagcacattattgaaatgcccattatgtgccaggcataataatatagtaagtaaaatagatggcattcctaacctcagtgttactctaattgcatagacaggaatgctggggaaagaatttatctttcagccagctattctcctgcctgggacccagctttagctagtcttggctctacaaaggaagttgtaacctaattggaacataatttcttctccgtaaaaactgagggttacaccaaatactttcaccacttctacctctaaaattcttgcttttaatgtgaattttagattaatttagattagattaatcccttaaaactacattcattacattcataccattcttgcatggccctctatatatttcttctctcctactaccttttttccctcatagctctggtgtcttgatacagttttgattggctatttatgtgctttcagtcaacctcactggactgaaagctttttgggagcagactcgggtttctgtgaacatgtgatttactgtgtgtgtacctatgcacacgaaatgaacaaatggtgacaaaattagttttttcttatttttgaaaatgctgttgatcttgtgaatttaatattagactgtctttcaagatcaacaacaaaataatatatgtaaaataatataaattgtaattctgcttgtttcttttcattgatagattattatgtatgtttacaaggacatgattagtttagaaaggaatgattattaaatatatggttatataatatggttagctgttaatagccatggaacagatctctattcagtattggttttataagcactcagcaaaattctgttttaagtatgtgttctaaattttaaaatgaatgtatgttgacatttttcattgcttacattccagaaatgagcttattttactggtaacaattaaatgtgagtttagtaagggtagaaaattggaggaaactggagtctccttttctctttagcagatgtcttagtctgtttgtcagctataacaaaatgccttaggcaaggtaatttataaacaatagaaatgtattgctgatagtctgcagtatggagtctggggagtccaggataaaggcaccaacagattatatgtctgctgagggtttgctctctgctttgaagatgatgctttcttattgtgtacccatgtggtgaaagggccaaggcagtgtccttcaatctcttttataagggcactcattccattttgggagggcagagccctcatgacttacttcctaaaaggccccacctcttaacactattacattggatgttaggttccaacatgaattttggcaggacactaacactcagactatagcaccagacaagcaagcagtcactgtaatttaagcccattagaatggaaggtccataaagacatatttttgtctgttttgttgttgatgtatccccagcctggtgtacatcaggcagtccataaatatttattgagtgaatgagtacatgaataaatgaatgagaatatttactgagctgtcgttcattttatagcaggtacaatgttgtttcttcaccactgatatattcatttattacctcttatttattagcagtgtttctgaaataatattaaaattagaagttttcttgaagcttgttttacaacttagaattattatccagtagctttccttaatatttttataacctcatcaacaaacagtgagtgtctcttgtaagtagcgtactgccgaaccttagtcagagaagacatgacatagttttggtccatgaagggttttcaacccatttggagaagtaggaaatagatacaaagatgatttgtaacaacctgaggggtgtcaaaaagatggtacatgtaggaaattaatgttatattcaagtgaaaatttgatattgtttatgtatattattcaacttttaaaaactttgcattaaagtatggaaaggaagcataagtataccattgttttaatggttatctttgatgagatcatgggcaagttgaatttttatttcttacgtgtatttttaaaagcaagcaataactctaaataaattaatctaggccaggtgcagtggttcatgcctataatcccagcactttgggagattgaggcaggaggaccacttgagcccaagaattggagaccagactggacaacaaaaggagaccctgtctctataaagcacatacacagagacacacacacacacacaccaaaaacctagctaggcatagtggcacacacctgtggtcccagctactcgggaggctgaggtaggaggatcagtttaggcccgggagcttgaggctgcagtgagctgtgatcgtgtcactgggtgacagggcgaaatcctgtctcaaaaaaaaaaaaggcaaaactgtagttctaggacagatttgatataaaaaacaaaagtaaagcaggctatttgtttagtaacatcaattgctagacctctctcctgtttatgtattcacttggaagtcccataggcatccaaattcatcatttaaaactgaattctctttccaggtttattcttaactcctatattctctatcacaggaaatggcaccactttttatcaattttcccaagccagagttctatgtgctacttggaactctcctttttttccctctcccttccccaccgtagccagtgatccaatttagttcatccatttaaacagctttaaattcgtagcctattgactatttcactgccactgccttggttcaggatttcattatttcttgcttaggctattattgtaaaaaccttcttactcatcgccatctctaggacctaatctattctctgtattcctggtaggatgatcttcctcaaatatatgtttgagtttatcatttctttgcttaaaaccctcaaaggctccctgtgtgctgagggataaaacccttactgcttagcatgatacacaagccctgtcataatctggcctcaccctgcctttagtagtttcatctcatgttactgcttgtaacttccgtgttctgagtaactgagttacctaataacctgagatgaaaatactctttttgttcaggtttgcttttatagtttctccttccttttccccagtctgtctgctaaatagccatttcaatattcaaggttgacttctggtgttacatcctctgtgctgccttctcagatcctccacagataacattaaaggttccctcttctccagttgtgtaacacttcatactttattaaagcacatactgcattattttaaacttgactcattttattatctctagactgtgaactgcttaataagggtgactttcttttgtattgtgtccctagatcagtgcaggtgctaaataaatgttgaatgaatgtttaattactgctttgtcaggttgaaggtgatagtgaagaggagctggcatagacaaaaatacttagcccctgtgactgtggcaaataagatgtcaaacaagtaattatatgaccaagagaagactcatggtatgtgttgtaaccaagattctgttgcctttttcaactaaaatatttggttttgtttgattttaaacagaaagtgtagcaaaagtgagagggagaacaaggtagattggtcttttctctcttttctttcttttcttctctttctctcttttttttttttcttttgagacaaggtcttgctctgtcacctagcctaggatgtagtggcacaatcacagctcactacagccttgacatcctgggatcaagcagtccttcagctctgcctcccaaaatgctgcgattacaggcacgagccaccacgctcggccctagattggtttttgattgccagatacctaaaaatgaagacatgaaataagtttgtttactctgatagattcatttctttgcaaattgagatcttataatatgaagctacagttacatagctgaattttttgaatccgtagtaattaataaattcctaatgaaatgtatgcctgaatgcactttttggaacaatcttgaacctacaaaagagttgtgaatatagtgcaaataatttattgctttttttctgaatcatttgagaataagttgctgacatgtttcctcattgcctcccaatactttggtatttccaacaaataagaatattcccttatgtaaccacaatatagctatcaaaataaaaattaacatcaatacatttttttcaccttgtccttagatcctatttgggttttgcaaattgtcccagtaatttcctgtatagcaaaaggatccagtttagaattatatgtccatttagttgtcatatctctttagtttctttgaatctgaaatcattccttggtgtttcctggacttttatggttttctttttccttttttttttttttttgagacagaatcttgctctgttacccaggctggagtacagtggtacgatcttggctcactgcagcctcctcctcctgggttcaagcaattcttgtgcctcagcctcctgagcagctagggctataggcacccaccaccactcccagctaaatttttttttttttttttgagatggagtctcactgttgctcaggctggagtgcagtggcgcgacctcggctcactgcaacctcctcctcctgggttcaagagattcttctgcctcagcctcccaagtagctgggattacaggcacgtgccaccatgcctggctaatttttgtattttactagagacgacgttttgccatgttggccaggctgctctcgaacttgtgacctcaggtgatctgcctgccttggccttccaaagtgctggaattacaggcatgagccaccgcacccaacccatgctgtcttttgtgtccttttgatatgcccccgtaattctttgagtactttcttacctttagcaaaacaagacattccaggttcatcttgtattttgcctgtcccagccctgatactatttctctgaaaagccctggttacttttggggtgctgcttctcctaggacctttcagaggacagaagctagggaatatatgtatatttatatgtctgtacacacacacacaggtatatatacacatttatacctatatttttctatctgtacatattgactgatgagttcacatcagtacctcccgttgcaatgcaataccgtagggttccttcttcttttctctctctgtttgtaactcactgtttgacaaacttgatttcctttcatcttattgagaaacttgatttcctttcatcttactatgtttacttatttgatcaatctcctgttgtaaccaatctcccattgctactgcctcctgctttctgacacattaataccctaattacccaacttggcctctcatagcttgcctcctacatggatgctcttgacacctggggctgtcctcctgctctcctgtgaataccctccagtctacttggtttcttactccccactttgggcagccctactaggtagatagcctcctatcttgctcatcctgctaggattttgaatcctacctaaaactgccctttgcttctgctccctcaaccccgatagatgtcttccctaccccatttgaactccaacaccccatgccaggctgcctatctacggaaatgccctctttagtcagtcttctactttcccaccgtaggcaacccttctacacagatgccctccttattcagctcaggctccaaggcctcacatgccctcctcaccctgcttggattgtaactccccgtgctgggctccccctctcttgcccagtgaacacactatttatacctgccgggtaacctctgataaccaaccttaggcaatccttctatgtggacatcctcattactacttaggttatgataccctctgttggttgccccttgcatggataccctcctcacccttctctggctctggcattttatcctgggctctccctgctcactccacagagatccttctcattctattcatgcttttactccttgggctaggctgtccatccatatggagatttgcgttctgtttgggttcccacctcccaccctaggcagaccccctgtgcatcagccttctttcttgcgtggatgctgtcctcatcccacctcttgggcactaacatcccaacctgagccatcctcccctgcacagatattcatatattcttcaccctgcttaggctctgacaccacacactaggctgtcctatatagatactttcttcatgttgctcagactctgcatctagaatatctcttgcccctctcatccactcatttatgtcctcctcaccctgcttaagctctgaaatcccttcccaggcctccccctattctctataggtatccttccccctcccctctaggcttctgataccctcctttgagccctcttattcctcttggactccatctgagtccaaagttcttttttttttttttttttctttgagatggagtctggctctgtcacccaggctggagtaagtggcgcgatctcggctcactgcaagctccgcctcccgggttcacgccattctcctgcctcagcctcccgagtagctgggacaacaggcgcccaccatcacgcccggctaatttttctatttttagtagagatggagtttcaccgtgttagccaggatggtctcgatctcctgaccttgtgatccgcccgcctcggcctcccaaagtgctgggattacaggcgtgagccaccgtgcccagcctcaaagttcttaaagctctattgaaaaggtactcttgtaagatatctaaaaattataaataaaccataaatgttttactcagtggtgtatggattcttgataactagagagttttgttccttctaggatagactcaagaaatttcttcagaaaataacaaagaaatttaaaatataatcagaatagttaggtgactggtatattccattctgtctttcatgctaagaggttatttagagaacaattttcttttctttttttttttttgagacagggccttgctctgtcacccaggctggaacgcagtggcacaatcatggctcactgcagccttgacctcctgggctcaagcagtcctcctacctcagcctcccgagtagctggaactacaggcttgcaccacctcacctggctaatttttgtatttttttgtaaagacagggtcttgctgtgttgcctaggctggtctcaaaactcctgggctaaagtgatcctcccaacttggcctcccaaatgcctggattacaggcatgagccactttgcctggctgaacataattttaaagtttttgagtgaaaaataatacctagtagaaaaaagatatgttatactatattaaattgtctgtggaaggccgggcacggtggctcatgcctataatcccagcactttgggaggccaaggtgggcggatcacctgaggtcgggagttcgagaccaccctgaccaacacatggagaaaacctgtctctactaaaaatacaaaattagctgggcgtggtggcgaatgcctgtaatcccagctatttgggaggctgaggcaagagaattgcttggaccggggaggtggaggttgcggtgagctgagatcgtgccattgcactccagcctgggcaacaacagcgaaactccatctcaaaaaaaaaaaaaaaaactctgtagaactcaagttagttttcttcttccccaaattgatataatttatactgctgtatattatttaaaattactttaaaacactagattgttttaggaaaacagtaattaaatacagcctggcagaagtgctatgaataagtaaatatgtggcagcagactagtaaattggcttaaacttagaaattgagaaaaatttgttaagacagagcattacctaccagttattcttggactgcatactcttttagaaactgaatatccagtggacctgcagccagtacattttttccagtagagatgccaagtatgatgactgtcaagcttgaagtgtttttaacaaaatgaatgctgtctctcttcaatgcagaacgatgttggcacattgtagatgccaggcattttgttttagaatatttaatgtgaaattataaccttggaatttaccagctgattgagatagttaatggagaggtggaagagtaaggcatttcattcccaaaccattttctgaaggttttttctaactctttcagattccaagagtagcttcacatttagaggttttttttaaagtaaaatctaatatttaaaaaaagattaaaatgtttagaaatggatttttcaggattataatgtttgcatttcatatcagagagcattcattgtttgagtaactaatatctgttgtgagcattagtttacttcttgttagatttttaaagcattcccaacacaaaggaacattcttttttaccacagatatttatttctctttagctgcttacttgacaacgaaacagaaacatcttatttacggagcttttttccccgtttttattatccacctctgtatagatgcaagtccatagtattagttgtacaactttattttactatttgaaagtaaataagacagtcttgagaaaagtcataaagtagatgggctctctctgactattttgatttttactctctgacccgaaagcagttgaacaccaaatgccagctcttaggtcaacaagggtgaggtagggaggtagggatgaaaattctaagaaagaataagaacttagacttcttttcaagagatcaacttatttaagccttgtagcatctctgtgaggctgtgctctatccgtgtatagccctaattttgttgtatatattttatttgattatatacttcagtaaaaagaacacctgtgaacccattgtgtagctcagcttatttctactcctcctgtctcccatcaaaggaagccgctgtcctaaactttatcatctttctcttatcacatgtgtttttctttttttactataatacagatatcacattctttattgataaaacctacctcataggattgattgttttgaggttaaatgagaaaaatacatatactgagcctggccctgcaaagtgctcaaaaaatagtagctgtaattatgttattaatgttgttattttgctgagtgagtacagcatgaaaagcatgtcttttcccagctgtttcctgtggcttatctccctgcactcttgaggtcttttcatctcttcctggaatgaccagtaacagtaaagcagtagagaaggggatttgggtgatcagctctttggacatagagtgcccaactgagaagaaacaaacaaataaaaaattaagttgccctattaaattaccaatttttttcttctctctcactgtcctgtgcctcagaataggatttctgcctactttaaatttgacccactgtagtgaaattcttccaccctcttgtagacagtgttgaataataaaggattgaattaacccagaaataatcagtgacataaatggatctattatagtttacagaatgactaaacaagccaaccagtcagtgcatttttacattgttttcctttccacccaacattgggaagcattaatttattttcaatatctgaaaatgttgatttcattcttctatttcctttttccagttgccctgggctctatgagaatgcaccagcatgggacagattcttgatcttctgaacttgcttccctttctgcctatctacttttcttatacacatattaataatttatgttaatggagttattatatcgcacttgccctaattctactacatggatacttaagcagtgcacttaccgtggcattttggtcaactaaaatttttaatgaaatttaggtgagttgattacacattatcgcacaaattattagcagcattaatagaaaaaatatatcagaaaataatcaggtcaggcatggtggctcacgcctgtaattctagcactttggaaggccaaggcaggaggcttgcttgagcccaggagttcaggaccagcctggccaacatagcaagaccgcgtctctacaaaaaaattgaaaaggtaactgagcatgtctgagaaaaaataaataaaaagaaaataatcaccctagtcttggccgactgaagaaagagttccttagaacacaaaagtaaaatcacttctagattaaaaaagagagagagagagaaatagagtgagtacatgtaagtttattgcacaagagcagattttaccagctcttacattaatccttgttaagtttcatctccttcctttgggcagatattccagtctttcatgatctgtgatgaattatgacataagatttaatcccttttaagcctatgtcatttgaaaagtcatatctttgttcaagttgtgatataaccaccttcttccagattgaacctatacattttttgggtactgttgtttagaagtcatctattttattaagtctatatttcttcttcttgtttacaataacttataaagatttttatcacatattttactgaatttaggataactgcctgcagcattttcctgatcctctagtagaagagccttaaaagacaaattagtttgcagcttggccttctttatatatagaagctatgtgaagagagatggttttgtccatgaagtttattagagcactgttagataccctgcttgttcttgtctaattctttcttgtgcttcttctattactctcttcctttaaaaaaaaaaaaacagctttattgatatataatttacatactataaaggttacccatttagagggtacaattcagtggttattaatgtaaatacagagttgtgtaaccattgccatttttatcactccaaaaagaaaccttatctaatacccatatcccttctctctcactttctctcactctcttttctctctcatctaagtgattttgcttttgttttctaaggaagtctttcctcagaagctgcctttccattagggatttcccattctgtttcttcgtatcttgtgtttataaacctggaatttcattattctcttatatttctgaactgatttaaaagataacataagaaaaatagatactgtggcataacatgaagtagccggcacttatttaggactgtcattttcatagatttaaagtacatatgggccaggtgcagctcatgtctgtaatccaggcactttgggaggctgagacaggaggatcacttgagtccaagagtctgagaccagcctgggcaacagagggagactctgtctctacaaaaagtttttttaaaaaaattagccagtgtacatttgtggtcccagccactcgggaggctgcagcaggaggatctcttgagctcaggagttggaggctgcagtgaactttgattgtgtctgtatactccaacctggatgacacagtgagaccctgactcaaataaaataaaataaaataaaataaataaagtgcatatgctcttattcaggatttctttcattggctagtggagactgtaaaagcatttaatttagattgaatttagggttgaatagcagtattaatagcataatttatattcctttaatctttcggtatcccatgggaagcagatttaggagaaaggccagtggctgtgttcagattgtatggttatagtttagagggaatatctttggggtactggggtaaaagaagagtttaaatgatgatttaagtcttagagaagttatttaaagtagcagaaccaaaccagttatgtctgaaataaaatcctgtgctggtaatgactatatgaactgtagcttcccttggataggcatgataaacttctggcaggctgacttcttttatttccaaacacttgagtcagttaatcagaaaacatctttggtgaaggaatccatgcttcctataccttccacttgaccttgcattttacttgtttgttttgaggggcagactttggagaggggtggaatataacaagttctgcatttaatttctttccatgtactttttagtaacattactatcatacctctagtggagaggtatgatacctcaactttatacccttctttgggaaagttagagtgtttcagtccacaaagttttgctttgatttgattaatttattttaataattggagaaatggagataaaatcctgattagtaacatgctattagtgattgggctattactaggataaatttttttccatcacataaatcataaatgcatttgggtagatctttttctctttttatcgaatctgtttctttcaaatttcctttttgtttgggaaaaaaaaaaaaaagaaaaaaatagactcgaggctgggtgtggtggctcacgcctgtaatcccagcactttgggaggccgaggtgggtggatcacctgaggctgggagttcaagaccagcctgaccaacatggagaaaccccgtctctattaagaatacaaaattagccaggcatagtggtgtatgcctataatctcagcaacttgggaggctgaggcaggagaatcacttggacctgtgaggcggaggttgtggtgagccaagattgcaccattgcactccagcctgggcaacaagagagaaactacatctcaaagaaaaaaaatggacttgagtgtgtttctctcttatgtctaaggaactcttattttcaacctggaatgagaaagataattgtattacaatgaatatttggtgataatggcatttctgttttaattaggttctccctatctctactccctccatattgtttgaaagatggaagtaatttgctaaaggctttttttttttttttaacagtcttgctttgttggccaggctgaagtgcagtggcacgatctcgactcactgcaacctccgtctcctgggttcaagcagttttcctgcctcagccttccaagtagctgggattacaggtgtgtgtcaccacacccagctaattattattattattattgttatttttttttgagatggagtttcactcttattgcccaggctggagtgcaatggtgtgatcttggctcactgcagcctccgcctcccaggtttaagcggttctcctgcctcagcctcccaagtagctgtgattacaggcatgcaccaccatgtccggctaattttgtatttttagtagagacagggtttctccatgttggtcaggctggtctcgaactccctacctcaggtaatctgcctgcctcggcctcccaaggtgctgggattacaggcatgagccaccacacctggcctcaagtctttttttttcttttttttgcccaaacaaaaaggaaatttgaaaaaaaaaaaaaaaagaaacagattcaataaaaagagaagaagatctaccgaaatgcatttatgatttatgtgatggaaaaaaacagggtctcaccatgttggccaggctagtctcgaactcttgacctcaggtgatccacccgcctcggcttcccaaagtgctgggattacaggcatgaaccaccgtgaccggccgtctacttaaggcttttaacaacattttaacaaactgaaaatttttagtcagggcatattatattctgacagatgctgaatttgccacatgatttgaagatgaacatttcaagcattaggtaacaacatttttccttctttcttttatttctttcattctttttttgtttttgagatggagtttcactattattgcccaggctggagtgcaatggcgtgatctcggctcactgcaacctccgcctcctaggctgaagtgattctcctgcctcggcctcccgagtagctgggattacaggtgaccaccaccacgcctggctaactttttgtatttttagtagagacagggtttcaccattttggccaggctggtctcgaactcctgacctcaagtgatcctcccgcctcggcctcccagtgttgggattacaggtgtgagccaccgcgcctggcccaggtaacagcatttttcaaaagaaacttttaagtttattctttactgtgaatgaagatcgtttaagagtacaacttctaattttagctttctttcatgaccttcctccttatccctatccacatcaaagttaggatatatactttagtgattaactaggaagctcaaagtatttatgaatccagtaagcagttaactagaaatattgtctcttaccatggataaaatgtcttatggtgctacctttgtattttaaagtactcaggcagataattaataatcttcttcaatttttggaattttggatttcttggcatactaggcaagtcccttaaatttcatgcctcagttattttgaaaataagtatacgcgatatgcctctaattgttcttttttttaaaaaaaaaaaaaaagaaggagtttcgctcttgttgcccaggctggagtgcaatggcgcgatcttggctcactgcagcctccatctcctgggttcaagtgattctcctgcttcagccttctgagtagctgggattacaggtgcccgtcaccatgcccagctaattttttgtattttttagtagagatggggtttcactatgttggccaggctggtctcgaactcctgacttcaggtgatccacccccttcagtctcccggagtgctggaatttacaggcatgaccattgtgcctagctctaattggttttttgaagttccttctaacatggattctactacctttagaggatattttgggaattatttctgttaaaaacctatacaataaaggatattttaaaaagttaaaatatattttaatatatataattttatgggcaattatagtattacaaaatatttttaaaagatacagggttctttaatttggaatacaaaagtaatcgtaatctaatataggtatttatgcattatgcagtctgatttaagagtttcctttacctttgcctttccagggttggagatgcctcagagagtaagaagtatttgcttgagccataacattccttttttttttttaagcttcaatccacaaagtttttctttgattagattgatttattttaataattgggaaaaatgaattatgatagtgttgaattaaaatattttctcaagggtgttgggtaaaagagcaggactatactaattgactggagaagccaatttaaagctgatccacagtagtatatgccatttcatatgtaaagggtaagttttacttatactattgcaaaggaagatactggaccatcttgggttatttggcatttcttccattctgtctagttttatccaattttcaatgttaataactttttctagagactatcttgaacataaggaataaagccaagaagaaaacagggacagaactaatgggaaattcatttttcagttcaataagattatataataaaataaaaaataaaaaaattttttttttttttttgaaacagggtctcacccaggctggagtgcagtggcatgatcatggctcactgtagccttgacctcaagcagtttacccacctgagcctcccaaatagttgggactgtaggtgtgcatcaccacgcctggctgattaaaaaaaaaaaaaaaaccttttgtagagatgggggtcactgtgttgcccaaactcgtctttaattcctggcctcaagcaatcctctcaccttggcttcccaaagtcatggattacaggtgtgagccactgtgctcagctgctaatagctctttacattaattttgtgggattgtttgtgaataatacagttctcctcatgagagaaaagacatactcattttgtgcatattagattgttgactgaatctcttttaaaaattgttttctcctctctttcccctccccacagaatctgtctatgatcttctcccaaaggagttacagttacctccatctagagaaacatctgtagcatcaatgagtcagacaagcggtggtgaggcaggctcgcctcctccagctgttgttgctgctggtatgcatttcattttactttattaaagaaaactagggccaatataaatctggccaacatgaacagtgctggcaaaattcatactaaaaagagtgtgatttgagggttttaaaaagaggcattaaaatatgtacttttaaccttaaactttttcaatattattttcttaatgtaattcttatttcttaaaattttacattgtctcatctataaatgccatttcctaaaatggaccttgtcttcaaatatgggaaccagcttaaagttgtttggttgactgtgcttaaaaaggttaaataccaagctgtgaatagaaaattatatttgagtttctgtttaataattaattttaaagacttgcaccaagggaaaatattttatatgatctgaaaaatgactgaagcactcaagtgtcttttatattcatagcatgttactgaaacctttttattatatttaaaaatatatgtgacttcgtagttttcaatttattgaaagtaatggaggacgtcaatataatatttatataaagacattttcttatattgatgaaaaggtatagaaagtaatgtttgaaatttattagacttatttttactcagctctcaaatcatacacttaatgatatacaattggctcaaatttttattttacataaaaataaaagatagacaagctaatagaaaaaagtgttatcagtgacaaattagtatcagtccttcctgtaatgttagtttacccacctaatattggatttatagactgctaagtgtgtttgttttaaaaaaaggaaacatatatatatatatatatatatatatatatatatatatatatatatatatatatatatattttgaagttttatctgtcctaattagaggtttcttgcctaatatgacacctctcatctttaaaaatgatatttaaagtttatcagagcattgttttcagtaaattattttagtttcaaaatgagaacagtaaagtgtaaggttgtggtttaaatgaggatattggtactatagtataacttcagatatatttctcatatgcattaacctatgtaccattaaccttatgtaccaatctttctcaggctgcatagtgcattgctgaagccttcctggttgaaggcaggaaaactttaaatatggcaaagaaactgatcagccctgttcactgttcatgtgttgccagacactttctaacagtttctgtggatttaattgtgaattagtgaactttttagtaatcaaattgataagatgacctggtttgctttatatccactgggttctaaaatggctctgatgatatttttctggaattttaagttttaaatctggttttaaaattgcatccaataataaaatatgacaaagataaaatattttttatgagatacttcactttaaatccacaagtagaaattgactaactgatttcttttgtatcttttgagattgttttttaaagatacgttgaatctatatagaactaaaagtctgtttcttctgtgctttttaacatctgttgacggtagatccagttccttttaaaagctgaaaaaattgttaggtttagaaaaagaacagttcttccttttagataataccaaattgaattttagaaattcttatatatataaaaatatattaaaagttcttgaatttgggtccctaatgaaatattaaccttctccccaccacagtatatttaagaaaaatctctcaagataaattacattgaaagctgtgagttgaaaaatcatgaaaataagaaatctaattaaaagaagtattttgaagtaatgcattcttattatcttgaaattattgacattgtaaagatggcaaagagagtaagaaggtaaactttctagttttgttatagtcacacacagaaagtttatatgatcattaacaagtcatttaaaatctttttcaaaatataaatttagcaaccaatgtagattattctaggattctaatagcttagaaagagcacttcataccttaccattataaacaagagagtttaaatcacagaataattattttaaggaaatcagtatatatcattagaattatatttttatttgacatactaatattcttggtgatataactgtcagagttacttggagtatattaccaagttactcaatgtttttctagccagaaggctagatagatgtctagggaaaggcatattaatttagacttgtatgggtttttaaaaaatctttagcatttttgaaaaaatatgggccaggcatggtggctcacaccagcactttgagaggcccaggccggcagatcacctgaggtcaggagttcaagaccagcctgatcaacatggtgaaactgcgtctctactaaaaatataaaaaatcagccgggcgtggtggcgggcgcctgtaatcccagctactctggaggctgaggcaggagaattgcttgaacccgagaggcggaggctgcagtgaaccaagatcgtgccattgcactccagcctggtcaacaagagtgaaactccgtctcaaaaagaaaaaagaaaaaatatgaaatgtgtaaaaatattgactcttgatatagttaattcttcagagttttgaaggagccggattggctgctctcaggtatgagggcctggtgggaacagacttctagttctgccataaaggtttgtgtttgacaagttttaaattaatttaaattttaaaatttaaagactgggcatatgagtgttcatggacatttttttgttgtttaattttttaaaatgtgtttctcagattcaccaatttagatttttttcctcttcctgttactaagggaataagtaaatatgatgctgctaatccacaatccagaatattgggtaaaagagcgtctatcaagcctttatctgcttctacacaattcatacttttatgcactcccatcaataatatattttagtcctctaatcccagggtcaaggtgtcggggaaaggggcttatttagacacaatttctcccctcttcatggggccaagtgtcagaatctgggaggtggagttcagagtcaccaattttgttatcccatttttttttttaagagacatgttctagctctgtcatctaggctggagtgcgaggtgcgatcatagctcactgcaaccttcaactactgggctcaagtgatcctcccacctcatctgggaaataagtgcacactaccacactgggctaatttttttttttttttttttttttaagagacagggtctgtcacccaggctgaatgcactggtgtgaccttgactcactgcagcctaaaccccctgggctcaagtgatcctcccatttcagtctcctgagtagctgggaaccacaggcatatgccaccacatggacctgggtaatttttttttttttttaaacagagtctcactctgtcgcccaggctggagtgcagcagtgtgatctcagctcactgcaacctccacctcccaggttcaagcagttctcctgcctcagcctcccgagtagctgggattgcaggtgcacgccaccatgcccagcaaatttttgtatttttagtagagacggggtttcattgtgttggccaggctgatctcaaactcctgacctcaggtgatggacctggctgatttttgtgttttttgtagagacagggtcttactatgctgcttctccagggatggtctcgaacgaactcctgggctcaggtgatcctcgaggcttggcctcctaaagtgctgggattacaggtgtgaaccactatgctcggccctggattgtttttttaattttttgtagagttgtcttgctgtgttgcccaggctggtctcaaacccctggcctcaagcagttctcctaccttggactcccaaagcactggaattccaggtgtaagccaccacactgggccctcctcctcatttttaagaattctgtttttgtcccagtggaaagatagttaagccttagatgttcaatatatcaatgaatgaaagctttaaaaatataaactttctgaaccattttgtaagttctcagtaattaaaagagaggccacgttcctaaaacataaaagttatccaaatgaattgatgacactttttggcaaaataaggagtttattaagaagaagtacaaatcatgaaaagattcttttgtttattttttggataatcctatagtatagttatacagaattaaaacataggtattaggagaactaaatgagttatatcagaatttggggcttttgaaaagatgtatggcaggtttggggttttttaaaataacagctttattgagacataattcacctgctgtataatcaaatatttttaatctatgtgcttacagttttaatcattaaatttacttaatttatttaaaatagaaagtcatggactttagtcttcattttaagaaatcaagttactttcttgttctattctacacttgttttgtttggcttcatttgggaatataacattgtgtttattagtttatttcaaaatatatttttctaagtggactgtttgaagtttctttaaaatttttaattcaaattcttgaactaaacaatgaattaaactaggccgggtacactggctcacgcctgtaatcccagcactttgggaggccgaggtgggtggatcatgaggtcaggagttcaagaccagcctggccaagatggtgaaaccccgtctctactaaaaatacaaaaattagctgggcatggtggcaggcttctgtaatcccagctacttgggaggctgaagcaggagaattgcttgaactcgggtggcagaggttgcagtgagccaagatcacgccactgcactccagcctgggcgatagagtgagactccatctcaaagaaacaaaacaaaacaaaacaaaaatgaattaaactataggttttataattcagccagagaatcttaataatgcattaataattctttttttgcatagcttcataatattcatattttggtttcagtaattatatattaatactctttttagaagtaacagtacactaatacttcatagcaattgtgcttttgtttttgtttttgttttttgagatggagtcttgctcttttgccaggctggagtgcagtggcgtgatcttggctcactgcaacctccacctcccgggttccagcgattctcctgcctcagcctcccgagtaactgggactacaggtgtgtgccaccacacccggctaacttcatagcagtttttaacatgtataaagataatacacagtcataaagtgtgtacagtggaaatcttggttgaatatctccacttgttggaccactgtcggtttttaagttcataacttgatgtgaagtgatccatataataaatttttcttttggaagagctttgatatatagtgctttgagttctatgccatgtcacttaataaatctcaagtatgtaacaagtattttctacaaaatttcattgagtgctatttatactataagagagggcactagagatgcaaattaatgtcctataatcaaataagtgctatattctaattcatttcatatctcctaatcacctgaattaaaatcacagaaatttctaaaccatctataataatacactgtacaaaaactgaggtgaagaaaatatgttactcctcctgtaggagacagcttttaaaaaatgaaaatatattatcacttttaagttcctactatgtgacaagaattgtgttaggtaatttgcatgtcatcatatcacaatccttctagccataaagtatctctcttttttcttttacctagttcttactccttgtcattgtgcttgagggaatttggcattgtgtgctatcacttcgattagggaaacgcaagatccttaactaggcaatgtatagaatattgagttgaaaagccatacctcttctctacaagtgtcaggatcttcgaatgggaatttgatttctataataataatttaataaaagtgatttctagcaacaaaattttttatcccattgaatttattataacttaatttacttacgttagaaagtatttacagttatataatgaggattttcttgagttgactaaatttgaggaagaaatttgcctttgattgctttcctgggttaacatatttcagaatttttgccacctaatgtagtatactcttcatgaaattaaaccagaaacccactaacgagaaaggtaattcacctacagatgctgtgagctaaaatgttgtgagttgatcttggttattctttatggccattcccttttttccaagaaaactagaccatttctagaaggaagtcagatcctagttacaaacatgttgcaagcagatttaaaaatctctactcctccttctatcttattatactgaaattacatagtaaatttaaatacatacacttatacatatggatggtatgtatgtatggatttatgctgaagtctgcattattagagagcaaacttgggcctatagccattaattcagaaacaactgctaattgtttgacagttacaaattgacattgccaaaaagcaaacttggcctattattgctttgttcctttaatatttctctttttattgtcctcttaataacacttttataaatattgtgatttattcagtttctaataaataagcatatttttatattacttgagtcaacagaacagcattttgaaactgttcacagattctcattcataagctaaatacttatagaaaatagatacagttactgattttatgcattctgtacaattttgcctaagaaattaatgcatagaagtggacttttttatatcaccaacaagattgaaaatataagcaaaaagtgtttataactaattgttttataagaaaggaacttcacctgtttctggatattttttcctctggaattcagccataaaaaagaatgtaatcttgtcatttatggcaatgtggatggaactggaggacattaagtgaaataagccaggaacagaaagttaaacactgcatgttctcactcatatgtgaaagctaaaaaatgttggtctcatagaagtaaaaagtaagacagaggatagataatagaggctgggaagggtaggaggaaggaagggatagggagaaatttgttgaaggatacaaaatttcagctagatagaagaaataagttctagtgttctataccactgtaggatgactgtagttaacaatactatatagtttcaaatagctggaaggaagatactgaacattcctaacacaaagaaatgataaatatttagataatggatatgttaattaccttgatttgatttctgtacattatatgtatcagaacattatctaccccatgaatatgtatgattattatttgttaattaaaaaaataaaattaaaaaaatcatacatgggccaggcatagtggctcatgtttgtaatcccagcactttggggggccgaggcgggcagatcacttgaggtcaggagtttgagagcagcctagccatcatggtgaaaccccatctctactaaaaatacaaaaattagctgggtgtggcggcgggtgcctgtaatccccagctcttcaggaggctgaggcaggagaatcactcgaacctgggaggcagaggttacagtgagccgagatcatgccactgcactccagcctggcgatagtgagattccgactcacaaaaaaaaaaaaaaaaaaaaaatcatacatagtaaaatggtagcattttttgaatatgagtggaagctacatgagtgttttaaatatttcataattttaaaatcactgggtgcaaatgactatatgaataaaagtgtccaataaactgtactcttaaaaactaacaaatatatgggatatattagatacttgatggatttatatttggcataagtaaggttatattcacttttcatccatcattgcatatatgtatcaagtatgtgtgtactggcagtatttatttagcccactcaggtagaatttattcttcccatataattacagggtattatcatcaactaaattaaatcagaaaatgaatgagaaagcacctcaaagtaccaggtctatacagccattctctagatcaaacttacttacaaacacacacacaacatgtacatagttttatttatttgtttatttttctcacagatgagattaacatgggctttggagtcataaagactgaatttgaatctaattgctatcatatcatatctcctatatagatggactcttgggaaagttaaataaatttctaataatattacccttgtagttagacaataataccaacttcttcttaaggttcttatgaagataaatttgtaaaatagccgaacattttctgacaagtagtaattattgaataaacattgacctccttccccatgtgtttctaacctcctttgttagtaaagtttttttttttttttttttttttgtcatccaggctggagtgcaatggtgcgatctcagctcactgaaacctccacctcctgggttcaagcgattctcctgcctcagcctcccaagtagctgggattacaggcacctgtcaccatgcctggctaattcttgtatttttagtagagacagggtttcaccacgttggccaggctggtcttgaactccggacctcaggtgatccgcccacctcagcctcccaaagtgctggtattacaggcgtgagccaccatgcctggccattagtaaggtgttaaaaaataggttctctttgtaaaaattagttttgaactttatttttactttttttctttgcattctcacccagtctatttttggtcttattttgaagtttcgcacaccagtcaagatgtatatatatgtgggccatgggatatactttctgactttgttattctgtcatgttgacactctctcagtgggaatctgcattggtctgttttcacactgctgataaagacatacccgagactagaaagaaaaaaaggtttaattggacttacagttccacatggctagggaggcctcagaatcatggcaggaggcaaaaggcacttcttacatggcagcagcaagagaaaatgaggaagaagcaaaagcagaaacccctgataaacccatcagatctcctgagacatattaactatcacaagaatagcacgggaaagaccagcccccatgattcacaacacatgggaattctgggagatacaattcaagttgagatttgggtggggacacagccaaaccacatcattctgcccctggcccctccaaatctcatgtcctcacatttcaaacccagtcatgccttcccaacagtcccccaaactcattaactcatttcagcattaacccaaaagtctaccagtccaaagtctcatctgagacaaggcaagctccttttgcctatgagcctgtaaaataaaaagcaagctgattacttcctagatacaatgagagtacaggtattgggtaaatacagctgttccaaatgggagaaattggccaaaacaaaggggttacagggcccatgcaagtccgaaatccagtgggacagtcaaattttaaagctccaaaatgatctcctttgaatccaggtctcataaccaggtcacgctgatgcaagaggtgggttcccatggtcttgggcagctctgcacctgtggctttgtagagtatagcctcccttccagctgctttcatgggctggcattgagtggctgcagcttttctaggtgcatgatgcaggttgtcagtggatctaccattctggggtctggaagacattggccctctcctcacagctccattacatagtacccagtacggactctgtgtggggtctccaaccccacattttccatctgctttgccctagcagaggttctccgtgagggccccacccctgcagaaaacttgccagggcatccaggggtttccatacatcctctgaaatctaggcggaggttcccaaatctcaattcttgacttctgtgcacccacaggctcaacactacatggaagctgccaaggtttggggcttccaccctctgatgccacagcttgagctgtgtacattggcccctttcagctatggctggagcatctgggacacagggcaccaagtccctaggccacacacagcatggggaccctgggcccagcacacaaaaccgctttttcctcctgggcctctgggcctatgatgggaggggctgccacaaaggtctctgacatggcctggagacattttcctcatggtcttggggattattaacattaggcttcttgctacttatgcagttttctgcagccagcttgaatttctccctagaaaatgggtttttcttttctgtcgcatagtcaggctgcacattttccatacttgtatgctttgcttcccttataaaactgaatgcctttaacagaacccaagtcacctaatgaatactttgctgcttagaaatatcttccactagataccctaaatcatccctctcaagttcaaagttccacagatctctagggcaggggtaaaatgccggtctctttgctaaaacataacaagagtcacctttactccagtttccaacaagttctttatctccatcagagacctggaccttattgtccatatcgctatcagcattttgggcaaagccactcaacaagtctctaggaagttccacactttcccacattttcctgtcttcttctgagccctccaaactgttccaaactctgcctgttacccagttccaaagtcacttctacattttctggtattttttcagcaacaccccactcctggtaccagtttactgtgttagtccattttcatgctgctgataaagacataccccagattgggaagaaaaaatgttcatttggacttacagttccacatggctggggaggcctcagaatcatggtgggaggcaaaaggcacttcttacatggtggcagcaagagaaaatgaggaagaagcaaaagtggaaacccctgataaactcatcagatcttgtgagacttattatctgtcagaagaatagcacaggaaagaccagccgccatgactcaaataccacctcctgggtccatcctgtgacacatggaattctgggagataaaattcaagttgagatttgggtggggatacatagctaaaccatatcagaacctttgtatataaaaggaacattgatagaggatgatgaaatcataggaaagaccgacagtttctgaaggactaattctataaagtctgctgtttaagagttcttaatagtatttttttaatgaagtgatttaagttgcatggttaatgatcaaaacttctggtagaggctgggcacggtggctcacgcctgtaatcccagcattttgggaggctgaggctggcggatcacaaggtcaagagtttgaggctagtctggccaacatgatgaaaccctggctctactaaaaatacaaaaattatctgggcatggtggcaggcacctataattccagctactctggagtctgaggcaggataatcgtttgaacccgggaggcggaggttgcagcgagccgagatcacgccattgcactccagcctgggcgacagagtgagactgtgtctcaaaaacaaacaaacaagcaacaacaaaaacaaaaaacaaaaaaacttctggtagagcaatttatgacttctggttttttgtctaggcagtttattttgtctacgattggatctaacgtacactttactccagacccaggtctaaaacctgattgattaaatcagaagtttttaatgatgctgtaaatgattttttattattgtttaatcatatcttaaaaaaaacaaacgtagggctgggcacggtggctcacgcctgtaatcccagcactttggaaggttgtggtgcgtggatcacctgaggtcaggagttcaagaccagcctggccaacatggtgaaaccccatctctactaaaaaatacaaaaaattagccagaggtggtggtgggcgcctgtaatcccagcgactcgggaggctgaggcaggagaatcacttgaacccaggaggcagagattgcagtaagctgagattgcaccactgcactccagtttgggcaacagagagagactcggtctcaaaaaaaaaaaaaaaaaaagtaaaaacattgaagtagaattggcaggaatgcctttattttttaatctaaaatatttaaaatgtattgtagcgtattgaagtgtccttcagataatatcccttggaactttttttttctctaattttgaagtttagtgatactctgtttttatcttaaagtgacattatctttcagtagttcagtgtttgtctctgtctctctctctttttagcctatacttcctggtatatttggcagtgtaataaatgtagctgtcagctagtataattattcccttttgtgtttaaattattggagatagaagattacatctggatattagtctcttcattcagtattgacaagtgatggtatccagtggtacttaaatcattggatgatggaaaacatctttttcttccattaggaaagaattttacatggacttaaaaatcaaagtatttaatgtgtatatctagtacatgttttatacactgtgcttagatcctttgggttgaatttttgtttgaatagaaaaaaattttgtttggatagaacaaaaaatacatttaaaacattgctctaagtttcaggataagcattttatttttcagggagcactctttagtaaatattatatgagtgtattaatggtactctgataaggtagaaataattatttaaggagaattcagattaaaaactggagagtaattgttttataacattagaaccctgaatggcaatttgatgaactggagaagaaaaagatgtctgcaataaatcagaaacaaacccttcagcttcagcagtagtgctcattattttttttaaaaaaatagagcctctaggatcaaacatattatacaaagtagcatgtatcattaaaagtataaattggtatcctttttaaggggagtataaagaagtatgtaggagtcagtgtggtctgaaaaatggaaaggttattttgctgctaaaatataggtttttttacagtgtaagtgcattgctcagaacatatcttcttccacgcttcaaaagagtttgggtaagggaacagcctgaaaaacacctgaaagagagaattctggcttatggattagagagcatctataaacagaacaaattggtgaataagagttcacaaaaattttgtctaagaaatttccccacatgcattcagaggttaataattaaattttttgaagttcattttaaaacattgcttattttaacatgtaaacgtatgttgggtgggaaaagtacaaatgggagattgaaactgttttaatcatgtaaatgatcagccctacaatttttgtttttttaataatctggaatgcttattttatatgctgggatgctagttgttttttctattaatacacttaacttgcattctagcttcgccattcagagacaggcatcgtgtggtgggttgtgtgacagtgtctgtcaatagtgaagacaaatagtgccagagacacttaacccatccaatctcacccagggtataggtcggtctcgttttcagacttcttcataagtccttctttctttctctcttcctttcttactttttgtttgtttgtttctaaatagtggattgatactgattgaaactaaaactttttgtaaagttttaaactttgcattaatattataagaaaaagaagaaaagtagaaaatgaaggttggcatgtaaggtgtcgacaaagcaggtttgcagccactttgtgtgttctagatatttcaatctcttggcaacatgagtgttggccttacagcttttttctctgaatatctttcttctttaatctgaaaatatgtccttgtatctggtgacttttatcagatgagaacttcagagttggtcattgttaccagtaagaaaaatataatgcttaagaagaaataacgaaggttgaacattatgtgttttagatcagaaatagtttctggccaggcacagtggttcacgcctgtaatcccagcactatgggaggctgaggcaggcggatcagctgaggtcaggagttcgagaccagcctgaccaacatggtgaaaccctgtctctactaaaaatacagaattagccgggcgtggtggtgcatgcctgtaatcccagctacttgggtggctgaggcagaagaatcgcttgactctgggaggtagaggttgcagtgagccaaaatcgtgccattgtactccagcgggggcaacaggagcgaaactccatctcaaaagaaaaaaaaaaaggccgggcacggtggctcacacctgtaatcccagcactttgagaggccaaagtgggcagaacacaaggtcaggaatttgagaccagcctggccaatacggtgaaaccccgtctctactaaaaatacaaaaattagccaggtgtggtggcgggcacctgtagtcccagctactcgggaggctgaggcaggagaatcgcttttacctgggaggcagaggttgcagtgagccaagattgtgccactgcattccagcctgggcaacagagtgagactccgtctcaaaaaaaaaaaaaaaaaaaaaaaggaaattgtttccaaatatcttttttttaatgattatttttgaatagtcaataatttattccttctttgttccactatttgttcacttagcactcttgcaaaattttatggctttttttaaactagcttttttagaaaactcaattttgcacagatgttgaaaaattataaaatatgtacatattcaaatgttagggatcaaattttaatcttggaagcttggaaattaaatatcatttctgtcatatattttaaagcagtgaaaggtatttctttcttttgaggacttcagcaaatatttctaatttcaaagctttctattaaaagtttttagttccatataaagtatatcttttttatgatattttaagcactaatatattatggtagttaaaataatttctagttgacaaatctagagctgatagttcttaagtttaaaatacagtttaagcaaggagtatataaaatctacatgggtttctataaatggtatcgtttaaaatcttatttcagtctgggcatggtgcctcatgcctgtaatcctagcactttgggaggctgaggtgggagaatcccttgagcctaggagttcaaaaccagcctgggcaacatggtgaaaccctatctctacaaaaaaatacaaaaattagccaggtatggtggtgcatacctgtagtcctagctattcaggaggctgaggtgggatgatcgcttgagcccaggaggtcgaggctgcagtgggttgtgatcgtgcccctacactccagcctgggcaacagagcaagactgtctcaacaaagaaaacaaaaaagaaagtaaagaaagtaaataaaatcctgtttcatcttttattaaattgcagattctgggatattcatattccatgtagacattatttaatatctgccagtctttgaatctcaactatttttgagtatttatagtttccatcaattcttaaaagaagctgtatgtacaattcaagttcaccatcgttactggcatttggtctgataactggctactgttaatagtggcaaacagacttaaatacaggatactttacatatgacactttacctgcctcttttaaattttaaaattattctatttaaaataatctgacattataaatttctatgagtaaattatagaatggtctattaatttttcctttagtttgttgtgctttctgtggtcacagaaaatgctttagaaaaaataaaattattctagcccaggcacagtggctcatacctgtaatcccagcactttgggaggctgaggtgggcagaacacaaggtcaggagttcaagaccagcctggccagtatggtgaaactatctctactaaaaatacaaaaattagccggacgtggtggcgggtgcctgtagtcccagctactcgggaggctaaggcaggagaatcgtttgaacccgggaggtggaggttgcagagagccaagattgtgccactgtactctagccttggcaacagagcaagactgtgtctcaaaaaaaagaaaagaaaagaaaagaaaaaggaaaaaaaaagtattctatataagttagactataggttcaaagataattccttcataaaagaaaaaaaatcaataaaatttattcacatggccatgcaccatggctcacgcctgtaatctcagcacgtcaggaggccgaggtgggtggatcacttgaagtcaggagttcgagaccaccctggccaacatgatgaaatcccatctctactaaaatacagaaattagctgggcgtggtggtaggcacctgtaatcccagctactcaggaggctaaggcgggagaatcacttgaaacctgggaggcagaggttccagtgagccgagatcgcgccactgcactccagcctgggcaacagagcgagagtccctctcaaaaaaaaaaaaaaaaaagaatatatagacgggtcagaactgcattcacactttggttctatagaatatcaagctgttttttgatactttatttagtgatacagtggtattcccaggaggatttgtcagcacttttctgggaatgcttggaaatgactaattagcattagaaatttaaaatgttctgatatcattattttatgtatttatattttaataggatattaaggatttttttcatggtaaatttatggatatataagtaggtaatttggcttacttataatttaaggaaataaaattactagagtactctcggtagagatagcaaatcgttacctctagactcttagtattttctctgtatcaaataatgctatcgtagtaatatatattctaagtactttgaattatatttgaattatatttgaatataaaagaataaaaattcttttattcttcaacctacatttatttgccagcttatctttaatgtaactccaaatacataccaaatttttggcttcccagaaatcaatttaataatttgaattttattacaatgtaggcactgtgataggtgttgggaggatctaagatgagaaagatattgtcagtgctttcgaagtgctcacagttcttaccctccattttactacctcacatggcattattaattaatgcactcagatctcttgctaaccagaatgtaatgttttgatgtgaaagattttatacatcattatcatcatcagaggatcaatagtaccatggtaaagaattttaggctgggtgtggtggctcacgcttataatcccagtactttgggaggccaaagctggaggattgcttgagcccaagaatttgagaccacctgggcagcatgacaaaactttgcctctacaaataatttaaaaagtagccaggcatggtgttgtgtgcctgtagtctcagttactcgggaagctgaggcaggaggattgcttgagcccaggagatcaaggctgcagtgagccatgatcgtgccactgcactgtagcctgggcaacagagtgagaccctgcctcaaaaaaaaaaaagaattttacagtttaaaaaaaattatttcatttgtcttaaaatgagtagaatctttgcaattgaggtagactttaaaaagtaatatttttctattaaaagatggttactgttcttttctgacagagttaatattttcagtgtcatagttttgtgctaactttttctttaataagtatgcccaggatcaatcctgcagttgtgcacacacaatcgtgtgttagctgtccatggaaaatgtatagaatatttaaatttatgtaggatatgatatcacagtttggcatacttaccctagaacacacacttatgtctgactgttaaatcagttgggttttataatcattacggttttgatatttgataagatttgcaagataaaattttttacctcagagaacaagacaaggttatatcgtgcatattaaattcataataccatataacttgcttttgggttcatgattgcttttcacctgtactttccatctgtcatgaacagggatccctgagatgttcatactctgcattctcatgtgcatgatccttagatttaaaaagggtgagtgggagaaagttgctttatagaaatataagttcacagcattcatgttttgtgtgttccactgcaaatattgcatgctgcatacttgtatgctgcatacttgtatttctctgaaaatgaagaacataggctcataagtacacaaaaaattagtttcgtttttgccaatagttggaacagatgaaggaatgttagatgtaataccttttctattttttctaaaatgaattctgtagtatttttcaaaagacaaggaaaaaaattatatttaaactcaaagtggctacaaatcagctcctaaactgtcactgacagtagcatatagatttcgtagtttttacaaacttttaaaaatatttatttactaagaaaacattgcattaatgcatgatacaaaattgataagttttcctttaaattggaatgcagtttaaagtgactgaattttccaatttcagctactgcatttgagaaggatacatactggaaaatggaactggtatcatctaatttctttagactccttcacttatggtagttgggaaaaatctttccatgtggcattatatagatcatattcttgatgactaatattaattactgtgctttttagccttgacagtaatgaagaattctgggtggatatagttcattcaaataatttaggtgtattttaaatacatgttttcaattgaaaaaaacagatctttggcacttggcttttaattatgtaaacattgacattcttacattttgctctttatattataattgatgtgtatgttgcaattccaataactgcacatacagttttatcatacactttaaaacagtggcatacttggtcatagatacaaattaattttagattgaaatatatctttgtcacattacctatttttatttttgtgtgtgtatgtaatgacaacctttccatattgtgaacaagataaaatgatatctaaaatgttagtcatgacaacttccaaccttagcgatcaacgcgcctctgagtttatgctgttaagggctaaagtaatagtattttcagtgcgctattctgccagttgccacacatgctgaaaagatctacttaaatctttcttgctaggcataacagataaatagttttataaaaaatattaattctgatgctctccagagatttttatgcttaactattttctgttagatttcagccagtaaaatttaccattgttcttacattggaaaattcccttactagtcacaatcaaccaggtcctttaaaaagagaaaatggacagctctaaccaattgtcaagcatgtaatcaagtactttattaagagaaatccatccattaatcagttcttcctttgcttttcattatgtcataaaggatggatttattttagagcttatggttttgaactaccacttccagcttctggagacccaatgattaacttgcttctacaacccagaatgttccaaatcatacctttttcatcttgattctcctagattttacaacaaatcatagtgacaataccagttccattttgcctccaattcagttgattatatattttttctatttatttctcattttataattgatatctggaataatcagcagctcttttctcatttattttctcatatttttattccaggatttgcctctgaagcagggagtgtctgcattaaaaatgacctgtagttctctgcttcataggttagaaacttattttaatattttgtggctaagcacagtcccacttttcaaattctataatgaattatttaattggcattgaatgtggaccaccagcatatatttcatattggggttttctttattactttaaatgattaaaattcaatagaatgtccagctgaggcaataaaagctttatttttgctttacagcttaaaacgttaaatgagattttaaaaatctatggattgtaacataagtaaaataatgctatttgggcatttttaaaaattccatttcttaggccttatattgcttgaagcatttatattctaaaacataaccaaattctgactattcattttggggaaaaacaatcagttcacaaatcacattttcaatgggactgctagccagcataggtgaaaacatgtatagtgtatttactcttgaattgtacactgcagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatgggttggtattcacattttttaaaattctatcatcattatgcaaaacaaacaaacaaaaaaaattcccaatttttcctaattgctgagctcaagtttgcatataaagcaacagtgctaattttatcattgaaatacatgaaaattttaacttaaaattaccaacttttactagatagaaaataaaataatcatagattctagcaatagatatcttattatcagtatagttaggtagtagaaaatgaaaataatctgttctgaaataaatttcaaatgaatttatattttaaaaggacttttactcagccaggtgcggtggctcacacctgtaatcccagcactttgggaggccgaggcgggcggatcacctgaggtcaggagttcgagaccagcctgaccaacatggtgaaaccccatctctactaaaaatacaaaaaaaattagccgggcattgtggcatgtgcctgtaatcccagctacttgggagaactgaggcaggggaatcgcttgaacccaggaggcagaggttgcagtgagccgacatcacgccactgtactccagcctgggcgacaagagcgaaactccatctcaaaaaaaaaaaaacaccaaaaaaaaaaccgaaagaactagcaatgtaatgactccatccaaaacaactcaaacagtcactaagagctatgttctctttccaattgtgtcctcatatggtttacattttttagaggattttagacttaatttttttctctttaattgatgaaaacaagaaaaaactaaattgagagtttgattctcatcatttagattcatgtatcataagcttttttcctttgatactaatacattgattgtacagagtcgatattttttttaaatcactcattttttttctgtgattctgggttacttatttagagggtgatgaaacaggatcatggtacatgtttgagttttctttcatctctgccagtcacactacccactaatatagttcaatagctatgttacagaatattcactgctataatgcagactagtatgacttttaattcctttagtaattttattgtaatatttaattgctagacttttaaattagatttttgtatagtacattcaaaataatttgttaaaatttaactctctaggacccaggatctcctacaatttcagttttacacaaaaagtggtcaagaagctttagattgatttactacttgatgacatcactgatctttttttggttaaaaattcagttgaatattatagagaatattcttaatatatatttaacttgcccttaagcactccctcagtacattttaaaaagtaatatctaccctttaagcaataattactctacaccgcttctttacctccttaagggtgatgtagttaaatgaaaatgaatatttaaatgcttttcagttttagaaagtccagtttagtaaattacctaaaagaaaataagatatactctttcctaaaatgttgccatttaataaaatcaagaatttcagaacataatatttgtagaactattacttataaaataaggctctgaaatgtaatgaatacagcaggtaaatacttaagtaactgtgatagtaacacagatctaaaagtctcatgaatatcatttaattacatatgtgtgtttatttgtgctttagtggagaaagtctttaatataaagttccagaagataaattttcatttttatatcaaaatgaatgttgaaggttcaaatttagagcaaatagaatttttacttatggctagtaaacagtgatttgcagttgctaattaaatatcttgaccttcatttttctgcttctacttttgtatgatagctatatcttagaaatgatttgaggttacccagggaaagtataatgacattggtcaagacagactctttcatgaaataattcatggagcagaaattccatcaagcagaagaaatgtccagcttcttaggtaatgaaaaaaatatttgaaactagtatatggaaatgatggaagaattttaaaattggaatttataacaactatattgaggaaaggatgaaaccatacctaaatatatagaaaaatcggccttaaaaataatttttcagagcatgtcaagctaaaagcctgtattcttcaacagtgaaaaaaatcttaaaatgttttgagagataaggatatagccttagatctaatgtgccataaatctacaatttatatcatactaagtatttagaaaatgtactttaaaatgtatacagcagtttattgatcttcaagataccacatagaaatctgatagcttgtagatgaaaatagcatttttatatgactaagatgttagagtctaataagagaataaaaccattaaaaaaaaaagcttagtatttgaatattcctagccatatcattcttaaatttctcaactaaatgtcctgagaatcagttgccccatgtctcttctagatatttctataagttaagataggatgtcatctggatgtgaaacctactttaggctttttgtaatgaaaattatttttttgacataggtcaccagaaggattatgcggcacgaataaattagaatgtcattttaagacttctgaatagaatatgccatgatggtggattttcctttttggttgtcatttagaagtaaaatcccatgtaactgactgctactttattttttcttaagccatcatgccttaaaaattagtaacttgactacgtttctaagcattagtggatgttttcatggttttacatgtctatacatctcaatatgtatgtattccatttttacattttagaaaaaaaagatagttttaagaacttctaaagtaccattttagaaattgcttaattacatgatattcttctttaagccataatgtgtatactcactcaatacttcatcccaagtgagatcatttgttttgctagactagtaaaactcactttcatttatttgcccttataaatattagcttgactagcataagtgagtataaaaacatgtcttgccaagttaatcgatatgctctatgaattttccttgtatttcaaactaaaattttcccttttctattataaaattgatacatatgaattacaaatatttgaaaaatacaagaaaacctcataatctagtcactcagtaaatctgctattatcattttgcagtattttctttcatctctttgtatgtatatttgggggatatttctacatagtttcaataaatgaatatttttactttaagattagtataaaacagaatatcatagactttcatgtgtgaggaactgcacactagttagaccaaatgtttgaatctgtacccagaatgatgaaaagaaaaacagggtttactgcccattgttccagcttcaacttgatacttatgttcatagaatttattcttccagggccttttaaatgacttgcacaagtaatctttgatttacttatgtcaaatttacacgaatggcattccttgtccagttaggatctttctcatcttaatattacagaagcttctttatccctctgctttcctttctttgtccctttcttcttctttgccttcatcaacaaacatttcttcagcacctgttatgtttcaggaagtgtgccaggttcagggaatataaagatgattaagcacagtattgcgccttgagaacttttcctctcatctatcagtcttactgaattcctatgctagtttcattccttctttgctccattcttttgcctctttcctagccaaggattcaacctactccccatttccattgaagatagtgcctttcctcactttgttcttgatgattaaggcaacaacttggttacagctggaggggtaaacattagagccaggtttaagcctgcttagcttctctgtgtttgaagtcgtaatattcctactggaatctggttgcttttagaggagatttttcttcacagtcatctggctcctggatctttgatgtgagtcaaaacttaggactaggagggtcacagagaaagctatgaccctgactttatttaaaaacatacgtgaattttttttttttttttgagacggagttttgctcttgttgaccaggctggagtgcaatggcacgatctgggctcactgcaacctgcacctcctgggttcaagtgattctcctgcctcagcctcccgagtagatgggattacaggtgcctgccaccactcctggctaattttttgtagttttagtagagacggggtttcaccatgttggccaggatggtctcaaactcctgacctcaggtgatccaccccgcttggcctcccaaagtgctggaattacaggtgtgggacaccacaccattgctcaaaaggaaagataactaacaatattgtttttacttgtttttattatgtatttgcagtgcttcaactattttacagattaaatgtgtttgcctgaagtcataaccaccatttgggatactgtttttctttgaacatgcattccacatagcaaatgcattataaataaatgttaaaaagcataactaaaaaaaataagggccaggtgcagtggctcatgcttgtaatcccagcactttgggagactgaggcgggaggatcacctgaggtcaggagttcgagaccagcctggacaacatggtgaaaccccatctctaacaaaaatataaaaattagctgggcttggtggcacacgcctgtaatcccagctacttgggaggctgaggcaggagaatcacttgaacccaggaaacagaggttacagtgagctgagattgtgccactgcactccagcctggatgacagagtaaaactccatctcagaaaaaaaaaaaaaaaaaggtagaatgctggtgctgtaaagcccagattgtaaaaatttttattgagggctttaattacttaactaatcacagataaaaataatctgaaaaatcacactcctagaaaagattgtttagagtaaagctaatttcccaataaaaattgaatcgctaattttttatctaatttcttcagtttggtttactgagaaggatactcaaaagaataagctacatataccttcatttggtttgtaggccattttgtatgggggtatgtagggtttttgggggtttgttttttgttttcgctaccctcacttcttttactgtgcagttaaaaaataacagtagttaatcttatagctttatataaattttggaatttatatgtggaatgcatacatggaatttttaaatcttattttgactgaagtacaatgttaaaggttatagtgacattagctattctttcctgttagtctcagtttattgcgctcaatcttcctcccttcctcctaccactcacatacgttcattttcttttctgtcaaacatactttgttttatttttgcatcatatagtaaacttttttacaaaacctttttaaagatactttgctcatgtatcttcctttaggcaatattttattttgccagcaagctgaatagttgtttttactattattgccagttctgtttcttcctttgtcttaatggctttttttttttatcaaaaaactctttttgatactttctccatgttgtgctttgatttctcagaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaaggtatttactttatttatcatttgaattttagttaaaatgtaaaggggaatgagaatatgtcctgaaaagtaaaatattttcaaatcatgaattttcttccctcatatttgatatttgaattagattcatcccaaactttagaaagaattttttttttttttttttgagacagagtctcactctgtcacccaggctggagtgcagtggtgtgatctcagctcactgcagcctctgcctccggggtgcaagtaatcatgcctcagccacctgagtagctgggactacaggtgtgtgccaccaggcccagctaatttttgtattttagtagtgtcgcagtttcaccatgttggcgagactggtctggaactcctgatctcaagtgatcctcccgccttggaggaagaaatattaaagtgaattcagagaaatacagtagaaattattaagaactttgaaaataaggtttttgagatggttatagtaatcaagactattggactgagaaaagacttgattaatacttaaggcttacggtttaagaaatgggatatcatttgcatccactcaagtacaggaggaaagaaggaaatgaggaaaaaaaaagaaatgaggtatcaattgagtcttaattttttttacagttgagactaaaagttaaaagggacttaaattttagcacctaggatatcttggtataaagaatatttgtctttgaagacaaacctcaaaaaaatgggggaatggggagaggacttaacaagtgtccctaccccttgctaaatactaaatagggaggaattttggctagtcatatggtagattcttattaaatacagtttgtataaatatgttagttgaacagtattttaagttaggagtagaggtggactgcctttcattttatacttgaatgaaattatgattgaaactctggatcaatcaggaaacgtgtctgccaccatttataaggttgttaatagtcacgtgtacaatatcaagtctacccttcttcactacatactaccttaacccacacccagtccttcaatcccaggacaggtaacaggcaagtgagaaatctatgttatgctttgtgtaaatatttgtctagctagatattttggtagtttggtcattacgtttaacctaattgccctgactttaagttatgttttgtctagttagaagtattgttagattaattgcttaactatgatagggaatgaattgaccttaaaagtttgtttagtcattcattcaacaaatactacactcctccatgtgccaggcactgttctagattctgctgaccagcaatttgactagtttgcttattttcctcattatgataccattttatagagatgtagctgtactggaatagaaaagatgtgtgaattttttaagtactttgtttggcatgcattgtacaatttactttgtgattttctgcattctatattaggagcttcaatgtttaactataagcctcatcaagaatcaggattggaaacatttgttcccaaatgctgttttaaatatttatttatttttcagcatacaaattataatttaatttatgaaggcttgctagagacctgtaatgatccatagatccccgtttgaactagcagtctctcagaccataatgttttgtctcaggatttaatgatgttatatgtatgtatctagtccgtgaaaatgagcttcatttccttcttattcatatagctgcactcatacttttctattcaagtagctttagtagaataaaaatttggtatatgtgctctcatttgatgatgatgatgatgccactaacagttttgtgagttttcccattagttatggtggtaggtcctgagcaacccaaatgctgcctgaagtactgtgcattcattctcatctgcttgtacaaataaattataaatgataatttatcatctaacatctaaatttataatttaagtatagttattacagaattaaaactatgacttacttcaggaatttagccaactcttttatgaaaatgttttatctctatttttcttgaagatttaaatttttttaaatgtaattcagttacaagtataggatttggtcttaaatatttgattttataattagattatttgaaatactaattagtgtttctgttgcatgttttctggtttcagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcgtaagtacttagtaagaatttttcattatacattacactcttgtgttaggcagaattgttcagtttctaatgtatagaagattttttgcgtattttattaaaatgttttaaatattatgaataaaaaaagacattacttcagaatggtaatgggttaaaattaactcttttaccatttgctaaagaattcccatggttgggccaggcgcagtggctcatgcctataatcccagtgcttttggagtctgaggctggtggatcacctgaggtcaggagttagagaccagcctggccaacatggtgaaaccctgtctctactgaaagtacaaaaattagctgggtgtggtggcacgtgcctgtaatcccagctacttgggaggctgaggcaggagaatcacttgaacccaggaggcggagtttgcagtgagccgagattgtgccactgccctccaagctgggcaacaaagcgagactctgtctcacaaaaaaaaaaaaaaaaaaaagaattcccgtggtaaaggcagggaaatcaaagccaagtggaaagctggccaaagacttacttttttgggtttataatagtaacattgaaaataaaaacttcaatttgatttgctttcctgaattccactttcttaatgtttgctttaaaaactttttttttttttttgagacagagtctccgtctgtcgcccaggctggagtgcagtggtgctatctctgcttactacaacctctgcctcccaggttcaagtgattctccctgcctcagcctcccaagtagctgagattacaggcatctgccaccacacccggctaattttgtatttttagtagagtcggggtttcaccatcttggccaggctggtctccaactcctgacctcaggtaatccacacaccttggcctcccaaagtgctgggattacaggcatgagccgctgcacccagccgaaaaactgttcagcagagactatgaagtgccttattccatcttgatgtgaaacacatattgctggtttaaattcaccgtctgttgttattttcctctgtttaaaaaatatatatctttagatttagattatgtgtttttcatcttgtgcatttaaattttaaaaattatttttccttaagccttttgtaaaggacctttaatcctaaaattgaaccgtaacagcaggaaatatattggtatggggtagatctatgttgtaattatttgtatattggatagttgctaaagactttacttggttttcagttttcttttgaaagccattttaaatagattggtaaaaggttagttggaaaagacattttgagaaatattttgtaaattttttttttttggagagggagtcttgctttgttgcccaagctgcagtggagtggcacgatctcggctcactgcaacctccacctcctgggttcaagcgattctcctccctcagcctcccgagtagcttggattacaggcgcccaccaccgtacctggctaatttttgtattttagtagagacggggtttcactgtgtaggtcaagctggtcttgaactcctgacctcaaatgatccgcccacctcaggctcccaaagtgctgggattacaggcgtgagccaccgtgcctggcctcataaatattttttaacttgtaacttttgaaaattactaaaaaaggggctgggcacgcagtggctcacacctgtaatcccagcactttgggaggccgaggcaggtggatcactaagtcaggagttcaagaccagcctggccaagatggagaaaccctgtctctactaaaaatacaaaaaattagccaggcgtggtggtgggcgcctgtaatccaagctacttgggaggccaaagcagagaattgcttgaagccgggaggtggaggttgcagtgagctgagatcatgccactgcactccagcctgggcaacagagcaagactccatctcaaaaaaaaaaaaaaaaaaagacaattataaaaataaatacatataggccgggcgcagtggctcacgcctgtaatcccagcactttgggaggccgaggcaggcggatcacgaggtcaggagatcgagaccatcctggctgtcatggtgaaaccccgtctctactaaaaatacaaaaaattagccaggcgtggtggcgggcgcctgtagtcccagctactccagaggctgaggcaggagaatggcgtgaacccgggaggcagacttgcagcgagccaagatcgctccactgcactccagcctgggcgacagggcgagacttgtctcaaaaaaaaaaaaataaataaagtaaaataaataaataaatacatatagtagaggaggaaaggaaggaatttactgattataaaaatagtacttattcaatataagaaagttgaaaacaggccaggcgtgctggctcatgcctgtaatcccaatgctttggaaagctgaggcatgcagatcatctgaggccaggactttgagaccagcctggccaacatggcgaaaccccatctctactaaaaatatagaaattagccaggagtggtggtgcatgcctgtagtcccagctacttgagaggttgaggcaggagaatctctggaaccctggaggcagaggctgcagtgagctgagattgcaacattgtgctccagcctgggcaacaagagcgaaactctgtctcaaaaaaaaaaaaaaaagttgaaaacacagggtaaaaaaagctaaaaacatgccctttaaaaactaacttgtggcctggcacagtggcttgtaatcccaacactgggaggctgaggtggacagatctcttgagccaggagttcgagaccaacctaggcaacatagtaagactccgactgtactaaaaatacaaaagtgagctggagtggtggtgcgtgcctgtaatcccagctactcaggaggctgaggcatgagaattacctgaacccaggagggagaggttgtagtgagctgaggtagcgccattgcgctcaggcctgggtgacagagcgagactctgtctcaaaaaaataaaataaaaatataaataaaaaacaacttcctggaaataaccgctattttaatgtgtatcttcccagtcttttttggacaaaattgagaaaatactgtacccactgttttgtaatctgctttttacttaacatatcatgagcatttttcacatatcattcaatgtggtaacatactttttagtggctattattctatccttctggaggcagctactaattttttaaaagtaaaatccattttatctgttttctgaattagctctgtaaagaaagagactaaatgtatttttttattttttttttttttttaaaaaaaaggtctctggccaggtatggttgctcatgcctgtaatcccagcactttgggaggccagggtgggtggatcacttgaggacaggagttcaagaccggcctggccaacatggtgtaaccccatctttactaaaaatacaaaaaatagttgggcatggtggcggccacctgtaatcccagctactcaggaggctgaggcaggagaatcccttgaaccccaggagacagaggttgcagtgagccgagatcacgccactgcactccagcctgggtgacagtgagactccatctcaaaaaaaaagatctcttataagccattatttatgttcagattttaaaatagtgattttattttttttactttttattattataaacaaaagattgacaggattaggaacagtggtgaatgtttagaatttacccttttgtactttttgaacttggaactttgtaactttattacatattcacagaattaatagataagcaaaattttaaaaacaaacttgttgattaagaacattatactatttatacaacaaaatgtccctttatatattttttttctgtattagggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtagtaagtaagaagatacggagatactaaacatatggagtttctttcattttctgttaatcttttagacatctctaaattttagatatttcatatgctccggcttgtgatcatgcaaaatttgaaatattttaaaagcagtagtcagattttctagaccaaactagaggtgaatacttgggatacaattcaaaagatgtggaacattttgtagtttcctattatcataatatgctgatttaaaaagtaatttggaccagacagggtggctcccagcactttgggaggccaaggtgggaggatcacttcagcccaggagtttaagaccagcctgggcaatgtagtgaaaatcctgtctctacaaaataaaaaaatatatataataagttgggtgtgatggcttgtgcctgtagtttcagctactcaggaaggtgaggcaagaggatcacttgagccctaggaggtcaaggctgcagtgagccttgagcgtgccactgcacgccagcctgggcagcagactgcgactgtctcaaaaaaaaagaaagtaatttgagctggttatcagaagtaaattacaaagcgaaagcattttctaagcatcttcactgtgtggtaaattactgtggttctaactgttttgtgttagaacatgagtaaggtaagcagaactttgcaaataacaacatgtcagaagtttcaattattaattataatattatagtatagtgttgggagtgggaaattcaattcttatcactaaccttgacatggatagaaaatgatgtgtgcgtgtttgtgtgtgtaaattcaattatgttgttatatatgtctcaccataattgtagtttctctctaatgattattgttataggtaataaataggaaaaattttccttttcacgtctctctctctcttttttttttcttttttgagatggagtttcgcttgttgcccaggctggagtgcaatggtgtgatctctgcttacagcaacctccacctcccaggctcaagcgattctcctgcctcagcctcccgagtagctgggattacaggtgtgtgccactagcacctggctaatttttgtatttttagtagaggtggggtttcaccctgttggccaggctggtcttgaactcctgacctcaaatgatctgcccactcctcccagcaccccccaccaccctttttttttttttttttgttagattgtggctcatgcctgtaataccagcactttgagaggccaaggcaggaggacaggagtttgagaccagccgaggctggtctctcttcctgtttccttctgtctcccattccaatcccagctcttcttactaaccaactttgttttcacctctcattttactccagctgtttaaacctgccaaaaagtttgtattcatggaaactaacataagccagaaacttataatggaagtgtattgaacaacataatgagagaacctgtctttacaaaaattaaaaaaaaaaaaaaaagccaggcatggtggcatgtgcctgtagtcccagctactcaggaggctgaggcagaaggatcacttgagcccaggagttttgagatagcagtgagctatgatcacaccactgcactccagcctgtataagagacccagtctcttaaaaaaaaaaaaaaaaaaaaaaaaaaaaggaaattgttcagatgagtgctttttgtttttaatttttattgtgttctgataacaaaatatgcctcattgctcattcagtcactcatttagtcaacataaattaaatgcagttgttctcaatcctgggtgtaggttcgagtcacctgtagtgctttaaaacaaacaaaaaggcatgccaattgatgatttgtttttggaaaacttcatagttaattcaatggatagttacagtgtgcctaactctgaaattaaagattatagtttaaggagcttacagtttagcaggctggggaaaaaacaggcaagtaaatgtctaattttatagtaaaattatattaacttccatatatgtgtatataaaattgtatataggccaggcgtgggagctcacacctataatcggagcactttgggaggccaaggcagggggattgcttgagcccaggagtttcagattagcttgggcaacaaagcaagaccctgtctctatttttttaattgcatataaaaattatataagcttccaattgtattataaagttatataaagatactatactgcacagtagctgtgtgaataaagtacagtggaaacatagtaagagcatctaattcagactgctcagagatggtagaacttgttctgtcttgtcttaaaacacaaatagaagtaaaacaagtaaaatgggatttacttgaaaaattttcatatctacccttctgtagtaattctgggcagagggattcatgtataaatatgctccctggaaggatatgattcttttgggggaaataaaaagagttttatgtgattggaataaaaagatatacattatgaagtggtaagatttgaggttacagaggtagacaacacctctttcttttttttttttttttttttttttgagacggagtctcgctctgttgcccaggctgaagtgcagtggcatcatgatctctgctcactgcaagctccacctcccgggttcccgccattctcctgcctcagcctcccgagtagctgggactacaggcacccgccaccacgcccggctaattttttgtattttttagtagagacggggtttcaccgtgttagccaggatggtctcgatctcctgagctcgtgatctgcctgcctcggcctcccaaagtgctggggttacaggcgtgagccactgcgcccggccgacaacacctctttcataaagagacttgtgtattcagcaaaataatttgaattttatcctgaccacttaggaagcttgatgcttgaacttgcgactttgagggctggatatgggaggaaaagaagaataaacataaaaatgatctacagtaaaacacaggacccaaaaaatctttttatttaaaaaaattaaaatgtttgttccattataagtttctggcttgtatttctttccgtgaatataaactttttggcagctttaagcagttgcagtaaaatgagaggtaaaaaggaaattggttagtgcaaagagttgggattggaatgggagatagaaggaaacaggaagagagagaggtagaaaaggaaaggggccaaaaggtgacagagttggaagggagaagaggaaacagatacttgatcttccttctatagatactcagtggaaagaatttctaatatcaggattcatgcagtgccttgtggctttaaaaaaattacttctaattattggtttaacaatggccattggatcctttgtctttttgtttttaaggggatagaagatcatccctttttacattcttaacatctttcatgttctccagacaatataggtgtatatgttttttgttttggtatgtatgtttatattattttgttatgttatatcaaattaagaatattaattttcagctaggtgcagtggcacgcacctgtagtcccagctacttgggaggctgaggaaggagaatcacttgagcccaggagtttgaatccagcctgggattcaaacccatctctttaaaaaaaaaaaaaaaaaaaaaaaggccaggtgcagttgtacacgcctgtaataccagcactttgggagggcgaggtaggaagattgcttgaagccaggagttggaaaccagcctggacaacatagcaagagtccatctccacacacaaaaaaaatgttttaagttagctgggcgtggtggcatgtccctgtagacccagctacttgagagactatgatgggaggattatttgagcccaagagttcaaggatacagtgagctatggtggcaccactgcactccagcctgggcaacagagtgaggtcttattgatctgtccttaaaaaagaaaaaagaaaaaattttcatatctacccttctgtagtagtttttaataggacaaaattaatcatggctttcttacatgtaatatatattagattttatcttatggttactcaattaaatatgactctgaatttaagaattttctacttcccctatttctacctatcccacagctatggggaaaggatggtattgttaagcaaactatccctctcttaaaattttggataggattagtaatttacatagtcagatgtaggctttatactctaaaatattctgttaactatgttgttctactagacattattacaaagctttattctcttgacaggttgaaatatttgcttacttatttttcagtattcagatattcattatttttttcaactttatttatttatttattttttgagacggagtctcactctgtcacccaggctggagtgcagtggcgatcccggctcactgcaagctccacctccggggttcacaccattctcctgcctcagcctcccgagtagctgggactacaggtgcccattaccacgcctggctaatttttggtattttttagtagagacggggtttcaccgtgttagccaggatggtctcaatctcctgacctcgtgatccgcctgcctcggcctctcagggtgctgggattacaggtgtgagccaccgcacccggcctcaactttatttttcagactgctagttgaaaagcatctaaaagcacacagtttttacaataccaaaaaggtgattttttgtgtgttctaatttttaagcattattcctttcaagtaatttttaagcattattcctttcaagagtcagcttataaataacttggtcgggcgcagtggctcacgcctgtaatcccagcactttgggaggccaaggtgggcccattacctgaggtcaggagattgagaccagcctgagcaacatggagaaaacccatctctgctaaaaatacaaagttagccgggcttggtggtgcatacctgtaatcccagctactcgggaggatgaggcaagagaattgcttgaacctgggaggtggaggttgcggttagccaagactgcgccactgcactccagcctgggcaacaagaacaaaactccgtctcaaataaatagataaataagtaaataacttaaaaataaaacagttaatgcttaagtaatcttgactttagttgtgtttagtatggcgtctgttggggactcatctcgtaaactttaaagaaaggaccttttaaaaggccagaagttaaattatcttgaatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaagccactgctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaaccaaagccaaaattgacaaatgggatctaattaaacggaagagcttctgcacagcaaaagaaactaccatcagagtgaacaggcaacctacaaaatgggagaaaattttcgcaacctactcatctgacaaagggctaatatccagaatctacaatgaactcaaacagatttacaagaaaaaaacaaacaaccccatcaacaagtgggcgaaggacatgaacagacacttctcaaaagaagacatttatgcaggaaaaaaaacacatgaaaaaatgctcaccatcactggccatcagagaaatacaaatcaaaaccacaatgagataccatctcacaccagttagaatggcaatcattaaaaagtcaggaaacagcaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagatacatgcacacatatgtttattgcagcactattcacaatagcaaagacttggaaccaacccagatgtccaacaatgatagactggattaagaaaatgtggcacatatacaccatggaatactatgcagccataaaaaatgatgagttcatgtcctttgtagggacatggatgaaactggaaatcatcactctcagtaaactatcgcaagaacaaaaaaccaaacactgcatattctcactcataggtgggaattgaacaatgagaacacatggacacaggaaggggaacatcacactctggggacggttgtggggtggggggaggggggagggatagcactgggagatatacctaatgctagatgacgagttagtgggtgcagcacaccagcatggcacatgtatacatatgtaactaacctgcacattgtgcacatgtaccctaaaacttaaaagtataataataatacatttaaaaaaaaaactttacaagaatagtaaattttaagtaacaaaactgtataatatgtgggatctcttttgcataattgtataatgtcaagattcaatatacttcttttctgacttgtactgtataacttgtgaataaagcaggtcatttttgcagaaactaaaaaaaaaaaaaaaagaaagtaaccgactagttctttctgtaatgtaaatacgaatatgtagaagataaatatattctaaaccttggggcctcatttggctgtcttatgcctttaacaaataaatttaaaaaatgagatatgggaaaaagttttatcagtaatcagtgaagtggaatttccacacagtatttgaaaatggagggaaaggttatatgctttacgtttcattttggtaatacaatatattaatgtaattttaacaagatataccatatgtttctggaatgtttttaaaaacaagtatctatttcctgttactccaaaaagttacctttgaataaactgatttagttaattcttcatttaaaagggtatatcattgtcagtgtatgaccaataaccctttccattctgttcacacatttaccctataggttctagacaatacttattttttgtttttttgttttttgtttgtttctttttttagacaaggtttcacttttgtttaccaggctggggtgcagtggcgtgatctcgggtcactgcaacctctgcctcctgggttcaaccgattctcctgcctcagcctcccgagtagctgggattacaagcatgtgccagcacacccagctaattttttgtatttttagtaaagatggggtttcaccatgttggccaggctgaccaacttgaactcctgacctcctcgaactcctgacctcaggtgatctgcccctctcggtctcccaaagtattgggattacaggcgtgagccacctcacccggccagtgtatttgtttatacattaacaatttctattaaactccccagcattgttgaaaatgtcatttatcatatacaaacaggttaaatatctcttatcttaaatgcttaggacccgaagtgtttcaggttttgaatttctttggactttgaatttctttgcatatacataatgaggtttcatgggaatggtacccaagtgtaaacacagaattcatttgtgtttcatgtacagctatacacatagcttgaaggtaattttacataatattttaaataattttgtgcatcagagtttcaaaaagcaaaggtgtcactgtttcagccacctttgtaaataatctttgtaaataacctgttgggcatcaccatcattcctgactctgaatttatttttatttttatttttttttgagacgaagtcttgctgtgtcacccaggctggagtgcagtggcacgatcttggctcacagcaacctccacctcccaggttcaagagattctcctgcctcagcctcccaagtagctgggattacaagcacccaccaccacgcccagctaattttttgtatttttagtagaaacagggtttcacccgactctgaatttatatgctaccaataagcaatccttttcttatatttcttcacacgtaagtacttaacaccggtgcagtcatgactcactgcagcctcaacctctggggtttaagtgatcctcccactccagcctcctaagtagctgggaattgcatgtgcatactaccacgcccagctaatttttttgatttttttgtagagacaaggtctcactattgcccaggctggtcttgaactcctgggctcaagtgatccttcaaccttagcctcccaaagtgctgggattacaggtgtgaaccactgcacccagcccaggtgtgtaaatttttgagcattgtattggcactcaaaaagttttggattttggagcatttaagattttagatttttggctgggcatggtggctcatgcctgaatcccagcattttgggaggccaaggtgggtggatcacaaggttcgagaccagcctgaccaacatggtgaaaccccgtctctactaaaaatacaaaaattagctgggcgtggtagtgtgcatctgtaatctcagctactgaggaggctgaggcaggagaatcacttgagcccaggaggcagaggttgcggtgagctgagatcacacctctgcattctagcctgggcgacagagtgagactcagtctcaaaaaaaaaagattttagatttttggattagggatgctcaacctgtatttaacaaagacaggatacttgtttgtatcaatagctgaaggctaaatgatactgcaataacacacaatttaaaagaagacaacaaaacaaaactcagtggcttacaacaactgagttggtaaaaccatgtgatggctctcaaaactttcacttggacttggcacattacttcagttcatatttgattatccaaaccagtcacatgaccaagcctgtcagtagagcaagaattatagcctttccagataattgtgtaactataaaaatatttattactcctccttcaataaagacaactcatagaaccggatgattgcaagttgattttaggtaagaaataagttttggtggttcttcttatagaatgcttatgtatctccacagctcagccagcaggagtgccagaaatcttaaagaaaagcttgcatagctgttcagtgaaaggagaagaagaagtgtttttaatcggcaagaactttctgaaaggaactaaagttattttccaagaaaatgtttctggtaagtacgcatatttgtggtacagatatttgtatgttttcactttgttatatggatatagtcatagctacagagtaaaaaaaatagttcaaaaatttaataaatcactttttatttcaatcagatgaaaactcttggaagtcagaagctgaaattgatatggaactatttcatcaggtaaaatttaagctttttttataatttggttatttactctctgagcaattcagttttgttttgaaattttcctgaatcaatagattaaatttcttcttcctatgggattgatatgaattatttaaagtttctttcttgagtttctttaactgaaatagaattattttcctaatggtaaacatgaccacctctattttaaaaagttaggatcattaacaaatgtttccattgttaataaacaaaatctttctttcctgatacttattttctctgaggatttgcataatcttaatccactatatagttaaataaaagggaaaccaatatttattgagaatctgttatgtttcaggtactttatatttgttaaaccttcttgtgtttagaagcactcatcacactgatattagtctgtatttgcaggacctcaccatgtattgtttcccaaataacaatgaaaacttgaaaacaaggatcaagacctgacttaggaattcgtatttagagcagacaggaccaaacccctagaaattgagactaacagaaggccaaatttataagcaagttagaaggcacatggagaagaggtagtatgtacaggtgtagaactgagacagagagagaagagagaaacaggaacaagctaatgtgtaaattacccaaagcctaaaatttagtgtaagctgatggggaaagaaaagagcacatgacagaaggtagagaaatagaagatgcaaaaattagacaatctatagccactttatccaaaaagtttataatttccttgttgttttaaaatttattttttattcctttgtgtatttttaaaaacctaataaaatttaaaacatatatccaatatattgccacactcaaggctcagggcacagccaagactgttgccacttcatacaccagacacaagttcaaaggtccccaggccaccctctttttttgaacgagtggctcaaacagtatttttcctactgtccccttggatttgataacttcctagaaaaattcacagaactctgggaagtgctatacttagtgcctgtagtttttttgtttgtttgtttttgttttgttgttgttgttcttttaagacagtcttgctctgtcgccaggctggcatacagtggcgcgatttcagctcactgcaacctctgactccctggttcaagcaattctcctgtctcagcctcctgagtaactgggactacaggcatgtgccaccatgtccagctaatttttgtatttttagaagagacggggtttcaccatgttggccaggatggcctccatctcctgacctcatgatctgcccgccttggcctcccaaagtgctgggattacaggtgtgaaccactgtgcctggcctagtgcctatagttttacaacaaaaggacagaaatcagaatcagctaaagggagagatgcataacacaaggtctcggagtgtcccaggcactaaccttctgtcatcctcaggaagacattaccatcttggcatagcaatgtgtgatgataacaatatgcagagaattaccaagcagggaagctcacccaagcctttggtgtccagagttattatttcagacctgattatatactgcccatgcagctacctttggtcttcacttccacaaggttagaattgatatggtgtgttccaaagcctctgttataaatcacattgttagactatccagcgaccaaagctctcaagtaaatatcactgtcacacaagacattgcaggaacctagagattacctcctagcagccagaggtaaagaccagaactctctctgggtaaagttaattatttcctagacaatatcgtatagtgtggagattcctatatatctagacaaatgctatgtggcaagttttcctctggccttatgcaactacatgttgtggaaaagagataatgggacttaacaaacattcctttgtcacacagaccattgggcaatatctcctagggtttatagtcagactagtcttaattgaagttttaatacctgctttgtcattagcaatctgtgttaactaagtaagacaaatgacttttgtgctccagttttctgatctgtaagataagcgctttcattagattatttgagactcctctgactctaacattttattatttcttatattatttgatcagaccatctccactcccatgaaccaacaatagcttcctctggagtactcctggaggttagaggcaatgtattataattcttctgtgttccttgtaataccaaacacttaatagatacacaagaaaaacttattagttcattttattcaccttgaagaaaaaaatgggtgactgtgtggtctaagtaaggttcatttgttctttccgaggatacttcaaaccctaatttcagccaggtctttaaatacctagagttgtaatcctaactgaaacttaatttattcatgcagtacttttgtatgctatgaacatgttttgtttcttgacaaattagttagattaatgtagactcccttgcttgtaatgctctattatgattgttattcttatgataaagattgatagataaggagactatttctggagattgagagacttgccttataaattatacaaaatatcaatgacatagccccaacaaattgtagtattaacttgctattttgtatagaactttatattcataagttatcctccctccctacctccatttttctttctctctctctctcttgccttttgaggcatggggtagttatatttttaaaacactttttttcagggcagttatgccagctacagtaggttaaagaataataatcataaaaataagacacgtggtggaatggaaaggaattatatccttatttggtgactatatctagaggtcctggggtttttgcaagcaagtatgtaaacaaactaaatcataatataatctgtcattaattctgtggttttgttcatttttatctttttcagagagaggttttattttattttttttctaaaggggttttcttggaagccttttctttgagtggaatcagagctgagatcctagagaattgattctagagattatataaaggaagaaaacccacaaagcaaacctttagggggaagaaaatgtgttgagactgggcatagtgactcatacctataatcccagcactttgggaggtagaggcaggaggattgcttgaagctgggagtttaagaccagcctgggcaacatagtgagatcccatctctacaaaaaatttaaaatatagccagtcatggtggcacatgcatatagttccagctacttgggaggctgaggtcagagaatcacttgagcccaggaagttgaggctgcagtgagccctgattccgccactgcacttccacgtgggtgacagtgagaccctgtctcaaacaaaaaaaaaagacaacacactttggatgtgatcagtaaagaaatattaggcctacacaaaaaaagttgaaagggaatctctacaatatttaaaaatacccagcagatggtatagtagaaaagaccatttaaagataatttcacaaattgcagttgtgaaagattgtaatagctgttcagttgcaaacccaaaatcaattcatcaggtattacactttttctatcatattataaatattgccaggcgtgtggctcatgcctataatcccagcagtttgggaggccgaggcaggtgaatcacctgaggtcaggagttcgcgaccagcctagacaatatggcaaaaccccatctctactaaaaatacaaaaatttgctgggtgtggtggcatatgcctgtaatcccagctacttaggaggctgaggcaagaaaatcacttgaacccaggaggcggaggttgcagtgagctgagatcacgccattgcactccagcctgggcaacaagagtgaaactgtctcaaaaaaaaaaaaaaaaaaaaagtaatacggtattataaatattgagactaatgaagtctggaaaaacaattctttgttcaattgttttctggtcttctggtccatagtatacctcatgctcatgtataccaaatatgatgggtacatgatcattcattatgtctattcccttttaacaactgtagatgagttatatataacattaattacctattaaaaatatatataaagggatattcaatctatatatacaaatatacataaaaggatagctcaggggaagatggtataaatgtggaaagaaaattcttgaaagaagtacaaaaaaaagatcctcagaagaatttgtgggaagaactagactaaacaaagacttgaaagcttagagttatgtttttcaaatcagttctaagagtaattttgtaatgggtctttggtcaagtctaattgtagatattctaattatgtaggtattctgattatatatattcccaactgtaaaattaatgtgacaaaataaaaagtatctcatagaagagtgaaagatatctagcaccattgctggtacactctgaaaaagattatctgctagggaaaaagttatttgaatctaagcagatttttctaagaagttaaaattcaattgttttcctctttttatcccaaagagcattatacctgctcccaaagcctcccaaccctttgtatgttttgtatgtactgtatccctagctcagtgatagttaattgtttctaatttatgagagggtattaaaaatagcttttgatcactagtgacagtttacctaatttttaattcagatcagttgtagaatttctagattcagattgaggaagtttgaagaattagtagcaaaataggttcatttggtttttaaaaggtttcaaaattagttttacttaaatgtgctctccaaagcaagtagagtaaaagtattttgataaaatatgcatctgatttgtagacactagtcctgttactaattgccaagaaacaagtttttattcaaaagaatagtttgaattatggagtttgccaaacaattttaagagtgagagctctcacaagctgttcattcaaccatctccttaactctagatagactgtttctgtgacatagttgtagtgtttaaacaacagagtaaaaatgaggtagacaagattcagtaactctgtttcttagaagttagatcaataccagtgcgttttttatgaccttgtatgtgttcagatttagctcctgccttataactgtggatgtatgcatatttgtacatgtttttccacctagttgaaaagaatgtggtttttttgagatggccaacttaggaggcattctgttaatgccgtaaattagaagctagttttttgtttttttgttttttttgttttggagacagagttacgctcttgttgcccaggctggagtgcaatgacgcgctcttggctcacctcaacctccgccccccgggttcaagcgattcttctgcctcagcctcctgagtagctgggattacaggcatgtgccaccagggctggctaattttttgtatttttagtagaaacagggtttcaccatgttaaccaggctgttctcaagctcctgacctcaggtgatctgcccacctcggcctcccaaagtgttgggattacaggcgtaagccaccatgcctggcctagttctttatttataatgtgactgtatttcagagagtgttttaagatggctcagaaacaaattaaattctcagaaatggaaaccttgaccttgatctcatttgtcccatattttctattcaactgagtcaacgaactatgtagtctaactaaattttaaatgtcatcaaactcacgtcaccctcagctgtcagcttcggcctcctgcaaatcagatcattagtgaaaaagcataatcactaccctgtgatatcccctaccattataataatctactagggaagaagaaaaaaaagtcaaatatggctcatattaccctctaagaagatatagtacccttgagtaagtactggtgaaacttttatgaactctgcctttctcttataaggatgcttctgccactgttccaactaaaaacatctttggtttactgagatgtggataaactgaacccaatttgacttaaaatgagaattatgttgttaggagtagcgaactgcattgtgaaatacatctcacattgaggttgtacagaatgtatggtaactgactttgcccttggtgggcatattttttttctaataatttattcattcttttattcaatatgtaccttatgtaaggtactattctttacaagtgagacagagtgaagaacaaaacagcctagatcctcatggagcttacattcttatgtttggagaaagaccaaaaaacaagcaaatagggtaatttgcaggggtgaggataagtgctgttatggaaataaacaagattatgttataaggttggggaagggttttgctttaaataggatgatcagggaaggcttctttgaggtgacatttgtatctgacctgataatgggttaggaactcaccatttgaggaggtgaaggaataatattgcaattgaagagaataacaagtatagagaatctgaggtaaaactgagtttagtatgttaaaagaagggaccgaggtcagtgtggctacagtgtagtgagctagaagagcaggaatgagatgaagttgacagggcagggatcttgaccttgtaagccattataaaacacttggattttaccttaaaagcagtgttaagattaatatcctgatgcctgtgaacctgagctttaaaatgcattcttttttttttaatcactttttaaactttacagctaacaggaaatatacttcatttaaaatttttaaatttaagtattgcttcttttccaactcttgtgcttttctttacattagaatcatcttattgtgaaggttcctccctatcatgaccaacatataactttgcctgtgtcagtgggaatatatgtagtgacaaatgctggaagatctcatgatgttcaaccattcacttacactccagacccaggtatgtcaaaatgaaaaattcagaactaaaacaaataattaatttccagttttttgaaagaatatgaagatgactagccaaccaaaaagaaagttgctcactaagatgaattgatgttagtttcttttggaaatgacattattttctaagaggacagccgccagatactgcttttactcttatattaaggaatcatttctaccttatgctataataataaaaggcagcaatgctctgaagtcagattctctgaagctatctgacaggttactcctccataagaatttccatgcattgactaccgcttatgtgcagaaacctgaaagtgacaactttgggaaattgctaatagtttagtttggctggtttatagggtacattttgagagagagaagagataaactagagtgacaggtgataaaataaaaaatcccaaagactgatggtgaataaatatttttttctttctatattgccccataatacctgataaatattttaaataaaactttggttgggttaaaacgatattttaggctgggtgcggtgatgcacacctgtaatctcagcactttgggaggccgaggcgggtggatcacctgaggtcaggggtttgagatgaggctggccaacatgttgaaaccttgtctctactaaaaatacaaaaaaaaaattagctgggtgtggtgatgggtgcttgtaatcccagctactggggaggctgaggaaggagaattgcctgaacctgggaggtacaggttgcagtgagctgagattgtgccattgcactccagcctgggcgatagagcgagactgtctcaaagacagaaaacaaaacaaaaacctgatattttagaaatgagaggaactaaattttttttttttgcatgtgagtgggagacggagtctcgctgtgtcgcccaggctggagtgcaatggcgcgatcttggctcactgcaacctccacctcctgggttcaagctattctcctgcctcagcctcccgagtagctgggactacgggtgtacaccaccacgcccagctaatttttgttttttcagtagagacgaggtttcaccatgttagccaggctggtctcaaattcctgaccttgtgatccacctgcctcggcctcccaaagtgctgggattacaggcatgagccaccacgtccgaccctaaaatgttcaaagtttagaagatacctatttatgaagtgtctcacaagttatttgcctgcattcatttagatgcctgaaaaaagcaaaaagcctccttttggcagaaatggggagaacattttggaaatggaaactctttgcatgctccattgacctaggcttggcttctgccatgtttaccattggttcagttcagtccagtctcaagcatacttcagaattagcagttcttctctatctgtagtttattagtatgttatttccatatagttcaagatccagtgaggtagaaggtaaagaatggggcaaagaaagaaagccctggcatcaaaaagtgaagaaaacagtagctaggacagaataacaactaatttaagttaattgctttctgtcacttaatttttctattcactattctcttttcttttcttttctttttgagatggagtcttgtgttgcccaggctggggtgcagtagcgtgatcctgggtcattgcaacctctgcctcccaggttcaagcgattttcctacctcagcctctcatgagtagctggcactacaggcatgcaccaccatacatggctaatttttgttagtagagacagggttttgccatgttggccaggctggtctcaaactcctgacctcaggtgatctgcccgcctcggcctcccaaagtgctgggattacaggcgtgagccaccactcccagcctcatattttattcttaatcgtatctgaattttgcaacattattttctactaatttgttacaaaaggtatgccacagtacagcactgttaaaataccccttgaaggcctggcatggtggctcacacctgtaatcctagcacattgggaggccgaggtgggcgaatcacttaaggccaggaattcaaaaccagcctggccaacatggtgaaacccctctctactaaaaatacaaaaattagccaggcgtggtggtgggcacctgtttacccagctacgtgggaggctgagacaggagaatctcttgaacccgggaggtggaggttgcagtgagccaagatcacaccactatactctagcctgggaaacagagtgagactttgtcaataaataaataaataaataaccttgatatttgtctcagaattaaagatcatgtgtgaaaacattggaccaaaaaggcaaagtttagaaataacatcctggcttcaacaaaaataggagaaagaagattggcttattctcaaagaccaaatattttattgtttcctttctaggaaggcttaaaacatctaaggaaatttgatataaaattaataatagttggctgggcatggtggctcacgcctgtaatccccgccagcacttcgggaggccaaggcaggtggattacaaggtcaggagatcaggaccatcctggctaacacggtgaaacccatctctactaaaaatacaaaaaaattagccgggcgcggtggtgggcacctgtagtcccagctactcaggaggctgaggcaggagaatggcatgaacctgggaggcagagcttgcagtgagctgagattgcgccagtgtactccagcctgggcgacagagcaagactccatctcaaaagaaaaaggaaagaaaattaatgatagttaaagcattttagtaactgatagttactaaatattgacatttaatgtttggcaggagcttgcacaaacatgagaagaaagatggtataattaatacataggatttgtttcctgatgagcttctgcatcagttgtgttggaagggaaaggaatttatgtcaggaaatagccttaaaggttttgctatcctgaaaacactgagattttcttgtcttcacttgtttctttgtttttattgatatgagacttcaggactttgaagtacttagcatcaacactaagaatcatcatttcttagtgataaatgctaattattagaaattggcctttgataaattgctgaacaaacaacttttaagtattctacttcaaaggctatactaattgcctaattttggccattcttaggcaatcattactgtatgtttgctctttcaagttttcccccagcatattttgtatgttacagatagcaatcactcttagaaaaccttgtttgaataaatataaggtatgcaaactttgtaatacaatctaatgtcttagcttctgcctctatgatacagctaattagtcttcctgcaattttcatttttttgtttttttgtttttattttgttttgtttttttgagatgaattcttgctctgtcacccaggctggagtacagtggcgtgatctcggctcactgcaacctccacctcccaggttcaggcaattctcctgccacagcctccgaagtagctgggactacaggtgcccaccaccacacctggctaatttttgtatttttagtagagacggggtttcaccatgttggccaggctggtctctaactcctgacctcaagtgatccgcccgcctcagcctcccaaagtgttgggattacaggcatgagccacagttgtacttttttgtattttatgaaatgtaataatcttttcaagtgtccatgagaagtgtcttggaagccatgagagagaatatgatttcaggaaaacttgggcacagagaatttggcctatctcagtatgacaaactaatagctgttgtgattcatttagggactgttgttaaatatttgattactcgatagtgtattattatagcagccaaaacaaggtccatcctaatatttacgggttggagtagaagtggtgactgttaatactattagttgaaatacttaaaagttataaataaaactaacaaatcattaagtgaaatacctcctatcttactttgaccaaaataccctcataacaacctgaaaggctaaatttgaatttagaattttcaaactgctttgagttctaagctgggctatggtagcatgaggagagagcatccctgcctgccacccttcttttgccactttttggctccatcctatacttggaagcctttgataccttaatcagtgtttccacctaatatgcctaagagtgctcacaaaatctaggatagttgtacagaaaatctagggattggccgggcacggtggctcacgcctgtaatcccagcactttgggaggccgaggtgggcggatcatgaggtcaggagatcgagaccatcctggctaacacagtgaaaccccgtctctactaaaaaatacaaaaaattagccaggtgtggtggcaagtgcctgtagtcccagctacccaggaggctgaggcaggagaatggcatgaacccgggaggcagagcttgcagtaagctgagatcgcgccactgtactccagcctgggcaacagagcaagactccatctgaaaaaaaaaaaaaaaaagaaagaaaagaaaatctagggatcctgggtgcctgttacatggtctaaaggtagggtcaaggcaaaggctcaagtgaacatgtcctggttccacacattcttccaggtacagaccttctaacatcccatggggccatactgccccaaatcaaaatgtgtattctctcaggcacttagatacttttcagagtcataaaacctttgtattattgatagtctctgaagctttgcttagccattaaaacattttaattttttttttttttttacttcagcctattcagacacaaaaatcacacattatttgctgtaactccacagtggtgatttctataagaaatgggaatgtaatatttaacattttttttttttttctaaaaaagaaattactggctgggtgaggtggctcacatatgtggtcctgacacttcaggaggccaaggcaagaggatcacttgagcccaggagtttgagaccagcctgggcgatatagtgagacccccccccccgccatccctacaaagaaaaaataatactaagctgagcttggtggcatgcacctgtagtcccagctacttgggaggctgaggtgagagatcgcttgagcctgagagattgaggctccagtaagccgtgatcatgccaatgtactccagcctggacaacagagcaagaccctgtctcaaaaaaataataagaagaatttaaaaataactcataacatgatttataagtagaaatttaaatttttttcaaggattagcttatatttttaaatcttttattactagaattaatgtcatgcataaatatgtgtgttttttttccattcagttgcctataaatcatttgttggacctactgtgaagcatactaagataaattatttaacttcattctcaggagatgtgtacagatttccctctttatttttgttataactatcatttgacatgttagaaaatataaaataaatatattgaaaaatagaaattggctgggcgtggtggctcacgcatagaatcccagcactttgggagaccgaggtgggcagatcacctgaggtcagaagttagagaccagcctgaccaacatggagaaaccccatctctactaaaaatacaaaattaacagggtgcggtggggcatgcctgtaatcccagctactggggaggctaaggcaggagaatcgcttgaacccaggaggcggaggttgcagtgagctgagatcgcgccactgcactccagcctgggcaacaagagcgaaactccgtctcaaaagaaaaaaagaagaaaaaagaaaagtagaaattaaggccaagcacggtggttcatgcctgtaatcccagcagttagggtgtctgaggtgggcagattgcttgtgctcagcagtttgagaccaacctgggcaacatggcgaaacaccatttctaccaaaaatataaaaattagactggcgtggtggcgtgtgcctgtagttccagctactcaggaggctgaggtgggtgatggcttgagcttgggaggtggaagttgcagtgagccgttatcacgccactgcacttcagcctgggtgacagagccccagaccctgtctcaaaggaagaaaatatatatgtatattcaaataaaatatataatcatttgaagcaagaacgaatttatttgtaatttattaaactttattttttagaactgatttatatttaggcccattaaatttatagtttaaatttgttacagtaggctgggcactcaagcctgtaatcccagcactttgggaggccaaggcgggcagatcacttaaagtcaaaagtttgagacccagcttggccagcacggtgaaaccccatctctactaaaaatacaaaaattagcctggcagccagtgcggtggctcacgcctataatcccagcactttgggaagccaaggtgggcagattacctgaggtcaggagtttgagaccagcctggccaacatggtgaaaccccatctgtactgaaaatacaaaaattacccaggtatgatggtgtgcgcctgtagtcccagctacttgggaggctgaggcacgagaatcccttaaacccgggaggtggaggttgcagtgagtcaagactgcgccattgcactccagcctgggtaacaagagcgaaactccgtctcaaataaataaatagcctggcatggtggcgtgcacctgaaatcccagctactcaagaggctgaggcaggagaatcacttgaacctgggaggtggaggttgcagtgagccaggatcataccactgcactcctcctgggcgacctagcgagactgcctcaaaaaaaaaaaaaaaaaaaaattggctgggcacggtggctcacacctgtaatcccagcaatttgggaggccgaggcgggtgaatcacgaggtcaggagttcaagaccagcctggccaagatggtgaaaccttgtctctactaaaaatacaaaaaaattagctgggagtggtggcaggcgcctgtaatcccagctactcgggaggctgaggcagagaattgcttgaacccaggaggtggaggttgcagtgagccgagatcacgccactgcactccagcctgggcaacagagcgagactctgtcgcaaaaaaaaagatggggtttcaccatgttggtcagggtggtcttgaactcctgacctcaagtgatcacccgccttggcttcccaaagtgctgggattacagacgtgagccactacacatggcctggtattgttttgctaagtgatcacatgctccgcccacttggagattggagaatttagaggatagaaatttacctcaactagaatttctgctaaataaataattaaatgatactttgtgacaagatattctaattaaagaatttaagatacgaggtttttaggatgagtaaatgtagataaatacattaatcttttttttaatagcagcagctggtgctttgaatgtaaatgtgaagaaggaaatatctagtccagcaagaccttgctcttttgaagaggccatgaaaggtaccaagtaaattcttctcaaaaatcgtaattgggtgctcctgtatgttttctctagcacaccttactattttgttttctcttaggtacttataatactttgcagggtatcttcatattgtaaaataaatatgtgtttaactttactaaatgtagagacttgttttccaatttgatatttttcttgctgaatatgtttttatatatatatatatatatatttttttttttaagtatattggagtggaggagttttgtttttttttttaattacccaatattaaaagtatatgaggctgggcacagtggttcatgcctgtaatgccagcactttgggaggccgagtcaggtagatcatttgaggtcaggacttcaagacctgcctggccaacatggtgaaaccctgtctctactgaaaatacaaaaattagccaggggtggtggcaggtgcccgtagtcccagctgctcgggaggctgagtcaggagaatctctttaatctgggaggcaggggttgcagtgagccaaggtcatgccactgtactccagcctgggcgacagagcgagaccctgtcttaaaaaaaaaaaaaaagtgaaataaggccaggcacggtgggtcacacctatagtcccagcactttcagaggccaaggtaggaagattacttgagtccagaaatttgagatgataaatatccattggctaataattaaatgcatcatctatagttattgctgaacagatatgggcagcacagtgagaagatttcttgtctctacaaaaaaattaaaacaggccaggcgcagtggctcacgcctgtaatcccagcactttaggaggccaaggtgggcagataacctgaggtcaggcatttaagaccagagtgaccaacatggagaaacccattctctactaaaaatacaaaattagccaggcatggtggtgcatgcctgtaatcccagctacttgggaagctgaggcagaagaatcgcttgaactcaggaagcagaggttgcggtgagccgagatcgtgccaccgcactccagtctgggcaacaagagcaaaactatctccaaaaaagaaagaaagaaaaataggccaggcgcggtggctcatgcctttaatatcaacactttgggaggctgagcttggcagatcatcggaggtcaggagttggagaccagcctggtcaacatagcgaaaccccatctctactaaaaatacaaaaaaaaattagcctggcatggtgatgtgtgcctgtaatcccagctactctggaggctgaggcaagagaatcacttgaacctgggaggtggaggctacagtgagccaagattgtgccactgctctccagcctgggcaacagagcgggactcggtctcaaaaaaaaaaaattaaaaacattaaccgggcatggtggcatgcacttatcatcctagctattcatgagactgaggtaggaggattgcttgatctgaagaggtcgaaggtgcattgagctgtgatcgtaccactgcactccagcatgggcaaaggaacaaggttctcaaaaacaaaacaaagcagaaatttggttggtttatatacttttttgataaaaaatttaaatcaggctgggcacggtggctcacacctataattccagcactttgtggggctgaggtgattggatcacctgaggtcaggagtttgagaccagcctggccaacatggtgaaacctcatctctactaaaaatacaaaatttagctgggcatggtggtgcgtgcctgtaatcccagctgcttgggagattgggcagaagaattgcttgaacccgggaggcggggattgcagtgagccgagatcatgccactgcacttcagcctgggcgacacagtaaaactccacctcaaaaaatatatataaatcacatatgagaaattgtttggtagagattacttgagaaaaaatgcaagtgttggattgtaatgcattgacaccagcttgatgttcttagagcaaattaattcttaggaggagaaaaagattaatctgatattttcatttataatgtactactaaattgaagttgactagaagattattattgaattaacaagatggaacatatctgacaaacttaatgtctggcctggagacattttggactgtttttggtgggactagacttaaataaaattggaacaaggccagatgtggtgactcacacctgtaatcccagcactttgggaggccaagccagtggatcacctgaggtcaggagtttgagacctacctggccaacatggcaaaaccctgtctctactaaaaataaaaaaattagctgggcgtggtggtgtgtgcttgtaatcctagctagttgggaggctgagacaggagaatcgcttgaatccaggaggcgaaggttgtagtgagcccagattgagccactgcactccagcttgggcaatagagcaagactctgaaaaaaaaaaaaaaaaaaaggattggaacataaataaaattaacctttgtgacctttgtgcatatggccgtagaaggacttgtgtctttgcatgagcattagactaaatgtccttttactgtttgtctttaccagtagacatacttgtcagtggtcaactgaggataggtaaaagactcttgctcaactttctctacctagtctcactttccagaaagggggagaagataataagcattactatctaaatacattttaagaaaaattgtagatctgttaagcagtaagtgtataggtgatatatttatttatatgtaatttctaattgaattataatataatcttatctgtaaacatggacatttttagatcaaaaatactattaataaaaatataagccaggtacagtggctagtgcctataatcccaactactcaggagactgaggtgggaggatcacttaaacccaggagtttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaaaaccaggagtttgaggctgcaggtactcactccagcctgggtaacagagtgagaccctgtctctaattgaatgaatgagtgagtaaatgaatgaatgaatgaatgaatatttttaaaaagaaaaatacagactgtatatttttatttttatttattattattattatttgagatggagtcttgctttgttgcccaggctggaatgcagtggcgtggtctcggcttactgcaacctctgacctctgcctcctgggttccagaggctgaggtaacaggtgccctctaccacacctggcttttttttatttttactttttttgtatttttagtagagacggggtttcaccatgttggtcaggctggcgaactcctgacctcgtggtccacccacctctgcctcccaaattgctgggattacaggcatgagccaatgcgcctggcccatatttttatttttataggattaaccaaacaatccacaacaaactaaattgacagtgataaagctaaagtaagattattttcttcattcattcagcaaacatttgttgattacctactgtgcaacaggtgataacaacatctgccttcacagagctcatgatctaatggaattcaaaagcaagaatagtagttgactattacaggatcaacttaagataacactaatggtttttcaaaatgttctatgggatattcttagattacttttaaatgcctgccctgtgcatgatctgaagttttgtctcagtcaaaattaggttgtaggccgagtgtggtggctcacgcctataatcccagcactttgggcagcctagtagggaggatcacttgagctcaggagttcaagaccagcctaggcaaagtaacgagactcttgtctctacaaaaaaattttaaaaattagtcaggcatggtggtgtgtgcctgtagtcccagctacttatggggctgaggtgggaggattgcctgagcccaggaggtggaggttgcagtgaggcctgattgtaccactgcactcccaccaacagagagagaccctgtctcaaataagataaaataaaataaaaatctggttgttaggggaattgtattggtattagaatttaggtgaaaataggtccaaagaactcatgaataaatgattcatttctcaaactacttaggtagaataataaaacatggaatgtcaaaagttaaatgagcactttcccctctgtcaaaataatcagttttcataggaattaggtttttagccaaatggctgtgaggcaagttgaagtaagacaagaaaattgcaaatatttttagatgaaaatatttactttcagcagattttgagacagtcttgctccgttgcccagcctgcagtacagtagagcgatctcagctcattgcaaccacctcctcctggattcaagcaattcttgtgcctcagcctcccaagtagctgggatttacaggcatgtgccaccatgccctgctaatttttgtatttttagtagagacagagtttcaccatgttggccaggctggtctcgaactgctggcctcaagtgagccacctgcctcggcctcccaaagtgctgggattgcaggcatgagccaccacacttggcctttcagcagcatattgactgacaacaacaacaaaaatttatgaagggagcgatccaacttatagaccatgtgccattttaaaagcttctttatagccaagatttcttctcgatatcaaattaagaaatttaacagctatgctttctgaagactgtttccatagagcttccaagtggtagtaaacttttaaatcaggatttggctatgtgctcaactcagaagactgtcattagcaatagcagtaggtaccactgagtgccactgcggactcaagtagacaaaaaagaagaaagaaaagcaatcaagggggaaaggtagatatagtgaagtggtagaatcttgctatatgttgcctctaggtataaatctagaactaactactcctgaaaatggaggtagtaggaggtgggaaataatttttcattttgcttgggaaatttggtttgtaaacctaaaatagcccttatttctggggaaaaaaaaaaagatgtttaaagtccagtctaaaagagaattgtgtccatgtgtcaacttgtcatattcaagttttctaattaatttagttttcttttaatttagaaaagcaaaatttattaatcactgggtggtattttctaatgagaagcttgaacttagtttaagaaagaagtgctctgacaatctcatagtccttaagaagttctgagactatattgtcagatagctaaatgctaagaggagagtgtagtttgtaattgagtagctttatcctcctggagatttttaagctgtatcctataatatactcttggtcaggttgggtagtatgattcaaggcacttggaaccgtcttggggaatatagcttggtaattgaactgcttaagcttattattaatatttaagctatagttccaggcccattccagaggtcccccagccaatgcacttcataaaagggaagatatatcttaatataccaggtttgtatctcatgctaccattgtagcatcaaaaaaatagacatttaaatcatggctaataacaaattttagaatgaaatagttggtaaattttgtgattttaaacttttctttttgtgtgtgtgtatatgcagcaatgaaaactactggatgtaatttagataaggtaaatattatccctaatgccctgatgactccactcataccaagcagtatgattaagagtgaagatgttactccaatggaagtaacagcagaaaaaagatcttccactatttttaaggtaagctgtattgactagtgcacaaacctcctatataaaaattgctgtcttttacttttcctatttttttaacattatttttactttggatgcacttaatgaattttgctgtaaagagggaatgctttatacttcagcaaaattgcccacatagtgacttccaatatacaagggaggaattaatatgttgtatgagatattgatgaaagtactaattttagcattttcagaattagagatgtttttatttttttcccagtcttttcccataactttctgtttcttttttttacttgtcttatcccctgtaatgttactgaggagccacaaaattgagatattttgatacctgctcttcatgaaccataaaattactgtgttctgattacccttaattcacctaagcatatcaatagccgattattctacttccttgtttgactatctttgcttgtcgtacttttaaaaaatatatctcaaggaaaatgagacatcatgttatggagaattgtagtcctgtacctgttttctaaatgataataatatagagtggaaagctggtcctgcatatatttttagagcaatagtgatttttgatgtatgttacaaacttgtttaatgtttatatattcataatatttggggatttttattttttagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaatagtaagaaactctaatttttcattacttaattggtcattattattattagaaggaagcagagtgcagtggtgcgatctcagctcactgcacctgcaccctctgcctcccaggttcaggtgattctcctgcctcagcctcccaagcagctgggattacaggtgtgcacaaccacgcccagctaatttttgtatttttgttagaggcggggtttcaccatgttggccaggctggtgttgaatttttgacctcaagtgatccgctggcctcggcctcccaaagtgctgggattacaggcgtgagccaccacacctgtcctgtatagttgttttaagagtacagattgtagttagaactctatcacctatagactataagatcttgtacaagttatttggcttttatgggtctcaattctctcatttaaaatggtgataatattacatactttacatggatttggggaggattaaatatggcaatgtataaaaatgtgtgtttgccattttaagctataaacttaaaaggaaaatgaagtcagaatgacagataataccttacccagttgaagtaagtagtttctaaggaggtagaaactcatctttaatgtttatataccaaggaatttatataggacttttgatatttaagcaaagttgtatttttagactgcttaaaggaaacctaagatgaattccagtgccagtctgtgaaaacctttttcttggactatcaggtgcctaacttttagtaatatacaaggagaatgcagtaatgaattttccccaacaactaataaatatcttttcatgaatctttactaatcagatagcttctatttttaatgtttctgcagactgtagtcagcttttaagcttctgttttcaatgtctctgcagactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatatgtaagtattgcattttggcttcttattgaaaagcatcagattttattcttcttaacagatttaggttaagtaatagtagttctaatcttttaaaatgtggctttctcacaagatgatacttttttactctgaataaaattattctgaatgatagcttatggtcatatagttaatacagaccaggccgggcgtggtggctcatgcctgtaatcccagcactttgagagaccaaggtgggcggatcacgaggtcaggcgatcgagaccatcctggctaacatggtgaaaccccgtctctactaaaaaatacaaaaaaaaaaaaaaatacagaccaaacatccctagtccaaaaatccaaaatccaaaatgctctgaaatccgaatctttttgagtgctgacatgacatctcaagtggaaaattccacacctaacctcatatgatagggtcatagtcaaaagtcaggctcacaacatgcagtttatttggtgtccccaagggtaaaaaagatccttccagctcccttcagctgtgatagatttttttaggtgtatgtgaaacagaagtgaatttcatgtttggacttgtgtcttatccccaagatatctcattgtgtatatgtgcatattccaaaatccaaaaaagaaatcagaaacacttctgatcccaaacattttagataagggatactcaacctatattggacattccttctgcctctgagcttctttgccttggaataacaaaacatctgatgagtatgcaaaatgtgtttcctttgtactatatattggatataaccatgcctcacttatcccttcctccagaaataaatattgagtcagaaaagtctgtggaagatcaaatatgataaagttttacttacagtaccataatatactttaggatcattcagggtgtcagaaactttataaatgcttccctccctagtaagttaaattaaactttttctcttttttagaaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttctttttttttttttttttctatcctgtacatttagttgaactgtgcggaattgtggtgttggttttgtttacacagccagatttttccttctttttgttttgtgatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacgaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttctttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatctaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttcttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtgga

SEQ ID NO: 2623 - DNA, 138701 bp, Homo sapiens; identical to SEQ ID NO: 2622
  source 1..138701: mol_type = genomic DNA

SEQ ID NO: 2624 - DNA, 138701 bp, Homo sapiens; identical to SEQ ID NO: 2622
  source 1..138701: mol_type = genomic DNA

SEQ ID NO: 2625 - DNA, 138701 bp, Homo sapiens; identical to SEQ ID NO: 2622
  source 1..138701: mol_type = genomic DNA

SEQ ID NO: 2626 - DNA, 138701 bp, Homo sapiens; identical to SEQ ID NO: 2622
  source 1..138701: mol_type = genomic DNA

SEQ ID NO: 2627 - DNA, 129723 bp, Homo sapiens
  source 1..129723: mol_type = genomic DNA
agattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgaggtgagtcaggctgtggggggtggggcgtgggggcggggagacagggagacagggagacagggccaggggaggcgaggggtccccgtcccgccgggggcggctgagccgcgacccccatggcttctttggccggagcgggcagaggccgaagggatcggggtgacggtggagggggcgggcggagcagtggcggcccctcccccgcggagccgccggccgctcggggcccagattccgtcggcccccggggctctgcggcaccggtcgcttctagccgctctcagcccgtccggccccgccaggctccgcgagccgccggccccggcctcccgggctcggggatggccccagactgggccccgcgctggggccaccgcgatcggggcgccgcgtcttctcttaccgggaccctcctccccagcaaagttgcccccaagcgggcggcgtggcctggagccggttctgagtgcagggtcaccattttcctccctttccagcttgtttttgcgccgtcgttccaccccctctccctccggcctagtccactccctccccatgttgggacagcccccctcgaccaggcgttcttcctttcctcgtcatcttcttgctggaaagggcccgatggaaagggcccgaattttcttttctttttttttctcttcccacctccgtggcattctaattacttctcccttctcctttacaaagatgggggtgccctctctggattggttttattcctctcctctcccaggaggaccagcccaggcacagacgctgtcctttgagaattttctctgcttttccgttcaagggctggttgcagggagggagctcaggcagagacttttcatttaagaactcttttggctaaggcctgcaggggattcccagcatctgaaatattagcactggagctgatccctactcaggtgaaattcctttactggacaccacaagaatgtgtcagaacaggttccctgtgcaaggggcttcaaaaccaaaatattcccactgcgctctttacgctttttaaaccaccgggagggggcaaaagacataactgggttgttaactattcatttcaccgtgtaaaaaaaaatgtaggtgtttcttctgcttttggtttgatgtatccatccatttgcttattccaccccctccaaaaaagggacttcaccttcctactagtgtatctaaattgtttaagtgaatcagagtgagatggtttactctgaaaggtgctggactttacagactgaccattgattttgtacacagagtcctacttagtaattgtagccactgtctgttgctccaatgactttagttggcagccaccatcctgtaggatgtttttcgggcaacattacctgaggtactttagaaatattgtagttttgaatgtcaaaaaaaaaagagacatatcaagagatgattcttagagcagggctaatgtgttagaattgagtgctaaaaatagccaagacattaacaccatttggggagtaatcatcagataattttccatgaaacatatactttatgaaaatctaagtttagcttcgagaccaatgtagagacaattcagcctcttttgcggggaatatattcacaaatatgggctttagcgcttaaaaatacactgcagttggccgggcgcagtggctcacgcctgtattcccagtactgtgggaggccgaggcagttggatcacctgaggtcgggagtttgagaccagcctgaccaatttggagaaaccccgtcaccccgtcactactaaaaatacaaaattagccgggcgtggtggtgcatgcctgtaatcccagctactcgggaggctgaggcacgagaaccacttgaatccgggaggcggaggttgcggtgagccgagatcgcaccattgcactccagcctgggcaaaaagaacgaaactccgtttcaaaatgtatgtgtgtatatatatatatgtgtgtgtgtgtgtgtgtgtgtgtgtgtgtatatatatatatatatacacacacacacattgcagttatataagagatgtatgctatccttggcatttttttcctcattcagcataaaaagtacctaatgctttttgtgtttttcagattctctgaagttacacccatcacagaattttcatagagctggactattggaaggtcagcaaagtaccattttaaagcatattgtgttagtatgcaaaggctttctctgaaatggagtttaaatgggaaagtatgaaactttgcaaactcacacaatgtagttttctcctaaagagtctgatccttcttttagagcagctgaatgtttcaatgggttttgttgctgcgtttgatgtgcttgttggctgttctatctgctttgagaaacattgaaaaaaaaatcattttaaattatgtgttgagtgttctactttagaattccagaccttcattttagctttttatacacaaaatagaatgtgaaaaggcccaaacattaacatgaatataaaagagtgacaccaaacacataattagtttgaaaattcagaatttagaacatttatatgctgagcatttcaaaatatgttaattatttattgcaaaagcattgatgccattgttattgcattatacttaagggtaaggaaagccaagtaatagcgatgatgattgagctatgcttagaagaaaggggtttagaaagttctggaaatgttaatagagtctgtagattagtttaaacagcttacacttactttagaaaacttttggctttgtgtgtgtgtgtgttttaacattttaagacataaaatagtcttgtgtttttgtagattttgaagtgatttcacatatatcatctttaaatctttataattttggaattggacagcaaaggtactaatttccccattgtagagaagagaaactaaggctgaaattaagaaaccaaaaaaaaaaaaaagtcccacagtagaagaaataatactttctgcgtttcagttagtgctctttatgcaaagcggccaccgtgaaatacacatgtaaccagtaacaaacattttatggtctactttaaaaaggccctaaatatttaagtttgacttgagaagatttttgcctcccttggaggtagtccgggatagtggggggcaagtgggttttgtagttgagcttaaatttgaataccaacttagctccttattagttctgtgacttcgggcaagtgattttacctctctaaactttaatattcttcctgttaaaatgtagctgtctcttaaatttagtgagctaatgtgtattaaattgcctagcatagcgtctagcttaataaatgttagttttttcctttagtatcagctaaatttttttaacagtataatttagagcatataaaatgttctcaaataaataattggttaaatttgttttgtacgtgtaagaagcccatagatatacattagtatgaaaatcaaatatttttaaaactacaatttgaagtgagaaatttttagcagtgtttcttagtgaagcagatttctggtttttattcatattcaatttgtgaccatgttgtagagacatatttgtctgtacaaacccatctcatttcctggacaacaaaccatagagtgtcataatcatagagatgatcagggaggagaaagacatgaagaaaaaaatgagtgttaattatttaagcaaatatttttagtgagctgatggaaatacagacaaccatttagcatgtttatttacatgtttatgcctaaatactttcgttaatttttcattttagttaaggggattctcatttaaagtaaggctacccttttagaaattatatataaaatataacatgtataagtatcaattctgtcatgccctttaaaatgttttgagacagggtgtcttaaaaaagttgtttgcttctgtaatgaagtgtctaatctgtgccacctcattgctatttcttttttattattgacattttaaagaatacataaaagtagagagaataaaataagccccatatacccatcaccacagtttaaccagtatctaatcttgcttcttttatcccttcttctctctcaagctggattattttaaaacaaatatcaaacatcagatcacttcatacataagtatttctgtattacagtgactttcttatattaattattattgatataatttaattgttaatataattattgtattaatttttaattactctgtatagtttataaactatttcttggaatattctagtttatttcagcaaagtctcttgtgactctcctgccctcttttcaagacagagtgctgcaggaggctaccgcttctagtatatagtatatcctataacctatgttgaaattgtaggccatgctgctagattggagttcatattgttgctctgacatttacttgtatggccttagcctaataatttaatcttttttgcttcaattttctcatctttaaacgggagcaataatagtgcctcatcctaggtttttgtgaagattatttgaggcaaattcgtgtaaagcatttaatttagcacatgctaagtgctcagtaaatgttagctaaagttaaaaaatttttaaaaactaaatgctagctgtagagtgtttactgtgtgccaagaactttacaaataagaactcctgaggtgggcatatcacttgaggtcaggagtttgagaccagcctggctaacatggtgaaaccccatctctactaaaaaaaaaaaaaaaaaaaaaaaaaaaagccaggcatggtggcatacacctgtaataccaactactcgcgatgctgaggcaggagaatcccttgaatctgggagacagaggttgtggtgagccaagatcactctactgaactccagcctgggtgacagagtgagactctgtctcaaaaaaacaacaacaaacaaacaaacaaacaaaataagaactcagcgaattctcctgactaccctttgagatggttattattatcctactttagagatgagcaattgaaggcataactcacccagagtcacaagctagtaaattgtagaaccagaattccaacccaggtagtctcactttagcctagcctcttgactactgtgctgtactaactcccaatggtatatactatcaagttctgtctagtaatatttatgtatgcatgttttacatcagtagtctagattttcatctataaatagtatttaaaaacttggcccagagtgaggggaatttaagtaattggtgtgatataatttaatttttttatagaacgtacgttttccaaatttaaattttttttttggggggaaacaaggttggaaaacctgcacttgggtattattattattatttattattattatttttttgagatggagtctttgctctgtcgcccaggttggagtgcagtggcacgatctcggctcactgcaagctccacctcctgggttcacgccattctcctgcctcagcctcctgagtagctgggactacaggcgactgccaccacgcccggctaattttttttggattttttagtagaaacagggtttcaccatattagccaggatggtctcgatctcctgatctcgtgatccgcctgcgtcagcctcccaaagtgctgggattacaggcgtgagccaccgcacctggcctgcgcttgggtattattaaactttagaagtagattcaaaatgtctactattcaactgagtttgcatttaaccttcctatcaaaacagtgctagtctttcttgcaacctctttttaaatttaatacgatgattgcctgacaatgggaaaagggtcctggctaattaattaatgttataatacatggccattaaatgatgtttctggtaaccccataattaacatgtgacactcttaataaaataagtaaataaaaattatgctgttacaattatattcaaagtaacttgtgttacaaaaatcctgaacaaaagtatacatcactgattttctatttttcaattctatttttgtattttccatctttaaagaacatggtttatatattttttttaaataaaattgtttgccattagtaagttcaaattcgaaggctaggattcctttttgaagtgcctgggaaaaaaattcagctgcagagaaaaggcaccatttgttgtacattctataatgaaaactattcattttggcaaatgaaaaactaagatagaaatgaaactgaatgaatcattctagaaatagagaaatataagattatagaaaaatcatagataaaacaggaaaaataagagtataaacaaattggaaaaatagataaatataaacaatagatttaacaattttaatgattttaaaagcatgagttaagagattatatatcaaatgaaagaactggttaaataagagctaaatgctgatctgatataatctttgttatttatttatttatttatttatttttgatacagagtctcactctgttgccaggctggagtgcagtggcatgatctcagctcactgcaacctctgcctcctgggtttaagtgattgtcctgcctcagcctcctgagtagctgggactacaggcgcgtgccaccacacccagctaatttttgtatttttagtagagacagggtttcaccatgttggccagggtggcctcgatcccttgacctcatgatccaccctccatggcttcccaaaagtgctaggattacgggcatgtgccaccgcatccggccacaatctttgtttaaattaaacatttaagaccggaagatttttaaaagaaaatgtgaaatatgacaatgagttaagagaaaataaactatgattttttttttactactgctaatctatttgatatggtaccatccagaattatacttcatagtgcaaaaatggaaaatcctaaacatagtagcaatgttttattgactttatagaatatttctgatttatatttcttcctagggcccttgttatatcatagatcataaatgcctataatattttatgtacaaagatacctttttggaaaggattttttgaaaacatttaacatgaaaaataatctattgaattcttttcttgtttagtatctaataatctctgtggatccatgtctagtaaactaaaagtattatggaaataatgaagttcaaacatgtcaaaagtcatacctagttcatcccagcttcttgtctttagatccatctctttctgattgcttaccacctgtttttgtgtcccttcctaaactctgctttcattattttcactcaatactggaattctattgcttatttaaaataaaaggatataaattcatattctaatccagtggttcttggcctgattttaatttactcttgactctgattattccaggagtcccctaaaatttcaaagtggtagtacagaaaaacatttcccagtgtgattagtattatatataaaaaacagccactttttttttttttttttttttgagatagagtttcgctcttgttgcccaggctggagtgcaatggtgcaatctcagctcaccgcaacttcacctccaggttcaagcgatttccctgcctcagcctcccaagtagctgggattacaagggcgcaccaccacacctggctaatactgtatttttattagagatagggtttctccatgttggtcaggttggtctcgaactcgtgacctcaggtgatccacccacctcggccccccaaagtgctgggattacaggcgtgagccactgcgcccggccaaaacagacactttttatatgaaaaagttgactcctcagagtatattttatattaagagtaacaggtaactagaaaaaaataaagattattcagtggcataggatatagaccttttaactttagagaggtaaaagacatttttcaatagaaatgttgcttattaatttgtattattgtcttttcttgctgttgctaagattttatttcaagttacgcaaagaaggttgctgtgtcttctgtttgcttttgtgttaataaaagtcaagtttaaataaactaacagagtataagaccaatgataattatgtacttgagtgaaaaggtagagatttcctctatgagttaactacagataatggatctagctttcagaataaataaacttgatgtaataaaggatatatatatttaatcatttgaactaaacatttgttacatgagagttcagttacttttatttgttcttaatagcttttgaaaaatatatacttttctcttttttttttttggtttttgaaacggagtcgtgctctgtcacccaggctggagtgcagtggcacaatcttggcttattgcaacctctgtcacccaggttcaagcaattctcccaccagagcctcccaagtagctgggattacaggcacgcaccaccatgtccagctaattttttgtatttttttagtagagatggggtttcaccatgttggccaggatggtctcgaactcctgacctcgggtgatctgcctccctcagcctcccaaactgctgggattacaggcatgagccaccgtgcccagcccattctcttttatttttaacatttatgtggtaaataggtaatgatcattattgcttcccacccatgaatgtttatcacttctttttcattcaggaaacactgtgattagtcttttactgaatttggtatttagttttgaagatgagagaagaacagaaaagtttctaatagtgagctaagttgttgattatgcttatttatttatttatttatttagagacggagtctctctgttgcttaggctagagtgcagtggtgcgatctgggctcagtgcaacctccgtctcttgggttcaagcaattctcctgcctcagcctcatgagtagctgggactacaggtgcacaccaccatgcccagctaatttttgtgtttttagtagagacagggtttcaccttattggtcaggctggtcttgaattcctgacctcaggtgatccgcccgcctcagcctcccaaagtgctgggattacaggtgtgagccattgggcctggctgattatgcttatctttataaaattagttttacaggaggctgaggtgggaggatcatctgagcccaggacgtcaaggctgcattgagcctgcatgatcatgggatcatgccactgcactccagcctgggcaacagagcaagaccctgtcttaaaaaataataataataaaataaataaataaagcaagagaagaaaaaaatttagttttaataaaaaaaactgtacctgaggcaatctttgtaggacatgctagtcaaaagaataaattcagtgttagtaataattgaaaaccttttttgagcaatttatatgtcaagcagtttatgtttaacaccattttacatatatttttcacatttaactcttagaaaaatcctgcgatgtagtaccagtatccctatttcgtaaatgaacaaactgaggtacagagggatctactaattttcccaagggcacatatctcgtggatgaggctggaatttgaacttcaccagttttaccccagagctgtgagattatattgactgtcttaacagtcagtaagaacatttgaggccgggctcggtggctcacgcctgtaatcccagcactttgggaggccgaggtgggcggatcacgaggtcaggagatcaagatcatcctggccaacatggtgaaaccccgtctctactaaaaaaatacaaaaaaattagctgggcgtggtgggcgggcacctgtagtcccctgaggcaggagaatggcttgaacccggaaggtggagctttcagggagcggagatggcgcctctgcactccagcctgggcgacagagtgagactcggtctcaaaaaaaaaaaaaaaaaaaagaacgtttgaaattggcatttatactttgggccctaataagattacaccattgttcagatggtataaaaagaatagtttgtgtaggattctttactaagcagcttccataaagtaatgagacaaattttataaactacatacaaaaattcataaagaatatgattatgactcttttggggaagattttaatactcaaaattagcaaatcattgcctggctttggtgagtgtctttaacatttagaggaagtgatggctgatcaaaacacctatgttggcctagctcagtggctcacgcctgtaatcccagcactttgggaggctgaggtgggcggatcgcttgaactcaggagttcgagatcagcctgggcaacgtagcaaaaccccctctctaccaaaattagccagggatggtgttacgcacctgtagtcccagctacttgggaggcaggctgaggtgagaggatcacatgagcccaggaggtcaagaaatacctctctcctggctgatgatgggactcagaagtgaaaagtaggagaaggctaagcagaagccaccacctaaggggaattactttagaaatgaaggtgccgtggggctcttgatttctttggcagtagttttatggaagcatggatgccattgttccctatttctgctagtatgtttcagagacaaagtaaattcaagaagagatgagcaacagaagaaatagtactaatgtgagctatgtgaatagtggtattttgcatagagcctttattaatttactttggttctttctgctttgtcttttttaatctgcccctttcaccccgtgtatccgttttctcacggtagtctatacattttgttgttctgctatggcatcttgtatcctttctctatttcccttcttctgaaaacaaacgtctataaaggaggtttgctattgtaaattgtagtttagaagttaaccctccccctgtggtttagtctcttctaataagctataagcaacatgggccagaacctatgtgtaaattcatcttgagtgaatgaataaataacactattatggctaagtaacctatacttgcacatatacatgaaaaatatatggttggctatattatggaataatataggaatctataaaagaacaaaaaatttattacctttatacccagttttaaaaatactgtgttcccttttagaaggttgtggtgcttgaacgacaacaaaaaggtaaagagtacgcactgtatagacccatttatgtgaagttctttaaaagacaaacctatggtaagaaaaagcagatcagtagttgcctggggctggagtgggcaggattaactacaaaggaccaaaagtagctttacggaatgattgaaatgttctctgtcttgaccatgtgattacacaaacatacatactttttaaaaaaactcatagaacatttaaaatgggtgcatttctatacttctataaaggacacgggttatatatattctgccactgcactccagcctgggcaacagaagaaacagtattaatgtaagctatatgaatagtgatattttgctattttgggaagctgaggtgggaggatcacttgaacccaggaggtagaggatgcagtgagcagagatcgtgccactgccctccagcctgggtgacagtgagaccctgtgtcaaaaaaaaaatttttttttttacctgtactgaacatgtacagacttctttttcttgttgttattccctaagtgatgcagtgtaacagctatttatgtagcacttacattgtattaggtataagtaatctagagatgatttaaagtatataggaggatgtgcataggttatatgcaaatacaaaaccattttatattagggacttgagcatctggaaattttgcgggaagtcctgcaacccatctccaacagataccaagggacgactgtactccgatatatagtttctatagttaagcataaaggtgaaaacagaatatgagtttttggtcccttacaagtgagtactatcttgtgcttaactatgtatcataaatactaattttgagtaaaattcagatgtgcccatagtcatatatatactgtattctgatagctagtttgagatattaggcattaaaatgcttttattagcaattcaatagaacacttaaaatttgttggtagaagactgattacataactcaaattatttgtttgaattaaagttttcattacagtcatctaagtcaataaaactcgtgtttaagtgtgtcttatgacagtgaccataagccaaacacagacttaagccaacaaatagctatcctttacaatggagttgtgaatttgttaatgtttttcttttctccagtttataagtagcaacttgttggattgtcattctgaaacactgaaacaaagattttacttgaaaaaaaatactatggtaaaatggaatgaataataaattaattttcccaaatgtcaatattcaacttataaacaccttgataattgacatttgtaagaactttagaaacactataaaagttgcatctgaataagtttttttttttttttgagacggagtctggctctgtcacccaggctggagtgcagtggcgtaatctcggctcactgcaagctcctcctcccaggctcaagtgattctcctgcttcagcctcccaagtagctgggactacaggcctgcaccactacacctggctaactttttatatttttagtagagacggggtttcaccatattggccgggctggtctggaactcctgaccttgtgatccgcctgtctcagcctcccaaagtactgggattacaggcgccggccactgcgcctggccataagttttaataaaattatattgtgaactccaagacatttttctgtattcttttttgtgtctgttattaaattatattctctggaatattgggctaacgtagggtgaatggatgggaaaataaacacagatgtaattttataattatttttaaagaacttttcattttcttagtgaatttttgcctataatattgggtacaggatgagaatttatatgtaatatttgaattatagatactttggataaaatgacttcttaattccttaaaaaactaattattgcttttttttaaaactaggtaattaggtagttgaaagacagaatgtcattaagttaactaaattaccactgtattacagtaaatacaaacaacatacttacagtgtaaactatggtaaataaaaactaaaaaaacacttccttgaaagtattttttaaccaaacttcacaaggatggatagaattaacactataaattctgcacagaaaaaaaatagtgcatactaaattgagaacagatgcacagaagtgctatttttagaaattaaaaaatggtaaagatgataataggcagatcagaagtcccacatatttatcagggttgtaaataaaaacccagttcaaaaacatgcattactaactggctgtgtgatttttaggcaagttacttaacctttctgtgactgtttgttcttgtaaaataggaataatagacttatagaactgtaacgaggaatggatgagttaatatttctaaagcatttggaatagtgcttgacacatagtaagtgctatatgagtgcttcttaaataagcaaaataaaagtatgtacccagaggaaaattacttggcaaacatacttagaatgtagcaagaaaccaggattttattagcataagcttcagaacaactcaagtgttgctaaatttacattacattacatattaatgtaataactattttaatgtaatatgtattttaatatgtaatgtaattacatattaaatatgtatataattacttttaatatgtaatgtaatgtaactacattacatattaaaagtttagggctgggcatggtggctcctgcctgtattcccagcactttgggaggccaaggtgggtggatcacctgaggtcaggagttcaagaccagcctgggcaatacagtgaaactgcatctctactaaaaaatacaaaaaaattagccaggcttggtggcgtgtgcctgtagtcccagctactcaggaggctgaggaaggagaaatgcttgaacccaggaggtggaggttgtggtgagccaggctcttgccagtgcactctagcctgggcgacaagagcgaaactaaaaaaaaaaaaaaagtttaggcatttatagcactgtgttgcgcagggtttatcttcctaaaatacaaatccaaacttatcacttgcttaaataatcctttagtagtatccatgggttttaggatgaaatccaaattctttttatttttgagatggtgtctcgctctgtcacccaggctggtgtgcagtggcatgatctcggctcgctgcaagctctgcctcccaggttcacgccattctccggcctcagcctcccgagtagctgggactacaggtgcccgccaccacgcctggctaattttctgtgtttttagtagagacagggtttcaccatgttagccaggatggtctcgatctcctgaactcttgatccgcccacctcggcctcccggagagctgggattacaggcgtgagctgccgcacccggccgaaatccaaattcttaaaacctgggtcctcattatatttcttaaaaaaattgagaaaaaattcggttaacaaagttcattttgtttgtttgtttgttttgtttttgagacagggtctcactctatcacctaggctggaatgcagtggtgcgatcctggctcactgcaacctccgccttctgggttcaagtgattctcatgcctcaccacatgagtagctgggactacaggagtgtgccaccacgccaggctaattttttgtatttttagtagaggtggggttttgttatgttggccagggtggtctcgaactcccgagttcctttttattgcagaatagtattccattttatggatatatcacattttgtttatctattcattagttgatggatatttgtgtcatttccacattttgactgtcatgaacaatgctgctgtgaacattcatgtacaagtttttgtatagacagatgttttcatttctcttgggtctgtctatacataggagtggaattattgggtcatatggtaactctatatttaactttctaagaaactgccaaactgctttccatgatggctgcaccattttttcatttttaccagcagtgtatgaaggttcagattttttcaaatttttttgccagtacctatctgtctttttaataaagccatcctagtgggtatgaattggtatttcttgtgattttgagtaaatgtctctgatgactaatgacattgagcatcctttcatgtgattactagacagtagtattaatatatctttggagaaatgcctattcaaggcttttgtgaactttttatgatgaaaaaatcttaaaaattatatatttatcatgtacaacatgttgttttgaaatatgtatacattggctaatttgagcttattaatatatgcattaactttttttggtgagaacgcttaaaatctattttcttagtgattttcaagaatgtaatacattgttattaatttttctcactttaaaattgggttattaggccgggtgggcgcagtggctcatgcctgtaatcccagcactttgtgaggccgaggagggcggatcatttgaggtcaggagttcaggaccaggctgggcaacatggtgaaaccccgtctctgctaaaaatataaaaattagccaggtgtggtggtgcatgcttgtaatcccagctgctcaggaggctgaggcaggagaattgtttgaacctaggagggggatgttgcagtgagtcgagattgtgcatctgtactccagcctgagcaacagagtgagactctgtctcaaataaataagtaaataaataaaataaaataaaattgggttgtcgtcttattcttgaattgtaagggggtagtgtcatttgatgcacaaatattttaattttggtaaaagccaatttattttttctttgttgctcatgctttggtgtcatattttaaaaactattgcctagcccagggtcacagaggtatacctatgtttttttctaagaactttataatcttagctcttacatttaggtatttgatccattttgagctaaatttgtatattgtgtgaggtaagagcctaacagcttcattgttttgcatgtgcatatctagttgcctgagcactatttgttgaaaagacttgtttcccccattgaatggtcttggcactcttgtcaaaaattaattgggcatagatgtatggctttttttttttttcttctggactctcagttctattccatttatctgtatgtctatcctgtgtcaataccatattgtgttattactgtagctttgtagaagttttgaaattaggaagcgtgagccttccaactttttttcttcttttgtaggattgtttcggctatttaatgtctcttgaatttttatataaattttaggaacagcttctcaatttctacaaagaagtcagctgtgattttagtaagaattatgttgaatctgtaggctaatctgaggagtattaccatcttaataatattaaatatttttgtccatgaacatgggatgtctttttattttttttagatctttatttcaacaattattttaaaaatttatttataagtattccattcttttttaatcattgttttttaagtgttaataaaattatggaaataatttgaagaaaggtttgtcaaaatttaggaaagctcttatttattaaatttctgttttatttatttaaatttatttattaaatttctgtttttaagggatggggtctcattctgtcaccctggctgctggagtgcagtggcatgagcatgaatcactgtagtcttgaactcctgggctaaagcaatcctcctgcctcagcctcctgagtagctgggactactcagtgtttacaggtgtataacaccatgcccagctaattaaaaaaaaaaaaaaattgtagggatggattcttctctgttgcccaggctgatcttgaactcttggcctcaagtgatcctcccatctcattcttccaaaatgctgggaatacaggtatgagcctcaaggcctagctgagcttttgtatttaaacacaagattatgcatgtgttaagggaaagaaacctagcatatgataaaatctgtaaaatattagaatcagtcatagatctaaagctgcagtaaacaataaagaacatctagtgaagtccagttttgcttaaatagttatactggatggtaagcttcttaagggcattgactataccttgcatttttgtaacacctggcacaaatgctttgtatttgaaaggttcttgatatttattgaatgaaagagtaaatgaatgaatcctacatccagaaaagaaggaaggaagggttttggaagtttgaggattgtgctctagttatatgtaacctacaagtagcaagtttcagttggaataataataattgcattaaaataactgcaaatggggaactaggcctttaaagagttggggccagttgcggtggctcacacctgtaatcctagcactttggaaggctgaggtgggcagatcacttgaggtcaggagcttaagaccagcctggccaacatgatgaaacctcatctctactaaaaatacaaaaaattagctgggcatggtggtgcgcacctttaatgccagctactcgggaggttgaggcaggggaatcgtttgaaccctggaggtggaagttgcagggagctgagatcgtgccactgcactccagcctgggagatacagcaagactctgtctcaaaaacaaaataataataattggaactatttaatctgtaaagataagaatttagataaataagatgaaaattgaggtgtatttgttctgtgtctcttttttttttttttgacagagtgttactctgtcatctggactgcaatgcagtgagtagggtgcagtggtgccatctcggctcactgcagcctccgcctcccaggttcaaatgattttcatgcctcagcctcctgagcagctgggactacaggtgcatggcaccacacctggctaattttttgattttttagtagagacagggtttcaccatgttggccaggctggtctcgaattcctgaccttaagtaatccacctgcctcggcctccctcggtcttgctatatatagcaagacaccatctctacaaaaaataaaaaaattagctgggcatggtggcatgtgcctgttgtcccaattactcaggagcctcaggcggaggatcccctgaggccaggatgtcgaggctgagtgagctatgattgtaccactgcactccagtctgggtgacagagtaagaccctgtctcaaaaataaaatttattttggtggtggatgcacagctgtgactctgctgaaagccactgaattgtgtgctttaagtaggtaaattgtatgatatgtgaattatatctcaataaaatatgtatatatatacatgtatatatattcacaaatataaatgtattggaagggtttaaacagatggcaagtgctgtcaaaacagagtagaatttatgtttttattttttattttttgaggtggagtctcgctctgtcgccatgctggagtgcagtggcatgatctcagttcactgcaacctctgcctcccgggttgaagcgattctcctgcctcagcctccctagtagctgggactacaggcagatgccaccacgcccagctaattattattatttttttttgtatttttagtagagatggggtttcaccatgttggccaggatggtcttgatcccctgacctcatgatccacctgcctcggcctcccaaagtgctgggattactggtgtgagccacggcgcccagcccaatttttttttttttaattgtgtggggctgtctctcataaaagtagttttcttcatgcattgctggtggtaatgtaaaatggtgcagctgttgtgaaaaacaggtggttcccccaaaaaagttaaacatagaattatatgatccagcaatttcacttataggtatatacccccaataattgaaagcagggactcaaacagatactaatgcactaatgttcctagcagcattatttacaatagccaaaagaagatggagacaacccaggtgtctttcaacagatgaatggataaattccaaaatgtggtatataagtacaagggaatattattcacccttaagaaggaatgaagttctgttacatgccacagtatgaatgacccttgaaaacatacgcaaagtgaaataagccagacagaaaaggacaaatattgtatgattccatttacatcaggtaaccagacacatgagatacttaaaataggcagagaaagaaagtagaatattgtctagaaagtagaatattggttaccaggagctgggggttggggaggaatgggaaactatagttaaatgggtacagagtttgtttggagtaatgaaaaagttctggaaatgaataatggtaatggttgcacaatgtcgtgcatagatttaatgccactgaattgtgcacttaaaaatagttaaaatggtaaattttatgtataatttactgcaattaaaaatgctttcaaaaaacaagaaatttttaagagtaagatgcactacttttttttgtaaagtttgtgagacataattgtgtggtatgtggaaaggagaatattttcatttttgcatttaaaagaatatagtgttttagttgtctgtcatttatggttttcttccttctgttttcagagagtgtgaatttctgactttctatgtgggacccaaaatctttagctttagatgtaagtgagatgacctaaataccactgactatgttacatctttgataatcaaaaactaaattttgataagccagactagactacagatgactttgtgaaaaattcatgaggcgtagacatattaaccttgtttagattggaatttttttttttctttttagacggaatctcactctgtcacccaggctggaatgcagtggtgcaatcttggctcactgtaacctccacctcccaggttcaagcaattctcctgcctcagcctcccgagtagctgggattacaggtgcccaccaccatgcctggctaatttttgtagttttagtagagacgaggttttgctgtgtttgccaggctggtcttgaactcctgacctcaggtgatctgcccacctcagcctcccgaagtgctgagattacaggcatgagccaccatgcccggcctcgactggaaaattttttgacttttaatatgcttggttgattcattttgttgatttctggaaagcaaatgtttgtatttaatagtagcaataggattgcagttttctaataaatatcacagaattatggcagtgagccaagaagaagaaaagctgtattagtgaaataagacatacttctatagctatggaaactgtaaaccctactaagtctgataaaggtattctctttgtatttgtattattagacattggtaggggttcatgaaaacccaagataactgctatattaaatctaggtatgattgtattcatcaaaaggcctggttaaaaggcactgttaggtagtttagtatttgttttgtgtgaatattaaagtgcttttttttctttttttttgagacaaagtctcgctctgtagcccaggctagagtgcagtggcgcgatctcggctcactgcaacctctgcctccaggttcaattgattcttctgcctcagcctcctgagtagctggaattaccgcctggctaattttttgtattttttttttttagtagagacggagtttcaccatgttggccaggctggtcttgaactcccaaccctcaggtaatccacccacttcggcctcccaaggtgctaggattacaggtgtgagccaccatgcccggcctatttttcttcaatttctcttctttttttttgagatggagtctggctctgtcgcccaggctgtagtgcagtggtgtgatctcggcttactgtaacctccgcccccctgtgttcaatcagttctcctaccttagcctcctaagtagctgggactacaggcgccgccactatgccgggctaatttttatatttttagtagagatagggttttgtcatgttggccaggctggtcttgaactcctgaccttaagtgatctgcccacctccggctcctaaagtgttgggattataggcatgagccactgtgcccagcctaatttcacttcttatggtcctcaactactaaagcattttctatttgaaagaataatattagattattgccacagctgacaatttatttgagaataaatgagagaataggaatatgactctgtttattaaagttaaattaatcttaaccagtacatttgtttactggtaaaatgcatattagctgtgcacaagtagattttatgaataaattattttaggtataaattaggcactttggtaatttatagtgctttcttttttttttttttttttttttttttgggacagagtctcactctattgcccaggctggagtgcagtggtatgattccggcttactgcaacctctgcctcccaggttcaagcgattctcctgcctcagccccctgggtagctggaattacaggtgcacaccactatgcctggcccgtttttgtgtttttagtagacacaggtttcaccatgttggccaggctggtctccagttgctgacctcgtgatccacctgcctcggcctcccaaagtgctggaattacaggcctgagcctctgcacctggccgcatgattagtgctttcaccaagtaataatttcctgatagataacctgactagcatattagcttaatatcttttctaattataaaaaccaactaactcctgagaatacttaagacaaggtctgtaatcagggttgcctgtatttggtgaaattaatgggctgtttggggtgccaagcttcaaaagagagatgattgctaatcctaaaatataaaggtaacctagagccagaaagatagctactgagtaattgtgttctcaccacacttatttgtgtgtaaatttaaaagtgcatttcctctcaaatttagatatgtcttgttctgctatttttctgtactagaaagtacttcttcagattgctaggctacttaccagaatcatcaactactaactagtaaagaaacaaactgtgttttgggatctcccatatcaaatatatttagaagtgaaatttagcaatcatttattttatgagtaaaatgaaacagaaaaagtgaactatgaggggtagactcctttggaaaaatcattttaggttggaacctataatattgcctagaagagagaacccatccatgttgaaatgccagattagagggaagtttatgaagaaaagaccatgtagaatgatttgaatgtttaccactgtctagttttggaaagaaagaccagggcattacatgcagggtccttcttggtgttggaccctccctcctcttttcctacttctttttttttttttttttttttttttttttttgagatggagttttgcttttgttgcccaggctggagtgcaatggcacaatcttggctcaccacaacctccacgtcctgggtacaagtgattctcctgcctcagcctcccgagtagctgggattacaggcatgtgccaccacgcccggctaattttgtatttttagtagagacagggtttctccatgttggtcaggctggtcttgaactcccaacctcaggtgatccacccactgcagcctcccaaagtgctgggattacaggcgtgagccaccacgcccagcctcctacttcttttttagtagcccgttgtttgtctaacttgtctatcagttggatgtttcagagatcatggatttcagtaaacatagctctttgtaacagaactggatggtgtgtcctatgagaaaaataccgttttagcaatcgaaatgtggatgtgctatataataagacagataatctttaaatgacaataaaacctcaactcagaaactcaaaggataaaatttgataaaaataagagggcaaaaaaaattttagcagttaaaacagctgggaatagacagagtagaaagcagtagccctaagttttatatttgactaaggttgaatagaaacttcaggttgcagtgtctacctcaggatgattcaaatcactttgagtctttaagatatggctcttgaattctcaacccaagaattttaaaaaaagagaaatcctcatttttttgctaagaaacaggaagttatttttcttgaaatataagttatttataattttgtttctcattatttcttctctgtatcttttttcttccatcatagatgactcattgacaccccacgcatctaaaaagttcttaagctggccacagtggctgacatctgtgatcccagcactttgggaggccagggtgggaggattgcttgagtccaggagtttgagaccagtttgggcaacatagcaagaccaacccccctccccaactgtctctacaaaaactttaaaaaaactagccaagtctggtggcacatgcctgtagtcttagctacttaggagactgataaaggagaattgcatgaccccaggagttcaaggttacagtgaactatgatcgcacgactgcactccagcttgggcgacagaatgagaccctgtctcaaataataaaaaaataaataaagctctgcattttggcagttgtgggtcgtctgagtacagacgttgagtcctgagtatcaggtgactaaaaactctagtattgtaaatagatttgtaaattgacaaatcttgttttagacaattttgctatggtatgcaacaaagttatttccaaatacttttaggtttggatatttaaagtgctatttaaaaaactgtattagtcaaagttcaggattttttgcgtaaatgtgatttaaagtataaggcagttctagttctttctttgtatttgtattgttaaaataagactcagttgaatttcagtttgaaaatactggaaaattgttattcatagctactttgtctcaggctagatgattataaggagaaaattaattctaaagtggtttaaaccaaatcatgttttaaatttagtgttatataaatttcaggttgtgttctatatctttttttggctttcccctccctcagcctaacagtttagttgttcaggatagggagatttgtcccatgtaattatttttcagttttgctgaacatatttttaaaatggctacctttcttgggtacagtgtcatgggattccccgccccatctggggtagagtgttgtgggattagagtgagataagagacaaaggagaatctttcaggtcttctaactcaaatcactagaaatttaggcacgatctggaccttaatgtgtgagaggctgtatcattttatttcccaaattgtattttcttttttcttgagactgagtctcactctgtcgcccaggttggagtgcagtggcgtaatctcggctcactgcaaccttcgtctcctgggttcaagcaattctcctgcctcagcctccctagtagctgagattacaggtacatgccaccatgcctggctaatttttctatttttagtagagatggggttttgccatgttgaccaggctggtctcaaacgcctgacctcaggtgatatgcctgctttggcctcccaaagtgctgggattacaggcatgagccactgtgcctggccacaaattgtattttctctaacttctagttggtatgaaaaaagtattaaagagtcccctccccaccccgccccagttttcttactccgaggatgaagatgaagtggaaagctttagatagttggtttttcagcctggccaccatggaaaaattatttactgttttatgaaacatgcaattcagttaatttggaggaagctgtttagtaaggggaaaaggacaggatttctagttaggaaacataatcaagtatctgttttaaactttgctagttttatttcttttcctctttttatcctcatttcctttttatctagcaagattatcgtgaagcttctatgaataattttctacattatgctagtgcctttaaacagtgtttgaatatgaatctctaacttgctctgaatatgttgagaaaaaaagttgatttttcaggataagtaattctttttgggtgttcaagatatttttaacaaaaaatttttcagaaattgaaagttggcttggcacagtagctcacacctgtaatttcagcacttcatggggccaaggcagatgacttaaggccaggagttcaagaccagcatgggcaacatagcaagaccccttcctacacagcccaggagtttgaggctgcagtgacctgtgattgtgccactgcatttcagcctgggtgacagaatgagaccctgtcttgatttaaaaaaaaattacaaaaagtctttccaaagctataaaaactttaagctttattctttctctttttccatgatacttattggctcttttaggtttagtggtaactcctaccaataattcttaaaaggaaaatgataattactttttctttttttttttttttttgagaaggaatctcactctgtcacccaggctggagtgcagtggtgtgatctcggctcactgcaacctctgcctcctgagttcaagcaattttcctgcctcaacctcccaagtagctgagattacgggcacccaccaccacgcctggataatttttgtatttttagtagagacggggtttcaccatgttggccaggctggtctcgaactcatgacctcaagtgatccacccaccttggcctcccagagtgctgggattacaggcgtgagcaccatgctcaatggtaactactttttagggatgatacatggtacttagttgtcactgatttttttttgttgttgttcaaaaattattatagtatctaaaatcttgtgaacatgggaacagattgtgaggagaaaaataaataaaagcttgtgattatttcaaattcttatgatctcaagtcttgactaaaatgtgtgctttacagggattaagattaaagtgaagctgtttttttccctcataatgtttctaacttaaatttttaaggggcattaatacttatgaaattgatagttttctcatcttttgattactcccctcaattcatgcttctgaaaaatgcattctagctaaaaatataagaatgcttattaatcataaaatatattggtacttgtttagtgtagaactaagggatttagatatatcctttaaaggcaaataatacatttgatcattaaatggaataaattgctttcagagtagagtagggtttattcttgggagtttgaagttgagcacagaggcatggatataagaatggattcacatctatttcctgtctgggtgctttaggaatttaatcctttttaaaactggaactattgggaattttattttttttgtgtgaggaatcatgaaaatcccatgtttaagtacatatttttctaattagattagttgcgttagtgtcaaaaatgaataaactagttttaggtttcctacgtgttttgaatattttatgtatatacatactcttactaactatgaatacataaattagccaacaaatgttagtcagaattttattttgattggtcaacttttaaaactgtgacttttactgagtttctgtctttatctttctagatgttatagtgaaatgtctaaggagggaaactgaaatgaagtggtgtctgccaaatgaataactttacttgtggtattgcagcacagttacttcttttttaaaaaaaaatttttttaattttaagacagggtctcactctgtcacccaggctgtagcctccacctcctgggctcaagcagtgctcccacctcagccttccaagttgctgggaccacaggtgtgcaccaccaggcccagctaattttttttttttttttaactagagacagtgtctccctaggttgcccaggcgtgtctcaaacttctgggctcaagtgatcctcctgcctcagcctcccaaaatgctgggattataggcaggagccaccatgcccggcctagttacatttctaacaaagtaattttgagaacacaggtaaaagggatgtgatctgaaaactgtttggtgtgtagaatggggagagaaaaaaggaagcaaattaaattgaaggaggaaatatggtaaatttaatttttgagtttattattggaagaaaacacgccattttgtgcagtataagaatataagcttatcagaatttttaaatattaaggtttgtattttaacccattttcatattagagccatttttttccagatcctgttttcagctgtatctattaatggggtgaatttactccaggctccctggttgttcattaacctagtagggcttgactactttaataggttcaggaaaatgtgcttgttagttgaaactgctcatagctggaattggaacttttctgcagtccttccttgtctgtggggaatatgtcctaagaccctctagtggatgcccaaaactgagcatagtaccaaacactatatatacagtcgtgtgtaactttatgatggggtatgttctgagaaatgcgtcattaggtagttcgatcatgcatacatcatagggtgtacttacacaaacctatgtggtatagcctgctacatatctaggctgtatgatttagcctgttgctcctaggctacaaatctgtacgacatgttactgaactaaatactgtagacaattgtaacacaatagtaagtatttgtgtatctgaacagacgaggtaacacgtggcatgacatcactaggagataggaatttttagtctgcattataattttatgggaccagtgttgtatattaattataatttataagtctttatgtatcttttatatggaaacccaaatgtcccagcaccattgctgaatattatccattttccctacttgatctacaatgtcagtattaagtggcatatagcaggtttctgtatattctgtattatgatcttatggcaccactgtcatatatgtgatccatccttgactgaaacatatgtggcacatgactgtactatgttttttcctatacatacatacctgtgataaagtttaatttataaataaggcacagtaggagattaataataataactattgtattgtcagggttctctagagggacagaactaataggatagatgtatatatctacaggggagcttattaaggagtattgactcacacaatcacaaggtgaggtcccacaataggtcatctgcaagctgaggagcagggaagccagtccaagtcccaaagctgaagaacttggagtctgacattcgagggcaggaaacatcgagcaagggagagagatgtaggctgagagactaagccagtttagtcttttcacgttcttctgcctgcttttattatggttgtgctggcagctgattagattgtacccactcagattgagggtaggtctgcctttcccagtccactgactcaaatgttaatctcctttggcaacatcctcacagatacacccaggaacaatactttgcatccttcaatcaagttgacactcagtattaaccatcacaactattaataaatagaacaatacagcaacatactataataaaagttatgtgaatgtggtctctcaaaatagcttactgttctgtattcacccttcttataatgatgtaagatgatacagtgccgatgtgatgatattaagtgaggtgcatcacgtaggcattgtgacacagcattaggctactgttgaccttctgtattcccgaatctgtgtcagtcattttaggggatcccttgttgctcatgggtttctggtgcaacatattgctgtcagtggagggaaagggggtagctatgaaagattcggtaaaccatgttttctgttcatgtctttcacctacaaatttaatgccttttaaatcttaactaagcacttatcttgctctggctgtaacttttgctgtttgaggtgtggcagcaaaactagcatgaataatttctttttcattctttcgcagttttacagatagaagactcattcttaccgtagatcttagcagcctcagcatacgattttttctttccttattaagaagtttcactttttcacttaaatgaagcacattaaaacttcactttggcatatccaaattgccaaatgtcactactcttccactttggggccattgttaagtaaaataagggttacttgaacacaaacactgtgatactttgacagttaatctgataatccatatggttactaagtgactaaagggtagatagtgtgtatagcatggatacactgggtaaagggatgattcatgtcctggatgggatggagctggactcgcaggtcaacagaaaatttcatcatgctacttagaatggtgttgtatttaaaatatataagttatttaaattggaatttttcatttaatattttctgaacttggttgaccatgggtaactgaaaccatggaaagcaaaaccatggataagggaggactactgtatttaccagatgagttgatttcattttgagaaaagttacttgtaactttagtaggctgacttaacatgttatgataacaggattatttagattataagagactgggcaggcagatattacactagtcttgtactttgctcataattttatagagcactttgatgtatatttatttcatttaatgtttttgacatctgagaggtatatattctcatagataataaaacccaaacgtcccagatgattaagagacttgctcaatttgacactgttagtcattagaagagctagtcttaaaaaaagaaaagaaggccgggtgcagtggctcacgcctgtaatcccagcactttgggaggctgaggcgggcagatcacgaggtcaggagttcaagactatgctggccaacatggtgaaaccccatctctactaaaaatacaaaaattagccgggcgtggtggcacgtgcctgtaattgcagctactcaggaggctgacgcaggagaatcgcttgaacccgggaggcagaggttgcagtgagccgagatcgcgccattgcactctagcctgggcgacagagcaagactctatcttaaaaaaaaaaaaaaaaaaaagtattctgacttcaatccattttttttctctaactgcaaccaagataatttatttactgagtattttcagctattatgataaaagacataaatgtgatttcttccctaattgagcttacttcatagtttgagagtcagactagtaaataattaattaaaaagagtatgttaggtgctctgaaagggaaagtatagtttgatgaggtgggaaacaaagaggagtccctgtgtgccaggggatcaggaagggcttttgatgggaggtgaacttgctatcaaaatcagtcctgaagtcataaaaattagtcatgtaaagattaaagggctatgttggaggaagaatgttccaggcagaggggagaataccatgttagaagttttggaggtaaatgagagcttggtgtattgaagaattgaaagaaattcagtatggctggattatagagctagagaagagggaaggagagggaaaggaggtagctatgaaagattcggtaaaccaaaagctggatatgataaggtcctaaattagtgacaactaggaagagaaaaagagtactgcaggtatcacaggctaaataaatgtgttagaaatattttagccaacaagtgatattttatacagttattttacatatatatatatctcttgcgatttccttgcacggtaaagggcacattatcctaaaagttgaaaataggttaacagtgcactgttcatcatggtgaactctggagatcagttttggctatcagattcttttgctatcattcctagcatgatttctttactctcgcttgttgaggttaattttgctctaaagaattctaaggtgggtcttggacctaatgttttctttttttttttttttgagacagagtctcgttctgtcacccaggctggagtgcagtggcgcgatctcagctcaccgcaagctctgcctcctgggttcacaccattctccttcctcagcctcctgagtagctgggactacaggcgcccaccaccgcgcctgactaattttttgtatttttttagtagagacagggtttcaccatgttagccaggatggtctcggtctcctgacctcgtgatccacctgcctcagcctcccaaagtgctgggattacaggcgtgagccaccacgcccagccggacctagtgtgaatagagggtagataactaagtgaggattacccttgctaggccttagtaactgttgtctagagaagaagatgttagggaaaagcaagggataaagtgggtatgaaggagtgtaaattatgacttgttgctatgatatttagttattggtttaatttttacatgtaagcttgtcattgatatactgaatattaaaatatttgggtgtggtggctcacacctgtaattccagcactttggaagcccgaggcgggaggatagcttgagcccaggagattgagaacagccttatgcaacataacgagaccctgtctataaataaaaaattagcctggcatggtggtgtgtgcctgcagtcacagctactcaggagcctgaagtaggtggatcacttgaggccaggaggttgaggctgcagtgagccatgattgcaccactgcacgccagcctgggtgacagagcgagaccctgtctctttaaaaaaaaaaaaaaaaaaaaaagatatttgggaaagtggccatttattcaatatacattttgtgcccagtgcttgaagtataaaaagactcaccattgttaatagggaagacgggcacacaatatcaacatagtaaaataattgtttcatgataaaaataaacagtagaagataataagttcagtttgggatatgttgaaattgagatgcttatgggatattgaacacctgctatgcaacaagcactaagctatatgctggggctacaaaaagtaaagaaaataaagtccttttcctcaccagttcatattctggtggttggaaacagacattaaagaaatgattataaaaatgtcagcgtaggccgggcacgatggctcacgcctgtaatcccagcactttgggaggctgaggtgggtgggtcacctgaagtcaggatttcgagatcagcctggccaacatgatgaaactaaaaatacaaaaattagccgggcgcgatggtgcgtgcctgtaattccagctactcaggagggtgaggcaggaaaatcacttgaacctgggaggtggaggttgcagtgagctgaaatggcgccactgtactccagtctgggctctgggcgacagagtgagactctgtctcaaaaaaaaaaaaaaaaaaaagtcagggtatgggattgacaagtccatagaaacagaaagtaaattagtggttgccagggattcaaggaatggaggttggagaatgactgctaatggggatggcttttcttttttgaggtgatgaaaatgttctggaattaggtagtagtaatgactacataactttgggcctatactaaaaacactgaatcatgcactttaaaagggtggaactttatgttgtgtgaattatatctcaaaaaatgttgggagttggccaggctcagtggctcacacctgcaatcccagcacttcgggaggctgaggagggaggatcacctgaggtcaggagtttgagaccagcctggccaatatggtgaaaccctgtctctcctaaaaatacaataattagctgggcatggtggcgcgtgcctgtaatcccagctgctcgggaggcaggagaattgcttgaacccaggaggcgaatgttgcagtgagccaagattgtgccactgcactccagcctgggtgacagagcgagagtcagtctcaaaaagaataaaataatgttgggagtgaaaaaaataaagcagggttaggagggataagaaaatggtgggggcactattttgtagagcatgatcatagtgatttttgagcctcatttgaacagacatctaaaggaatcgaaggagtaagcaatggagataaatgtggagttttccaggtggaggaaaggcaagtacaaagacatcaaggctgtgaaagtgcttggcatgttcaagaagtagcaataaaggcagtatacctggagcagagtggaaaagcaggagaattgtaggagagaaagggagagagatattaaggtgctagatcatgtaaggactttgggttttatgctgagatgggtgctgaggagtgatgtcatctgaattaggtttttaatgaattattctggctacagtgtagataataaagtgtaagagtaaaagagaaaatcaattaggaggtaattgaagtagttcaggtgagatgattagatcaggattgtagtattggaggttgttaagaagtggtggaattctcgattagaaaagtgagaaagaaaaagacaggattcatttctctgggaaaaaaaaaaaaacaagatatttcagggacatgaagagaggagtagactaaagagaaggcaacaaaggaagaaaataaacaggaattcctgaaagcaggagtattcaattgtgtcagaaattggaaataaatcaattaggagtttattgataaccaagcaatttgaatggggagtggttggaacagaagccaagtagtagttggttgagtaataaatgtgaatagaggaagtggaggcagctaggaagacaactgtagtactaagtaaggatggttgtgaggggaaggagagagtggaaactagaaaggcatatataagaataggaatcttgtggaatgagggagttgaaaggacaggaattattaatagaggaaagttttggaggagcagtgaagaaaaagggatctagtgcacatggttgcttcttttcttgagcccaaagaggtaaggataatttttacctgggaaaggaagtatgggaaatttatgtcctatacatttgctgtggagaaataaacagtcatttgccaagaatgatagatacaggatagtagccttaagagaatcatcatgaggaactggggagtaaagctgataaggaatactttgaaaaaaaaaaaaaaaaaaaggctcctgagctactttgaggaagatcttgaattcatagtggtactggtccacaattttgatttttctctatcaaaacttagaagctgtggttcaggaatgttgaagatgagtgcttaggatcattcaggattgggtatgattaacaggatgaatatgatcaaaaaataatggggatggggtaaaggaattcttcaagacacaagctcaggcttcgtcttttccttgaaatggcccccattggtcttttctcttttaattttgtacttttctctgctattgctgccttatgtttagtccattagaatttacgcacacacacatacacacacacccttaagcacttaaacatttttttttaaatatggaaaacgacaaaacaagaacaaatcacatgcagtcctgccatatctagatatgaccactgttaatatgttggtgcttattctttcaggcgtctctatatatgtatacatatctacttatttatacatttctgcataagagggattatacatctgttttatttgcctactgatgttattaaatatagatacaatttgtgatagctgcaaagtattacgtggtaatttatttatttatttttgagacagagtctctctctgttgcccaggctggagtgcagtggcgcaatcacggctcactgtagcctcgacctcctgggctcaagtgattctccagcctaggcctttcaagtggctaggactataggtgtgcaccaccatgctcggctaatattttttaaaaatttttttgtagagacaggatctcgctatgttgccaaggccagtttcaaactcctgagttcaagtgatcctcctgccttggcctctcaaagttctaggattacaagtatgagctaccatgccaatcaatgtggtttaaataacaaaatttagttaattagccaatcctttggtgatggactattatttcattttattttttaactgttataagtcattgtaatgaacatagtacaaatgatttccccctgtactggtatgagtactgttctaagtacttaaatttgtcttttatttctaaatttcttctgctgtcatgtttcaaggtgaatccttcagacttgcattcttttagctttctcttgagaatggatccaaatgaataaggctacctgcatattattagataagaccacccccaaaccatcttgtaatctacagtgttgaggttaagtgcataggctttgaagtcagaacagatttggattcacatctttgctctgcttcttcatttagttgtatagctttaaacttcagttttccagtctattaaataaagaacgttgaaagcataaggctttttttttcattgggagaactctataactgagatgaaataatcattatttaaaaattttctagctaattaaaatcctttgtggtacagtttaatgttattttccttttctagattaagggaaagtagataaatcttggttattatcttttttttttttttttgaaatggagtttcactcttgttgcccaggctggagtgcaagggtgcgatctcggctcactgcaactgcctcctgggttcaaatgattctcctgcctcagcctccctagtagctgcgattacaggcatgtgccaccacgcctggctaattttttgtatttttagtagaaatgaggtttctccatattgctcaggctggtcttgaactcctgacctcaggtgatccgccacctcagcctcccaaagtgctgggattacaggtatgagccaccgtgcccagactttttctttctttctttctttttttttttttttgagacagactctcactctcaaaatctataagaaaagattttccagcctaggctggagtgcagtggcacaatcttggctcactgcagcctcaaccttctgggctcaagcaatcctcctacttcagcctcccaagtagttgggactacaggcgtgcaacaccatgctcagctaatttttttgtttttttttttggtagagataaggttttgccacattgcccaggttagtctcgaactcctgagctcaagcaatccacccacctcagcctcacaaagtgctgggattacaggcatgcaccactgctcctggccttggttatcttttttttaaccttcataaatgaaatcctatgttcctattataaatcatgtttatgtattaaatatgtatgattataaatcatgttacatgtattcaaagaatatttaatgatagaaaatattcatgattgtatgttacattttttaaagaaacatatcaaattatgatcctagttttattttttaaaaaaacaggcctatagaaaatagactaaaatgttagaatggtgatctgtgggacttgggatttgaagtgactttttattttccgtcttacacttttaaaaaatttctgaatttttatgatatatcacctttatatctcccttaaatcctttatacatcctttttgtctatcacttttataacctaaagtgtgcaaatattaaaataggaatcttcatgtagtagaacattataactgaaacttttatgattatcttaattttttctcatggattttaatttgcagtgtttatatttatggcagccctctaaatcttcttcaagtttttcatttatatgatgcattgttggagttaaaatagaacatatcagccaggcacggtggctcatgcctgtaatcccagcactttgggaggtgggcagatcacttaaactcaagagtttgagaccagcctgggcaataaagtaagacctcatctctaaaaaaaatacaaaaattagccgggcatggtgatgtgtacctatgatcccagctactcaggaggctgaggtgggaggatggcttgagcctgggaggcagaggttgcagtgagctgagattacaccactgcactctagcctgggtgacaagtcagaccctatctcaaaacaaacacagaacatatttctgtattaaggtctgattctgtgatgtgtgtataattctaggattatcatttcctttgtagatatactaaatagaaaaacttgagatttgaacaatttccttgccagtattatcacatgcagcagcttttgatggtggagagacttaacagttaaaaatttccaacaacattaatttttagctatattatacttaattatataattaattttagtagctaatatttgttttaattctttctaatagcctaggtcagtggattcttggattattgcatttaatcctcagaacaaccatataaagtctagatagtatcattactcctattttacagagaggaaaacagactaaaagtaacttgtccaggggcacatagaagcaagcagcagagctgggatttaaatggaggcaatttggtaccaggacaacgtgcacacacacactccgtacttcctactgtgataaatttctctcttggttgggtgagatttgctgaaataatgtatatttaaaggatctagcactgctcttggtaccttgtaggtgctcaattgaattttcttttataatgggcagagtgatctcattgaattaggtggcatattccacctggtagtcaaataaggaatttttatataggtaaactcggatttgaggtttgttgtacagatagattatttcatcaccaaggtactagacctagtattcaatagttattttttcctgaccctctccctcctacccttgacctccaagtaggccccagtgtctgttcctctctttgtgtccatgagtaggagttcttttttaaaaattttttattgcggtgaactgcacaataaatcaatcattttaaagaaaaccctgttgtgcaaccactacctctatctatctgtctggttcaaagccatttttatcattcccagaaggaaaatcctgtgtccatcttcaatctcccctgcccgccatgagcccaacttatggcatccaccaatctgtgttctattgctatggatttgcctattctggatttacatgtgacctcttatgtttggcttctttccctcagtataatatttttgaggtttatccaccttgtagcatgtacttcatttattcttgtgggggaatactgttccattctatggataccacaatttgtgttacctattcatccactgatggacattcaggttatttccaccttctggccattgtgaatagtgttgctgttcacatcctataatagcatatgtgtacatgtatttgtttgactaccaatttttaattcttttaagtataagaagttttcttttttaaaggaaaatggcctttattggatgtttaaaaattctataaaaatattaattaaaaaagaaagtggaggccgggtgtggtggctcacgcctgtaatcccagcactttgggaggccaaggcaggtggatcacttgagttcaggagttcgagatctgcctggccaacatggtgaaaccccatctctactaaaaatacaaaaattagccaggcatggtggtgggcgcctgtaattctagctacttgggaggctgaggtaggagaatcgcttgaacccaggaggcggaggttgcagtgagccaagattgtaccactgcaccctagccagggcaacagagcgacagtgtctcaaaaagaaaatagaaaagtagtatacagtaaagagtactactgtatacatttgtatcatagcatcttacagggagcatggcttggcgctgggcaaatgtttgttaaattgaacttttggtttttgagaaacttctttctaattctgattttgctatcaactatctgattttggagaaatcctcagtttctgtgccctagtttttatttctgtaaagaaatagactaaactctttaagagtcttttaagttctgtgaaagtctgttcccttttttcttttttttttttgagacggagtctcgttctgtcgcccaggcaggactgcggactgcagtggcgcaatctcggctcactgcaagctccgcttcccgggttcacgccattctcctgcctcagcctcccaagtagctgggactacaggcgcccgccactgcacctggctaattttttgtatttttagtagagacggggtttcaccttgttagccaggatggtctcgatctcctgacctcatgatccacccgcctcggcctcccaaagtgctgggattacaggcatgagccaccgcgcccggcccccttttttcttttaataggaatgttttggtactgtatccttttaccctctggaagataggtacttaccagcccttggctattgtaggcagttctttctcattaaatttgcctctggaaagggctatatgatcaagaaagttgggaccactcactgttctcgtctttaacctcttgcaaggtttcttcaggaaagactcattttccatcctcccatcttccccttccatatcttgcaaaccctagtgtagagactgaagaactcaagtgcctatagggcacagacagcataatatcaattaaagaaattggctgaacggtactttaggtaacttgagagtacactaaaggaggcagctccagttttccttgtggatttagtattgctggatcctgtgattcaagagaagccaaaggtctgagatttttatgtaaaatctgatttttaaatgttggcaattaattttaaatgtttttttaaactgtgcaggcgaaacagaacacttctgcagtccaagtacttactataggaagtacaagacctgtagaaaggaaaactgtggctgggtatggtggctcacgggtgtaatcccagcactttgggaggccgaggcaggtgggtcgcctgatgctaggagttcaaaaccagcctggccaacataatgaaacgtcatctccactaaaaatacacaaaattagctgggcgtggtggtacgcctgtaattccagttactcaggaggctgaggcatgagaattgcttgaactggggaggcagaggttgcagtgagctgagatggcgccattgcactccagcttgggtgatagagggagactgtctcagaacaacaacaacaacaaaaggaaagctgtgtattgtgaagtgaaatcagagtcaccttgaaatgggcatgaggtattcatcagattgcctttggaataaaagaaataatgtccgtggaatatctcagtaacacctcctcattgctaacccttttgagggcagaaattatagtttttatttatgttagtagctccaattaatatattaataatagttctaggtgtgttctacacattattgctagtgcttacaactctacaaggtagataggtattaccactgtattataaatgagacagccaaggcttgctgtgataagtaacttgtccaaggtcacacaaaaaataagtgatacatttatgatgaaacctcagttctgactacctttgttctttcattatgacatgctgcctacctcttatttattataaacaatattggtatactgacacaaggatcagatgctttgtataatggttgtagacttttccaaggaatcttgtgactttcttctttttactttatcccccttaatgcaaaaaaagagagattacaataaatacttgaaatgcgtcctaattatctgttacgtatagtcatgattgtgagtttctgatcaagccaaatgaaaatttatgtgcttttaacaatgatattgacaacctctaatactagaacctttatcccctgagtcttaaccccttaattcttccatattttgtaattggccctttaaagataaataggtgtagaaggatttcttacatacctcttaagcatctgcttctagagcatagccactggcaaatggaaacaactgaattctcttctagagcacatttgaatccatctcactaaagcttctcaacttgtgacttcttctgaaaaatttattttggtcttctcattttctattttctttttctctcatgtcagtggaagagattctcaatttcttttctaaggtactttcaatttcctgacttgattctgtgacatactttttctattttccactctctcttttcattactccctttcatgtgtttgttttcctcacaccagtagtagtcaaactgctgttaactatgatttctgaaaaggtacttctgcatttgatataatttcaaaagggccatggtgcttaaaaagaaattagaaaactaaatgcttatggtagtataatcatgtaacagtgtactagaaaaactactttattggccggtcacggtggctcacgcctgtaatcccagcactttgggaggccaaagtgggcagatcacttcaggtcaggagttcgagaccaggctggccaagatggcaaaaccccggtctctaccaaaaatataaaaaattagccgggtgttgtggcgtgcctgtaatctcaactcctcgagagaggctgaggcaggagaatcccttgagtagttccccacatgcatacatacaatgatcactactcaactagatactctaaggagatcctctatagatctccagcgttctctctgagtgtgtctctcctttccagtactctgcattgagaaccccggccatctgggcttccccagactcctagctctaccacttcaacttaagaagcttaagaagactgctgggtggccaggcgcggtggctcacgcctgtaatcccagcactttgggaggccgaggcgggcggatcacgaggtcaggagatcgagtccatcctggctaacacggtgaaatcctgtctctactaaaaataagtatattgaaaattatctaccaccatgtgaaatagtagttgtcattttagtcaggctgtggtacagtgcaatggcacaatttctgctcactgcaagctctgcctcctgggttcacgccattctcctgcctcagcctcccaagtagctgggactacaggtgcctgccaccacgcccggctaattttttgttatgtaaatataattgttttttcctctaggttgaagaatttaggtaatctggccaggtgtggtggctcacgcctgtaattccagcactttaggaggccaaggcgggcggatcacgaggtcaggagatcgagaccatcctggctaacacggtgaaaacccgtctgtactaaaaatacaaaaaattagccaggcgtggtggcaggcatctgtagtcgcagctactcgggaggctgaggcaggagaatagtgtgaacccaggaggcagagcttgcagtgagctaagatcatgccactgcactccagcctgggcaacagagtgagactccgcctcaaaaaaaaaaaaagtatttaggtaatctgcagaagaaggtggttcaggtctttggttgctgttctttcctagactcttcagaaaaaaatgaattaactagcaatgcttaaagaggtagtaaatacaagccaatccattttcattccagctgcatttcatgcttcagagtaatggctgttagccagaatcacttgtgaagctttatacacatatacattctgtgatcttattccctgtaaacccctattcagtagtcggtctgtgatgaaatcccaggcatcttcattcaggttaaaaaaaatatacatatgtctacatgaaattctggtattccctgttgaaaaccagtcttaagttagaggcattctgcagttgtacggaaagtaagggaaacaaagttaaaatggaaaaaattgaattaagaggcagaagtaatgaatttgatcatttgttcattgccactcattgtagacacttatttttgatctctgtaaacatcagcttatatctcaaagtatgaggtctgaatacttgcttgtgggtgatcatctttgtgtagaatagaaaagacaaagtaggaccaggtgcagtagctcacacctgtaataccggcacttcgagaggccaaggtggtagaattgcttgagcccaggaattcaagaccagcctggacaacatggtgagaccctgtctctactgaaaaaaaaaaaaaaaaaaaaaagaaaaaagaaaatattagctggacatggtggcatgagcctgtaggcccagcatacttgggacattgaagtgtgaggatcacttgagcctgggaggttgaggctgcaatgagcaatgattgtgccaccgcactccaatctggacaacagagtgagacaagaagagagagagagagagagacagatagagcgagtgtcttgttgagttcttcagtgttgggtcaaagaagggaaaaaaattgtgcgtataaatagaaaaaaagaaaactaactttttaaggctttaaaaataactgaaagtgaagaccctgagatatgaaaagtgatttttgttaatcagaaaattggtgatttaggtgataatggggtggaagttggaagataggacgtgaggggacagggtatttggattaaatataacatagaaagataacatttttagttcaggtagtaggatattctggtaatgacagaaaggaaaacaagatgggttttttttggtttttgtttgtctaatatttttgtttttcatctctaagattatggtataaaaacaggaatttatgttttagaattgtttgggtagaatcacttaaggtagatgatttgcttattcattcatttgtttatttattaagcacattattgaaatgcccattatgtgccaggcataataatatagtaagtaaaatagatggcattcctaacctcagtgttactctaattgcatagacaggaatgctggggaaagaatttatctttcagccagctattctcctgcctgggacccagctttagctagtcttggctctacaaaggaagttgtaacctaattggaacataatttcttctccgtaaaaactgagggttacaccaaatactttcaccacttctacctctaaaattcttgcttttaatgtgaattttagattaatttagattagattaatcccttaaaactacattcattacattcataccattcttgcatggccctctatatatttcttctctcctactaccttttttccctcatagctctggtgtcttgatacagttttgattggctatttatgtgctttcagtcaacctcactggactgaaagctttttgggagcagactcgggtttctgtgaacatgtgatttactgtgtgtgtacctatgcacacgaaatgaacaaatggtgacaaaattagttttttcttatttttgaaaatgctgttgatcttgtgaatttaatattagactgtctttcaagatcaacaacaaaataatatatgtaaaataatataaattgtaattctgcttgtttcttttcattgatagattattatgtatgtttacaaggacatgattagtttagaaaggaatgattattaaatatatggttatataatatggttagctgttaatagccatggaacagatctctattcagtattggttttataagcactcagcaaaattctgttttaagtatgtgttctaaattttaaaatgaatgtatgttgacatttttcattgcttacattccagaaatgagcttattttactggtaacaattaaatgtgagtttagtaagggtagaaaattggaggaaactggagtctccttttctctttagcagatgtcttagtctgtttgtcagctataacaaaatgccttaggcaaggtaatttataaacaatagaaatgtattgctgatagtctgcagtatggagtctggggagtccaggataaaggcaccaacagattatatgtctgctgagggtttgctctctgctttgaagatgatgctttcttattgtgtacccatgtggtgaaagggccaaggcagtgtccttcaatctcttttataagggcactcattccattttgggagggcagagccctcatgacttacttcctaaaaggccccacctcttaacactattacattggatgttaggttccaacatgaattttggcaggacactaacactcagactatagcaccagacaagcaagcagtcactgtaatttaagcccattagaatggaaggtccataaagacatatttttgtctgttttgttgttgatgtatccccagcctggtgtacatcaggcagtccataaatatttattgagtgaatgagtacatgaataaatgaatgagaatatttactgagctgtcgttcattttatagcaggtacaatgttgtttcttcaccactgatatattcatttattacctcttatttattagcagtgtttctgaaataatattaaaattagaagttttcttgaagcttgttttacaacttagaattattatccagtagctttccttaatatttttataacctcatcaacaaacagtgagtgtctcttgtaagtagcgtactgccgaaccttagtcagagaagacatgacatagttttggtccatgaagggttttcaacccatttggagaagtaggaaatagatacaaagatgatttgtaacaacctgaggggtgtcaaaaagatggtacatgtaggaaattaatgttatattcaagtgaaaatttgatattgtttatgtatattattcaacttttaaaaactttgcattaaagtatggaaaggaagcataagtataccattgttttaatggttatctttgatgagatcatgggcaagttgaatttttatttcttacgtgtatttttaaaagcaagcaataactctaaataaattaatctaggccaggtgcagtggttcatgcctataatcccagcactttgggagattgaggcaggaggaccacttgagcccaagaattggagaccagactggacaacaaaaggagaccctgtctctataaagcacatacacagagacacacacacacacacaccaaaaacctagctaggcatagtggcacacacctgtggtcccagctactcgggaggctgaggtaggaggatcagtttaggcccgggagcttgaggctgcagtgagctgtgatcgtgtcactgggtgacagggcgaaatcctgtctcaaaaaaaaaaaaggcaaaactgtagttctaggacagatttgatataaaaaacaaaagtaaagcaggctatttgtttagtaacatcaattgctagacctctctcctgtttatgtattcacttggaagtcccataggcatccaaattcatcatttaaaactgaattctctttccaggtttattcttaactcctatattctctatcacaggaaatggcaccactttttatcaattttcccaagccagagttctatgtgctacttggaactctcctttttttccctctcccttccccaccgtagccagtgatccaatttagttcatccatttaaacagctttaaattcgtagcctattgactatttcactgccactgccttggttcaggatttcattatttcttgcttaggctattattgtaaaaaccttcttactcatcgccatctctaggacctaatctattctctgtattcctggtaggatgatcttcctcaaatatatgtttgagtttatcatttctttgcttaaaaccctcaaaggctccctgtgtgctgagggataaaacccttactgcttagcatgatacacaagccctgtcataatctggcctcaccctgcctttagtagtttcatctcatgttactgcttgtaacttccgtgttctgagtaactgagttacctaataacctgagatgaaaatactctttttgttcaggtttgcttttatagtttctccttccttttccccagtctgtctgctaaatagccatttcaatattcaaggttgacttctggtgttacatcctctgtgctgccttctcagatcctccacagataacattaaaggttccctcttctccagttgtgtaacacttcatactttattaaagcacatactgcattattttaaacttgactcattttattatctctagactgtgaactgcttaataagggtgactttcttttgtattgtgtccctagatcagtgcaggtgctaaataaatgttgaatgaatgtttaattactgctttgtcaggttgaaggtgatagtgaagaggagctggcatagacaaaaatacttagcccctgtgactgtggcaaataagatgtcaaacaagtaattatatgaccaagagaagactcatggtatgtgttgtaaccaagattctgttgcctttttcaactaaaatatttggttttgtttgattttaaacagaaagtgtagcaaaagtgagagggagaacaaggtagattggtcttttctctcttttctttcttttcttctctttctctcttttttttttttcttttgagacaaggtcttgctctgtcacctagcctaggatgtagtggcacaatcacagctcactacagccttgacatcctgggatcaagcagtccttcagctctgcctcccaaaatgctgcgattacaggcacgagccaccacgctcggccctagattggtttttgattgccagatacctaaaaatgaagacatgaaataagtttgtttactctgatagattcatttctttgcaaattgagatcttataatatgaagctacagttacatagctgaattttttgaatccgtagtaattaataaattcctaatgaaatgtatgcctgaatgcactttttggaacaatcttgaacctacaaaagagttgtgaatatagtgcaaataatttattgctttttttctgaatcatttgagaataagttgctgacatgtttcctcattgcctcccaatactttggtatttccaacaaataagaatattcccttatgtaaccacaatatagctatcaaaataaaaattaacatcaatacatttttttcaccttgtccttagatcctatttgggttttgcaaattgtcccagtaatttcctgtatagcaaaaggatccagtttagaattatatgtccatttagttgtcatatctctttagtttctttgaatctgaaatcattccttggtgtttcctggacttttatggttttctttttccttttttttttttttttgagacagaatcttgctctgttacccaggctggagtacagtggtacgatcttggctcactgcagcctcctcctcctgggttcaagcaattcttgtgcctcagcctcctgagcagctagggctataggcacccaccaccactcccagctaaatttttttttttttttttgagatggagtctcactgttgctcaggctggagtgcagtggcgcgacctcggctcactgcaacctcctcctcctgggttcaagagattcttctgcctcagcctcccaagtagctgggattacaggcacgtgccaccatgcctggctaatttttgtattttactagagacgacgttttgccatgttggccaggctgctctcgaacttgtgacctcaggtgatctgcctgccttggccttccaaagtgctggaattacaggcatgagccaccgcacccaacccatgctgtcttttgtgtccttttgatatgcccccgtaattctttgagtactttcttacctttagcaaaacaagacattccaggttcatcttgtattttgcctgtcccagccctgatactatttctctgaaaagccctggttacttttggggtgctgcttctcctaggacctttcagaggacagaagctagggaatatatgtatatttatatgtctgtacacacacacacaggtatatatacacatttatacctatatttttctatctgtacatattgactgatgagttcacatcagtacctcccgttgcaatgcaataccgtagggttccttcttcttttctctctctgtttgtaactcactgtttgacaaacttgatttcctttcatcttattgagaaacttgatttcctttcatcttactatgtttacttatttgatcaatctcctgttgtaaccaatctcccattgctactgcctcctgctttctgacacattaataccctaattacccaacttggcctctcatagcttgcctcctacatggatgctcttgacacctggggctgtcctcctgctctcctgtgaataccctccagtctacttggtttcttactccccactttgggcagccctactaggtagatagcctcctatcttgctcatcctgctaggattttgaatcctacctaaaactgccctttgcttctgctccctcaaccccgatagatgtcttccctaccccatttgaactccaacaccccatgccaggctgcctatctacggaaatgccctctttagtcagtcttctactttcccaccgtaggcaacccttctacacagatgccctccttattcagctcaggctccaaggcctcacatgccctcctcaccctgcttggattgtaactccccgtgctgggctccccctctcttgcccagtgaacacactatttatacctgccgggtaacctctgataaccaaccttaggcaatccttctatgtggacatcctcattactacttaggttatgataccctctgttggttgccccttgcatggataccctcctcacccttctctggctctggcattttatcctgggctctccctgctcactccacagagatccttctcattctattcatgcttttactccttgggctaggctgtccatccatatggagatttgcgttctgtttgggttcccacctcccaccctaggcagaccccctgtgcatcagccttctttcttgcgtggatgctgtcctcatcccacctcttgggcactaacatcccaacctgagccatcctcccctgcacagatattcatatattcttcaccctgcttaggctctgacaccacacactaggctgtcctatatagatactttcttcatgttgctcagactctgcatctagaatatctcttgcccctctcatccactcatttatgtcctcctcaccctgcttaagctctgaaatcccttcccaggcctccccctattctctataggtatccttccccctcccctctaggcttctgataccctcctttgagccctcttattcctcttggactccatctgagtccaaagttcttttttttttttttttttctttgagatggagtctggctctgtcacccaggctggagtaagtggcgcgatctcggctcactgcaagctccgcctcccgggttcacgccattctcctgcctcagcctcccgagtagctgggacaacaggcgcccaccatcacgcccggctaatttttctatttttagtagagatggagtttcaccgtgttagccaggatggtctcgatctcctgaccttgtgatccgcccgcctcggcctcccaaagtgctgggattacaggcgtgagccaccgtgcccagcctcaaagttcttaaagctctattgaaaaggtactcttgtaagatatctaaaaattataaataaaccataaatgttttactcagtggtgtatggattcttgataactagagagttttgttccttctaggatagactcaagaaatttcttcagaaaataacaaagaaatttaaaatataatcagaatagttaggtgactggtatattccattctgtctttcatgctaagaggttatttagagaacaattttcttttctttttttttttttgagacagggccttgctctgtcacccaggctggaacgcagtggcacaatcatggctcactgcagccttgacctcctgggctcaagcagtcctcctacctcagcctcccgagtagctggaactacaggcttgcaccacctcacctggctaatttttgtatttttttgtaaagacagggtcttgctgtgttgcctaggctggtctcaaaactcctgggctaaagtgatcctcccaacttggcctcccaaatgcctggattacaggcatgagccactttgcctggctgaacataattttaaagtttttgagtgaaaaataatacctagtagaaaaaagatatgttatactatattaaattgtctgtggaaggccgggcacggtggctcatgcctataatcccagcactttgggaggccaaggtgggcggatcacctgaggtcgggagttcgagaccaccctgaccaacacatggagaaaacctgtctctactaaaaatacaaaattagctgggcgtggtggcgaatgcctgtaatcccagctatttgggaggctgaggcaagagaattgcttggaccggggaggtggaggttgcggtgagctgagatcgtgccattgcactccagcctgggcaacaacagcgaaactccatctcaaaaaaaaaaaaaaaaactctgtagaactcaagttagttttcttcttccccaaattgatataatttatactgctgtatattatttaaaattactttaaaacactagattgttttaggaaaacagtaattaaatacagcctggcagaagtgctatgaataagtaaatatgtggcagcagactagtaaattggcttaaacttagaaattgagaaaaatttgttaagacagagcattacctaccagttattcttggactgcatactcttttagaaactgaatatccagtggacctgcagccagtacattttttccagtagagatgccaagtatgatgactgtcaagcttgaagtgtttttaacaaaatgaatgctgtctctcttcaatgcagaacgatgttggcacattgtagatgccaggcattttgttttagaatatttaatgtgaaattataaccttggaatttaccagctgattgagatagttaatggagaggtggaagagtaaggcatttcattcccaaaccattttctgaaggttttttctaactctttcagattccaagagtagcttcacatttagaggttttttttaaagtaaaatctaatatttaaaaaaagattaaaatgtttagaaatggatttttcaggattataatgtttgcatttcatatcagagagcattcattgtttgagtaactaatatctgttgtgagcattagtttacttcttgttagatttttaaagcattcccaacacaaaggaacattcttttttaccacagatatttatttctctttagctgcttacttgacaacgaaacagaaacatcttatttacggagcttttttccccgtttttattatccacctctgtatagatgcaagtccatagtattagttgtacaactttattttactatttgaaagtaaataagacagtcttgagaaaagtcataaagtagatgggctctctctgactattttgatttttactctctgacccgaaagcagttgaacaccaaatgccagctcttaggtcaacaagggtgaggtagggaggtagggatgaaaattctaagaaagaataagaacttagacttcttttcaagagatcaacttatttaagccttgtagcatctctgtgaggctgtgctctatccgtgtatagccctaattttgttgtatatattttatttgattatatacttcagtaaaaagaacacctgtgaacccattgtgtagctcagcttatttctactcctcctgtctcccatcaaaggaagccgctgtcctaaactttatcatctttctcttatcacatgtgtttttctttttttactataatacagatatcacattctttattgataaaacctacctcataggattgattgttttgaggttaaatgagaaaaatacatatactgagcctggccctgcaaagtgctcaaaaaatagtagctgtaattatgttattaatgttgttattttgctgagtgagtacagcatgaaaagcatgtcttttcccagctgtttcctgtggcttatctccctgcactcttgaggtcttttcatctcttcctggaatgaccagtaacagtaaagcagtagagaaggggatttgggtgatcagctctttggacatagagtgcccaactgagaagaaacaaacaaataaaaaattaagttgccctattaaattaccaatttttttcttctctctcactgtcctgtgcctcagaataggatttctgcctactttaaatttgacccactgtagtgaaattcttccaccctcttgtagacagtgttgaataataaaggattgaattaacccagaaataatcagtgacataaatggatctattatagtttacagaatgactaaacaagccaaccagtcagtgcatttttacattgttttcctttccacccaacattgggaagcattaatttattttcaatatctgaaaatgttgatttcattcttctatttcctttttccagttgccctgggctctatgagaatgcaccagcatgggacagattcttgatcttctgaacttgcttccctttctgcctatctacttttcttatacacatattaataatttatgttaatggagttattatatcgcacttgccctaattctactacatggatacttaagcagtgcacttaccgtggcattttggtcaactaaaatttttaatgaaatttaggtgagttgattacacattatcgcacaaattattagcagcattaatagaaaaaatatatcagaaaataatcaggtcaggcatggtggctcacgcctgtaattctagcactttggaaggccaaggcaggaggcttgcttgagcccaggagttcaggaccagcctggccaacatagcaagaccgcgtctctacaaaaaaattgaaaaggtaactgagcatgtctgagaaaaaataaataaaaagaaaataatcaccctagtcttggccgactgaagaaagagttccttagaacacaaaagtaaaatcacttctagattaaaaaagagagagagagagaaatagagtgagtacatgtaagtttattgcacaagagcagattttaccagctcttacattaatccttgttaagtttcatctccttcctttgggcagatattccagtctttcatgatctgtgatgaattatgacataagatttaatcccttttaagcctatgtcatttgaaaagtcatatctttgttcaagttgtgatataaccaccttcttccagattgaacctatacattttttgggtactgttgtttagaagtcatctattttattaagtctatatttcttcttcttgtttacaataacttataaagatttttatcacatattttactgaatttaggataactgcctgcagcattttcctgatcctctagtagaagagccttaaaagacaaattagtttgcagcttggccttctttatatatagaagctatgtgaagagagatggttttgtccatgaagtttattagagcactgttagataccctgcttgttcttgtctaattctttcttgtgcttcttctattactctcttcctttaaaaaaaaaaaaacagctttattgatatataatttacatactataaaggttacccatttagagggtacaattcagtggttattaatgtaaatacagagttgtgtaaccattgccatttttatcactccaaaaagaaaccttatctaatacccatatcccttctctctcactttctctcactctcttttctctctcatctaagtgattttgcttttgttttctaaggaagtctttcctcagaagctgcctttccattagggatttcccattctgtttcttcgtatcttgtgtttataaacctggaatttcattattctcttatatttctgaactgatttaaaagataacataagaaaaatagatactgtggcataacatgaagtagccggcacttatttaggactgtcattttcatagatttaaagtacatatgggccaggtgcagctcatgtctgtaatccaggcactttgggaggctgagacaggaggatcacttgagtccaagagtctgagaccagcctgggcaacagagggagactctgtctctacaaaaagtttttttaaaaaaattagccagtgtacatttgtggtcccagccactcgggaggctgcagcaggaggatctcttgagctcaggagttggaggctgcagtgaactttgattgtgtctgtatactccaacctggatgacacagtgagaccctgactcaaataaaataaaataaaataaaataaataaagtgcatatgctcttattcaggatttctttcattggctagtggagactgtaaaagcatttaatttagattgaatttagggttgaatagcagtattaatagcataatttatattcctttaatctttcggtatcccatgggaagcagatttaggagaaaggccagtggctgtgttcagattgtatggttatagtttagagggaatatctttggggtactggggtaaaagaagagtttaaatgatgatttaagtcttagagaagttatttaaagtagcagaaccaaaccagttatgtctgaaataaaatcctgtgctggtaatgactatatgaactgtagcttcccttggataggcatgataaacttctggcaggctgacttcttttatttccaaacacttgagtcagttaatcagaaaacatctttggtgaaggaatccatgcttcctataccttccacttgaccttgcattttacttgtttgttttgaggggcagactttggagaggggtggaatataacaagttctgcatttaatttctttccatgtactttttagtaacattactatcatacctctagtggagaggtatgatacctcaactttatacccttctttgggaaagttagagtgtttcagtccacaaagttttgctttgatttgattaatttattttaataattggagaaatggagataaaatcctgattagtaacatgctattagtgattgggctattactaggataaatttttttccatcacataaatcataaatgcatttgggtagatctttttctctttttatcgaatctgtttctttcaaatttcctttttgtttgggaaaaaaaaaaaaaagaaaaaaatagactcgaggctgggtgtggtggctcacgcctgtaatcccagcactttgggaggccgaggtgggtggatcacctgaggctgggagttcaagaccagcctgaccaacatggagaaaccccgtctctattaagaatacaaaattagccaggcatagtggtgtatgcctataatctcagcaacttgggaggctgaggcaggagaatcacttggacctgtgaggcggaggttgtggtgagccaagattgcaccattgcactccagcctgggcaacaagagagaaactacatctcaaagaaaaaaaatggacttgagtgtgtttctctcttatgtctaaggaactcttattttcaacctggaatgagaaagataattgtattacaatgaatatttggtgataatggcatttctgttttaattaggttctccctatctctactccctccatattgtttgaaagatggaagtaatttgctaaaggctttttttttttttttaacagtcttgctttgttggccaggctgaagtgcagtggcacgatctcgactcactgcaacctccgtctcctgggttcaagcagttttcctgcctcagccttccaagtagctgggattacaggtgtgtgtcaccacacccagctaattattattattattattgttatttttttttgagatggagtttcactcttattgcccaggctggagtgcaatggtgtgatcttggctcactgcagcctccgcctcccaggtttaagcggttctcctgcctcagcctcccaagtagctgtgattacaggcatgcaccaccatgtccggctaattttgtatttttagtagagacagggtttctccatgttggtcaggctggtctcgaactccctacctcaggtaatctgcctgcctcggcctcccaaggtgctgggattacaggcatgagccaccacacctggcctcaagtctttttttttcttttttttgcccaaacaaaaaggaaatttgaaaaaaaaaaaaaaaagaaacagattcaataaaaagagaagaagatctaccgaaatgcatttatgatttatgtgatggaaaaaaacagggtctcaccatgttggccaggctagtctcgaactcttgacctcaggtgatccacccgcctcggcttcccaaagtgctgggattacaggcatgaaccaccgtgaccggccgtctacttaaggcttttaacaacattttaacaaactgaaaatttttagtcagggcatattatattctgacagatgctgaatttgccacatgatttgaagatgaacatttcaagcattaggtaacaacatttttccttctttcttttatttctttcattctttttttgtttttgagatggagtttcactattattgcccaggctggagtgcaatggcgtgatctcggctcactgcaacctccgcctcctaggctgaagtgattctcctgcctcggcctcccgagtagctgggattacaggtgaccaccaccacgcctggctaactttttgtatttttagtagagacagggtttcaccattttggccaggctggtctcgaactcctgacctcaagtgatcctcccgcctcggcctcccagtgttgggattacaggtgtgagccaccgcgcctggcccaggtaacagcatttttcaaaagaaacttttaagtttattctttactgtgaatgaagatcgtttaagagtacaacttctaattttagctttctttcatgaccttcctccttatccctatccacatcaaagttaggatatatactttagtgattaactaggaagctcaaagtatttatgaatccagtaagcagttaactagaaatattgtctcttaccatggataaaatgtcttatggtgctacctttgtattttaaagtactcaggcagataattaataatcttcttcaatttttggaattttggatttcttggcatactaggcaagtcccttaaatttcatgcctcagttattttgaaaataagtatacgcgatatgcctctaattgttcttttttttaaaaaaaaaaaaaaagaaggagtttcgctcttgttgcccaggctggagtgcaatggcgcgatcttggctcactgcagcctccatctcctgggttcaagtgattctcctgcttcagccttctgagtagctgggattacaggtgcccgtcaccatgcccagctaattttttgtattttttagtagagatggggtttcactatgttggccaggctggtctcgaactcctgacttcaggtgatccacccccttcagtctcccggagtgctggaatttacaggcatgaccattgtgcctagctctaattggttttttgaagttccttctaacatggattctactacctttagaggatattttgggaattatttctgttaaaaacctatacaataaaggatattttaaaaagttaaaatatattttaatatatataattttatgggcaattatagtattacaaaatatttttaaaagatacagggttctttaatttggaatacaaaagtaatcgtaatctaatataggtatttatgcattatgcagtctgatttaagagtttcctttacctttgcctttccagggttggagatgcctcagagagtaagaagtatttgcttgagccataacattccttttttttttttaagcttcaatccacaaagtttttctttgattagattgatttattttaataattgggaaaaatgaattatgatagtgttgaattaaaatattttctcaagggtgttgggtaaaagagcaggactatactaattgactggagaagccaatttaaagctgatccacagtagtatatgccatttcatatgtaaagggtaagttttacttatactattgcaaaggaagatactggaccatcttgggttatttggcatttcttccattctgtctagttttatccaattttcaatgttaataactttttctagagactatcttgaacataaggaataaagccaagaagaaaacagggacagaactaatgggaaattcatttttcagttcaataagattatataataaaataaaaaataaaaaaattttttttttttttttgaaacagggtctcacccaggctggagtgcagtggcatgatcatggctcactgtagccttgacctcaagcagtttacccacctgagcctcccaaatagttgggactgtaggtgtgcatcaccacgcctggctgattaaaaaaaaaaaaaaaaccttttgtagagatgggggtcactgtgttgcccaaactcgtctttaattcctggcctcaagcaatcctctcaccttggcttcccaaagtcatggattacaggtgtgagccactgtgctcagctgctaatagctctttacattaattttgtgggattgtttgtgaataatacagttctcctcatgagagaaaagacatactcattttgtgcatattagattgttgactgaatctcttttaaaaattgttttctcctctctttcccctccccacagaatctgtctatgatcttctcccaaaggagttacagttacctccatctagagaaacatctgtagcatcaatgagtcagacaagcggtggtgaggcaggctcgcctcctccagctgttgttgctgctggtatgcatttcattttactttattaaagaaaactagggccaatataaatctggccaacatgaacagtgctggcaaaattcatactaaaaagagtgtgatttgagggttttaaaaagaggcattaaaatatgtacttttaaccttaaactttttcaatattattttcttaatgtaattcttatttcttaaaattttacattgtctcatctataaatgccatttcctaaaatggaccttgtcttcaaatatgggaaccagcttaaagttgtttggttgactgtgcttaaaaaggttaaataccaagctgtgaatagaaaattatatttgagtttctgtttaataattaattttaaagacttgcaccaagggaaaatattttatatgatctgaaaaatgactgaagcactcaagtgtcttttatattcatagcatgttactgaaacctttttattatatttaaaaatatatgtgacttcgtagttttcaatttattgaaagtaatggaggacgtcaatataatatttatataaagacattttcttatattgatgaaaaggtatagaaagtaatgtttgaaatttattagacttatttttactcagctctcaaatcatacacttaatgatatacaattggctcaaatttttattttacataaaaataaaagatagacaagctaatagaaaaaagtgttatcagtgacaaattagtatcagtccttcctgtaatgttagtttacccacctaatattggatttatagactgctaagtgtgtttgttttaaaaaaaggaaacatatatatatatatatatatatatatatatatatatatatatatatatatatatatatattttgaagttttatctgtcctaattagaggtttcttgcctaatatgacacctctcatctttaaaaatgatatttaaagtttatcagagcattgttttcagtaaattattttagtttcaaaatgagaacagtaaagtgtaaggttgtggtttaaatgaggatattggtactatagtataacttcagatatatttctcatatgcattaacctatgtaccattaaccttatgtaccaatctttctcaggctgcatagtgcattgctgaagccttcctggttgaaggcaggaaaactttaaatatggcaaagaaactgatcagccctgttcactgttcatgtgttgccagacactttctaacagtttctgtggatttaattgtgaattagtgaactttttagtaatcaaattgataagatgacctggtttgctttatatccactgggttctaaaatggctctgatgatatttttctggaattttaagttttaaatctggttttaaaattgcatccaataataaaatatgacaaagataaaatattttttatgagatacttcactttaaatccacaagtagaaattgactaactgatttcttttgtatcttttgagattgttttttaaagatacgttgaatctatatagaactaaaagtctgtttcttctgtgctttttaacatctgttgacggtagatccagttccttttaaaagctgaaaaaattgttaggtttagaaaaagaacagttcttccttttagataataccaaattgaattttagaaattcttatatatataaaaatatattaaaagttcttgaatttgggtccctaatgaaatattaaccttctccccaccacagtatatttaagaaaaatctctcaagataaattacattgaaagctgtgagttgaaaaatcatgaaaataagaaatctaattaaaagaagtattttgaagtaatgcattcttattatcttgaaattattgacattgtaaagatggcaaagagagtaagaaggtaaactttctagttttgttatagtcacacacagaaagtttatatgatcattaacaagtcatttaaaatctttttcaaaatataaatttagcaaccaatgtagattattctaggattctaatagcttagaaagagcacttcataccttaccattataaacaagagagtttaaatcacagaataattattttaaggaaatcagtatatatcattagaattatatttttatttgacatactaatattcttggtgatataactgtcagagttacttggagtatattaccaagttactcaatgtttttctagccagaaggctagatagatgtctagggaaaggcatattaatttagacttgtatgggtttttaaaaaatctttagcatttttgaaaaaatatgggccaggcatggtggctcacaccagcactttgagaggcccaggccggcagatcacctgaggtcaggagttcaagaccagcctgatcaacatggtgaaactgcgtctctactaaaaatataaaaaatcagccgggcgtggtggcgggcgcctgtaatcccagctactctggaggctgaggcaggagaattgcttgaacccgagaggcggaggctgcagtgaaccaagatcgtgccattgcactccagcctggtcaacaagagtgaaactccgtctcaaaaagaaaaaagaaaaaatatgaaatgtgtaaaaatattgactcttgatatagttaattcttcagagttttgaaggagccggattggctgctctcaggtatgagggcctggtgggaacagacttctagttctgccataaaggtttgtgtttgacaagttttaaattaatttaaattttaaaatttaaagactgggcatatgagtgttcatggacatttttttgttgtttaattttttaaaatgtgtttctcagattcaccaatttagatttttttcctcttcctgttactaagggaataagtaaatatgatgctgctaatccacaatccagaatattgggtaaaagagcgtctatcaagcctttatctgcttctacacaattcatacttttatgcactcccatcaataatatattttagtcctctaatcccagggtcaaggtgtcggggaaaggggcttatttagacacaatttctcccctcttcatggggccaagtgtcagaatctgggaggtggagttcagagtcaccaattttgttatcccatttttttttttaagagacatgttctagctctgtcatctaggctggagtgcgaggtgcgatcatagctcactgcaaccttcaactactgggctcaagtgatcctcccacctcatctgggaaataagtgcacactaccacactgggctaatttttttttttttttttttttttaagagacagggtctgtcacccaggctgaatgcactggtgtgaccttgactcactgcagcctaaaccccctgggctcaagtgatcctcccatttcagtctcctgagtagctgggaaccacaggcatatgccaccacatggacctgggtaatttttttttttttttaaacagagtctcactctgtcgcccaggctggagtgcagcagtgtgatctcagctcactgcaacctccacctcccaggttcaagcagttctcctgcctcagcctcccgagtagctgggattgcaggtgcacgccaccatgcccagcaaatttttgtatttttagtagagacggggtttcattgtgttggccaggctgatctcaaactcctgacctcaggtgatggacctggctgatttttgtgttttttgtagagacagggtcttactatgctgcttctccagggatggtctcgaacgaactcctgggctcaggtgatcctcgaggcttggcctcctaaagtgctgggattacaggtgtgaaccactatgctcggccctggattgtttttttaattttttgtagagttgtcttgctgtgttgcccaggctggtctcaaacccctggcctcaagcagttctcctaccttggactcccaaagcactggaattccaggtgtaagccaccacactgggccctcctcctcatttttaagaattctgtttttgtcccagtggaaagatagttaagccttagatgttcaatatatcaatgaatgaaagctttaaaaatataaactttctgaaccattttgtaagttctcagtaattaaaagagaggccacgttcctaaaacataaaagttatccaaatgaattgatgacactttttggcaaaataaggagtttattaagaagaagtacaaatcatgaaaagattcttttgtttattttttggataatcctatagtatagttatacagaattaaaacataggtattaggagaactaaatgagttatatcagaatttggggcttttgaaaagatgtatggcaggtttggggttttttaaaataacagctttattgagacataattcacctgctgtataatcaaatatttttaatctatgtgcttacagttttaatcattaaatttacttaatttatttaaaatagaaagtcatggactttagtcttcattttaagaaatcaagttactttcttgttctattctacacttgttttgtttggcttcatttgggaatataacattgtgtttattagtttatttcaaaatatatttttctaagtggactgtttgaagtttctttaaaatttttaattcaaattcttgaactaaacaatgaattaaactaggccgggtacactggctcacgcctgtaatcccagcactttgggaggccgaggtgggtggatcatgaggtcaggagttcaagaccagcctggccaagatggtgaaaccccgtctctactaaaaatacaaaaattagctgggcatggtggcaggcttctgtaatcccagctacttgggaggctgaagcaggagaattgcttgaactcgggtggcagaggttgcagtgagccaagatcacgccactgcactccagcctgggcgatagagtgagactccatctcaaagaaacaaaacaaaacaaaacaaaaatgaattaaactataggttttataattcagccagagaatcttaataatgcattaataattctttttttgcatagcttcataatattcatattttggtttcagtaattatatattaatactctttttagaagtaacagtacactaatacttcatagcaattgtgcttttgtttttgtttttgttttttgagatggagtcttgctcttttgccaggctggagtgcagtggcgtgatcttggctcactgcaacctccacctcccgggttccagcgattctcctgcctcagcctcccgagtaactgggactacaggtgtgtgccaccacacccggctaacttcatagcagtttttaacatgtataaagataatacacagtcataaagtgtgtacagtggaaatcttggttgaatatctccacttgttggaccactgtcggtttttaagttcataacttgatgtgaagtgatccatataataaatttttcttttggaagagctttgatatatagtgctttgagttctatgccatgtcacttaataaatctcaagtatgtaacaagtattttctacaaaatttcattgagtgctatttatactataagagagggcactagagatgcaaattaatgtcctataatcaaataagtgctatattctaattcatttcatatctcctaatcacctgaattaaaatcacagaaatttctaaaccatctataataatacactgtacaaaaactgaggtgaagaaaatatgttactcctcctgtaggagacagcttttaaaaaatgaaaatatattatcacttttaagttcctactatgtgacaagaattgtgttaggtaatttgcatgtcatcatatcacaatccttctagccataaagtatctctcttttttcttttacctagttcttactccttgtcattgtgcttgagggaatttggcattgtgtgctatcacttcgattagggaaacgcaagatccttaactaggcaatgtatagaatattgagttgaaaagccatacctcttctctacaagtgtcaggatcttcgaatgggaatttgatttctataataataatttaataaaagtgatttctagcaacaaaattttttatcccattgaatttattataacttaatttacttacgttagaaagtatttacagttatataatgaggattttcttgagttgactaaatttgaggaagaaatttgcctttgattgctttcctgggttaacatatttcagaatttttgccacctaatgtagtatactcttcatgaaattaaaccagaaacccactaacgagaaaggtaattcacctacagatgctgtgagctaaaatgttgtgagttgatcttggttattctttatggccattcccttttttccaagaaaactagaccatttctagaaggaagtcagatcctagttacaaacatgttgcaagcagatttaaaaatctctactcctccttctatcttattatactgaaattacatagtaaatttaaatacatacacttatacatatggatggtatgtatgtatggatttatgctgaagtctgcattattagagagcaaacttgggcctatagccattaattcagaaacaactgctaattgtttgacagttacaaattgacattgccaaaaagcaaacttggcctattattgctttgttcctttaatatttctctttttattgtcctcttaataacacttttataaatattgtgatttattcagtttctaataaataagcatatttttatattacttgagtcaacagaacagcattttgaaactgttcacagattctcattcataagctaaatacttatagaaaatagatacagttactgattttatgcattctgtacaattttgcctaagaaattaatgcatagaagtggacttttttatatcaccaacaagattgaaaatataagcaaaaagtgtttataactaattgttttataagaaaggaacttcacctgtttctggatattttttcctctggaattcagccataaaaaagaatgtaatcttgtcatttatggcaatgtggatggaactggaggacattaagtgaaataagccaggaacagaaagttaaacactgcatgttctcactcatatgtgaaagctaaaaaatgttggtctcatagaagtaaaaagtaagacagaggatagataatagaggctgggaagggtaggaggaaggaagggatagggagaaatttgttgaaggatacaaaatttcagctagatagaagaaataagttctagtgttctataccactgtaggatgactgtagttaacaatactatatagtttcaaatagctggaaggaagatactgaacattcctaacacaaagaaatgataaatatttagataatggatatgttaattaccttgatttgatttctgtacattatatgtatcagaacattatctaccccatgaatatgtatgattattatttgttaattaaaaaaataaaattaaaaaaatcatacatgggccaggcatagtggctcatgtttgtaatcccagcactttggggggccgaggcgggcagatcacttgaggtcaggagtttgagagcagcctagccatcatggtgaaaccccatctctactaaaaatacaaaaattagctgggtgtggcggcgggtgcctgtaatccccagctcttcaggaggctgaggcaggagaatcactcgaacctgggaggcagaggttacagtgagccgagatcatgccactgcactccagcctggcgatagtgagattccgactcacaaaaaaaaaaaaaaaaaaaaaatcatacatagtaaaatggtagcattttttgaatatgagtggaagctacatgagtgttttaaatatttcataattttaaaatcactgggtgcaaatgactatatgaataaaagtgtccaataaactgtactcttaaaaactaacaaatatatgggatatattagatacttgatggatttatatttggcataagtaaggttatattcacttttcatccatcattgcatatatgtatcaagtatgtgtgtactggcagtatttatttagcccactcaggtagaatttattcttcccatataattacagggtattatcatcaactaaattaaatcagaaaatgaatgagaaagcacctcaaagtaccaggtctatacagccattctctagatcaaacttacttacaaacacacacacaacatgtacatagttttatttatttgtttatttttctcacagatgagattaacatgggctttggagtcataaagactgaatttgaatctaattgctatcatatcatatctcctatatagatggactcttgggaaagttaaataaatttctaataatattacccttgtagttagacaataataccaacttcttcttaaggttcttatgaagataaatttgtaaaatagccgaacattttctgacaagtagtaattattgaataaacattgacctccttccccatgtgtttctaacctcctttgttagtaaagtttttttttttttttttttttttgtcatccaggctggagtgcaatggtgcgatctcagctcactgaaacctccacctcctgggttcaagcgattctcctgcctcagcctcccaagtagctgggattacaggcacctgtcaccatgcctggctaattcttgtatttttagtagagacagggtttcaccacgttggccaggctggtcttgaactccggacctcaggtgatccgcccacctcagcctcccaaagtgctggtattacaggcgtgagccaccatgcctggccattagtaaggtgttaaaaaataggttctctttgtaaaaattagttttgaactttatttttactttttttctttgcattctcacccagtctatttttggtcttattttgaagtttcgcacaccagtcaagatgtatatatatgtgggccatgggatatactttctgactttgttattctgtcatgttgacactctctcagtgggaatctgcattggtctgttttcacactgctgataaagacatacccgagactagaaagaaaaaaaggtttaattggacttacagttccacatggctagggaggcctcagaatcatggcaggaggcaaaaggcacttcttacatggcagcagcaagagaaaatgaggaagaagcaaaagcagaaacccctgataaacccatcagatctcctgagacatattaactatcacaagaatagcacgggaaagaccagcccccatgattcacaacacatgggaattctgggagatacaattcaagttgagatttgggtggggacacagccaaaccacatcattctgcccctggcccctccaaatctcatgtcctcacatttcaaacccagtcatgccttcccaacagtcccccaaactcattaactcatttcagcattaacccaaaagtctaccagtccaaagtctcatctgagacaaggcaagctccttttgcctatgagcctgtaaaataaaaagcaagctgattacttcctagatacaatgagagtacaggtattgggtaaatacagctgttccaaatgggagaaattggccaaaacaaaggggttacagggcccatgcaagtccgaaatccagtgggacagtcaaattttaaagctccaaaatgatctcctttgaatccaggtctcataaccaggtcacgctgatgcaagaggtgggttcccatggtcttgggcagctctgcacctgtggctttgtagagtatagcctcccttccagctgctttcatgggctggcattgagtggctgcagcttttctaggtgcatgatgcaggttgtcagtggatctaccattctggggtctggaagacattggccctctcctcacagctccattacatagtacccagtacggactctgtgtggggtctccaaccccacattttccatctgctttgccctagcagaggttctccgtgagggccccacccctgcagaaaacttgccagggcatccaggggtttccatacatcctctgaaatctaggcggaggttcccaaatctcaattcttgacttctgtgcacccacaggctcaacactacatggaagctgccaaggtttggggcttccaccctctgatgccacagcttgagctgtgtacattggcccctttcagctatggctggagcatctgggacacagggcaccaagtccctaggccacacacagcatggggaccctgggcccagcacacaaaaccgctttttcctcctgggcctctgggcctatgatgggaggggctgccacaaaggtctctgacatggcctggagacattttcctcatggtcttggggattattaacattaggcttcttgctacttatgcagttttctgcagccagcttgaatttctccctagaaaatgggtttttcttttctgtcgcatagtcaggctgcacattttccatacttgtatgctttgcttcccttataaaactgaatgcctttaacagaacccaagtcacctaatgaatactttgctgcttagaaatatcttccactagataccctaaatcatccctctcaagttcaaagttccacagatctctagggcaggggtaaaatgccggtctctttgctaaaacataacaagagtcacctttactccagtttccaacaagttctttatctccatcagagacctggaccttattgtccatatcgctatcagcattttgggcaaagccactcaacaagtctctaggaagttccacactttcccacattttcctgtcttcttctgagccctccaaactgttccaaactctgcctgttacccagttccaaagtcacttctacattttctggtattttttcagcaacaccccactcctggtaccagtttactgtgttagtccattttcatgctgctgataaagacataccccagattgggaagaaaaaatgttcatttggacttacagttccacatggctggggaggcctcagaatcatggtgggaggcaaaaggcacttcttacatggtggcagcaagagaaaatgaggaagaagcaaaagtggaaacccctgataaactcatcagatcttgtgagacttattatctgtcagaagaatagcacaggaaagaccagccgccatgactcaaataccacctcctgggtccatcctgtgacacatggaattctgggagataaaattcaagttgagatttgggtggggatacatagctaaaccatatcagaacctttgtatataaaaggaacattgatagaggatgatgaaatcataggaaagaccgacagtttctgaaggactaattctataaagtctgctgtttaagagttcttaatagtatttttttaatgaagtgatttaagttgcatggttaatgatcaaaacttctggtagaggctgggcacggtggctcacgcctgtaatcccagcattttgggaggctgaggctggcggatcacaaggtcaagagtttgaggctagtctggccaacatgatgaaaccctggctctactaaaaatacaaaaattatctgggcatggtggcaggcacctataattccagctactctggagtctgaggcaggataatcgtttgaacccgggaggcggaggttgcagcgagccgagatcacgccattgcactccagcctgggcgacagagtgagactgtgtctcaaaaacaaacaaacaagcaacaacaaaaacaaaaaacaaaaaaacttctggtagagcaatttatgacttctggttttttgtctaggcagtttattttgtctacgattggatctaacgtacactttactccagacccaggtctaaaacctgattgattaaatcagaagtttttaatgatgctgtaaatgattttttattattgtttaatcatatcttaaaaaaaacaaacgtagggctgggcacggtggctcacgcctgtaatcccagcactttggaaggttgtggtgcgtggatcacctgaggtcaggagttcaagaccagcctggccaacatggtgaaaccccatctctactaaaaaatacaaaaaattagccagaggtggtggtgggcgcctgtaatcccagcgactcgggaggctgaggcaggagaatcacttgaacccaggaggcagagattgcagtaagctgagattgcaccactgcactccagtttgggcaacagagagagactcggtctcaaaaaaaaaaaaaaaaaaagtaaaaacattgaagtagaattggcaggaatgcctttattttttaatctaaaatatttaaaatgtattgtagcgtattgaagtgtccttcagataatatcccttggaactttttttttctctaattttgaagtttagtgatactctgtttttatcttaaagtgacattatctttcagtagttcagtgtttgtctctgtctctctctctttttagcctatacttcctggtatatttggcagtgtaataaatgtagctgtcagctagtataattattcccttttgtgtttaaattattggagatagaagattacatctggatattagtctcttcattcagtattgacaagtgatggtatccagtggtacttaaatcattggatgatggaaaacatctttttcttccattaggaaagaattttacatggacttaaaaatcaaagtatttaatgtgtatatctagtacatgttttatacactgtgcttagatcctttgggttgaatttttgtttgaatagaaaaaaattttgtttggatagaacaaaaaatacatttaaaacattgctctaagtttcaggataagcattttatttttcagggagcactctttagtaaatattatatgagtgtattaatggtactctgataaggtagaaataattatttaaggagaattcagattaaaaactggagagtaattgttttataacattagaaccctgaatggcaatttgatgaactggagaagaaaaagatgtctgcaataaatcagaaacaaacccttcagcttcagcagtagtgctcattattttttttaaaaaaatagagcctctaggatcaaacatattatacaaagtagcatgtatcattaaaagtataaattggtatcctttttaaggggagtataaagaagtatgtaggagtcagtgtggtctgaaaaatggaaaggttattttgctgctaaaatataggtttttttacagtgtaagtgcattgctcagaacatatcttcttccacgcttcaaaagagtttgggtaagggaacagcctgaaaaacacctgaaagagagaattctggcttatggattagagagcatctataaacagaacaaattggtgaataagagttcacaaaaattttgtctaagaaatttccccacatgcattcagaggttaataattaaattttttgaagttcattttaaaacattgcttattttaacatgtaaacgtatgttgggtgggaaaagtacaaatgggagattgaaactgttttaatcatgtaaatgatcagccctacaatttttgtttttttaataatctggaatgcttattttatatgctgggatgctagttgttttttctattaatacacttaacttgcattctagcttcgccattcagagacaggcatcgtgtggtgggttgtgtgacagtgtctgtcaatagtgaagacaaatagtgccagagacacttaacccatccaatctcacccagggtataggtcggtctcgttttcagacttcttcataagtccttctttctttctctcttcctttcttactttttgtttgtttgtttctaaatagtggattgatactgattgaaactaaaactttttgtaaagttttaaactttgcattaatattataagaaaaagaagaaaagtagaaaatgaaggttggcatgtaaggtgtcgacaaagcaggtttgcagccactttgtgtgttctagatatttcaatctcttggcaacatgagtgttggccttacagcttttttctctgaatatctttcttctttaatctgaaaatatgtccttgtatctggtgacttttatcagatgagaacttcagagttggtcattgttaccagtaagaaaaatataatgcttaagaagaaataacgaaggttgaacattatgtgttttagatcagaaatagtttctggccaggcacagtggttcacgcctgtaatcccagcactatgggaggctgaggcaggcggatcagctgaggtcaggagttcgagaccagcctgaccaacatggtgaaaccctgtctctactaaaaatacagaattagccgggcgtggtggtgcatgcctgtaatcccagctacttgggtggctgaggcagaagaatcgcttgactctgggaggtagaggttgcagtgagccaaaatcgtgccattgtactccagcgggggcaacaggagcgaaactccatctcaaaagaaaaaaaaaaaggccgggcacggtggctcacacctgtaatcccagcactttgagaggccaaagtgggcagaacacaaggtcaggaatttgagaccagcctggccaatacggtgaaaccccgtctctactaaaaatacaaaaattagccaggtgtggtggcgggcacctgtagtcccagctactcgggaggctgaggcaggagaatcgcttttacctgggaggcagaggttgcagtgagccaagattgtgccactgcattccagcctgggcaacagagtgagactccgtctcaaaaaaaaaaaaaaaaaaaaaaaggaaattgtttccaaatatcttttttttaatgattatttttgaatagtcaataatttattccttctttgttccactatttgttcacttagcactcttgcaaaattttatggctttttttaaactagcttttttagaaaactcaattttgcacagatgttgaaaaattataaaatatgtacatattcaaatgttagggatcaaattttaatcttggaagcttggaaattaaatatcatttctgtcatatattttaaagcagtgaaaggtatttctttcttttgaggacttcagcaaatatttctaatttcaaagctttctattaaaagtttttagttccatataaagtatatcttttttatgatattttaagcactaatatattatggtagttaaaataatttctagttgacaaatctagagctgatagttcttaagtttaaaatacagtttaagcaaggagtatataaaatctacatgggtttctataaatggtatcgtttaaaatcttatttcagtctgggcatggtgcctcatgcctgtaatcctagcactttgggaggctgaggtgggagaatcccttgagcctaggagttcaaaaccagcctgggcaacatggtgaaaccctatctctacaaaaaaatacaaaaattagccaggtatggtggtgcatacctgtagtcctagctattcaggaggctgaggtgggatgatcgcttgagcccaggaggtcgaggctgcagtgggttgtgatcgtgcccctacactccagcctgggcaacagagcaagactgtctcaacaaagaaaacaaaaaagaaagtaaagaaagtaaataaaatcctgtttcatcttttattaaattgcagattctgggatattcatattccatgtagacattatttaatatctgccagtctttgaatctcaactatttttgagtatttatagtttccatcaattcttaaaagaagctgtatgtacaattcaagttcaccatcgttactggcatttggtctgataactggctactgttaatagtggcaaacagacttaaatacaggatactttacatatgacactttacctgcctcttttaaattttaaaattattctatttaaaataatctgacattataaatttctatgagtaaattatagaatggtctattaatttttcctttagtttgttgtgctttctgtggtcacagaaaatgctttagaaaaaataaaattattctagcccaggcacagtggctcatacctgtaatcccagcactttgggaggctgaggtgggcagaacacaaggtcaggagttcaagaccagcctggccagtatggtgaaactatctctactaaaaatacaaaaattagccggacgtggtggcgggtgcctgtagtcccagctactcgggaggctaaggcaggagaatcgtttgaacccgggaggtggaggttgcagagagccaagattgtgccactgtactctagccttggcaacagagcaagactgtgtctcaaaaaaaagaaaagaaaagaaaagaaaaaggaaaaaaaaagtattctatataagttagactataggttcaaagataattccttcataaaagaaaaaaaatcaataaaatttattcacatggccatgcaccatggctcacgcctgtaatctcagcacgtcaggaggccgaggtgggtggatcacttgaagtcaggagttcgagaccaccctggccaacatgatgaaatcccatctctactaaaatacagaaattagctgggcgtggtggtaggcacctgtaatcccagctactcaggaggctaaggcgggagaatcacttgaaacctgggaggcagaggttccagtgagccgagatcgcgccactgcactccagcctgggcaacagagcgagagtccctctcaaaaaaaaaaaaaaaaaagaatatatagacgggtcagaactgcattcacactttggttctatagaatatcaagctgttttttgatactttatttagtgatacagtggtattcccaggaggatttgtcagcacttttctgggaatgcttggaaatgactaattagcattagaaatttaaaatgttctgatatcattattttatgtatttatattttaataggatattaaggatttttttcatggtaaatttatggatatataagtaggtaatttggcttacttataatttaaggaaataaaattactagagtactctcggtagagatagcaaatcgttacctctagactcttagtattttctctgtatcaaataatgctatcgtagtaatatatattctaagtactttgaattatatttgaattatatttgaatataaaagaataaaaattcttttattcttcaacctacatttatttgccagcttatctttaatgtaactccaaatacataccaaatttttggcttcccagaaatcaatttaataatttgaattttattacaatgtaggcactgtgataggtgttgggaggatctaagatgagaaagatattgtcagtgctttcgaagtgctcacagttcttaccctccattttactacctcacatggcattattaattaatgcactcagatctcttgctaaccagaatgtaatgttttgatgtgaaagattttatacatcattatcatcatcagaggatcaatagtaccatggtaaagaattttaggctgggtgtggtggctcacgcttataatcccagtactttgggaggccaaagctggaggattgcttgagcccaagaatttgagaccacctgggcagcatgacaaaactttgcctctacaaataatttaaaaagtagccaggcatggtgttgtgtgcctgtagtctcagttactcgggaagctgaggcaggaggattgcttgagcccaggagatcaaggctgcagtgagccatgatcgtgccactgcactgtagcctgggcaacagagtgagaccctgcctcaaaaaaaaaaaagaattttacagtttaaaaaaaattatttcatttgtcttaaaatgagtagaatctttgcaattgaggtagactttaaaaagtaatatttttctattaaaagatggttactgttcttttctgacagagttaatattttcagtgtcatagttttgtgctaactttttctttaataagtatgcccaggatcaatcctgcagttgtgcacacacaatcgtgtgttagctgtccatggaaaatgtatagaatatttaaatttatgtaggatatgatatcacagtttggcatacttaccctagaacacacacttatgtctgactgttaaatcagttgggttttataatcattacggttttgatatttgataagatttgcaagataaaattttttacctcagagaacaagacaaggttatatcgtgcatattaaattcataataccatataacttgcttttgggttcatgattgcttttcacctgtactttccatctgtcatgaacagggatccctgagatgttcatactctgcattctcatgtgcatgatccttagatttaaaaagggtgagtgggagaaagttgctttatagaaatataagttcacagcattcatgttttgtgtgttccactgcaaatattgcatgctgcatacttgtatgctgcatacttgtatttctctgaaaatgaagaacataggctcataagtacacaaaaaattagtttcgtttttgccaatagttggaacagatgaaggaatgttagatgtaataccttttctattttttctaaaatgaattctgtagtatttttcaaaagacaaggaaaaaaattatatttaaactcaaagtggctacaaatcagctcctaaactgtcactgacagtagcatatagatttcgtagtttttacaaacttttaaaaatatttatttactaagaaaacattgcattaatgcatgatacaaaattgataagttttcctttaaattggaatgcagtttaaagtgactgaattttccaatttcagctactgcatttgagaaggatacatactggaaaatggaactggtatcatctaatttctttagactccttcacttatggtagttgggaaaaatctttccatgtggcattatatagatcatattcttgatgactaatattaattactgtgctttttagccttgacagtaatgaagaattctgggtggatatagttcattcaaataatttaggtgtattttaaatacatgttttcaattgaaaaaaacagatctttggcacttggcttttaattatgtaaacattgacattcttacattttgctctttatattataattgatgtgtatgttgcaattccaataactgcacatacagttttatcatacactttaaaacagtggcatacttggtcatagatacaaattaattttagattgaaatatatctttgtcacattacctatttttatttttgtgtgtgtatgtaatgacaacctttccatattgtgaacaagataaaatgatatctaaaatgttagtcatgacaacttccaaccttagcgatcaacgcgcctctgagtttatgctgttaagggctaaagtaatagtattttcagtgcgctattctgccagttgccacacatgctgaaaagatctacttaaatctttcttgctaggcataacagataaatagttttataaaaaatattaattctgatgctctccagagatttttatgcttaactattttctgttagatttcagccagtaaaatttaccattgttcttacattggaaaattcccttactagtcacaatcaaccaggtcctttaaaaagagaaaatggacagctctaaccaattgtcaagcatgtaatcaagtactttattaagagaaatccatccattaatcagttcttcctttgcttttcattatgtcataaaggatggatttattttagagcttatggttttgaactaccacttccagcttctggagacccaatgattaacttgcttctacaacccagaatgttccaaatcatacctttttcatcttgattctcctagattttacaacaaatcatagtgacaataccagttccattttgcctccaattcagttgattatatattttttctatttatttctcattttataattgatatctggaataatcagcagctcttttctcatttattttctcatatttttattccaggatttgcctctgaagcagggagtgtctgcattaaaaatgacctgtagttctctgcttcataggttagaaacttattttaatattttgtggctaagcacagtcccacttttcaaattctataatgaattatttaattggcattgaatgtggaccaccagcatatatttcatattggggttttctttattactttaaatgattaaaattcaatagaatgtccagctgaggcaataaaagctttatttttgctttacagcttaaaacgttaaatgagattttaaaaatctatggattgtaacataagtaaaataatgctatttgggcatttttaaaaattccatttcttaggccttatattgcttgaagcatttatattctaaaacataaccaaattctgactattcattttggggaaaaacaatcagttcacaaatcacattttcaatgggactgctagccagcataggtgaaaacatgtatagtgtatttactcttgaattgtacactgcagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatgggttggtattcacattttttaaaattctatcatcattatgcaaaacaaacaaacaaaaaaaattcccaatttttcctaattgctgagctcaagtttgcatataaagcaacagtgctaattttatcattgaaatacatgaaaattttaacttaaaattaccaacttttactagatagaaaataaaataatcatagattctagcaatagatatcttattatcagtatagttaggtagtagaaaatgaaaataatctgttctgaaataaatttcaaatgaatttatattttaaaaggacttttactcagccaggtgcggtggctcacacctgtaatcccagcactttgggaggccgaggcgggcggatcacctgaggtcaggagttcgagaccagcctgaccaacatggtgaaaccccatctctactaaaaatacaaaaaaaattagccgggcattgtggcatgtgcctgtaatcccagctacttgggagaactgaggcaggggaatcgcttgaacccaggaggcagaggttgcagtgagccgacatcacgccactgtactccagcctgggcgacaagagcgaaactccatctcaaaaaaaaaaaaacaccaaaaaaaaaaccgaaagaactagcaatgtaatgactccatccaaaacaactcaaacagtcactaagagctatgttctctttccaattgtgtcctcatatggtttacattttttagaggattttagacttaatttttttctctttaattgatgaaaacaagaaaaaactaaattgagagtttgattctcatcatttagattcatgtatcataagcttttttcctttgatactaatacattgattgtacagagtcgatattttttttaaatcactcattttttttctgtgattctgggttacttatttagagggtgatgaaacaggatcatggtacatgtttgagttttctttcatctctgccagtcacactacccactaatatagttcaatagctatgttacagaatattcactgctataatgcagactagtatgacttttaattcctttagtaattttattgtaatatttaattgctagacttttaaattagatttttgtatagtacattcaaaataatttgttaaaatttaactctctaggacccaggatctcctacaatttcagttttacacaaaaagtggtcaagaagctttagattgatttactacttgatgacatcactgatctttttttggttaaaaattcagttgaatattatagagaatattcttaatatatatttaacttgcccttaagcactccctcagtacattttaaaaagtaatatctaccctttaagcaataattactctacaccgcttctttacctccttaagggtgatgtagttaaatgaaaatgaatatttaaatgcttttcagttttagaaagtccagtttagtaaattacctaaaagaaaataagatatactctttcctaaaatgttgccatttaataaaatcaagaatttcagaacataatatttgtagaactattacttataaaataaggctctgaaatgtaatgaatacagcaggtaaatacttaagtaactgtgatagtaacacagatctaaaagtctcatgaatatcatttaattacatatgtgtgtttatttgtgctttagtggagaaagtctttaatataaagttccagaagataaattttcatttttatatcaaaatgaatgttgaaggttcaaatttagagcaaatagaatttttacttatggctagtaaacagtgatttgcagttgctaattaaatatcttgaccttcatttttctgcttctacttttgtatgatagctatatcttagaaatgatttgaggttacccagggaaagtataatgacattggtcaagacagactctttcatgaaataattcatggagcagaaattccatcaagcagaagaaatgtccagcttcttaggtaatgaaaaaaatatttgaaactagtatatggaaatgatggaagaattttaaaattggaatttataacaactatattgaggaaaggatgaaaccatacctaaatatatagaaaaatcggccttaaaaataatttttcagagcatgtcaagctaaaagcctgtattcttcaacagtgaaaaaaatcttaaaatgttttgagagataaggatatagccttagatctaatgtgccataaatctacaatttatatcatactaagtatttagaaaatgtactttaaaatgtatacagcagtttattgatcttcaagataccacatagaaatctgatagcttgtagatgaaaatagcatttttatatgactaagatgttagagtctaataagagaataaaaccattaaaaaaaaaagcttagtatttgaatattcctagccatatcattcttaaatttctcaactaaatgtcctgagaatcagttgccccatgtctcttctagatatttctataagttaagataggatgtcatctggatgtgaaacctactttaggctttttgtaatgaaaattatttttttgacataggtcaccagaaggattatgcggcacgaataaattagaatgtcattttaagacttctgaatagaatatgccatgatggtggattttcctttttggttgtcatttagaagtaaaatcccatgtaactgactgctactttattttttcttaagccatcatgccttaaaaattagtaacttgactacgtttctaagcattagtggatgttttcatggttttacatgtctatacatctcaatatgtatgtattccatttttacattttagaaaaaaaagatagttttaagaacttctaaagtaccattttagaaattgcttaattacatgatattcttctttaagccataatgtgtatactcactcaatacttcatcccaagtgagatcatttgttttgctagactagtaaaactcactttcatttatttgcccttataaatattagcttgactagcataagtgagtataaaaacatgtcttgccaagttaatcgatatgctctatgaattttccttgtatttcaaactaaaattttcccttttctattataaaattgatacatatgaattacaaatatttgaaaaatacaagaaaacctcataatctagtcactcagtaaatctgctattatcattttgcagtattttctttcatctctttgtatgtatatttgggggatatttctacatagtttcaataaatgaatatttttactttaagattagtataaaacagaatatcatagactttcatgtgtgaggaactgcacactagttagaccaaatgtttgaatctgtacccagaatgatgaaaagaaaaacagggtttactgcccattgttccagcttcaacttgatacttatgttcatagaatttattcttccagggccttttaaatgacttgcacaagtaatctttgatttacttatgtcaaatttacacgaatggcattccttgtccagttaggatctttctcatcttaatattacagaagcttctttatccctctgctttcctttctttgtccctttcttcttctttgccttcatcaacaaacatttcttcagcacctgttatgtttcaggaagtgtgccaggttcagggaatataaagatgattaagcacagtattgcgccttgagaacttttcctctcatctatcagtcttactgaattcctatgctagtttcattccttctttgctccattcttttgcctctttcctagccaaggattcaacctactccccatttccattgaagatagtgcctttcctcactttgttcttgatgattaaggcaacaacttggttacagctggaggggtaaacattagagccaggtttaagcctgcttagcttctctgtgtttgaagtcgtaatattcctactggaatctggttgcttttagaggagatttttcttcacagtcatctggctcctggatctttgatgtgagtcaaaacttaggactaggagggtcacagagaaagctatgaccctgactttatttaaaaacatacgtgaattttttttttttttttgagacggagttttgctcttgttgaccaggctggagtgcaatggcacgatctgggctcactgcaacctgcacctcctgggttcaagtgattctcctgcctcagcctcccgagtagatgggattacaggtgcctgccaccactcctggctaattttttgtagttttagtagagacggggtttcaccatgttggccaggatggtctcaaactcctgacctcaggtgatccaccccgcttggcctcccaaagtgctggaattacaggtgtgggacaccacaccattgctcaaaaggaaagataactaacaatattgtttttacttgtttttattatgtatttgcagtgcttcaactattttacagattaaatgtgtttgcctgaagtcataaccaccatttgggatactgtttttctttgaacatgcattccacatagcaaatgcattataaataaatgttaaaaagcataactaaaaaaaataagggccaggtgcagtggctcatgcttgtaatcccagcactttgggagactgaggcgggaggatcacctgaggtcaggagttcgagaccagcctggacaacatggtgaaaccccatctctaacaaaaatataaaaattagctgggcttggtggcacacgcctgtaatcccagctacttgggaggctgaggcaggagaatcacttgaacccaggaaacagaggttacagtgagctgagattgtgccactgcactccagcctggatgacagagtaaaactccatctcagaaaaaaaaaaaaaaaaaggtagaatgctggtgctgtaaagcccagattgtaaaaatttttattgagggctttaattacttaactaatcacagataaaaataatctgaaaaatcacactcctagaaaagattgtttagagtaaagctaatttcccaataaaaattgaatcgctaattttttatctaatttcttcagtttggtttactgagaaggatactcaaaagaataagctacatataccttcatttggtttgtaggccattttgtatgggggtatgtagggtttttgggggtttgttttttgttttcgctaccctcacttcttttactgtgcagttaaaaaataacagtagttaatcttatagctttatataaattttggaatttatatgtggaatgcatacatggaatttttaaatcttattttgactgaagtacaatgttaaaggttatagtgacattagctattctttcctgttagtctcagtttattgcgctcaatcttcctcccttcctcctaccactcacatacgttcattttcttttctgtcaaacatactttgttttatttttgcatcatatagtaaacttttttacaaaacctttttaaagatactttgctcatgtatcttcctttaggcaatattttattttgccagcaagctgaatagttgtttttactattattgccagttctgtttcttcctttgtcttaatggctttttttttttatcaaaaaactctttttgatactttctccatgttgtgctttgatttctcagaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaaggtatttactttatttatcatttgaattttagttaaaatgtaaaggggaatgagaatatgtcctgaaaagtaaaatattttcaaatcatgaattttcttccctcatatttgatatttgaattagattcatcccaaactttagaaagaattttttttttttttttttgagacagagtctcactctgtcacccaggctggagtgcagtggtgtgatctcagctcactgcagcctctgcctccggggtgcaagtaatcatgcctcagccacctgagtagctgggactacaggtgtgtgccaccaggcccagctaatttttgtattttagtagtgtcgcagtttcaccatgttggcgagactggtctggaactcctgatctcaagtgatcctcccgccttggaggaagaaatattaaagtgaattcagagaaatacagtagaaattattaagaactttgaaaataaggtttttgagatggttatagtaatcaagactattggactgagaaaagacttgattaatacttaaggcttacggtttaagaaatgggatatcatttgcatccactcaagtacaggaggaaagaaggaaatgaggaaaaaaaaagaaatgaggtatcaattgagtcttaattttttttacagttgagactaaaagttaaaagggacttaaattttagcacctaggatatcttggtataaagaatatttgtctttgaagacaaacctcaaaaaaatgggggaatggggagaggacttaacaagtgtccctaccccttgctaaatactaaatagggaggaattttggctagtcatatggtagattcttattaaatacagtttgtataaatatgttagttgaacagtattttaagttaggagtagaggtggactgcctttcattttatacttgaatgaaattatgattgaaactctggatcaatcaggaaacgtgtctgccaccatttataaggttgttaatagtcacgtgtacaatatcaagtctacccttcttcactacatactaccttaacccacacccagtccttcaatcccaggacaggtaacaggcaagtgagaaatctatgttatgctttgtgtaaatatttgtctagctagatattttggtagtttggtcattacgtttaacctaattgccctgactttaagttatgttttgtctagttagaagtattgttagattaattgcttaactatgatagggaatgaattgaccttaaaagtttgtttagtcattcattcaacaaatactacactcctccatgtgccaggcactgttctagattctgctgaccagcaatttgactagtttgcttattttcctcattatgataccattttatagagatgtagctgtactggaatagaaaagatgtgtgaattttttaagtactttgtttggcatgcattgtacaatttactttgtgattttctgcattctatattaggagcttcaatgtttaactataagcctcatcaagaatcaggattggaaacatttgttcccaaatgctgttttaaatatttatttatttttcagcatacaaattataatttaatttatgaaggcttgctagagacctgtaatgatccatagatccccgtttgaactagcagtctctcagaccataatgttttgtctcaggatttaatgatgttatatgtatgtatctagtccgtgaaaatgagcttcatttccttcttattcatatagctgcactcatacttttctattcaagtagctttagtagaataaaaatttggtatatgtgctctcatttgatgatgatgatgatgccactaacagttttgtgagttttcccattagttatggtggtaggtcctgagcaacccaaatgctgcctgaagtactgtgcattcattctcatctgcttgtacaaataaattataaatgataatttatcatctaacatctaaatttataatttaagtatagttattacagaattaaaactatgacttacttcaggaatttagccaactcttttatgaaaatgttttatctctatttttcttgaagatttaaatttttttaaatgtaattcagttacaagtataggatttggtcttaaatatttgattttataattagattatttgaaatactaattagtgtttctgttgcatgttttctggtttcagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcgtaagtacttagtaagaatttttcattatacattacactcttgtgttaggcagaattgttcagtttctaatgtatagaagattttttgcgtattttattaaaatgttttaaatattatgaataaaaaaagacattacttcagaatggtaatgggttaaaattaactcttttaccatttgctaaagaattcccatggttgggccaggcgcagtggctcatgcctataatcccagtgcttttggagtctgaggctggtggatcacctgaggtcaggagttagagaccagcctggccaacatggtgaaaccctgtctctactgaaagtacaaaaattagctgggtgtggtggcacgtgcctgtaatcccagctacttgggaggctgaggcaggagaatcacttgaacccaggaggcggagtttgcagtgagccgagattgtgccactgccctccaagctgggcaacaaagcgagactctgtctcacaaaaaaaaaaaaaaaaaaaagaattcccgtggtaaaggcagggaaatcaaagccaagtggaaagctggccaaagacttacttttttgggtttataatagtaacattgaaaataaaaacttcaatttgatttgctttcctgaattccactttcttaatgtttgctttaaaaactttttttttttttttgagacagagtctccgtctgtcgcccaggctggagtgcagtggtgctatctctgcttactacaacctctgcctcccaggttcaagtgattctccctgcctcagcctcccaagtagctgagattacaggcatctgccaccacacccggctaattttgtatttttagtagagtcggggtttcaccatcttggccaggctggtctccaactcctgacctcaggtaatccacacaccttggcctcccaaagtgctgggattacaggcatgagccgctgcacccagccgaaaaactgttcagcagagactatgaagtgccttattccatcttgatgtgaaacacatattgctggtttaaattcaccgtctgttgttattttcctctgtttaaaaaatatatatctttagatttagattatgtgtttttcatcttgtgcatttaaattttaaaaattatttttccttaagccttttgtaaaggacctttaatcctaaaattgaaccgtaacagcaggaaatatattggtatggggtagatctatgttgtaattatttgtatattggatagttgctaaagactttacttggttttcagttttcttttgaaagccattttaaatagattggtaaaaggttagttggaaaagacattttgagaaatattttgtaaattttttttttttggagagggagtcttgctttgttgcccaagctgcagtggagtggcacgatctcggctcactgcaacctccacctcctgggttcaagcgattctcctccctcagcctcccgagtagcttggattacaggcgcccaccaccgtacctggctaatttttgtattttagtagagacggggtttcactgtgtaggtcaagctggtcttgaactcctgacctcaaatgatccgcccacctcaggctcccaaagtgctgggattacaggcgtgagccaccgtgcctggcctcataaatattttttaacttgtaacttttgaaaattactaaaaaaggggctgggcacgcagtggctcacacctgtaatcccagcactttgggaggccgaggcaggtggatcactaagtcaggagttcaagaccagcctggccaagatggagaaaccctgtctctactaaaaatacaaaaaattagccaggcgtggtggtgggcgcctgtaatccaagctacttgggaggccaaagcagagaattgcttgaagccgggaggtggaggttgcagtgagctgagatcatgccactgcactccagcctgggcaacagagcaagactccatctcaaaaaaaaaaaaaaaaaaagacaattataaaaataaatacatataggccgggcgcagtggctcacgcctgtaatcccagcactttgggaggccgaggcaggcggatcacgaggtcaggagatcgagaccatcctggctgtcatggtgaaaccccgtctctactaaaaatacaaaaaattagccaggcgtggtggcgggcgcctgtagtcccagctactccagaggctgaggcaggagaatggcgtgaacccgggaggcagacttgcagcgagccaagatcgctccactgcactccagcctgggcgacagggcgagacttgtctcaaaaaaaaaaaaataaataaagtaaaataaataaataaatacatatagtagaggaggaaaggaaggaatttactgattataaaaatagtacttattcaatataagaaagttgaaaacaggccaggcgtgctggctcatgcctgtaatcccaatgctttggaaagctgaggcatgcagatcatctgaggccaggactttgagaccagcctggccaacatggcgaaaccccatctctactaaaaatatagaaattagccaggagtggtggtgcatgcctgtagtcccagctacttgagaggttgaggcaggagaatctctggaaccctggaggcagaggctgcagtgagctgagattgcaacattgtgctccagcctgggcaacaagagcgaaactctgtctcaaaaaaaaaaaaaaaagttgaaaacacagggtaaaaaaagctaaaaacatgccctttaaaaactaacttgtggcctggcacagtggcttgtaatcccaacactgggaggctgaggtggacagatctcttgagccaggagttcgagaccaacctaggcaacatagtaagactccgactgtactaaaaatacaaaagtgagctggagtggtggtgcgtgcctgtaatcccagctactcaggaggctgaggcatgagaattacctgaacccaggagggagaggttgtagtgagctgaggtagcgccattgcgctcaggcctgggtgacagagcgagactctgtctcaaaaaaataaaataaaaatataaataaaaaacaacttcctggaaataaccgctattttaatgtgtatcttcccagtcttttttggacaaaattgagaaaatactgtacccactgttttgtaatctgctttttacttaacatatcatgagcatttttcacatatcattcaatgtggtaacatactttttagtggctattattctatccttctggaggcagctactaattttttaaaagtaaaatccattttatctgttttctgaattagctctgtaaagaaagagactaaatgtatttttttattttttttttttttttaaaaaaaaggtctctggccaggtatggttgctcatgcctgtaatcccagcactttgggaggccagggtgggtggatcacttgaggacaggagttcaagaccggcctggccaacatggtgtaaccccatctttactaaaaatacaaaaaatagttgggcatggtggcggccacctgtaatcccagctactcaggaggctgaggcaggagaatcccttgaaccccaggagacagaggttgcagtgagccgagatcacgccactgcactccagcctgggtgacagtgagactccatctcaaaaaaaaagatctcttataagccattatttatgttcagattttaaaatagtgattttattttttttactttttattattataaacaaaagattgacaggattaggaacagtggtgaatgtttagaatttacccttttgtactttttgaacttggaactttgtaactttattacatattcacagaattaatagataagcaaaattttaaaaacaaacttgttgattaagaacattatactatttatacaacaaaatgtccctttatatattttttttctgtattagggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtagtaagtaagaagatacggagatactaaacatatggagtttctttcattttctgttaatcttttagacatctctaaattttagatatttcatatgctccggcttgtgatcatgcaaaatttgaaatattttaaaagcagtagtcagattttctagaccaaactagaggtgaatacttgggatacaattcaaaagatgtggaacattttgtagtttcctattatcataatatgctgatttaaaaagtaatttggaccagacagggtggctcccagcactttgggaggccaaggtgggaggatcacttcagcccaggagtttaagaccagcctgggcaatgtagtgaaaatcctgtctctacaaaataaaaaaatatatataataagttgggtgtgatggcttgtgcctgtagtttcagctactcaggaaggtgaggcaagaggatcacttgagccctaggaggtcaaggctgcagtgagccttgagcgtgccactgcacgccagcctgggcagcagactgcgactgtctcaaaaaaaaagaaagtaatttgagctggttatcagaagtaaattacaaagcgaaagcattttctaagcatcttcactgtgtggtaaattactgtggttctaactgttttgtgttagaacatgagtaaggtaagcagaactttgcaaataacaacatgtcagaagtttcaattattaattataatattatagtatagtgttgggagtgggaaattcaattcttatcactaaccttgacatggatagaaaatgatgtgtgcgtgtttgtgtgtgtaaattcaattatgttgttatatatgtctcaccataattgtagtttctctctaatgattattgttataggtaataaataggaaaaattttccttttcacgtctctctctctcttttttttttcttttttgagatggagtttcgcttgttgcccaggctggagtgcaatggtgtgatctctgcttacagcaacctccacctcccaggctcaagcgattctcctgcctcagcctcccgagtagctgggattacaggtgtgtgccactagcacctggctaatttttgtatttttagtagaggtggggtttcaccctgttggccaggctggtcttgaactcctgacctcaaatgatctgcccactcctcccagcaccccccaccaccctttttttttttttttttgttagattgtggctcatgcctgtaataccagcactttgagaggccaaggcaggaggacaggagtttgagaccagccgaggctggtctctcttcctgtttccttctgtctcccattccaatcccagctcttcttactaaccaactttgttttcacctctcattttactccagctgtttaaacctgccaaaaagtttgtattcatggaaactaacataagccagaaacttataatggaagtgtattgaacaacataatgagagaacctgtctttacaaaaattaaaaaaaaaaaaaaaagccaggcatggtggcatgtgcctgtagtcccagctactcaggaggctgaggcagaaggatcacttgagcccaggagttttgagatagcagtgagctatgatcacaccactgcactccagcctgtataagagacccagtctcttaaaaaaaaaaaaaaaaaaaaaaaaaaaaggaaattgttcagatgagtgctttttgtttttaatttttattgtgttctgataacaaaatatgcctcattgctcattcagtcactcatttagtcaacataaattaaatgcagttgttctcaatcctgggtgtaggttcgagtcacctgtagtgctttaaaacaaacaaaaaggcatgccaattgatgatttgtttttggaaaacttcatagttaattcaatggatagttacagtgtgcctaactctgaaattaaagattatagtttaaggagcttacagtttagcaggctggggaaaaaacaggcaagtaaatgtctaattttatagtaaaattatattaacttccatatatgtgtatataaaattgtatataggccaggcgtgggagctcacacctataatcggagcactttgggaggccaaggcagggggattgcttgagcccaggagtttcagattagcttgggcaacaaagcaagaccctgtctctatttttttaattgcatataaaaattatataagcttccaattgtattataaagttatataaagatactatactgcacagtagctgtgtgaataaagtacagtggaaacatagtaagagcatctaattcagactgctcagagatggtagaacttgttctgtcttgtcttaaaacacaaatagaagtaaaacaagtaaaatgggatttacttgaaaaattttcatatctacccttctgtagtaattctgggcagagggattcatgtataaatatgctccctggaaggatatgattcttttgggggaaataaaaagagttttatgtgattggaataaaaagatatacattatgaagtggtaagatttgaggttacagaggtagacaacacctctttcttttttttttttttttttttttttgagacggagtctcgctctgttgcccaggctgaagtgcagtggcatcatgatctctgctcactgcaagctccacctcccgggttcccgccattctcctgcctcagcctcccgagtagctgggactacaggcacccgccaccacgcccggctaattttttgtattttttagtagagacggggtttcaccgtgttagccaggatggtctcgatctcctgagctcgtgatctgcctgcctcggcctcccaaagtgctggggttacaggcgtgagccactgcgcccggccgacaacacctctttcataaagagacttgtgtattcagcaaaataatttgaattttatcctgaccacttaggaagcttgatgcttgaacttgcgactttgagggctggatatgggaggaaaagaagaataaacataaaaatgatctacagtaaaacacaggacccaaaaaatctttttatttaaaaaaattaaaatgtttgttccattataagtttctggcttgtatttctttccgtgaatataaactttttggcagctttaagcagttgcagtaaaatgagaggtaaaaaggaaattggttagtgcaaagagttgggattggaatgggagatagaaggaaacaggaagagagagaggtagaaaaggaaaggggccaaaaggtgacagagttggaagggagaagaggaaacagatacttgatcttccttctatagatactcagtggaaagaatttctaatatcaggattcatgcagtgccttgtggctttaaaaaaattacttctaattattggtttaacaatggccattggatcctttgtctttttgtttttaaggggatagaagatcatccctttttacattcttaacatctttcatgttctccagacaatataggtgtatatgttttttgttttggtatgtatgtttatattattttgttatgttatatcaaattaagaatattaattttcagctaggtgcagtggcacgcacctgtagtcccagctacttgggaggctgaggaaggagaatcacttgagcccaggagtttgaatccagcctgggattcaaacccatctctttaaaaaaaaaaaaaaaaaaaaaaaggccaggtgcagttgtacacgcctgtaataccagcactttgggagggcgaggtaggaagattgcttgaagccaggagttggaaaccagcctggacaacatagcaagagtccatctccacacacaaaaaaaatgttttaagttagctgggcgtggtggcatgtccctgtagacccagctacttgagagactatgatgggaggattatttgagcccaagagttcaaggatacagtgagctatggtggcaccactgcactccagcctgggcaacagagtgaggtcttattgatctgtccttaaaaaagaaaaaagaaaaaattttcatatctacccttctgtagtagtttttaataggacaaaattaatcatggctttcttacatgtaatatatattagattttatcttatggttactcaattaaatatgactctgaatttaagaattttctacttcccctatttctacctatcccacagctatggggaaaggatggtattgttaagcaaactatccctctcttaaaattttggataggattagtaatttacatagtcagatgtaggctttatactctaaaatattctgttaactatgttgttctactagacattattacaaagctttattctcttgacaggttgaaatatttgcttacttatttttcagtattcagatattcattatttttttcaactttatttatttatttattttttgagacggagtctcactctgtcacccaggctggagtgcagtggcgatcccggctcactgcaagctccacctccggggttcacaccattctcctgcctcagcctcccgagtagctgggactacaggtgcccattaccacgcctggctaatttttggtattttttagtagagacggggtttcaccgtgttagccaggatggtctcaatctcctgacctcgtgatccgcctgcctcggcctctcagggtgctgggattacaggtgtgagccaccgcacccggcctcaactttatttttcagactgctagttgaaaagcatctaaaagcacacagtttttacaataccaaaaaggtgattttttgtgtgttctaatttttaagcattattcctttcaagtaatttttaagcattattcctttcaagagtcagcttataaataacttggtcgggcgcagtggctcacgcctgtaatcccagcactttgggaggccaaggtgggcccattacctgaggtcaggagattgagaccagcctgagcaacatggagaaaacccatctctgctaaaaatacaaagttagccgggcttggtggtgcatacctgtaatcccagctactcgggaggatgaggcaagagaattgcttgaacctgggaggtggaggttgcggttagccaagactgcgccactgcactccagcctgggcaacaagaacaaaactccgtctcaaataaatagataaataagtaaataacttaaaaataaaacagttaatgcttaagtaatcttgactttagttgtgtttagtatggcgtctgttggggactcatctcgtaaactttaaagaaaggaccttttaaaaggccagaagttaaattatcttgaatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaagccactgctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaaccaaagccaaaattgacaaatgggatctaattaaacggaagagcttctgcacagcaaaagaaactaccatcagagtgaacaggcaacctacaaaatgggagaaaattttcgcaacctactcatctgacaaagggctaatatccagaatctacaatgaactcaaacagatttacaagaaaaaaacaaacaaccccatcaacaagtgggcgaaggacatgaacagacacttctcaaaagaagacatttatgcaggaaaaaaaacacatgaaaaaatgctcaccatcactggccatcagagaaatacaaatcaaaaccacaatgagataccatctcacaccagttagaatggcaatcattaaaaagtcaggaaacagcaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagatacatgcacacatatgtttattgcagcactattcacaatagcaaagacttggaaccaacccagatgtccaacaatgatagactggattaagaaaatgtggcacatatacaccatggaatactatgcagccataaaaaatgatgagttcatgtcctttgtagggacatggatgaaactggaaatcatcactctcagtaaactatcgcaagaacaaaaaaccaaacactgcatattctcactcataggtgggaattgaacaatgagaacacatggacacaggaaggggaacatcacactctggggacggttgtggggtggggggaggggggagggatagcactgggagatatacctaatgctagatgacgagttagtgggtgcagcacaccagcatggcacatgtatacatatgtaactaacctgcacattgtgcacatgtaccctaaaacttaaaagtataataataatacatttaaaaaaaaaactttacaagaatagtaaattttaagtaacaaaactgtataatatgtgggatctcttttgcataattgtataatgtcaagattcaatatacttcttttctgacttgtactgtataacttgtgaataaagcaggtcatttttgcagaaactaaaaaaaaaaaaaaaagaaagtaaccgactagttctttctgtaatgtaaatacgaatatgtagaagataaatatattctaaaccttggggcctcatttggctgtcttatgcctttaacaaataaatttaaaaaatgagatatgggaaaaagttttatcagtaatcagtgaagtggaatttccacacagtatttgaaaatggagggaaaggttatatgctttacgtttcattttggtaatacaatatattaatgtaattttaacaagatataccatatgtttctggaatgtttttaaaaacaagtatctatttcctgttactccaaaaagttacctttgaataaactgatttagttaattcttcatttaaaagggtatatcattgtcagtgtatgaccaataaccctttccattctgttcacacatttaccctataggttctagacaatacttattttttgtttttttgttttttgtttgtttctttttttagacaaggtttcacttttgtttaccaggctggggtgcagtggcgtgatctcgggtcactgcaacctctgcctcctgggttcaaccgattctcctgcctcagcctcccgagtagctgggattacaagcatgtgccagcacacccagctaattttttgtatttttagtaaagatggggtttcaccatgttggccaggctgaccaacttgaactcctgacctcctcgaactcctgacctcaggtgatctgcccctctcggtctcccaaagtattgggattacaggcgtgagccacctcacccggccagtgtatttgtttatacattaacaatttctattaaactccccagcattgttgaaaatgtcatttatcatatacaaacaggttaaatatctcttatcttaaatgcttaggacccgaagtgtttcaggttttgaatttctttggactttgaatttctttgcatatacataatgaggtttcatgggaatggtacccaagtgtaaacacagaattcatttgtgtttcatgtacagctatacacatagcttgaaggtaattttacataatattttaaataattttgtgcatcagagtttcaaaaagcaaaggtgtcactgtttcagccacctttgtaaataatctttgtaaataacctgttgggcatcaccatcattcctgactctgaatttatttttatttttatttttttttgagacgaagtcttgctgtgtcacccaggctggagtgcagtggcacgatcttggctcacagcaacctccacctcccaggttcaagagattctcctgcctcagcctcccaagtagctgggattacaagcacccaccaccacgcccagctaattttttgtatttttagtagaaacagggtttcacccgactctgaatttatatgctaccaataagcaatccttttcttatatttcttcacacgtaagtacttaacaccggtgcagtcatgactcactgcagcctcaacctctggggtttaagtgatcctcccactccagcctcctaagtagctgggaattgcatgtgcatactaccacgcccagctaatttttttgatttttttgtagagacaaggtctcactattgcccaggctggtcttgaactcctgggctcaagtgatccttcaaccttagcctcccaaagtgctgggattacaggtgtgaaccactgcacccagcccaggtgtgtaaatttttgagcattgtattggcactcaaaaagttttggattttggagcatttaagattttagatttttggctgggcatggtggctcatgcctgaatcccagcattttgggaggccaaggtgggtggatcacaaggttcgagaccagcctgaccaacatggtgaaaccccgtctctactaaaaatacaaaaattagctgggcgtggtagtgtgcatctgtaatctcagctactgaggaggctgaggcaggagaatcacttgagcccaggaggcagaggttgcggtgagctgagatcacacctctgcattctagcctgggcgacagagtgagactcagtctcaaaaaaaaaagattttagatttttggattagggatgctcaacctgtatttaacaaagacaggatacttgtttgtatcaatagctgaaggctaaatgatactgcaataacacacaatttaaaagaagacaacaaaacaaaactcagtggcttacaacaactgagttggtaaaaccatgtgatggctctcaaaactttcacttggacttggcacattacttcagttcatatttgattatccaaaccagtcacatgaccaagcctgtcagtagagcaagaattatagcctttccagataattgtgtaactataaaaatatttattactcctccttcaataaagacaactcatagaaccggatgattgcaagttgattttaggtaagaaataagttttggtggttcttcttatagaatgcttatgtatctccacagctcagccagcaggagtgccagaaatcttaaagaaaagcttgcatagctgttcagtgaaaggagaagaagaagtgtttttaatcggcaagaactttctgaaaggaactaaagttattttccaagaaaatgtttctggtaagtacgcatatttgtggtacagatatttgtatgttttcactttgttatatggatatagtcatagctacagagtaaaaaaaatagttcaaaaatttaataaatcactttttatttcaatcagatgaaaactcttggaagtcagaagctgaaattgatatggaactatttcatcaggtaaaatttaagctttttttataatttggttatttactctctgagcaattcagttttgttttgaaattttcctgaatcaatagattaaatttcttcttcctatgggattgatatgaattatttaaagtttctttcttgagtttctttaactgaaatagaattattttcctaatggtaaacatgaccacctctattttaaaaagttaggatcattaacaaatgtttccattgttaataaacaaaatctttctttcctgatacttattttctctgaggatttgcataatcttaatccactatatagttaaataaaagggaaaccaatatttattgagaatctgttatgtttcaggtactttatatttgttaaaccttcttgtgtttagaagcactcatcacactgatattagtctgtatttgcaggacctcaccatgtattgtttcccaaataacaatgaaaacttgaaaacaaggatcaagacctgacttaggaattcgtatttagagcagacaggaccaaacccctagaaattgagactaacagaaggccaaatttataagcaagttagaaggcacatggagaagaggtagtatgtacaggtgtagaactgagacagagagagaagagagaaacaggaacaagctaatgtgtaaattacccaaagcctaaaatttagtgtaagctgatggggaaagaaaagagcacatgacagaaggtagagaaatagaagatgcaaaaattagacaatctatagccactttatccaaaaagtttataatttccttgttgttttaaaatttattttttattcctttgtgtatttttaaaaacctaataaaatttaaaacatatatccaatatattgccacactcaaggctcagggcacagccaagactgttgccacttcatacaccagacacaagttcaaaggtccccaggccaccctctttttttgaacgagtggctcaaacagtatttttcctactgtccccttggatttgataacttcctagaaaaattcacagaactctgggaagtgctatacttagtgcctgtagtttttttgtttgtttgtttttgttttgttgttgttgttcttttaagacagtcttgctctgtcgccaggctggcatacagtggcgcgatttcagctcactgcaacctctgactccctggttcaagcaattctcctgtctcagcctcctgagtaactgggactacaggcatgtgccaccatgtccagctaatttttgtatttttagaagagacggggtttcaccatgttggccaggatggcctccatctcctgacctcatgatctgcccgccttggcctcccaaagtgctgggattacaggtgtgaaccactgtgcctggcctagtgcctatagttttacaacaaaaggacagaaatcagaatcagctaaagggagagatgcataacacaaggtctcggagtgtcccaggcactaaccttctgtcatcctcaggaagacattaccatcttggcatagcaatgtgtgatgataacaatatgcagagaattaccaagcagggaagctcacccaagcctttggtgtccagagttattatttcagacctgattatatactgcccatgcagctacctttggtcttcacttccacaaggttagaattgatatggtgtgttccaaagcctctgttataaatcacattgttagactatccagcgaccaaagctctcaagtaaatatcactgtcacacaagacattgcaggaacctagagattacctcctagcagccagaggtaaagaccagaactctctctgggtaaagttaattatttcctagacaatatcgtatagtgtggagattcctatatatctagacaaatgctatgtggcaagttttcctctggccttatgcaactacatgttgtggaaaagagataatgggacttaacaaacattcctttgtcacacagaccattgggcaatatctcctagggtttatagtcagactagtcttaattgaagttttaatacctgctttgtcattagcaatctgtgttaactaagtaagacaaatgacttttgtgctccagttttctgatctgtaagataagcgctttcattagattatttgagactcctctgactctaacattttattatttcttatattatttgatcagaccatctccactcccatgaaccaacaatagcttcctctggagtactcctggaggttagaggcaatgtattataattcttctgtgttccttgtaataccaaacacttaatagatacacaagaaaaacttattagttcattttattcaccttgaagaaaaaaatgggtgactgtgtggtctaagtaaggttcatttgttctttccgaggatacttcaaaccctaatttcagccaggtctttaaatacctagagttgtaatcctaactgaaacttaatttattcatgcagtacttttgtatgctatgaacatgttttgtttcttgacaaattagttagattaatgtagactcccttgcttgtaatgctctattatgattgttattcttatgataaagattgatagataaggagactatttctggagattgagagacttgccttataaattatacaaaatatcaatgacatagccccaacaaattgtagtattaacttgctattttgtatagaactttatattcataagttatcctccctccctacctccatttttctttctctctctctctcttgccttttgaggcatggggtagttatatttttaaaacactttttttcagggcagttatgccagctacagtaggttaaagaataataatcataaaaataagacacgtggtggaatggaaaggaattatatccttatttggtgactatatctagaggtcctggggtttttgcaagcaagtatgtaaacaaactaaatcataatataatctgtcattaattctgtggttttgttcatttttatctttttcagagagaggttttattttattttttttctaaaggggttttcttggaagccttttctttgagtggaatcagagctgagatcctagagaattgattctagagattatataaaggaagaaaacccacaaagcaaacctttagggggaagaaaatgtgttgagactgggcatagtgactcatacctataatcccagcactttgggaggtagaggcaggaggattgcttgaagctgggagtttaagaccagcctgggcaacatagtgagatcccatctctacaaaaaatttaaaatatagccagtcatggtggcacatgcatatagttccagctacttgggaggctgaggtcagagaatcacttgagcccaggaagttgaggctgcagtgagccctgattccgccactgcacttccacgtgggtgacagtgagaccctgtctcaaacaaaaaaaaaagacaacacactttggatgtgatcagtaaagaaatattaggcctacacaaaaaaagttgaaagggaatctctacaatatttaaaaatacccagcagatggtatagtagaaaagaccatttaaagataatttcacaaattgcagttgtgaaagattgtaatagctgttcagttgcaaacccaaaatcaattcatcaggtattacactttttctatcatattataaatattgccaggcgtgtggctcatgcctataatcccagcagtttgggaggccgaggcaggtgaatcacctgaggtcaggagttcgcgaccagcctagacaatatggcaaaaccccatctctactaaaaatacaaaaatttgctgggtgtggtggcatatgcctgtaatcccagctacttaggaggctgaggcaagaaaatcacttgaacccaggaggcggaggttgcagtgagctgagatcacgccattgcactccagcctgggcaacaagagtgaaactgtctcaaaaaaaaaaaaaaaaaaaaagtaatacggtattataaatattgagactaatgaagtctggaaaaacaattctttgttcaattgttttctggtcttctggtccatagtatacctcatgctcatgtataccaaatatgatgggtacatgatcattcattatgtctattcccttttaacaactgtagatgagttatatataacattaattacctattaaaaatatatataaagggatattcaatctatatatacaaatatacataaaaggatagctcaggggaagatggtataaatgtggaaagaaaattcttgaaagaagtacaaaaaaaagatcctcagaagaatttgtgggaagaactagactaaacaaagacttgaaagcttagagttatgtttttcaaatcagttctaagagtaattttgtaatgggtctttggtcaagtctaattgtagatattctaattatgtaggtattctgattatatatattcccaactgtaaaattaatgtgacaaaataaaaagtatctcatagaagagtgaaagatatctagcaccattgctggtacactctgaaaaagattatctgctagggaaaaagttatttgaatctaagcagatttttctaagaagttaaaattcaattgttttcctctttttatcccaaagagcattatacctgctcccaaagcctcccaaccctttgtatgttttgtatgtactgtatccctagctcagtgatagttaattgtttctaatttatgagagggtattaaaaatagcttttgatcactagtgacagtttacctaatttttaattcagatcagttgtagaatttctagattcagattgaggaagtttgaagaattagtagcaaaataggttcatttggtttttaaaaggtttcaaaattagttttacttaaatgtgctctccaaagcaagtagagtaaaagtattttgataaaatatgcatctgatttgtagacactagtcctgttactaattgccaagaaacaagtttttattcaaaagaatagtttgaattatggagtttgccaaacaattttaagagtgagagctctcacaagctgttcattcaaccatctccttaactctagatagactgtttctgtgacatagttgtagtgtttaaacaacagagtaaaaatgaggtagacaagattcagtaactctgtttcttagaagttagatcaataccagtgcgttttttatgaccttgtatgtgttcagatttagctcctgccttataactgtggatgtatgcatatttgtacatgtttttccacctagttgaaaagaatgtggtttttttgagatggccaacttaggaggcattctgttaatgccgtaaattagaagctagttttttgtttttttgttttttttgttttggagacagagttacgctcttgttgcccaggctggagtgcaatgacgcgctcttggctcacctcaacctccgccccccgggttcaagcgattcttctgcctcagcctcctgagtagctgggattacaggcatgtgccaccagggctggctaattttttgtatttttagtagaaacagggtttcaccatgttaaccaggctgttctcaagctcctgacctcaggtgatctgcccacctcggcctcccaaagtgttgggattacaggcgtaagccaccatgcctggcctagttctttatttataatgtgactgtatttcagagagtgttttaagatggctcagaaacaaattaaattctcagaaatggaaaccttgaccttgatctcatttgtcccatattttctattcaactgagtcaacgaactatgtagtctaactaaattttaaatgtcatcaaactcacgtcaccctcagctgtcagcttcggcctcctgcaaatcagatcattagtgaaaaagcataatcactaccctgtgatatcccctaccattataataatctactagggaagaagaaaaaaaagtcaaatatggctcatattaccctctaagaagatatagtacccttgagtaagtactggtgaaacttttatgaactctgcctttctcttataaggatgcttctgccactgttccaactaaaaacatctttggtttactgagatgtggataaactgaacccaatttgacttaaaatgagaattatgttgttaggagtagcgaactgcattgtgaaatacatctcacattgaggttgtacagaatgtatggtaactgactttgcccttggtgggcatattttttttctaataatttattcattcttttattcaatatgtaccttatgtaaggtactattctttacaagtgagacagagtgaagaacaaaacagcctagatcctcatggagcttacattcttatgtttggagaaagaccaaaaaacaagcaaatagggtaatttgcaggggtgaggataagtgctgttatggaaataaacaagattatgttataaggttggggaagggttttgctttaaataggatgatcagggaaggcttctttgaggtgacatttgtatctgacctgataatgggttaggaactcaccatttgaggaggtgaaggaataatattgcaattgaagagaataacaagtatagagaatctgaggtaaaactgagtttagtatgttaaaagaagggaccgaggtcagtgtggctacagtgtagtgagctagaagagcaggaatgagatgaagttgacagggcagggatcttgaccttgtaagccattataaaacacttggattttaccttaaaagcagtgttaagattaatatcctgatgcctgtgaacctgagctttaaaatgcattcttttttttttaatcactttttaaactttacagctaacaggaaatatacttcatttaaaatttttaaatttaagtattgcttcttttccaactcttgtgcttttctttacattagaatcatcttattgtgaaggttcctccctatcatgaccaacatataactttgcctgtgtcagtgggaatatatgtagtgacaaatgctggaagatctcatgatgttcaaccattcacttacactccagacccaggtatgtcaaaatgaaaaattcagaactaaaacaaataattaatttccagttttttgaaagaatatgaagatgactagccaaccaaaaagaaagttgctcactaagatgaattgatgttagtttcttttggaaatgacattattttctaagaggacagccgccagatactgcttttactcttatattaaggaatcatttctaccttatgctataataataaaaggcagcaatgctctgaagtcagattctctgaagctatctgacaggttactcctccataagaatttccatgcattgactaccgcttatgtgcagaaacctgaaagtgacaactttgggaaattgctaatagtttagtttggctggtttatagggtacattttgagagagagaagagataaactagagtgacaggtgataaaataaaaaatcccaaagactgatggtgaataaatatttttttctttctatattgccccataatacctgataaatattttaaataaaactttggttgggttaaaacgatattttaggctgggtgcggtgatgcacacctgtaatctcagcactttgggaggccgaggcgggtggatcacctgaggtcaggggtttgagatgaggctggccaacatgttgaaaccttgtctctactaaaaatacaaaaaaaaaattagctgggtgtggtgatgggtgcttgtaatcccagctactggggaggctgaggaaggagaattgcctgaacctgggaggtacaggttgcagtgagctgagattgtgccattgcactccagcctgggcgatagagcgagactgtctcaaagacagaaaacaaaacaaaaacctgatattttagaaatgagaggaactaaattttttttttttgcatgtgagtgggagacggagtctcgctgtgtcgcccaggctggagtgcaatggcgcgatcttggctcactgcaacctccacctcctgggttcaagctattctcctgcctcagcctcccgagtagctgggactacgggtgtacaccaccacgcccagctaatttttgttttttcagtagagacgaggtttcaccatgttagccaggctggtctcaaattcctgaccttgtgatccacctgcctcggcctcccaaagtgctgggattacaggcatgagccaccacgtccgaccctaaaatgttcaaagtttagaagatacctatttatgaagtgtctcacaagttatttgcctgcattcatttagatgcctgaaaaaagcaaaaagcctccttttggcagaaatggggagaacattttggaaatggaaactctttgcatgctccattgacctaggcttggcttctgccatgtttaccattggttcagttcagtccagtctcaagcatacttcagaattagcagttcttctctatctgtagtttattagtatgttatttccatatagttcaagatccagtgaggtagaaggtaaagaatggggcaaagaaagaaagccctggcatcaaaaagtgaagaaaacagtagctaggacagaataacaactaatttaagttaattgctttctgtcacttaatttttctattcactattctcttttcttttcttttctttttgagatggagtcttgtgttgcccaggctggggtgcagtagcgtgatcctgggtcattgcaacctctgcctcccaggttcaagcgattttcctacctcagcctctcatgagtagctggcactacaggcatgcaccaccatacatggctaatttttgttagtagagacagggttttgccatgttggccaggctggtctcaaactcctgacctcaggtgatctgcccgcctcggcctcccaaagtgctgggattacaggcgtgagccaccactcccagcctcatattttattcttaatcgtatctgaattttgcaacattattttctactaatttgttacaaaaggtatgccacagtacagcactgttaaaataccccttgaaggcctggcatggtggctcacacctgtaatcctagcacattgggaggccgaggtgggcgaatcacttaaggccaggaattcaaaaccagcctggccaacatggtgaaacccctctctactaaaaatacaaaaattagccaggcgtggtggtgggcacctgtttacccagctacgtgggaggctgagacaggagaatctcttgaacccgggaggtggaggttgcagtgagccaagatcacaccactatactctagcctgggaaacagagtgagactttgtcaataaataaataaataaataaccttgatatttgtctcagaattaaagatcatgtgtgaaaacattggaccaaaaaggcaaagtttagaaataacatcctggcttcaacaaaaataggagaaagaagattggcttattctcaaagaccaaatattttattgtttcctttctaggaaggcttaaaacatctaaggaaatttgatataaaattaataatagttggctgggcatggtggctcacgcctgtaatccccgccagcacttcgggaggccaaggcaggtggattacaaggtcaggagatcaggaccatcctggctaacacggtgaaacccatctctactaaaaatacaaaaaaattagccgggcgcggtggtgggcacctgtagtcccagctactcaggaggctgaggcaggagaatggcatgaacctgggaggcagagcttgcagtgagctgagattgcgccagtgtactccagcctgggcgacagagcaagactccatctcaaaagaaaaaggaaagaaaattaatgatagttaaagcattttagtaactgatagttactaaatattgacatttaatgtttggcaggagcttgcacaaacatgagaagaaagatggtataattaatacataggatttgtttcctgatgagcttctgcatcagttgtgttggaagggaaaggaatttatgtcaggaaatagccttaaaggttttgctatcctgaaaacactgagattttcttgtcttcacttgtttctttgtttttattgatatgagacttcaggactttgaagtacttagcatcaacactaagaatcatcatttcttagtgataaatgctaattattagaaattggcctttgataaattgctgaacaaacaacttttaagtattctacttcaaaggctatactaattgcctaattttggccattcttaggcaatcattactgtatgtttgctctttcaagttttcccccagcatattttgtatgttacagatagcaatcactcttagaaaaccttgtttgaataaatataaggtatgcaaactttgtaatacaatctaatgtcttagcttctgcctctatgatacagctaattagtcttcctgcaattttcatttttttgtttttttgtttttattttgttttgtttttttgagatgaattcttgctctgtcacccaggctggagtacagtggcgtgatctcggctcactgcaacctccacctcccaggttcaggcaattctcctgccacagcctccgaagtagctgggactacaggtgcccaccaccacacctggctaatttttgtatttttagtagagacggggtttcaccatgttggccaggctggtctctaactcctgacctcaagtgatccgcccgcctcagcctcccaaagtgttgggattacaggcatgagccacagttgtacttttttgtattttatgaaatgtaataatcttttcaagtgtccatgagaagtgtcttggaagccatgagagagaatatgatttcaggaaaacttgggcacagagaatttggcctatctcagtatgacaaactaatagctgttgtgattcatttagggactgttgttaaatatttgattactcgatagtgtattattatagcagccaaaacaaggtccatcctaatatttacgggttggagtagaagtggtgactgttaatactattagttgaaatacttaaaagttataaataaaactaacaaatcattaagtgaaatacctcctatcttactttgaccaaaataccctcataacaacctgaaaggctaaatttgaatttagaattttcaaactgctttgagttctaagctgggctatggtagcatgaggagagagcatccctgcctgccacccttcttttgccactttttggctccatcctatacttggaagcctttgataccttaatcagtgtttccacctaatatgcctaagagtgctcacaaaatctaggatagttgtacagaaaatctagggattggccgggcacggtggctcacgcctgtaatcccagcactttgggaggccgaggtgggcggatcatgaggtcaggagatcgagaccatcctggctaacacagtgaaaccccgtctctactaaaaaatacaaaaaattagccaggtgtggtggcaagtgcctgtagtcccagctacccaggaggctgaggcaggagaatggcatgaacccgggaggcagagcttgcagtaagctgagatcgcgccactgtactccagcctgggcaacagagcaagactccatctgaaaaaaaaaaaaaaaaagaaagaaaagaaaatctagggatcctgggtgcctgttacatggtctaaaggtagggtcaaggcaaaggctcaagtgaacatgtcctggttccacacattcttccaggtacagaccttctaacatcccatggggccatactgccccaaatcaaaatgtgtattctctcaggcacttagatacttttcagagtcataaaacctttgtattattgatagtctctgaagctttgcttagccattaaaacattttaattttttttttttttttacttcagcctattcagacacaaaaatcacacattatttgctgtaactccacagtggtgatttctataagaaatgggaatgtaatatttaacattttttttttttttctaaaaaagaaattactggctgggtgaggtggctcacatatgtggtcctgacacttcaggaggccaaggcaagaggatcacttgagcccaggagtttgagaccagcctgggcgatatagtgagacccccccccccgccatccctacaaagaaaaaataatactaagctgagcttggtggcatgcacctgtagtcccagctacttgggaggctgaggtgagagatcgcttgagcctgagagattgaggctccagtaagccgtgatcatgccaatgtactccagcctggacaacagagcaagaccctgtctcaaaaaaataataagaagaatttaaaaataactcataacatgatttataagtagaaatttaaatttttttcaaggattagcttatatttttaaatcttttattactagaattaatgtcatgcataaatatgtgtgttttttttccattcagttgcctataaatcatttgttggacctactgtgaagcatactaagataaattatttaacttcattctcaggagatgtgtacagatttccctctttatttttgttataactatcatttgacatgttagaaaatataaaataaatatattgaaaaatagaaattggctgggcgtggtggctcacgcatagaatcccagcactttgggagaccgaggtgggcagatcacctgaggtcagaagttagagaccagcctgaccaacatggagaaaccccatctctactaaaaatacaaaattaacagggtgcggtggggcatgcctgtaatcccagctactggggaggctaaggcaggagaatcgcttgaacccaggaggcggaggttgcagtgagctgagatcgcgccactgcactccagcctgggcaacaagagcgaaactccgtctcaaaagaaaaaaagaagaaaaaagaaaagtagaaattaaggccaagcacggtggttcatgcctgtaatcccagcagttagggtgtctgaggtgggcagattgcttgtgctcagcagtttgagaccaacctgggcaacatggcgaaacaccatttctaccaaaaatataaaaattagactggcgtggtggcgtgtgcctgtagttccagctactcaggaggctgaggtgggtgatggcttgagcttgggaggtggaagttgcagtgagccgttatcacgccactgcacttcagcctgggtgacagagccccagaccctgtctcaaaggaagaaaatatatatgtatattcaaataaaatatataatcatttgaagcaagaacgaatttatttgtaatttattaaactttattttttagaactgatttatatttaggcccattaaatttatagtttaaatttgttacagtaggctgggcactcaagcctgtaatcccagcactttgggaggccaaggcgggcagatcacttaaagtcaaaagtttgagacccagcttggccagcacggtgaaaccccatctctactaaaaatacaaaaattagcctggcagccagtgcggtggctcacgcctataatcccagcactttgggaagccaaggtgggcagattacctgaggtcaggagtttgagaccagcctggccaacatggtgaaaccccatctgtactgaaaatacaaaaattacccaggtatgatggtgtgcgcctgtagtcccagctacttgggaggctgaggcacgagaatcccttaaacccgggaggtggaggttgcagtgagtcaagactgcgccattgcactccagcctgggtaacaagagcgaaactccgtctcaaataaataaatagcctggcatggtggcgtgcacctgaaatcccagctactcaagaggctgaggcaggagaatcacttgaacctgggaggtggaggttgcagtgagccaggatcataccactgcactcctcctgggcgacctagcgagactgcctcaaaaaaaaaaaaaaaaaaaaattggctgggcacggtggctcacacctgtaatcccagcaatttgggaggccgaggcgggtgaatcacgaggtcaggagttcaagaccagcctggccaagatggtgaaaccttgtctctactaaaaatacaaaaaaattagctgggagtggtggcaggcgcctgtaatcccagctactcgggaggctgaggcagagaattgcttgaacccaggaggtggaggttgcagtgagccgagatcacgccactgcactccagcctgggcaacagagcgagactctgtcgcaaaaaaaaagatggggtttcaccatgttggtcagggtggtcttgaactcctgacctcaagtgatcacccgccttggcttcccaaagtgctgggattacagacgtgagccactacacatggcctggtattgttttgctaagtgatcacatgctccgcccacttggagattggagaatttagaggatagaaatttacctcaactagaatttctgctaaataaataattaaatgatactttgtgacaagatattctaattaaagaatttaagatacgaggtttttaggatgagtaaatgtagataaatacattaatcttttttttaatagcagcagctggtgctttgaatgtaaatgtgaagaaggaaatatctagtccagcaagaccttgctcttttgaagaggccatgaaaggtaccaagtaaattcttctcaaaaatcgtaattgggtgctcctgtatgttttctctagcacaccttactattttgttttctcttaggtacttataatactttgcagggtatcttcatattgtaaaataaatatgtgtttaactttactaaatgtagagacttgttttccaatttgatatttttcttgctgaatatgtttttatatatatatatatatatatttttttttttaagtatattggagtggaggagttttgtttttttttttaattacccaatattaaaagtatatgaggctgggcacagtggttcatgcctgtaatgccagcactttgggaggccgagtcaggtagatcatttgaggtcaggacttcaagacctgcctggccaacatggtgaaaccctgtctctactgaaaatacaaaaattagccaggggtggtggcaggtgcccgtagtcccagctgctcgggaggctgagtcaggagaatctctttaatctgggaggcaggggttgcagtgagccaaggtcatgccactgtactccagcctgggcgacagagcgagaccctgtcttaaaaaaaaaaaaaaagtgaaataaggccaggcacggtgggtcacacctatagtcccagcactttcagaggccaaggtaggaagattacttgagtccagaaatttgagatgataaatatccattggctaataattaaatgcatcatctatagttattgctgaacagatatgggcagcacagtgagaagatttcttgtctctacaaaaaaattaaaacaggccaggcgcagtggctcacgcctgtaatcccagcactttaggaggccaaggtgggcagataacctgaggtcaggcatttaagaccagagtgaccaacatggagaaacccattctctactaaaaatacaaaattagccaggcatggtggtgcatgcctgtaatcccagctacttgggaagctgaggcagaagaatcgcttgaactcaggaagcagaggttgcggtgagccgagatcgtgccaccgcactccagtctgggcaacaagagcaaaactatctccaaaaaagaaagaaagaaaaataggccaggcgcggtggctcatgcctttaatatcaacactttgggaggctgagcttggcagatcatcggaggtcaggagttggagaccagcctggtcaacatagcgaaaccccatctctactaaaaatacaaaaaaaaattagcctggcatggtgatgtgtgcctgtaatcccagctactctggaggctgaggcaagagaatcacttgaacctgggaggtggaggctacagtgagccaagattgtgccactgctctccagcctgggcaacagagcgggactcggtctcaaaaaaaaaaaattaaaaacattaaccgggcatggtggcatgcacttatcatcctagctattcatgagactgaggtaggaggattgcttgatctgaagaggtcgaaggtgcattgagctgtgatcgtaccactgcactccagcatgggcaaaggaacaaggttctcaaaaacaaaacaaagcagaaatttggttggtttatatacttttttgataaaaaatttaaatcaggctgggcacggtggctcacacctataattccagcactttgtggggctgaggtgattggatcacctgaggtcaggagtttgagaccagcctggccaacatggtgaaacctcatctctactaaaaatacaaaatttagctgggcatggtggtgcgtgcctgtaatcccagctgcttgggagattgggcagaagaattgcttgaacccgggaggcggggattgcagtgagccgagatcatgccactgcacttcagcctgggcgacacagtaaaactccacctcaaaaaatatatataaatcacatatgagaaattgtttggtagagattacttgagaaaaaatgcaagtgttggattgtaatgcattgacaccagcttgatgttcttagagcaaattaattcttaggaggagaaaaagattaatctgatattttcatttataatgtactactaaattgaagttgactagaagattattattgaattaacaagatggaacatatctgacaaacttaatgtctggcctggagacattttggactgtttttggtgggactagacttaaataaaattggaacaaggccagatgtggtgactcacacctgtaatcccagcactttgggaggccaagccagtggatcacctgaggtcaggagtttgagacctacctggccaacatggcaaaaccctgtctctactaaaaataaaaaaattagctgggcgtggtggtgtgtgcttgtaatcctagctagttgggaggctgagacaggagaatcgcttgaatccaggaggcgaaggttgtagtgagcccagattgagccactgcactccagcttgggcaatagagcaagactctgaaaaaaaaaaaaaaaaaaaggattggaacataaataaaattaacctttgtgacctttgtgcatatggccgtagaaggacttgtgtctttgcatgagcattagactaaatgtccttttactgtttgtctttaccagtagacatacttgtcagtggtcaactgaggataggtaaaagactcttgctcaactttctctacctagtctcactttccagaaagggggagaagataataagcattactatctaaatacattttaagaaaaattgtagatctgttaagcagtaagtgtataggtgatatatttatttatatgtaatttctaattgaattataatataatcttatctgtaaacatggacatttttagatcaaaaatactattaataaaaatataagccaggtacagtggctagtgcctataatcccaactactcaggagactgaggtgggaggatcacttaaacccaggagtttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaaaaccaggagtttgaggctgcaggtactcactccagcctgggtaacagagtgagaccctgtctctaattgaatgaatgagtgagtaaatgaatgaatgaatgaatgaatatttttaaaaagaaaaatacagactgtatatttttatttttatttattattattattatttgagatggagtcttgctttgttgcccaggctggaatgcagtggcgtggtctcggcttactgcaacctctgacctctgcctcctgggttccagaggctgaggtaacaggtgccctctaccacacctggcttttttttatttttactttttttgtatttttagtagagacggggtttcaccatgttggtcaggctggcgaactcctgacctcgtggtccacccacctctgcctcccaaattgctgggattacaggcatgagccaatgcgcctggcccatatttttatttttataggattaaccaaacaatccacaacaaactaaattgacagtgataaagctaaagtaagattattttcttcattcattcagcaaacatttgttgattacctactgtgcaacaggtgataacaacatctgccttcacagagctcatgatctaatggaattcaaaagcaagaatagtagttgactattacaggatcaacttaagataacactaatggtttttcaaaatgttctatgggatattcttagattacttttaaatgcctgccctgtgcatgatctgaagttttgtctcagtcaaaattaggttgtaggccgagtgtggtggctcacgcctataatcccagcactttgggcagcctagtagggaggatcacttgagctcaggagttcaagaccagcctaggcaaagtaacgagactcttgtctctacaaaaaaattttaaaaattagtcaggcatggtggtgtgtgcctgtagtcccagctacttatggggctgaggtgggaggattgcctgagcccaggaggtggaggttgcagtgaggcctgattgtaccactgcactcccaccaacagagagagaccctgtctcaaataagataaaataaaataaaaatctggttgttaggggaattgtattggtattagaatttaggtgaaaataggtccaaagaactcatgaataaatgattcatttctcaaactacttaggtagaataataaaacatggaatgtcaaaagttaaatgagcactttcccctctgtcaaaataatcagttttcataggaattaggtttttagccaaatggctgtgaggcaagttgaagtaagacaagaaaattgcaaatatttttagatgaaaatatttactttcagcagattttgagacagtcttgctccgttgcccagcctgcagtacagtagagcgatctcagctcattgcaaccacctcctcctggattcaagcaattcttgtgcctcagcctcccaagtagctgggatttacaggcatgtgccaccatgccctgctaatttttgtatttttagtagagacagagtttcaccatgttggccaggctggtctcgaactgctggcctcaagtgagccacctgcctcggcctcccaaagtgctgggattgcaggcatgagccaccacacttggcctttcagcagcatattgactgacaacaacaacaaaaatttatgaagggagcgatccaacttatagaccatgtgccattttaaaagcttctttatagccaagatttcttctcgatatcaaattaagaaatttaacagctatgctttctgaagactgtttccatagagcttccaagtggtagtaaacttttaaatcaggatttggctatgtgctcaactcagaagactgtcattagcaatagcagtaggtaccactgagtgccactgcggactcaagtagacaaaaaagaagaaagaaaagcaatcaagggggaaaggtagatatagtgaagtggtagaatcttgctatatgttgcctctaggtataaatctagaactaactactcctgaaaatggaggtagtaggaggtgggaaataatttttcattttgcttgggaaatttggtttgtaaacctaaaatagcccttatttctggggaaaaaaaaaaagatgtttaaagtccagtctaaaagagaattgtgtccatgtgtcaacttgtcatattcaagttttctaattaatttagttttcttttaatttagaaaagcaaaatttattaatcactgggtggtattttctaatgagaagcttgaacttagtttaagaaagaagtgctctgacaatctcatagtccttaagaagttctgagactatattgtcagatagctaaatgctaagaggagagtgtagtttgtaattgagtagctttatcctcctggagatttttaagctgtatcctataatatactcttggtcaggttgggtagtatgattcaaggcacttggaaccgtcttggggaatatagcttggtaattgaactgcttaagcttattattaatatttaagctatagttccaggcccattccagaggtcccccagccaatgcacttcataaaagggaagatatatcttaatataccaggtttgtatctcatgctaccattgtagcatcaaaaaaatagacatttaaatcatggctaataacaaattttagaatgaaatagttggtaaattttgtgattttaaacttttctttttgtgtgtgtgtatatgcagcaatgaaaactactggatgtaatttagataaggtaaatattatccctaatgccctgatgactccactcataccaagcagtatgattaagagtgaagatgttactccaatggaagtaacagcagaaaaaagatcttccactatttttaaggtaagctgtattgactagtgcacaaacctcctatataaaaattgctgtcttttacttttcctatttttttaacattatttttactttggatgcacttaatgaattttgctgtaaagagggaatgctttatacttcagcaaaattgcccacatagtgacttccaatatacaagggaggaattaatatgttgtatgagatattgatgaaagtactaattttagcattttcagaattagagatgtttttatttttttcccagtcttttcccataactttctgtttcttttttttacttgtcttatcccctgtaatgttactgaggagccacaaaattgagatattttgatacctgctcttcatgaaccataaaattactgtgttctgattacccttaattcacctaagcatatcaatagccgattattctacttccttgtttgactatctttgcttgtcgtacttttaaaaaatatatctcaaggaaaatgagacatcatgttatggagaattgtagtcctgtacctgttttctaaatgataataatatagagtggaaagctggtcctgcatatatttttagagcaatagtgatttttgatgtatgttacaaacttgtttaatgtttatatattcataatatttggggatttttattttttagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaatagtaagaaactctaatttttcattacttaattggtcattattattattagaaggaagcagagtgcagtggtgcgatctcagctcactgcacctgcaccctctgcctcccaggttcaggtgattctcctgcctcagcctcccaagcagctgggattacaggtgtgcacaaccacgcccagctaatttttgtatttttgttagaggcggggtttcaccatgttggccaggctggtgttgaatttttgacctcaagtgatccgctggcctcggcctcccaaagtgctgggattacaggcgtgagccaccacacctgtcctgtatagttgttttaagagtacagattgtagttagaactctatcacctatagactataagatcttgtacaagttatttggcttttatgggtctcaattctctcatttaaaatggtgataatattacatactttacatggatttggggaggattaaatatggcaatgtataaaaatgtgtgtttgccattttaagctataaacttaaaaggaaaatgaagtcagaatgacagataataccttacccagttgaagtaagtagtttctaaggaggtagaaactcatctttaatgtttatataccaaggaatttatataggacttttgatatttaagcaaagttgtatttttagactgcttaaaggaaacctaagatgaattccagtgccagtctgtgaaaacctttttcttggactatcaggtgcctaacttttagtaatatacaaggagaatgcagtaatgaattttccccaacaactaataaatatcttttcatgaatctttactaatcagatagcttctatttttaatgtttctgcagactgtagtcagcttttaagcttctgttttcaatgtctctgcagactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatatgtaagtattgcattttggcttcttattgaaaagcatcagattttattcttcttaacagatttaggttaagtaatagtagttctaatcttttaaaatgtggctttctcacaagatgatacttttttactctgaataaaattattctgaatgatagcttatggtcatatagttaatacagaccaggccgggcgtggtggctcatgcctgtaatcccagcactttgagagaccaaggtgggcggatcacgaggtcaggcgatcgagaccatcctggctaacatggtgaaaccccgtctctactaaaaaatac

SEQ ID NO: 2628 - DNA, 4496 bp, Homo sapiens
  source 1..4496: mol_type = genomic DNA
ttagtcttagcatttactttccccaccccacattcttggaacagcctttagttctacaggaaatggcactgatggacagaagactagcattaccttcatgaaagggctgttagagctgcctgggaagaaggcgtgccttggggaactgggaagatgccgtcagtgtgggtgggcaggaggacagccagtcgtcctgctgccagcccaatagcttccagcggcaggtgcccaggtgctaccggagcccctcataggggtaggggcagggactgcacctcctccaggcactcatcgtaagcctcctggtactcctcatggggcttgaccattatcacacaggtggggcgcttggagcctgcggctgcacccaggtcctacagaggggaaagaagtgctgtttggaaaaaagctgtacaacctgtatgccaggaagtcaccaactgatgacccaccagcctaatctggcccacaaccatgttctgttcggtccatgttctatttaaaagcatcttgaattggttgccatcatttaaactcaatcagactttgaaggcatggtccagccacacagggcctacattcccacatggcaactatgaaagggctccagcccagcaggggctgtcccggtccctgccacccccacttcctgtgcctcagatctggcccctgttacgtaagataaggacagctacaggtccctctgagcctaaacccacctaaccggactaacatgggtgaagcatcttagcttacaaagctctttcacatacatctatctctttattctcatagtccacagataactgactatttggttcttaccatcaggccaaacggtaagttccttcagaacagggcctcctgctttatcccaagaagtgatactgtaggtacccaagatccacccccagcctctattttttttttttgagacagggcctcactctgtcatgcagtctggagtgtggtggtgtatgatcatggctcactgcagccttgaactcctgggttcaagtgatctcctgctttagcctcccaagtggctgggactacaggcatgtgccaccacacccagctaattaaaaaaattttttttgtagagatggagtctcactttgttgcgcaggttattcctgaactcctgtcctcaactgatcctcctgtcttggcctcccaaagcactaggattacaggtgtgagccacagcgcctgggctgggattcccactttacaagatgggaactgaaatgcaagaagtaacatatctgtagtcccaaaactaagaagatgtggagctgagaatccatccaggcctgtcttagctccaacactcctggctctttcccacactctcctgctatggcagactatcccagacaccccagtgctgagcaaggtcagggggccacgtgctccttaccgtcttagaggggatatagacatagggcaaatttcggtcctcacacatgactgggagatggcagtatacctcaatgggcagtgtgtctcctgccaaaaccatgatcctgaaatgagagaaaacactgtcatctctggcttgctccttccttctttcagttttaagtgctgccctgggctgggtcttagggatagagacaaaattgtgtttggtgagcacactatttgggggtgatctctacctcttggcaacatacaggtgccaccaaagtgatgtagtgctcggacaggtgaagtacaggatgggtgccaaggtgtatgagctcagctctctttggagagtcaaaaaagggttcaaccaggaggtgacacttgaacagcacgctgatggatgactgtgtggcaggcagcccacggaggggctggggcgggggagagcatgtggtgtgagaatcagaacggcaccagacacagccgagagactggcaggggacacccccaagaccttgagtaccaggctaagaagcatgggctctgtcccaagagtgacagtgaggcaatgaaagcttgccagagactcagccagggttcctagctggccaggtgtcaaggctggggggcaagggcctcaggagcctaagacacagaaggaaaagtctgctctcccatgctggataacaggcggacacacaaggacagagccctcggctgaaagaatgcttccgcactcctagtgctcctctgggccctctgctggctccccttctgttaagcgcctttcactgtgagtgttcctcacagccttgtcctcggctgccctctcctctcaggaccttcttcctggctgaccggagccactgccatggggtcaggtgccatctatgtgctgaaaactcccagatgtactatctccagcctggccctctctcttccatgctccaaacccctatagccatctgcctgtttgacagttctcctggtgtggggcggggtggaagtcatgtgtctctacagcacctcaaaaacttacccagacccaaatttgtgatctttctacacaaatctggtccccctccactgttcacatctcaagattgggccctctgtccctccagctgggcatgtcagaacctagaagtcgtcaatacctccccattctccacatctgaaagtcctttcaaatctgtcccctttaactctgtctccaccatcacctctccaggactacagtagtctactacctgaactttcccaaacctactcgtacctctctaatcctttcttcaattgtcagaaaaatcttagggtgtaaaaaataataaaaattatgtcacttcctggctttaacccctaatagcctccaaagtgctgagtataaaaactaaatttactgtgtcctacaaggccccctaagaaggtagcacttctgctcaccagaccctctcctgcccagaggcccactctttcttctggcagaatcctcccacccaccccccaattaatccctgtgtcttaagacctcagctcaaatgtgactgctgagggaaacttccccagatgcgccctccccagctaggttagatgccgttgagcatcaagtctgcccaacattattgatctcttgagcacctacagtttcacttcttgggataaagcaaggaggccctgttctgaaggagcttaccatctggcctgagagggtgataaagggaagaaaaatgtaaacaaggttcaaactttgataaatgccattaagaaaagtggggtgatgaagttatcattgcactctgttattttccttcatggctatctatcacaacgtgtaattagttgtgtgtgtgtcattatctgatgaatgaatgtcactgtttcccccataacacagtgcctgaaaaagagtacattcaattgttaaggctgccaggcgcggtggctcatgcctgtaatcccaacgcttcgggaggctgaggcaggaggattccttgagcccaggagttcaagaccagcccgggcaacatggcgagactcctctgtctctgcaaaacaacaataacaacagccaggcgtggcgcaagccggtggtctcagctattcgggaggctgaggtgggaggatcgcttgagcccagggggacgaggctgcagcgagctgtgatcgcaccaccgcactccaacctgggtgagagctagacccatctcaaaaacaaacaaaaacgttaacgttcagttccttaaatacagagccggagaggggtcatccctaggactgagattcagggctgagaggattagggcgggggccggaggtaatctgaggcaaggagcggagcccggggaggagggtccctgaattaatgaaggtgggtttactctaagggactttgcttacacaattcgcttcactttggaattcactttgagctggtatacgtggtgtaccggtattgtcgtaccggtattgtaccaaagggactttaccgactgcttgattggcttctgtatatggggctaggtcagagttaacctttttactgcgcgcctactaagtagagatttctccgttaacgtttagaaatgcaaaatccagaggaaggaaggttcttaccctttttctcctttgttgacaaatttctgaacctctttcaccccgcgccgaatctgcttctgcttcaccgctgcaacgacagaagagtcggtcgggggcctcgctcagccacccgcgcacccatcccacccgcgcacccatcccggccacgccgccgtccgcctcacctttcttgatgcatttgtagagcttccgcgtgaggcggcgagaagccaggggctgcgcgatggggttctggttgaccagcagctcctggtaggtgcgctccccggaacacgcctccgcctgagcctcgggcccgtcgggatctgcctttattttggtcatcgcagcggccgctgaaacctagtcccagggaggcgagcccacgcggtccacagctttaggcatcacttccaggtcatcagctgcgcgagaagccgccgtacaacacggccaatcaggaaaggaagtctccgactcagcccaat

SEQ ID NO: 2629 - DNA, 4496 bp, Homo sapiens; identical to SEQ ID NO: 2628
  source 1..4496: mol_type = genomic DNA

SEQ ID NO: 2630 - DNA, 40432 bp, Homo sapiens
  source 1..40432: mol_type = genomic DNA
ttactggcttcgagtacactttatttaagcagttactagtttaaaagcacctgtaataacactgagatcatcatcatcaaattgccacccaacaagcctagcttcttgcagaaaagttaacttggataacacttggctaagttttctgactaatgctggatcaggtagaaattctttagtactaaagtcaaaaaacactaattgcttaagattctcaaatacacccatgaaggcaagccatccatcactgctcacacgatttcccgccaaattcaactgctggaagtttttcagagggttctttccaaaaaatgcacctgggtaaagaaataagtatattagttggaagaaaaattttttttaaaaaaaaagagaaataggttctacatttattttacatacttttttttcactctgaaatggccatgtttgaaccagtgctttgcctcagaaagaaattattaatataattctctatagctagggcagtgattgtgaatatggtctattatattttcctagagtataagggaatctgataaatagtgattcgtagtgaggtagcaacaatatgtaaatgaattacttttttttccccttttccttactcctaggaaatggaaggttgctttaattaaatattcagtacttgttttcaaaactggagtcaatctttggcaatattaagtcgtttcctcttctgaaaaagtaaacaccacctaactgttgtttctatgggtatgttcctaactgtaaacttgagtaagtgagcctccttcagtatctaaagatttgggtgtttttgtttacctgtttatgtataaccctcccgagcctcttcaggaagttcctccattccttacagaatagggcacctaaagtatttcctacatagggtaggtggatatcctgtctttctgatacacaaagaatgcacacacacacacatacatacaaaggatgtgtgtgtgtgtgtgtgtgtgtgtgtgtgtgtgtgtatacatacacaaatagtttagtgttcattctttatcccatgttaccagtttaggtggtactggaacccaagtgagtcttgcaataagaaaaaatacctttctttcaggttatttaccatcatacagattggccagtatacaacattaggatttcacaaaactagctctgtgttaattacacatattaaattgtgcaaagcgttagccctacccacctacctggccctttctggatgactaagttcaccttgaagtacagagtggacagacaggcagactggacatgggaactcttacttacatgtttatactccagagtatcacacacaaaatgcagaagatgtatgcctggtttatcaatccacattactcggctcatccgagctcatcttagtcttagtgtacctcacccaactttggagggttaatttgttgtatattaaacttgtgtttcttgggagatgtgtaatattagataatgttccagaaactgacccttatggaaatgaaggtccatgattcagtttggattccaagtaggaaaagaggttttaaaagttcctttccattgtctcagtgagaagaccactaaagagttcaagttaaagaaggaaagattcggtgctgtacaaccttaaggttagcaagcaaagactaaaaggtatctgctaccagtaatgagggcttaatgacagaaatggacagtcttgtccgaccagcttacgtgggtgaggtcaacctagttatgcactgaaactatacccttacccactttcagtaaaggtgtttaccagctccgtagtgagaggagatctgtgaatttggtgtctgatgtcactgcatggccttgtgtagtttgttcagtgcaactaagtacattctagagtgtgtccttagtcaatgtcagccaatgcttttatcaccatcataaggtcttgagtttcgaaaggtcttcaggttcttctttacagacacctaaagtgattggccctgcctgaccgtggtcaagatgctagcggctaaagtgggcaaagccaggtaaggagatgattcacagggttctgccttcatgtctcttacccatggtcagtgtcactgacaccatctttgggccttctttgccacttttattaatttgaaaagtgagacagaggccgggtgcggtggctcatgcctataatcccagcactttgggaggccaaggcgggcagatcacctgaggtcaggagtttgagaccagcctgaccaacatggagaaaccccgtctctagtaaaaatacagaattagccaggcgtggtggtgcatgcctgtaatcccagctattcgggaggctgaggcaggaggatcacttgaacccaggaggcagaggttgcggtgagcagagatcacaccattgcactccagcctgggtaacgagtgaaactccatttcaaaaaaaaaaagagaagaaaagtgagacagactgctagttgttcccaaaactgtctctccttattccatagttaatagagttttatttcggcatatggccactcatatcccaacctcccttgctattaggtgtggctaaatttttgccaaggaagtataggcagaagtgatgtgtgcaacttccatgtcacttttccgcttttcccctcttctactaggttgaaatgatcacagggcagtgacctagctatggccataaagtcaaaaataacactcttaaggaatagaggagtaaaaaaaaaaagtaggggtctgggcctgaaagactgcacagaggaaaaccaccccacctgcctggactgctcatttctggactgttacatgatagagaatcaagttctgccttctgtaagccatggtatagttgggtctctgttatcacagcgtagcctatgcccagcccaaatagtacctaggtccttactttcccctgccttccacctcctctgttccttggaggatggctttctccctgctctctcttccatctcatgttcatgtcctttctgcctttgccccttctccatatgcttcccagcatggcatgcactcagtccaaatgctggttgccagttgtgtgtctatttaaggctctttccccaaagatcaactttttttctccttctcagctagcagaacatattttcaccacctaaaaggaatttaagaagaatttaaagcccattccaccctcacagggtgagcaatttatagtggttatctactaaggtataaggatcttatcatcaatttaagagagtttcttagataattattggaatgtgtgctagtgcaggaaccaagaacaaacaacatttgtcataagccaagggcatgccttttgttcatttaatctgcagtgcttatgttatgaggagcagactagatccaagagaaacagaatccatgacatttagagccataggctgtatgtgggctgtggagagtgcaaatggcttgattggaattccaggaaaaatctcagatgccctgggtagaagggttctgattcttgggggttcctgtatcccaaacacaactcttcatttgtgttgtcctgtagttcacctgaacgagtaccagagttctcactgtttattcattcagcaacatctttagtgctactatgtgctgcggattatgctgggtgctggggatatgtgtaaacgacagacatggtccctgtctaaatgggcttacaaaatagtgtgaagacatgcattataaagtaattagatgggtggtgggtgctatggtaggtcagggtaccctgggagcacacaaaagcaataggctttcccactccactttgttcccagaacacttgcaattgggcttatatgctccaggaggaagactggaggattcttaggagaaatggaactgccccccgggaaaaggccctacaaagaaggggccattttgcttgcccaatcaccccctagtggagttagcctgtcaaaaattcaccgcctcccttagacacacagaactccctatcaacttgtgtctccctctaaaatgtgaagaggacagtgcaggattatcagacatttgacaacagcctcccacaaggaagactgagactaaaagccaaaacaactcccaaagaaatcaggcactgtagaaaacaagaaaaatcaaactccaaagacctaagtttttcagagatcctaagtttttcagtagactgcatctactcagcaacaataagatgctaagaaagagcttttggaaaataaaatatgatagcgggatctatacagcagaatgattgggcccaggatttaacacagagcttctagaacatgaatagggtctgcgatggctttttttttttctttttttgagacaggttctggctctgttgcccaggagtgcagtggtgcaatctcagctcactgcaatctgccccactggctcaagtaagtgatcctgccaactcagcttcccgtatagctgggattataagtatgtgcactacgcccagctaatttttgtatttttagtagagacagggtttcaccatgttggccaggctggttttgaactcctgacctcaagtgatacacccaccttggcctcacgaagtgctgggattacaggcatgagctctctttgagaacaggctggatagcagagttcagcttcaaacatccaagttgaaagataccatttaacaaagggttttgttagagcaggtgaaattggtcaggcatggtggctcatgcctgtaagcccagcactttgggaggctgaagcaggcagatcacttgaggtcgggagtttgagaccagcctggccaacatgatgaaacctcgtctctactaaaaatacaaaaattagctgggcatagtgcacacacttataatggcacatacttatagtggcggcatggaccggtaatcccagctactggggaggctgaggcaggagaatcacttgagattcagagaagcgaatagagaacagagaatcccaggaagcggaggttgcagtgagccaagatcgcaccactgcactgcagcctggaacaaaacaaacaaaaaaacaggtgaaatagatacctgagctagcaatgatttttatgttgtagtctcagattgctgatgggtaagaaacaaaattttgggagtcaagcaaaacatggcaaagcttggagatcaaatgcaatctctgaggaagaacagcagatagtctagaccaagctttaaggaaaactagaaacatttaatatctgggtagaggaatcaccattgaaaagaagactgagaagtagccaaggtggcatggaggtcaagagaatgttttgaaaagaagggaatgctcagtgtcaactcctgcggaggaatcaaataaattaaacacttctgaaagtgtctattgaaattcagccacatggaggggtgtggagagtcagatgcaatgagtagaaagtagcagatggtcaggaaatggagatgtcataagggtacataaaatttgttttagagcttttaccttgaaggagaggagagatagaatgataaccaaaggaggaagataggactcagggagagttttatttaaaatggaagagatttgagcaactttaaaaactgacaggagggagtcagtaacaagaggcacagtcaataaaatgatgtccctgaactggagtgagggtgaggctggcatctcaagcactgctaaagagactgcccttaggtaggagaagagaaacctataagctctaaggagaaggagagaaaaaaataacagtcacatcctctgtgaaataggagacgctgagtactgattgagaagaaaaaagtgtgaaatagtttacatacagtgttgaatacagaaacacagtaagattgccaggaaatattaagagagattgtgtttattcactgttttttgtttgtttgtttgttttgtctcccaggccggagtgcagtggtgccatcctgacctcaggtgacccacccgccttggcctctcaaactgctgggattacaaacgtgagccactgggcccagcccccgctattttttttttttttttttgaggtagagtctcactctcccacccaggctggagttcagtggcgcgatcttggctcactgcagcctccaccttctcggttcaagagagtctcctgcctcagcctcccaagtagctgggattacaggcatgtgccaccacacacagctaatttttttcatactacattttttaatccattcattatttgatggacatttgagttgtttccacttttgagctactaaacatgctattataaacattaatatacaagtttttatgtggatattggttttcatttatcttgagtacctaggaagagagttgctgggtcatatgacaactctatgtttaacattttgaacaacttgccagaatgttttcctcagcagctgcatcattttacattctaactaccagcatatgaatttctccgtatccttgccaacaacacttgttattgtatgtcttttaataaaaaataataaccatccctagtgggtctcaggtggtatctcattgtagttttggtttacattattaccctgatggctaatgatattgattatgttttctgctatttattttgcgatttacatatcttccttggtgaaatgtctgttcagattcttgcccattttacaaattgggttatttgcattttttatcagtgagttgtaagagtttttttgttttgttttttgacatggagtctcactctgtcacccaggctggagtgcagtggcgcaatctcggctcactgcaacctctgcctccaggattcaagcaattcttctgcctcagcctccagagtagctgggattacaggtatgtgccaccacgcccggctaatttttttgtatttttagtagagatgggatttcaccatattggccaggctggtctcgaactcctgaccttgtgatccacctgcctcaacctcccaaagtgctgggattacaggtgtcagccaccacgcccggccataagagtttttttatatattcaagatggaagtcctttattagataatgtgatctgcaatttttttttcacattctgtaggttgtattttcactttctttctttttctatttttttttgtggggggggggtgggggactgggtgtcactctgtcacccaagctgcaatgcagtggcatgatcacagctcactgcagcctcaacttcctgagctcaagccatcctcccacctcagcctcccaggtagctgggactacaggcgtacgctgccacacccagctaattttttggagattgagttttgccatgttgctcagactgggctcggactcctgggctcaagcaatctgcccacttcggcctcccagagtgctgggattacaggcgtgagccaccacacccagccttagttttgaccaaatgtctttttttctgttgcaggaactcatccaggataggacattacatttcattgtcatgtctctttaggttcctcatgcttatgacgatttctcacaatcaccttgttttttatttccttgacagtttcaaggaatactggtcagttttgtgtagaagtccctcagttaggattgtttgatgtttttctcatcattagatgggggatatggatctttggggaggaatatcatagaggtaaagtactattttcgtcatgtcatatctaggtacatactatcaacatgaatcaccactgttaatgttgaccttgttcacctgaccaaggtagtgtcaacagctttctccactgtaaagttactcttttttgctgccttttgctgcatgctacaagttttgatatacagcgttttcttaccattcacttctaaatattttcgttgaaatttgtcagtatgaacttgtatttatctcccaaattttgcagtttttccccagtatcctaagtgtagttacaaaattttaaaaagggaaatttaaggacaatccaggcctggggttttgtcaggaaagtacaccccatctactatatttcatttcatacctctcattccacatctcatgttctgcctgcatctcattaggtagtctttctttaattagagactccatctctcattacactcttcatttcaccattgcatctatcacacacatccatcactcaaagtcattgcctgaattgactcatgctactgtgggccatgagaatttcagctattaaagacaagaatgtttgcagggatggaagatggagttgaaactaggtaggaaggcaagtcaaaatagaaagggcctgaaaaataggtagaaggtagcgggatcgacggactggaagtcccagtgaagtaaaagaactggtgattaggagtagatagaaatacaggaggttgtggtttgagaatgggatatctgcatttattattttgcaggtagaacaattttaagtggcttgtcataatctagtcattgcatgctcatagaatgaatggatgaaggagagtggaagggaaggtcgttgaagaggaaggtccattagcggagcatagtggcctctagtcccagctacttgggtagttgaggaaggaggatcccttgagcccagaagttcaaggttagtgagctgtgatcacatccctgcactccagcctgggcaacagggagaccctgtctcaaagagaaagagaggggtgggggagggaggaaggaaggaaggaaggaaggaaggaaggaaggaaggaaggaaggaaggaaggaaggaagggagggagggaaaggaagaaggaagggagggagggaaggaggggaggggacatactgctttcactgtatcccataggtttcagtatgttgtgtttccattttcatttgtcttaagaaattttaaatatatatatatatatatatatatatatatttttttttttttttttttaattgtagagacgacatgttaccatattgcccaggctggtttcaaacttctgggctcaagcagtcctcccaccttggcctctcaaagtgctgggattatagtcatcagctaccacacccagcctatttcaagaaatttttcagtttccttctgaatttcttcattggcacacttgtcattccagagcatgttgtttaatttccatatgtttgtatagtttccaaagttcctctggttattggtttctagttttattctattctattatggtcagagaagatacttgaatcagatttcaattttgggggattttttaagacttattttgtggcctaacatgtggtctatccttgagaataatccatgtgctgaggagaagaatgtgtattctgcagctgttggatgaaatgctctataaatataggtccatttggtgtatagtgcagattaagtctgatgtttctttgttgattctctgtctgggagatctgtccaatgctgtaaatggggtgtcgagtctccagctattgttgtattgggttctatctctctctttagctctaacaatatttgctttatatatctaggttctccagtgttggggacatatatatgtgtgtgtatatatgggaagatgaagaagctctggagatggatgttgtgatagtggcacaataatatgaatgtacttaatgccacaaagcttttacacttaaaaacagtttaaatagggccgggtgcggtggctcaagcctttaatcccagcactttgggaggccagggcaggcggatcacgaggtcaagagttcaagaccattctggctaacacggtgaaactccatctctactaaaaatacaaaaaaaaaaattaggcgtggtggctggcgcctgtggtcccagctcctcgggaggctgaggcaggagaatggcatgaactagggaggtggagtgtgcagtgagctaagattgcgcaactgcactccagcctgggcgacagagcaagactctgtctaaaaaaaaaacaaaaaacaaagaacaaaaacagtttaataaattgtacgttacgtaaactaaacacattttagacaatctgtaagagaaatgaaggcaatcgaggctgttttcacaagtccttggctttagtatgatagcttccaagttgaacctgatgagcctgacctccttgtattaatgtttccatacgctggattggaataacttgtgcaaccagtgggatatgtcagaagtgaccagaaatgagtgggctgccatgttgtgaggacactcacagcctgtgaagaggtctaatgatgaggaagtgaggcctccagccaacagccagtgttaacttgccaaccatgtgagaagctaccttggaaggagatcctccagcagcccctctcatgagagaggtcaagccagagctaacctgctaaactcctaaattcctgaaccacagaaactgtgagataatggttattgttttaagccattatgttttgaggccatatgttatacaggaattgaaaactaatacagatagtatgaaggcttctttcatcaactgcctgaggttggtggtgtcttcagtcatttatatagatctatttgtttctggataatattacagctatttaaagatattttgtggctctatttagatacagctacattcgcctttatatgttttgaatacccagtaagtaacttgaaaatatttcctgatattggagggaggggcattgctgaatttcagaaagttaaggctagtaagagctatgactaatataatacatcttgttggatactgtgaatgcttttcatttaattctgtaggtaaaggaaatagaatctgaaggaaggccagtgttttaagtcttcttactctaacgtgaatgaattcattagacatatttatattttaaaaaaaagaggaagcaaaataaaataagggggcaaaataagcaaagccaacttaagaattttttaagggccaaatccagttatcttggctctgtatgtgtgtacctacctaaaattctaatctctgtatctgtgagtctccagtttttcaacccaagcttgacgagttgtgggacctcctccaaatgtttcaacaggctgctcaggctgccttgcacgtcacagccccagggcagcatcagtgcggtgagctgttctagcacgttcatcctgtcgactggaagaaacaaagagcagttcagggactggatggtctcaaaactgaggaagaacaaaggggtgttaggggaggaatgatctttatgtttggtggctctgcagcctactcaatctgtaatgagaatctacttaatttttggtttttttttggaaagtattcaagcatatacaaacattatgcagaagaatataatgaaactatatatactaataagacaccttcaaaaacattaaatcatgggcaatcttgcttaatcctgacctaattcctcctgtattattctaaagcaaatcatggacaatatgaatcagttctttccttttttttcttttaaccataatcacatatcactatcacacctaaaaaatcatatcaccaattccttaagcaaatttgtcttgcacatcggctactcttgacagttgcctcttcaaaggaggaaagcaggtgggataccgcctcaaagtgcagtgagcatatgtaaactggtgacttaaaagacatgggcctgtgttccttaagggcagtttaagaaaggcctaaatgattttcctaaggagggtgcatctagtaaggcacacatgggtataaaagacctcaggacccaggctatgtatttcgactacccagtatacatattcaagtatctaattttggctgaattgtcattcttactcagttcatgaagagcttcatttccatctttttccaggtaattttctgataaatcaagaatgctcagtttgaccaaattgtgaagattctgagctggggaaaaaaagtaatccaaaataaaaagattttcaggtaaatataaatgtattttgaagtatccttagaataattctgagttttatcttctctgctaatggtagtgcaaaccataacttgccttggttattttaattatttccaaaggctctggtgtaggtgtaacccccaaatcccatggttatgaccaaatgggcaaatagtcattggtcctaggttctgattaatgaattccaggtcacgtagaacctaaagcagcatgggatgtagttgttatgtcatcatggaaaaatcacttggtctctctaagcctcaatgtcttcctctatagaatgaggtagttggaccagataaaatgtaaagttgcttcaattataaaatgccgttaatcatgcaggagaaacaggaacaacaacaacaacaaaaatgaaatgagctggttttgtgtacctcaacttagatgattttattgacataatagttgagatattaataataaaaacatagtaaaaaatggatgagaaaaaaaacaaatagcaaaatggcagattcaaatttatccatatcaacaattacattaaatcttaatggactaaacactccaattaaaaggcagagataatcagatattcagaactttttttaaagcaagacccagttttatgctgtgtacaaaagacgtgtttgaatgacaaagacacaaatatgttgaggtaatggaaaactattttgcatgcaaacattaattatataatagtaccagtctagctaagaattgcttagtgcttttcttcacatattatcactcttgcttaatctagctgaagttttttctgtcagggctagaaaaatctcctttttaaaaaaatcagacaagtttttcatgaatatgtactcttgttataatattggctattattatttttaatcaatcatatgagcccttttcttaaagtatcttctgggttttgtgctctacaataaaaaacctgctgaacttctctttaaaagagtacgtttgctatttgcagttctaagcctgtctctccccatcagtaagtagagaaataaaggcatgtgctcattgttctcatattcccagtacttatccagcctttttcaactgtgggtttctctagctgtaactttatattagtatacaaatggcttccttagttatctttagagactcccagcagttatatagtttaactttaaaaagattataccactgttttccaaaatctaaattttaaaatatgtctgaattacacatgtatagtttatccagaaatatgcagttagtttccccgtagttgatatgcatccctttgggaactcagaaggctcaattatcatatcatgcacattaacttcatcttaacagggcaatgggtaggaattagaagcctgagatcatttaagaaaatctttatctctcacttctcaatcatttatccattcatttaaatgtttattaggcagtaaattatatgaccggttgtgtggcaagtttcaagcacctatttcttattttcttccttttcactttctctaaaaattacatcttcaattattctgaaattctcccctattatccatcaatagttgatttaattctaatatggagaaaaatcattaaaaacaatctgcttattatcgagaagtttttattttccagttttccttaaaattaaatttccatttgagacatttagtgtgaattagtataatagtatcacatgttctgttatactgtcctcattcagttaatggaagcaacagttacctaggattttcactgcatttgcagacaagcagcaggagactaattgaatttcttcaaggtcacagggttcacttgacagagacttgactatgtaatccattccctctccaatgtcagacaagtgggtcaaatgaaataaacacatcttcttcaggtttttcaggccttcagctgaaaaatgatagaaaggaatgcattaggataccaagttaattcgatttaagcatagattaatgaactgaaaagaaagcaaagaataattgtgcagagaccttgccatgttcttcctgcagcgactttaagttacaaagaatcaacgagagctttttttctttcaattctcactttccagtctcttggaccacacaaaaaatcacttatatggaggttattctcttagtagcatgagaaacactgtagtaaatttgtagtctttttaatgggcatcaatgtatactcttaccgtaattctttacatgaatgaagtcttctagagcactctcctttcaatcttctcaaaaatcttaaacagcgggggggctgagttcagggaggtagatgaggacttggctccttggagtgcttctagtgcaactgtctacagcctcaaaagccttgcctggactcatgatatggggcctgcctgaagctttagaatgaagaccacatccactgcagcatgtttaaccagaagaaagatttaccttatatcaacagtataattggaaacattctaaaatatcccccgttcttaagtctaaagctaatgtgcagtttaggattggttaggcctcactttgtgtcattaaaatactgtcttatcttgatggtactgtagcctacgggaaagaaatatatgattttaatgaccaggcatggtggctcacacctgtaatcccagcactatgggaggcagtgataggcgaatcacctgaggtcaggagttcaagaccagcctgtccaacatggcggaaccccatctctactaaaaatacaaaaattagctgggcgtgatggtgcacacctgtaatctcagctacttcggaggttgaggcattagaatcgcttgaacccaggaggcagaggttgcagtgagccaacatctcaccactgcactccagcctgggcgacagagcgagactcccatctcaaagaaaagaaaagaaaagaaataaaatatatgattctaataatatcagtcttgcagagctttcgggaaggttgcagataatgtacgttaacatatttaatgtggtgcctggcacatagtaagtgctccataaatgttcattgttgtcatgggagtatataccggttaaaggttgtgagcatgagctttgcagtcagttcctggatcccctacttaataattataaacttgggcaagttattcaatcttttagctgaagcgttagggatcattatatctatgtactaggactgttgtggggattcaatggaatgaggtatataaaactgccgaggctagtgtctaatctatagcagagtaactctttaataaagagtaaattattactgatataattagactggtttagtcaagttcacattttgattccttaatagcagaagcaggctatcctagagaggtactttttgacctctttctaccagttggtaagatcttgagcaagtcaataagctattttaggttctagtggagttttctgtgaaatgaatgagttgaattagatgctctcaatccccttccagctctgattttctgtgtaatttatacacatgcaataaatgtttattgaacactgaattaatttgattattctcacgtaggacatataaggaaaagaagtcagccatgttttgcttttgtttttgtttttgtttcaagatggagtctatctctgtcaccgaggctggagtgcagtggagcaatctcggctcactacaacctcctcctcctgagttcaagtgattatccttcctcagcctcccaagtagctggcattacaggtgcataccaccatgcccagctaatttttgtatttttagtagagacagggtttcaccatgttggccaggctggtctcgaactcctgaactcaggtgatccatctgcctcggcctcccagagtgctggaattacaggtgtgatccaccatgcccaggcttcagccatgtttggcttataggctagagttgtctttcggcaggaagcagaataagaaagaacaagatgaagggaagagaggagtattttagtgaggactcaagtagggaaaaaaagagccaaaaaaaaaaaaaaaaaaaatccaacacacgagaaaacagggacattcaaggaaagcagctttaacaggaatcctccctggcctgcagggcctggttccctgtggtaagccatgtgttctgcttgtgttcctgaagtttccttttccttttcatttttttgattggggaaacacaacctgcagtgtagaatgaaagcatgcttcccccaaagttttcttgattcacattgtttcctgtgtcctatttcatttatgaatttttttaactatgaaaccatagtataaactttaaaatattgtttctatgcaactatgaaactatactataaactttaaaatattgtttctatgcattaaataaaaacatagccaatgagccagggagacggaagttaaaaacacgtcaggggctctcttcccaaaagggttaccatctggtgttgtacaatttgaataaaatgatgctgaaggattttaatggcagtagggaaaatgtctggggaaaccaatgtagccacaagtacataaaaacatccttgccttgtgcagacacagccaatgtcagagcctgaagttaactcctcttattatcaaacttacattgatacaaatatgagaacagaaatctgacctagttttatagcatcttcttcattcatctttatgttatccattatgagctttgtaaggttcttcaagttacccaagctgtcagtcagaccacctgtcaaaagaaaaaagattggactctttcagcagatatttgctatttactatgtcatttactattactgtcatttttgttaccaatcaaaagattttaatgatcatcatgagccaaaaatgctcatgaaatagacataaaaatatactttttataagagatgggcattatacttcactgtaagcatgttctgcaaataatagactagataccaatttcccagataacagggaaaaaaatttcctttttttttttttttttttttttttgagacagagtcttgctctgtcgcccaggctagagtgcagtggcgcaatctcagctcactgccagctccacctcccgggttcacaccattctcctgcctcagcctcccaagtagctgggactacaggcacctgccaccacgcccggctaattttttttgtatttttagtagagacggggtttcaccatgttagccaggatggtctcaatctcctgacctcgtgatccgcctgcctcggcctcccgaagtgctgggattacaggcgtgagccactgcgcctggccgataacagggaaatttctaaacacttggaaattaaacaacacatttttaaataatcatgcattaaagaagaagtctcatggaaactttgataatattttgaaaaatataaaaataaaaacaaaacttcaaaatctgcagctctctcctcacaaaggggtgaaaagaaaaaaaaatctgcagctaacacagtgcttacagggacatttacagtattgcatacttatattagaaatgaggaaaggcctcaaatcaacaacctaggcatactacttaagaaattacagaaaagagagcaaaataaatgaaagaagaaagaaaataataaagataagggtgcaaatcaaagttattatgcctttattatacaaattaaaaacagaggcaaggtctcactatgttgcccaggctggtctcggactcctgagcacaagtgatcctttggcctcagcctcccaaagtgctaggattacaggcgtgagccaccatgcccagcccagaaatcaaaattataaacaggtaaacaatagaaaaaaatcaatgaagctaaaagttggatctttgaaaagatcaataaaatttaaaaatttctaccaagactgacaaagaaaaagaagacaaaaattaccaatatcagaaacaaaaaaggggatatcactacacacactgcagatattaaaaggacaattagagaataatataaacaaatctatgcacataaatttgacaacatatatgaaattgaccaattttttgaaaaccacaaactaccaacactcatgtgatacggagtaggtaaccggaataaccttatagctattaaagaaattgaatttgttatctaaaatttcccggaaaagacatctgtaggcacagatatgttcacttgcaaattctgccacacattttcatttttttccttctatcaactgtcttcatatctaccacacatttaaagaagaaataacaccaattctacacagtcacttccagaaaatagaagtacaaagaataattcccaactcattttatgaagccatcattaacttgatatgaaaaccagaaaaagacgtagaagaaaaacttttaggccaggcacagtggctcactcctataatccccgtgctttggggggcagaggtaggaggatcacttgaggccaggagtttgagaccagcctgggcaatatatccagaccctatccctacaaaatattttttaaattacccaggtgtggtggcaggtgtgagtagtcctggctactcaggaggctgaggcaagagaatcgcttgagcccaggagttcaagattgcaatgaagtgtgatgacaccactgcactccagccttggtgacagaatgagacaatgtctttaatgaaagaaagagagagagagagagaatagagaaagaaaggagggagggaaggacggaaaagaaaagaaagaaaattgaggctgggcgaggtggctcacacctgtaatcccagcactttgggagggcgaggcaggcaaatcacgaggtcaggagtttgacaccagcctggccaacatggtgaaactccgtctctactaaaaatacaaaaaatcagctgggtgtagtggcaggcgcctgtaatcccagctagtccagaggctgaggcaggagaatcgcttgaacccaggaggcagaggttgcagtgagctgagatcgcaccactgcactccagccctggtgacagagtgagaccccatctcgaaaagaaagaaagaaaattaaactttagaccaatatcattcatgaatacagaatcaaaaatcttcaacaaaatagaaaatggaattcagtcatgcataaaagaatattacggcaggcgtggtggctcacacttgtaatcccagcactttgggaggccgaggcaggtggatcacaaggtcaggagtttgagaccagcctggccaacatggtgaaaccctgtctctactaaaaatacaaaaattagctgggcgtggtggcgcgcctgtagtcccagctacttgggaggctgaggcaggagaattgcttgaacccaggaggcggcggttgcagtgagccgagatcgcatcattgcactcagcctggtgacacagcaagattccatctcaaaaaaaaaaaaaaaaagaatattacaccacctccaaatgggcttcatatagggaatgcaggatgctcaatatgtggaaatcaatccatataattcattatattggcagtctaaaagtaaaactacgtgatcccataaattgatgcagaaaacacatgtgacataatccaacatccaggctaggtggctcacgcctgtaatcccagcacttcgggaggcccaggcgggaaaatctcttgagcacaggagtccaagaccagcctgggcaacatagcgagaactcgtctctacaaaaaatttaaaaattaaccagatgtgatagttcacacttatggtcccagctagtcaggaggctgaggtgggtggatctgttgagcccaggaagtcaaggctacagtgagctatgatcacgccactgcactccagcctgggtgacagaacaagaccctgcctcaaaaataatctaaaaataatttaataaaaacaatccaacatccatccatgtaaaatgacatgatcatataaatggatacagaaaacatctttagcacaatccaacacctattcatgaccaaaaaaaaaaaattctcagcaacttgataaaagacacctacaagaaaactacatttaacattatacttaaaggtgaaagtctgaatgctttctccctaaggtcaggaacaaggcaagatgttaattcatgtcactattcaacattgtactacaagtcctagttagtgaaataaggcaaaaaaaaaaaataaataaaaggaatacagattggaagggaagaatttaaaatcattcttttcgaagataacatgattgtctatgataaaaatgtcaaggaatctacaacacccccttctgcaaaccccacaaaaaaaacccttctaaaactggctgggtgcagtggctcatacatataatcctagcagtttgcgagactgatggggaggatcacttgagcccaggagttcaagactggccttggcaacatagagagacctcctctctacaaaaaagaaggaggaggaggaggaggagagggagagagggggagggggaaggagaggggaagggagaggaagaaggaggaggaggaggagaaggaggaggaagaggaggagaatgagaagagaaaaaattagtgaggtagcgaggtgtggtggcacatgtcagtggtcccagcgacttaggaggctgagcattatgtagaaaatgggattatagaccgggcacggtggctcatgcctgtaatcccagcaatttgggtagccgaggtgggtggatcacttgaggtctggagttcaaggccagcctggtcaacatggtgaaaccctgtctctattaaaaaatacaaaaattagccaggcgtgttattgggcgcctgtaatcccagctactcaggaggctgaggtaagagaatcacttgaacctgggaggcagaggttgcagtaagccgagatcacaccactgcaccccagcctgggcgacagagtgagactccttctcaaaaaaaaaaaaaaaaaaaaaaacagatgaatagaggtcattatggtaagtgaaataagccaggcacagaaagacagacatcacgtgttcttacttatttgtaggatctaaaaatcaaaacaattgaactcacggagagtagaaggatggttaccagaggctgggaagggtagtagggaggaggtggaaatggttaatggatacaaaaaaatacttagaagggataaataagatctagtatttgatagcacaacatagtatctaagtcaaaataagttaactgtatatttaaaataactaacagtacaactggattgttcttaacacaaaacataaatggttgaagggatggatactccattttccatgatgtgattattacacattgcatgcctggatcaaagcatctcatgtaccccataaatatatatacctactatgtatccacaaaaatgaaaaatagaaaaaatttaccttatagggttaagacatctaaatgagttgatacacgaaatttgcttcaataatacctgtatgtgttcaataatgttggctatcgttatgtatacctttaaaaaatcaacaggttggggccaggtgtggtggctcacacctgtaatcccagccctttgggaggccgaggcgggtggatcacctgaggttgggagtttgaaaccagcctggccaacatggtgaaaccccgtctgtactaaaaatacaaaaattagccaggtgtggtggtgcatgcctgtaatcccagctacttgggattctgaggccggagacttgcttgaatccgggaggtggaggttgcagtgagccaagattgtgccactgcactccagcctgggtgacagagtgagaccctgtctcaaaaaaataataattaaataaagtaaatactttttttaaatggcaaacattaaaaaataattataaacaccatataggccaaattcagcacataggtgatcactttacaggatcagtataaaagaatagttgtcatgagtagatggtgagcttcctgacacagaaggtagtctaatacagtcttcgtgacacccagaatcttacagaagggattccctcattagggaggaggtttcaaagattatctgtacaaaaaattctagaatcttaaaatgataggaaatttctctgtagggtgacaagcaaggcagagctgggtgggaaattgctagcgtttgaaaactaaccccagactgctacagttaagtacagcaagattcctgcttcccatggcttcacaccacatagcagttcctgctcggggcaaccaggctggtctacacaggtagggcagacattctcctttagtgttatttggaatttggggaagtatccccgttacccagaaagattgccctcgcatatctgtgtctgaagtctaaaatctgaaatttcatcatgttagacaatattccccaaatcttctgtcattcattcttctttttcttttctttttggagatagggtcttgctgtgttgcccaggcacagatatgatcatatcttgctgcagcctgaaaattcctgggctcaagtgatcctcccacctcagcctctggagtatctgggattacaggcatgcaccatcacgcccagatgattaatttttgttggagacagggtcttcctattgtgtccaggctgatctcaagtaatcctcctgccttggcctcccaaagtgttggaattacaggtgtgagtcacctggcctggccccaaccaagtaaacaacagttagggtgggaacggagctgagtatcttctacaatttcccagatgagaatcttgtaacacaattagctcctagctcctgcaggtgattaatttacaggttggatttcctccaagacttgaagtagggcagggtgccacttggcagggaaggactgggtattgggtagagatgggggtgctcgcaggagaaggatttgctgaagacaagcttaacctgcgtatatatttattttttttaatttttttttttttttttagacagagtttcactcttgttgcccaggctggagtgcaatggcgtgatctcggcccaccgcaacctccacctcccaggttcaagtgattctcctgcctcagcctcccgagtagctgggactacaggcatgtgccaccacgcccggctaattttgtatttttagtagagatggggtttctccatgttggtcaggctggtcttgaactcccaacctcaggtgacccacctgcctcagccttccaatatattttttaataaaaatatttttagtatatttacatttttaataaaaatagttttaatatatttaaacacatacatatatgtatctatgtatgtatgtgtatatatatctttccaatcagactacagctctgggaatcttccctatggctcccaatctaacagctttcccccaacatagacctctctccacagcccttctaccttcctttcaagtcctgacacctggtagaaactactagaaaatttaaaacaaaactaataaaaatgaaatcatgtcttttgcagcaacattgatggaaccggaggccattatcttaggtgaaataactcagaaacagaaaatcaaataccatatatactcacttacaagtgggagctaaataatgtgtacacatggagatagaaagcagaatagacatggagacttggaaaggtgggagcgtgacagggaggcaagggatgagaaataatctgataatggtggttacactaaaagctcagatttcaccaccacgaaatatatcgatataacaaaactgcacttgtaccccctatatctataaaaataaataataaataataaagcaaaactatatatctaacattttcacagtattcctggctaatatttccagccagtcttgattatagctgtaaactaaaaatcctaagccccccaccaactgaatgcatcccctctgggctaaggagaccccagaaaaaaaccttaaactcagttcctggccatgacaggatgggaggtcaaacacacatcattatactccctctcttgtatggtttgaacacaactcatcagcattactgttgacatagagatcataagactaacagaacagactttttgtggcaataaattaccaagttataaagaggacataagaccatgccaggcaaaggctaagtcattcagctctacgcttaaagaataaactgtcctaggctgggcgtggtggctcacgcctgtaatcccaacagtttggaaggtggaggcagtagaactgcttgatcccaggagttcaagaccagcctgggaaacatagtgagacctcatctccccataaaaaatcaaacaatgaggatcaactgagcccaggaggttgaggctgcaatgagctgtgatcgcaccactgcactcccacctgggtgacagagcaagacccaacctcgaaaaaaaaaaaaaatttaaaaagaataaactctgtcgtaactgccacagatttttcttctttggtagctaaacaagcattggtctcaagataagcaatattgatagttgtgaatattaaacaattcgcaactcatccagctcacaaatgctaacaatccctgttccatctgccataactacagctttgattggagaagagagtgatttcagtaactttctcctgatcagaggaccaccaaccacagactggttctggctggtttacagagattgcgtacctgcttacctttgtgctctgaaaagaacttctgaagtataggcctaattgtaatacatttaaatcatttaaaggggtgtacaatcttttggtttccctgggccacattggaagaattgtcttgggctacacaaaaatgaatttgtgctgggccacattcaaagccgtcttgggctatgtgcagcccacggactgcaggttggataagcttgatttaatgctaaatctccaccccaaagtgaacatgggttgtatgttacatgcatgtttattcaatatgcatgtatcaagaccaccttcatgaatattcatagctcctcctgtaatctgttgaatatgtatgtttagccaacccattcaacataaagtgtctaccccaacccctccttcgaggtgcctgtctctggtcttggttggaggcatgtttctcagcctgtgggatggccaccttgcaggctgtaaccctttagaagaaataaagtctcctctctccttttccaaatttatacactgttatttttttttaagtgaacaaagcacaaaccactgatatttacaatacccggcagccgttgattctgtaggtcatgaatactcaaggttttcaggtttgttacagatgtgatgtgcctctcatcttctatggtgaggggactggcttccaccatgagagaataaatgttcttacaggtgctgaggaccaaactgaggcttccagccacaccagcacatctctttatttgcagcctgaggcttgtggcagagctgaatattttccccagatatctgatatcttgcttattcaacttgctgaaatcccggagtgtgacctccagagtcctgaattcctgcttccagttgaagaacaaagatacagccctgctgggaatgtaggtttctggggcctcttccatgtggattccacctgtgtcttctgcagccttttcccatgaagccatagctcccccataaaagtccagtttaatgaagtccagggcacttgcacaattgggcaaatgttcaaagaagtcaaataagtaatcggggatgttccctgagttgatatataagcttttaccttgaaagaaagcttcaaattcttggctcagggctgatttggatgtactctcttgatataaatggatgccacactctacaaaggaattgatgtttatggctttcagaatttcttgctcagtggtgtttttcacactttgcaaagattcctgtctccagagaggcctcttggcgatggaaagtccgagaaggcagccgtgttgatacactgctgcgaggtgcttcataacagccctggtggcttccacagatgacccacaggtgtaccggagcaggctgctataagtggatgtaatgtccgaaatggaaaccattttctgcaagtaaccattccccttggtcacctcctctggctcatgagacgtcaataaactgctgagtcttcgtcctgctgtgtactcctggaatgacttgtgaaagaatttatactttggcttgaacctttgagctgtatatttacagaggagcccagttgtcagcaggacatcctcattcacgctggacacatcctgcagttcgaaatcaaacttgtgggagaacacaccctccagagctaggtctccacagtggtccaggctccgaatgaagtcacttgcagccacacctttatgtttgtgtttgtttttctgtatcaacagatcatagaaggtatggaacagcgttgtttgtgtgtgagagtggaactcactttcacccatctggattgcacaagtgatgaccacaaagagaggggtcttcatgagattcctcaagcacctggatttctgaatttggagcaacaagccttcagcaagctccttgatcagcacttctcggatgagagcctgggcgctgtcttctgtcatatcccccacctcagcagtcagggcaccaaactgccgtatgtgcctcaggcactcagtggtagtggtgacgatgaccatgttcttgaagcggtggttttcctttatcagggcttcgatttctgggcagttctggggcttgaattcattgtagccatcaagaaggaaaagaaccctctgccgcagcttcagcagcatggccatgaatgtctgcttcctgattgtgccaggtatatccaggagttgatcacagagggtttcaaaaagtccaccctgggccctgctgagacggaggaagaagacgaatttgaacttggtcagagccttgcactttccggagccccagagcatggcaattcgctgcagcagagtggacttgcctttgccagattccccttcaatgatgcaggggctctgaagagcctgcaggaggccattcagggtcagctgctccacgcggtgatggtgttggtccttcctccacaggacaggttctgtgaaggtgcttttcaagttaaaaataatgtcaatatcttcaccaaggggataaaagttcagaaaagatggggtatggtacaagtcctttaaatcctgagccaaatcgtccaagtctccttctgatgtctgatgaaaaagacctattagagaagaggtgatgttaaagaagacccaattctgtgtctcctcaaaacctagagttcaggaggatgaacgggggggtgaggctgagaatctgccattggtgaatgtaatgtcctttcccagttctgagctggcacaaagggttctgtctgctccccctttccccagcatcctttaccccactcccctttttgctttctgtttcctcctttccacaaccaaatcttatagcagctggttggaaaagggaggagcttgtttttgggttaaggaaagtaaagaatttggcagagaaagatggttagggataattgtcatcatagtaggccttcactctgagtaaaatctgtcatgaccttatttactaattaaaaaaataaaaacaatattttatgaaacatagaatcatggttctgtgtcagtcaggctgtctttaccaggaggcctggacatggagtaggtagtcagctgggcctctctcccataggtagatctcatccaaccagggaatgctgagaaccactgctgcactggaagcttaactagtgcacttattctccagttttatcttgcagtgagacaatactcaatcatttatttcctggccttggggttatttgtttggcttcaccatcaattgatctactatgagtttttcctaaaatcatctaagcttttccttagcaggtatcaaaggccactgccaggtgatatgaagagaaggaaaagcagaggctctgccatggggaagatggatctttgttgtggtctattctacttgcagaaacagatgcaaaactaactgatacttactttgtccattcaagtcctgaaatagaggatagttccactccttaagggatttaagaaagaggttacaggactctgaaccctttttcaaaatcatgtgaatgatccctctagcagcatcctgctccaccttctcgcagcaaatgatgtttacttcttcgcgattcagaacattccatacaaataggtcatctgtgatttgctttataacagtcattcccattctttgaataagggctcggctattgtcctttatgaaattcactgaggagatggggagaaatatacatatttatttacttatataaaatgtgcatatccggctgggcacggtggctcacgcctgtaatcccagcactttgggaggccgaggcgggcagatcacgaggtcaggagatcgagaccatcctggctaacacagtgaaaccctgtctctactaaaaatacaaaaaattagccgggcgtggtggcgggcgcctgtagtcccagctacttgggaggctgaggcaggagaatggcgtgaacccaggaggcggagcttgcagtgagctgagatagcgccactgcactccggcctgggcgaaagagcgagactccgtctaaaaaaaaaaaattaaatatgcatatcagcatctgtctccagagcattagggccatgcatttttttcctgtgagcatctcctgagttatggagatgccaaatgcctgaattccaggccttcaagaaatgctctgccaagcattttttttctgagacggagtcttgctgtgtcacccaggctggagtgcagtgacgcgatctcggctcactgcaagctctgcctcctgggttcaagcaattctcctgcctccgcctcctgagtagctgggattacaggcacgcaccaccacactcagctaatttttctattatttgtagagacggggtttcaccattttggtcagactggtctcgaactcctgaccttgtgatccacctgccttggcttcccaaagtgctgggattacaggcgtgagccaccgtgcccggcctctgcaaagcatttctaaccccagagttattgatgagcaagatgttttgctttggtgaagaagtaaggtgagttatcttgtccctctgatataaagcagtccccagtgaggttgtagttgtaagaccgttggctttagaataatggcaatggcctaggatctgccacttgctaccatctatgtgaccttggcaagtcactaagcctctttgagtctatttcaattacgtgctgctggccgggtgcggtggctcacacctgtaaccccagcactttgggaggccaaggcgggcggatcaccagaggtcgggagttcgagaccagcctgaccaacatggagaaaccttgtctctactaaaaatgcaaaattagccaggtgtggtggtgcatgcctgtagtggcagctactcaggaggctgaggcaggagaatcgcttgaacctgggaggtggaggttgcggtgagccgagatggtgccattgcactccagcctgggcaacaagagcaaaactctgtctcaaaaaaaaaaaaaaaaaaaagtacgtgctgctaaatgtttcacaaactggccctggccctctgggagtaaaggccctaatttgtagcattcaccaatccccaaggtataaatattcctaccatggcctatttcaagctaacagcgtatgttaactggctaacaaaaatcctgaaaattcaataatcaggtttcacatcacagtaacaaccagctccagcacactggggattcctcatctgtacaatggtgtcaagagcattatttaacttaggaagttgttacaataattcatgtatagtatctcatacaaagtaataactcaatatatgttagctactatttttagcctttattcaggtgtcaccagacaaagagcacattgtatctccacagactttggtcttttctgaagagtatcacatcaaaacactggtttttatccaatgtaagctctctcgccaggtcttgagggtagctgtgtcctttttgtgtctgactctgcaaggtctaattctgaaacgtagaccacaccgtacccaggcactgtacccacgctatgtttgtgacagcttggagaaatgtcttcctggtttttaactctcagacaccgtctgcactagatttcttcctgggctaggctgctcctggttttttttttttttttttttttcagacgaagtttcactgttgctgcccaggctggagtgcaatggcgcgatctcagctcaccacaacctctgcctgccaggttcaagcaattcccctgcctcggcctcccaagcagctgggattacaggcatgcgccaccacacccagctaattttgtatttttagtagagatgagatttctctatgttggtcaggctggtctcgaactcccgacctcaggtgatctgcccgtctcagcttcccaaagtgctaggattacaggcatgagccaccgcacctggccgctcctggctttcaaacctgtgttgactgatcagagagggaatgcactcctctcaaagaccccagaacctctctggcctgaaatgcaccatcaatcactccaagcaccaggaccccaccccagccgtcctttctcaccattgcagagctctgctgctgacctcagctagaatattccctgtctacatgtcctgcaagagtcccatctctctccttctggggtctcatctgttctctagcttccacatcatccctatggaagtaacctctaagtctgtgtcccattgtgatcttcagtttagagctaaagaaatacagcctcacccgggcgcagtggctcacacctgtaatcccagcactttggaaggctgaggtgggcggattatctgaggtcgggagttcgagactagcctgaccaacatggagaaaccctgtctctactaaaaatacaaaattagccagtcgtggtggcacatgcctgtaatcccagctactcgggaggctgaggcaggcgaatcacttgaacctgggaagcagaggttgcggtgagcccagatggcgccattgcactccagcctgggcaacaagagcaaaactccgtctcaaaaaaaaaaaaaaaaaataagaaatacagcctcagaaaggcttagagacccacacacacacaagttcacagcctagccttcctgagactacctttcttcacctataaaatgaagacacgttatttaaaatactctaattatttaaaagactcattatattgaataagtcacataactctcatacccaaaaatgtcttaaaattggaaaagtggctaggcgtggtggctcacacctgtaatcccagcattttgggaggccgaggcgggtggatcacgaggtcaggagatcgagatcatcctggctaatatggtgaaacctcgtctctactaaaaatacaaaaaattagctgggcatggtggcacgcgcctgtggtcccagctactcaggaggctgaggcagaagcatcgcttgaacccaggaggtggaggttgcagtgagccaagatcacaccactgcactccagcctgggctacagagcgagactccatctcacacaaaaaaaaaaatttacaaaaaaaaatatatatataaacagtaagatattattttactatgttatatctccttgtatgtagaccatcatactccttccttatcaagtaattaggtggaaaaaatgctgctcatttattcattaattattcattcttttcagaatatctctttgtctagaccaatgcttttcaatagaactttctgtgataatgaacatgttctatatctgcattatacaatatggtagtcattagccacatgtgactactgagtgcttgaaatctggctacagtgactgtgcaactgaagtttacattttattttatttaaattcacctttaaatagctacagagggctagtggctactattaatatactagatagtgcaggtctacacccagccatttaaagtggaaggagctacattttggttgccacttagatctataccatgtttcttcacaatgagcttgacatgtatagctctctgctgtctggctgaacaggtgatgagaactaacagtttaaaacatacacctggtcactctttgtgtaagtcctatcctatctgtggttctgccttttatcacaggttaccatatttgtaactgaattcctaaaacaacagaagaatatttattggtaattccacatatgactggtcagaggaagccatgaactgattttccatttaaaatcaccagtatttggtagcagactgtataaccaggcagatgttatttctcatatacttacttgttctggatgaaagcttcccacctttctataacacaatagaaaatattatttccaaatggaaaggtcaaaggtgatcccaatattgtcctcttttttctgtaaaactactcttcattctgtaaaacaaacaaaacagaaccagagactatcaggtggaggggctgatgcaattatctaggtaatgccccgcttttcatagatgagaaaatggtgacccaaaccagaaaaaaactcgctcaaagcccctggctattcatggccaggccctaaagagaacccaggcggctggactccttgcctagagctctaaactatgttcagctggaactttgcccttctcttcaaagtttcttctcatttctgctgttcagagccaagaaggcaacatggaattaaatgtcaaaagacggtataagtgtcaacatgaatggtgcagagggtacgttctctccagtatttccaggaaagagtatatggactggaatcatccagggaggaagttttcatggaggagacagcacatgaaccaggtcttaaaggataagtagggctgggcgcggtggctcacgcctgtaatcccaacactttgggaggccgaggcaggcggatcacgtgaggtaaggagttcgagaccagcctgaccaacatggtgaatcctgtctctattaaaaatacaaaaattagcggggcgtggtggcacacgcctgtagtcccagctgttccggaggctgaggcaggagagtcacttgagcccgggagacggaggttgcagtgagccgagatcgtgccactgcatcccagcctggcagacagagcgagactctgcctcaaaaagaaaaaaaaaaaaaaaaaaggataagtaagatgaggccaggtagttgggctggggtggaggtggagatgaggatgtaaaacgccttgcaggtgagaggatgagatcagggagtatggaaaggggaaaagttctcttgtccccttcgcagggcttgcgatgggggtgtggctcacttcttcagtgcccgctgctcagacctctaggggatcatacagatgggcgggctgtggggttccaatcccacggcagtgtctagtggtgaatgtttacagctcctgaagccccagtgggtgtgtgttacagggtgctcttttagttcagctgtccgtaggcgtcttgtattagctcaatgggacccctgccttattgcaaggacagagggctttctgtattccggggttcttgccttggtgtaccggaggaattggatcacacgtggtcttggagaatgagcgcaaggtttcattgagtggaagaagctctcagcagatggggtagccagaagggagatggtttttccccggagtaagaccgccaccaactcttctccaaccctccaggccaaactccgagtcgttcctctggtggatggcctgctggcgtgccgatgtctgttgtgtgctcttccgccagcattctcccttcaacgtcctctggacgtccagctgcttgtatgttcttccgccgatgtgttcctctcgacgtccagccgcttgtgtgtctgcctgcaagggtctctgggatttttataagcataggatgacggtgtggcaggccagggtggccttgggaaatgcaacatttgggcgccaaggcaggagtgcctgtcctcacctaggtccgtgggcacaggcctgggggtggagcccttgccagggacgcgcccttctcttcccagcacttcccttccccccttccctatcaatatgagtaattgaggagacagaaaaaaggagttatgcttccagggtacaaaggggaaaagctatggaaagccttgtacgccaagatgaggcatttgttctttatcctatgagcaactgggagagattatggtataaggagtatgtttaaagtgatgttttaagataagaaacggatttcaatttcctggtatggtcctgtcatttcatcctcctagttgctttaaaagcaacttcctttctcccttcctcctccacacactctgaaaagcaggggcccagaagcctctgagactgctctgtgtgcattcccaaaccaagttagatgatctaccccggctcctcatacacacatacacgaccccctgcatcaggatgaagatgcaaagtctgaattaaagacagcatgagagggcagacaggaagtggggaagagaactagaatcactgggtggagagaaacaaaatgggagctatgtgagtgtgattgtggtatgtgaatggagttggcttgggaactcatgtggatggggttggcatgggaactcatgttatcctaacattaaaactctttttttgagacagggtctcactctgtcacccaggttggagtgcagtggccccatcatggctcacggcatccttaaccttctgggctcaggtgatcttcccacctcagcctcctgagtaactgggaccgcaggtgtgtgccaccatgcctggctaattttttttttttttttttttttttttttagagacagagttttgccgtgttgcccaggctggtctcaaactcctgggctaaagtgatctgtctgcctcagtctcccaaaatgctgagatcacaagaatgagccaccgcgtctggccattaccctaacattttattatgaacattttcaaacatagagaaaatccatccctctattcatttatcaatctattttacttattttcttgcatattcaatgtaagttgcagacgttagtacacttctatgttcatataattaactagaattcaatattggtttattattctttcttaggaaaaattcacctacagtgaaagcagagatcttaactgtaccctttgatgagctgaaaaatgcttctacctcaaacacctatcaagacagaaaacattaccctctccttagtatcctatgccccttcccagtcaaattccatctctgccacaccctcaaagaaaatcactcttctgatttttttaaaccgtaaattagcctgttgaagaacttcacataaacggaatcatacagtatgtgctactcctttcattccacacaatgtctgtgtaagtcactcatgctgttgcttgcagtataagtagtttgtaacatttcattgcttagtagtattgtactgtataaaatactagagtgtattggccgggcacggtggctcacgcctgtaatcccagcatattgggaggccgaggtgggcggatcacctgaggtcaggagttcaagaccagcctggccaacatggcgaaaccctgtctctactaaaaatacaaaaattacccgggcatggtggctcatgcctgtaattccagctacttgggaggctgaggcaggagaatcacttgaacccaggaagcggaggttgcagtgagccaagatcgtgccaccacactccagcctgggcaacgacaaaaaaaaaaaaaaaaaaaacaacgaaaaaaaaaaaactagagtttatttatctattctcctgttgatggattgggttgttttcagattggggctatcataaatacagaacaatgaatacttttgtacaagggggtccttccccacaaaaacttctctaagaatagcttactttgactctgatctttctaatttcacaagctctttgaataaggatctcctcagcttaaactagatgctcacagccatggcaagtttgctgtgaatgttgctgttgtgagagtgataagtgaggataagaaagtcctagataaagtttcctttcattcaaaaagcccccaaatcatatcttttctaataaaaagcagcctgaaaaatcaagctgcaagtatagataagctaaaagcttgcattggtaaatgccagtagctgtgcccatagaaaaaagccacctgggggccaggcatattcaacatggcggatccatcttcccttttctttttcaaccatgtgtacagtaggaacagacaacatagtgccggccagatagagaccccatctgcataataaaacataagggtggaatggccggcttcttcgtgcgctatgcaaacgttataccggttctgaccaatctctcagtccctatgtatatcagacaccaccttctcaagttcatctataaaaccccatgcattggctgggtgcagtggctcacgcctgtaatcccagcactttgggaggctgaggcaggcggatcacaaagtcaggagatcgagaccatcctggctaacaaggtgaaaccctgtctctactaaaaaattcaaaaatttagccaggcgtggtggtgggcgcctgtagtcccagctaatcgggaggctgaggcaggagaatggcgtgaacccggggggcggagcttgcagtgagccgagatcgcagcactgcactccagcctgggcgacagagcgagactccatctgaaaacaacaacaacaacaacaccatgtatttcaccacaaaaccactcactcaggttcccctctctctctgcaggagagagagctattctcttttctctttctttcgcctattaagcctccccccttttgtttttttttgagatggagcctcgctctgtagccaggctggagtgcagtggtgcgacctcagctcactgcaacctctgccatctgggttcaagcgattctcctgcctcagcctcccgagtagctgggattacaggtgcatgcctcctcacccagctaatttttgtatttttagtagagatggggtttcaccatgttggccaggatggtctcaacctcctgatcttgtgatctgcctgcctcggcctcccaaagtgctgggattacaggcgtgagccaccatgcccggcctaaaactccactctcaaactcacttcttgtgtgtctgtgtcctcgattcctttggcgtgagacaacgaacatcaggtatttaccccaatgatgctgcttcaaaagcatatctattttcagaaaataaagtttcccttttatgttaaaactgattcattaacaatataaaaaattgtcattgaaattggagcagccaggcgcggtggctcacgcctgtaatcctagcactttgggaggctgaggcaggtggatcacgaggtcaagagatcgagaccatcctggccaacatggtgaaaccccgtctctactaaaaatacaagaattagccaggcgtggtggcaggcgcctgtactcccagctactcgggaggctgaggcaggagaatcacttgaaccagggaggcggaggttgcagtgagccgagattgcgccactgcactccagcctggtgacagagcgagactctgggtcaaaaaaaagaaaaaaagaaagaaagaaaagaaaagaaattggggcagctcaggagcttaagcaagggcacattttggtgtcaggattgcgttcaaactacagctctaccactgacacactaagagtcctcaatcaaggggtaatgactggcacacaggaaggactcagtgaatggcggcaactgtagattcttctctccctttctacttccccaaaaaggggtgggtttgggaagaatcacaccatccctgactgggtcaaagtttaagtcagagtagaaaaagaggaagaagatagaggaaggagctaagatgtataaagtttttaattgctctcaagaacaaaatcaatccatatactgaagatcatgtaatttttctcagttacccactggcataaagaatagggctgtggaccaggcgtggtggttcacgcttgtaatcccagtgcttggggagactgaggagggtggatcacctgaagtcaggagtttgagaccagcctggccaacatggtgaaaccccatctctgctaaaagtacaagaaattagccaggcgtggaggtgcacacctgtaatcccagctacttgggaagctgggacaggagagtttcttgaacccaggaggtggaggtttcagtgagccaagatagcaccattgcactccagcctgggtgacagagagagactctgtctcagacaaaaaaaaaaaagaataggactgagaccagtgtactctcttggaatgtagctatggccctgcaacccctccccgcaagctgtccagtgaataactgaattgggtggaagaagtccttcccccacatttgtacattggaaaataatataataatatatattatatatatataggcaatctgcctgcctcggcctcccaaagtgctgggattacaggcataagccaccatgcccagctggaaaataatatttagtactaattctaaaattggcattttcttaaaaaaggttacatgagctcctcagagaactgaagtttctctggacccatataacccacgtctatggggtcattcccacacctcacagataaaataagggaaagagtacatataattaggagcagacaggaagcacacagaaatggaaaatgtgtgtgggctttggcattgcagatctgaattcaaatcctcactctgcaccttatgaggtaagtatccctagacatgttacttagcctttccgaatcttgctttccaaatcatgcataatattcacctccctggactattgtgaagattaaacatgaaagtagttgtgacaaagatggtcagtgggtattatctgtcttcctttctagtaaaaaggctctagactagaatgttcttaggtctttaataggcttcagcaatctcacatgttaatattagtgttatgtgctgaactgggcttcccccaaatccatatgttgaagccctgaacctcagaatgtgactgtatttgcagacagagcctttaaagaggtcattaagctcaaatgaggctgttatgagaagaggaaatcgggacacacaaagggagataccaggaatgtgcatacagagagaaaaggccaaggagggaggcgtggggagaagccaaccctgctgacaccttggtcttggacttgcagcctccagaactgtgggaatataaatttctgttgtttaagccacccagtctatggtattttaaacacattaatacgactaatattataaaagtgtgtgaacagttaagaagtgtgctgaccaggttctatcctagttttgtagacaattagcagtgtgatgtagggcaggacatttaactcctctctaccacattttccacctctcaaagccaggctgcaaggatctactgagataatgtacataaagaccctatcacgaaataggtgtcccgtaaagggtgatttccttcacttctgtctccaaatatcaggtttctcatcagtaacttgggagattggatggactaagtagtccacctcgttcctttcagctttgatcatctgtgattctaacaacagtcttagcaacaagagtgagtttcctggccgggcacgttggctcacacctgtaatcccagcactttgggaggctgaggtgggcagatcacgaggtcaggagttgagaccagtctggccaacatggtgaaaccctgtctctactaaaaatacaaaaattagctggggcgcggtgccgggtgcctgtaatcccagctacttgggaggctgaggcaggagaattgcttgaacccaggaggcagaggttgcagtgagccgagatcacgccactgcagtccagcctgggtgacagagcaagactctgtctcaaaaaaaaaaaaaaaaaaagagtgagtttcctttctgtaatgccaaaaagtgtttccaaagtcctttccatctcacagtagtccaaggggtacatgtaccccttgaacctgatgaagccccagcagacccgattaaccacccctaaaggtttctcggcaggcaaatccagccaggcatgcaaatcacactcgtcaatgttaaggcttttgtacatcccagacacaagctttaaatgaatgtaaacccagattttaatatttgggccccagaccttaaaaatcccattctctctacccacagtacctggctgagcaatccaattgccctcttcttgggagaccaagacatgtttttaaaataaagtttctttgtatttgctttccgtttcagtgaggcctcgagttcttgtagaccagataccttcttgttctgtgagaggacagtgt

SEQ ID NO: 2631 - DNA, 41172 bp, Homo sapiens
  source 1..41172: mol_type = genomic DNA
ttactggcttcgagtacactttatttaagcagttactagtttaaaagcacctgtaataacactgagatcatcatcatcaaattgccacccaacaagcctagcttcttgcagaaaagttaacttggataacacttggctaagttttctgactaatgctggatcaggtagaaattctttagtactaaagtcaaaaaacactaattgcttaagattctcaaatacacccatgaaggcaagccatccatcactgctcacacgatttcccgccaaattcaactgctggaagtttttcagagggttctttccaaaaaatgcacctgggtaaagaaataagtatattagttggaagaaaaattttttttaaaaaaaaagagaaataggttctacatttattttacatacttttttttcactctgaaatggccatgtttgaaccagtgctttgcctcagaaagaaattattaatataattctctatagctagggcagtgattgtgaatatggtctattatattttcctagagtataagggaatctgataaatagtgattcgtagtgaggtagcaacaatatgtaaatgaattacttttttttccccttttccttactcctaggaaatggaaggttgctttaattaaatattcagtacttgttttcaaaactggagtcaatctttggcaatattaagtcgtttcctcttctgaaaaagtaaacaccacctaactgttgtttctatgggtatgttcctaactgtaaacttgagtaagtgagcctccttcagtatctaaagatttgggtgtttttgtttacctgtttatgtataaccctcccgagcctcttcaggaagttcctccattccttacagaatagggcacctaaagtatttcctacatagggtaggtggatatcctgtctttctgatacacaaagaatgcacacacacacacatacatacaaaggatgtgtgtgtgtgtgtgtgtgtgtgtgtgtgtgtgtgtatacatacacaaatagtttagtgttcattctttatcccatgttaccagtttaggtggtactggaacccaagtgagtcttgcaataagaaaaaatacctttctttcaggttatttaccatcatacagattggccagtatacaacattaggatttcacaaaactagctctgtgttaattacacatattaaattgtgcaaagcgttagccctacccacctacctggccctttctggatgactaagttcaccttgaagtacagagtggacagacaggcagactggacatgggaactcttacttacatgtttatactccagagtatcacacacaaaatgcagaagatgtatgcctggtttatcaatccacattactcggctcatccgagctcatcttagtcttagtgtacctcacccaactttggagggttaatttgttgtatattaaacttgtgtttcttgggagatgtgtaatattagataatgttccagaaactgacccttatggaaatgaaggtccatgattcagtttggattccaagtaggaaaagaggttttaaaagttcctttccattgtctcagtgagaagaccactaaagagttcaagttaaagaaggaaagattcggtgctgtacaaccttaaggttagcaagcaaagactaaaaggtatctgctaccagtaatgagggcttaatgacagaaatggacagtcttgtccgaccagcttacgtgggtgaggtcaacctagttatgcactgaaactatacccttacccactttcagtaaaggtgtttaccagctccgtagtgagaggagatctgtgaatttggtgtctgatgtcactgcatggccttgtgtagtttgttcagtgcaactaagtacattctagagtgtgtccttagtcaatgtcagccaatgcttttatcaccatcataaggtcttgagtttcgaaaggtcttcaggttcttctttacagacacctaaagtgattggccctgcctgaccgtggtcaagatgctagcggctaaagtgggcaaagccaggtaaggagatgattcacagggttctgccttcatgtctcttacccatggtcagtgtcactgacaccatctttgggccttctttgccacttttattaatttgaaaagtgagacagaggccgggtgcggtggctcatgcctataatcccagcactttgggaggccaaggcgggcagatcacctgaggtcaggagtttgagaccagcctgaccaacatggagaaaccccgtctctagtaaaaatacagaattagccaggcgtggtggtgcatgcctgtaatcccagctattcgggaggctgaggcaggaggatcacttgaacccaggaggcagaggttgcggtgagcagagatcacaccattgcactccagcctgggtaacgagtgaaactccatttcaaaaaaaaaaagagaagaaaagtgagacagactgctagttgttcccaaaactgtctctccttattccatagttaatagagttttatttcggcatatggccactcatatcccaacctcccttgctattaggtgtggctaaatttttgccaaggaagtataggcagaagtgatgtgtgcaacttccatgtcacttttccgcttttcccctcttctactaggttgaaatgatcacagggcagtgacctagctatggccataaagtcaaaaataacactcttaaggaatagaggagtaaaaaaaaaaagtaggggtctgggcctgaaagactgcacagaggaaaaccaccccacctgcctggactgctcatttctggactgttacatgatagagaatcaagttctgccttctgtaagccatggtatagttgggtctctgttatcacagcgtagcctatgcccagcccaaatagtacctaggtccttactttcccctgccttccacctcctctgttccttggaggatggctttctccctgctctctcttccatctcatgttcatgtcctttctgcctttgccccttctccatatgcttcccagcatggcatgcactcagtccaaatgctggttgccagttgtgtgtctatttaaggctctttccccaaagatcaactttttttctccttctcagctagcagaacatattttcaccacctaaaaggaatttaagaagaatttaaagcccattccaccctcacagggtgagcaatttatagtggttatctactaaggtataaggatcttatcatcaatttaagagagtttcttagataattattggaatgtgtgctagtgcaggaaccaagaacaaacaacatttgtcataagccaagggcatgccttttgttcatttaatctgcagtgcttatgttatgaggagcagactagatccaagagaaacagaatccatgacatttagagccataggctgtatgtgggctgtggagagtgcaaatggcttgattggaattccaggaaaaatctcagatgccctgggtagaagggttctgattcttgggggttcctgtatcccaaacacaactcttcatttgtgttgtcctgtagttcacctgaacgagtaccagagttctcactgtttattcattcagcaacatctttagtgctactatgtgctgcggattatgctgggtgctggggatatgtgtaaacgacagacatggtccctgtctaaatgggcttacaaaatagtgtgaagacatgcattataaagtaattagatgggtggtgggtgctatggtaggtcagggtaccctgggagcacacaaaagcaataggctttcccactccactttgttcccagaacacttgcaattgggcttatatgctccaggaggaagactggaggattcttaggagaaatggaactgccccccgggaaaaggccctacaaagaaggggccattttgcttgcccaatcaccccctagtggagttagcctgtcaaaaattcaccgcctcccttagacacacagaactccctatcaacttgtgtctccctctaaaatgtgaagaggacagtgcaggattatcagacatttgacaacagcctcccacaaggaagactgagactaaaagccaaaacaactcccaaagaaatcaggcactgtagaaaacaagaaaaatcaaactccaaagacctaagtttttcagagatcctaagtttttcagtagactgcatctactcagcaacaataagatgctaagaaagagcttttggaaaataaaatatgatagcgggatctatacagcagaatgattgggcccaggatttaacacagagcttctagaacatgaatagggtctgcgatggctttttttttttctttttttgagacaggttctggctctgttgcccaggagtgcagtggtgcaatctcagctcactgcaatctgccccactggctcaagtaagtgatcctgccaactcagcttcccgtatagctgggattataagtatgtgcactacgcccagctaatttttgtatttttagtagagacagggtttcaccatgttggccaggctggttttgaactcctgacctcaagtgatacacccaccttggcctcacgaagtgctgggattacaggcatgagctctctttgagaacaggctggatagcagagttcagcttcaaacatccaagttgaaagataccatttaacaaagggttttgttagagcaggtgaaattggtcaggcatggtggctcatgcctgtaagcccagcactttgggaggctgaagcaggcagatcacttgaggtcgggagtttgagaccagcctggccaacatgatgaaacctcgtctctactaaaaatacaaaaattagctgggcatagtgcacacacttataatggcacatacttatagtggcggcatggaccggtaatcccagctactggggaggctgaggcaggagaatcacttgagattcagagaagcgaatagagaacagagaatcccaggaagcggaggttgcagtgagccaagatcgcaccactgcactgcagcctggaacaaaacaaacaaaaaaacaggtgaaatagatacctgagctagcaatgatttttatgttgtagtctcagattgctgatgggtaagaaacaaaattttgggagtcaagcaaaacatggcaaagcttggagatcaaatgcaatctctgaggaagaacagcagatagtctagaccaagctttaaggaaaactagaaacatttaatatctgggtagaggaatcaccattgaaaagaagactgagaagtagccaaggtggcatggaggtcaagagaatgttttgaaaagaagggaatgctcagtgtcaactcctgcggaggaatcaaataaattaaacacttctgaaagtgtctattgaaattcagccacatggaggggtgtggagagtcagatgcaatgagtagaaagtagcagatggtcaggaaatggagatgtcataagggtacataaaatttgttttagagcttttaccttgaaggagaggagagatagaatgataaccaaaggaggaagataggactcagggagagttttatttaaaatggaagagatttgagcaactttaaaaactgacaggagggagtcagtaacaagaggcacagtcaataaaatgatgtccctgaactggagtgagggtgaggctggcatctcaagcactgctaaagagactgcccttaggtaggagaagagaaacctataagctctaaggagaaggagagaaaaaaataacagtcacatcctctgtgaaataggagacgctgagtactgattgagaagaaaaaagtgtgaaatagtttacatacagtgttgaatacagaaacacagtaagattgccaggaaatattaagagagattgtgtttattcactgttttttgtttgtttgtttgttttgtctcccaggccggagtgcagtggtgccatcctgacctcaggtgacccacccgccttggcctctcaaactgctgggattacaaacgtgagccactgggcccagcccccgctattttttttttttttttttgaggtagagtctcactctcccacccaggctggagttcagtggcgcgatcttggctcactgcagcctccaccttctcggttcaagagagtctcctgcctcagcctcccaagtagctgggattacaggcatgtgccaccacacacagctaatttttttcatactacattttttaatccattcattatttgatggacatttgagttgtttccacttttgagctactaaacatgctattataaacattaatatacaagtttttatgtggatattggttttcatttatcttgagtacctaggaagagagttgctgggtcatatgacaactctatgtttaacattttgaacaacttgccagaatgttttcctcagcagctgcatcattttacattctaactaccagcatatgaatttctccgtatccttgccaacaacacttgttattgtatgtcttttaataaaaaataataaccatccctagtgggtctcaggtggtatctcattgtagttttggtttacattattaccctgatggctaatgatattgattatgttttctgctatttattttgcgatttacatatcttccttggtgaaatgtctgttcagattcttgcccattttacaaattgggttatttgcattttttatcagtgagttgtaagagtttttttgttttgttttttgacatggagtctcactctgtcacccaggctggagtgcagtggcgcaatctcggctcactgcaacctctgcctccaggattcaagcaattcttctgcctcagcctccagagtagctgggattacaggtatgtgccaccacgcccggctaatttttttgtatttttagtagagatgggatttcaccatattggccaggctggtctcgaactcctgaccttgtgatccacctgcctcaacctcccaaagtgctgggattacaggtgtcagccaccacgcccggccataagagtttttttatatattcaagatggaagtcctttattagataatgtgatctgcaatttttttttcacattctgtaggttgtattttcactttctttctttttctatttttttttgtggggggggggtgggggactgggtgtcactctgtcacccaagctgcaatgcagtggcatgatcacagctcactgcagcctcaacttcctgagctcaagccatcctcccacctcagcctcccaggtagctgggactacaggcgtacgctgccacacccagctaattttttggagattgagttttgccatgttgctcagactgggctcggactcctgggctcaagcaatctgcccacttcggcctcccagagtgctgggattacaggcgtgagccaccacacccagccttagttttgaccaaatgtctttttttctgttgcaggaactcatccaggataggacattacatttcattgtcatgtctctttaggttcctcatgcttatgacgatttctcacaatcaccttgttttttatttccttgacagtttcaaggaatactggtcagttttgtgtagaagtccctcagttaggattgtttgatgtttttctcatcattagatgggggatatggatctttggggaggaatatcatagaggtaaagtactattttcgtcatgtcatatctaggtacatactatcaacatgaatcaccactgttaatgttgaccttgttcacctgaccaaggtagtgtcaacagctttctccactgtaaagttactcttttttgctgccttttgctgcatgctacaagttttgatatacagcgttttcttaccattcacttctaaatattttcgttgaaatttgtcagtatgaacttgtatttatctcccaaattttgcagtttttccccagtatcctaagtgtagttacaaaattttaaaaagggaaatttaaggacaatccaggcctggggttttgtcaggaaagtacaccccatctactatatttcatttcatacctctcattccacatctcatgttctgcctgcatctcattaggtagtctttctttaattagagactccatctctcattacactcttcatttcaccattgcatctatcacacacatccatcactcaaagtcattgcctgaattgactcatgctactgtgggccatgagaatttcagctattaaagacaagaatgtttgcagggatggaagatggagttgaaactaggtaggaaggcaagtcaaaatagaaagggcctgaaaaataggtagaaggtagcgggatcgacggactggaagtcccagtgaagtaaaagaactggtgattaggagtagatagaaatacaggaggttgtggtttgagaatgggatatctgcatttattattttgcaggtagaacaattttaagtggcttgtcataatctagtcattgcatgctcatagaatgaatggatgaaggagagtggaagggaaggtcgttgaagaggaaggtccattagcggagcatagtggcctctagtcccagctacttgggtagttgaggaaggaggatcccttgagcccagaagttcaaggttagtgagctgtgatcacatccctgcactccagcctgggcaacagggagaccctgtctcaaagagaaagagaggggtgggggagggaggaaggaaggaaggaaggaaggaaggaaggaaggaaggaaggaaggaaggaaggaaggaagggagggagggaaaggaagaaggaagggagggagggaaggaggggaggggacatactgctttcactgtatcccataggtttcagtatgttgtgtttccattttcatttgtcttaagaaattttaaatatatatatatatatatatatatatatatttttttttttttttttttaattgtagagacgacatgttaccatattgcccaggctggtttcaaacttctgggctcaagcagtcctcccaccttggcctctcaaagtgctgggattatagtcatcagctaccacacccagcctatttcaagaaatttttcagtttccttctgaatttcttcattggcacacttgtcattccagagcatgttgtttaatttccatatgtttgtatagtttccaaagttcctctggttattggtttctagttttattctattctattatggtcagagaagatacttgaatcagatttcaattttgggggattttttaagacttattttgtggcctaacatgtggtctatccttgagaataatccatgtgctgaggagaagaatgtgtattctgcagctgttggatgaaatgctctataaatataggtccatttggtgtatagtgcagattaagtctgatgtttctttgttgattctctgtctgggagatctgtccaatgctgtaaatggggtgtcgagtctccagctattgttgtattgggttctatctctctctttagctctaacaatatttgctttatatatctaggttctccagtgttggggacatatatatgtgtgtgtatatatgggaagatgaagaagctctggagatggatgttgtgatagtggcacaataatatgaatgtacttaatgccacaaagcttttacacttaaaaacagtttaaatagggccgggtgcggtggctcaagcctttaatcccagcactttgggaggccagggcaggcggatcacgaggtcaagagttcaagaccattctggctaacacggtgaaactccatctctactaaaaatacaaaaaaaaaaattaggcgtggtggctggcgcctgtggtcccagctcctcgggaggctgaggcaggagaatggcatgaactagggaggtggagtgtgcagtgagctaagattgcgcaactgcactccagcctgggcgacagagcaagactctgtctaaaaaaaaaacaaaaaacaaagaacaaaaacagtttaataaattgtacgttacgtaaactaaacacattttagacaatctgtaagagaaatgaaggcaatcgaggctgttttcacaagtccttggctttagtatgatagcttccaagttgaacctgatgagcctgacctccttgtattaatgtttccatacgctggattggaataacttgtgcaaccagtgggatatgtcagaagtgaccagaaatgagtgggctgccatgttgtgaggacactcacagcctgtgaagaggtctaatgatgaggaagtgaggcctccagccaacagccagtgttaacttgccaaccatgtgagaagctaccttggaaggagatcctccagcagcccctctcatgagagaggtcaagccagagctaacctgctaaactcctaaattcctgaaccacagaaactgtgagataatggttattgttttaagccattatgttttgaggccatatgttatacaggaattgaaaactaatacagatagtatgaaggcttctttcatcaactgcctgaggttggtggtgtcttcagtcatttatatagatctatttgtttctggataatattacagctatttaaagatattttgtggctctatttagatacagctacattcgcctttatatgttttgaatacccagtaagtaacttgaaaatatttcctgatattggagggaggggcattgctgaatttcagaaagttaaggctagtaagagctatgactaatataatacatcttgttggatactgtgaatgcttttcatttaattctgtaggtaaaggaaatagaatctgaaggaaggccagtgttttaagtcttcttactctaacgtgaatgaattcattagacatatttatattttaaaaaaaagaggaagcaaaataaaataagggggcaaaataagcaaagccaacttaagaattttttaagggccaaatccagttatcttggctctgtatgtgtgtacctacctaaaattctaatctctgtatctgtgagtctccagtttttcaacccaagcttgacgagttgtgggacctcctccaaatgtttcaacaggctgctcaggctgccttgcacgtcacagccccagggcagcatcagtgcggtgagctgttctagcacgttcatcctgtcgactggaagaaacaaagagcagttcagggactggatggtctcaaaactgaggaagaacaaaggggtgttaggggaggaatgatctttatgtttggtggctctgcagcctactcaatctgtaatgagaatctacttaatttttggtttttttttggaaagtattcaagcatatacaaacattatgcagaagaatataatgaaactatatatactaataagacaccttcaaaaacattaaatcatgggcaatcttgcttaatcctgacctaattcctcctgtattattctaaagcaaatcatggacaatatgaatcagttctttccttttttttcttttaaccataatcacatatcactatcacacctaaaaaatcatatcaccaattccttaagcaaatttgtcttgcacatcggctactcttgacagttgcctcttcaaaggaggaaagcaggtgggataccgcctcaaagtgcagtgagcatatgtaaactggtgacttaaaagacatgggcctgtgttccttaagggcagtttaagaaaggcctaaatgattttcctaaggagggtgcatctagtaaggcacacatgggtataaaagacctcaggacccaggctatgtatttcgactacccagtatacatattcaagtatctaattttggctgaattgtcattcttactcagttcatgaagagcttcatttccatctttttccaggtaattttctgataaatcaagaatgctcagtttgaccaaattgtgaagattctgagctggggaaaaaaagtaatccaaaataaaaagattttcaggtaaatataaatgtattttgaagtatccttagaataattctgagttttatcttctctgctaatggtagtgcaaaccataacttgccttggttattttaattatttccaaaggctctggtgtaggtgtaacccccaaatcccatggttatgaccaaatgggcaaatagtcattggtcctaggttctgattaatgaattccaggtcacgtagaacctaaagcagcatgggatgtagttgttatgtcatcatggaaaaatcacttggtctctctaagcctcaatgtcttcctctatagaatgaggtagttggaccagataaaatgtaaagttgcttcaattataaaatgccgttaatcatgcaggagaaacaggaacaacaacaacaacaaaaatgaaatgagctggttttgtgtacctcaacttagatgattttattgacataatagttgagatattaataataaaaacatagtaaaaaatggatgagaaaaaaaacaaatagcaaaatggcagattcaaatttatccatatcaacaattacattaaatcttaatggactaaacactccaattaaaaggcagagataatcagatattcagaactttttttaaagcaagacccagttttatgctgtgtacaaaagacgtgtttgaatgacaaagacacaaatatgttgaggtaatggaaaactattttgcatgcaaacattaattatataatagtaccagtctagctaagaattgcttagtgcttttcttcacatattatcactcttgcttaatctagctgaagttttttctgtcagggctagaaaaatctcctttttaaaaaaatcagacaagtttttcatgaatatgtactcttgttataatattggctattattatttttaatcaatcatatgagcccttttcttaaagtatcttctgggttttgtgctctacaataaaaaacctgctgaacttctctttaaaagagtacgtttgctatttgcagttctaagcctgtctctccccatcagtaagtagagaaataaaggcatgtgctcattgttctcatattcccagtacttatccagcctttttcaactgtgggtttctctagctgtaactttatattagtatacaaatggcttccttagttatctttagagactcccagcagttatatagtttaactttaaaaagattataccactgttttccaaaatctaaattttaaaatatgtctgaattacacatgtatagtttatccagaaatatgcagttagtttccccgtagttgatatgcatccctttgggaactcagaaggctcaattatcatatcatgcacattaacttcatcttaacagggcaatgggtaggaattagaagcctgagatcatttaagaaaatctttatctctcacttctcaatcatttatccattcatttaaatgtttattaggcagtaaattatatgaccggttgtgtggcaagtttcaagcacctatttcttattttcttccttttcactttctctaaaaattacatcttcaattattctgaaattctcccctattatccatcaatagttgatttaattctaatatggagaaaaatcattaaaaacaatctgcttattatcgagaagtttttattttccagttttccttaaaattaaatttccatttgagacatttagtgtgaattagtataatagtatcacatgttctgttatactgtcctcattcagttaatggaagcaacagttacctaggattttcactgcatttgcagacaagcagcaggagactaattgaatttcttcaaggtcacagggttcacttgacagagacttgactatgtaatccattccctctccaatgtcagacaagtgggtcaaatgaaataaacacatcttcttcaggtttttcaggccttcagctgaaaaatgatagaaaggaatgcattaggataccaagttaattcgatttaagcatagattaatgaactgaaaagaaagcaaagaataattgtgcagagaccttgccatgttcttcctgcagcgactttaagttacaaagaatcaacgagagctttttttctttcaattctcactttccagtctcttggaccacacaaaaaatcacttatatggaggttattctcttagtagcatgagaaacactgtagtaaatttgtagtctttttaatgggcatcaatgtatactcttaccgtaattctttacatgaatgaagtcttctagagcactctcctttcaatcttctcaaaaatcttaaacagcgggggggctgagttcagggaggtagatgaggacttggctccttggagtgcttctagtgcaactgtctacagcctcaaaagccttgcctggactcatgatatggggcctgcctgaagctttagaatgaagaccacatccactgcagcatgtttaaccagaagaaagatttaccttatatcaacagtataattggaaacattctaaaatatcccccgttcttaagtctaaagctaatgtgcagtttaggattggttaggcctcactttgtgtcattaaaatactgtcttatcttgatggtactgtagcctacgggaaagaaatatatgattttaatgaccaggcatggtggctcacacctgtaatcccagcactatgggaggcagtgataggcgaatcacctgaggtcaggagttcaagaccagcctgtccaacatggcggaaccccatctctactaaaaatacaaaaattagctgggcgtgatggtgcacacctgtaatctcagctacttcggaggttgaggcattagaatcgcttgaacccaggaggcagaggttgcagtgagccaacatctcaccactgcactccagcctgggcgacagagcgagactcccatctcaaagaaaagaaaagaaaagaaataaaatatatgattctaataatatcagtcttgcagagctttcgggaaggttgcagataatgtacgttaacatatttaatgtggtgcctggcacatagtaagtgctccataaatgttcattgttgtcatgggagtatataccggttaaaggttgtgagcatgagctttgcagtcagttcctggatcccctacttaataattataaacttgggcaagttattcaatcttttagctgaagcgttagggatcattatatctatgtactaggactgttgtggggattcaatggaatgaggtatataaaactgccgaggctagtgtctaatctatagcagagtaactctttaataaagagtaaattattactgatataattagactggtttagtcaagttcacattttgattccttaatagcagaagcaggctatcctagagaggtactttttgacctctttctaccagttggtaagatcttgagcaagtcaataagctattttaggttctagtggagttttctgtgaaatgaatgagttgaattagatgctctcaatccccttccagctctgattttctgtgtaatttatacacatgcaataaatgtttattgaacactgaattaatttgattattctcacgtaggacatataaggaaaagaagtcagccatgttttgcttttgtttttgtttttgtttcaagatggagtctatctctgtcaccgaggctggagtgcagtggagcaatctcggctcactacaacctcctcctcctgagttcaagtgattatccttcctcagcctcccaagtagctggcattacaggtgcataccaccatgcccagctaatttttgtatttttagtagagacagggtttcaccatgttggccaggctggtctcgaactcctgaactcaggtgatccatctgcctcggcctcccagagtgctggaattacaggtgtgatccaccatgcccaggcttcagccatgtttggcttataggctagagttgtctttcggcaggaagcagaataagaaagaacaagatgaagggaagagaggagtattttagtgaggactcaagtagggaaaaaaagagccaaaaaaaaaaaaaaaaaaaatccaacacacgagaaaacagggacattcaaggaaagcagctttaacaggaatcctccctggcctgcagggcctggttccctgtggtaagccatgtgttctgcttgtgttcctgaagtttccttttccttttcatttttttgattggggaaacacaacctgcagtgtagaatgaaagcatgcttcccccaaagttttcttgattcacattgtttcctgtgtcctatttcatttatgaatttttttaactatgaaaccatagtataaactttaaaatattgtttctatgcaactatgaaactatactataaactttaaaatattgtttctatgcattaaataaaaacatagccaatgagccagggagacggaagttaaaaacacgtcaggggctctcttcccaaaagggttaccatctggtgttgtacaatttgaataaaatgatgctgaaggattttaatggcagtagggaaaatgtctggggaaaccaatgtagccacaagtacataaaaacatccttgccttgtgcagacacagccaatgtcagagcctgaagttaactcctcttattatcaaacttacattgatacaaatatgagaacagaaatctgacctagttttatagcatcttcttcattcatctttatgttatccattatgagctttgtaaggttcttcaagttacccaagctgtcagtcagaccacctgtcaaaagaaaaaagattggactctttcagcagatatttgctatttactatgtcatttactattactgtcatttttgttaccaatcaaaagattttaatgatcatcatgagccaaaaatgctcatgaaatagacataaaaatatactttttataagagatgggcattatacttcactgtaagcatgttctgcaaataatagactagataccaatttcccagataacagggaaaaaaatttcctttttttttttttttttttttttttgagacagagtcttgctctgtcgcccaggctagagtgcagtggcgcaatctcagctcactgccagctccacctcccgggttcacaccattctcctgcctcagcctcccaagtagctgggactacaggcacctgccaccacgcccggctaattttttttgtatttttagtagagacggggtttcaccatgttagccaggatggtctcaatctcctgacctcgtgatccgcctgcctcggcctcccgaagtgctgggattacaggcgtgagccactgcgcctggccgataacagggaaatttctaaacacttggaaattaaacaacacatttttaaataatcatgcattaaagaagaagtctcatggaaactttgataatattttgaaaaatataaaaataaaaacaaaacttcaaaatctgcagctctctcctcacaaaggggtgaaaagaaaaaaaaatctgcagctaacacagtgcttacagggacatttacagtattgcatacttatattagaaatgaggaaaggcctcaaatcaacaacctaggcatactacttaagaaattacagaaaagagagcaaaataaatgaaagaagaaagaaaataataaagataagggtgcaaatcaaagttattatgcctttattatacaaattaaaaacagaggcaaggtctcactatgttgcccaggctggtctcggactcctgagcacaagtgatcctttggcctcagcctcccaaagtgctaggattacaggcgtgagccaccatgcccagcccagaaatcaaaattataaacaggtaaacaatagaaaaaaatcaatgaagctaaaagttggatctttgaaaagatcaataaaatttaaaaatttctaccaagactgacaaagaaaaagaagacaaaaattaccaatatcagaaacaaaaaaggggatatcactacacacactgcagatattaaaaggacaattagagaataatataaacaaatctatgcacataaatttgacaacatatatgaaattgaccaattttttgaaaaccacaaactaccaacactcatgtgatacggagtaggtaaccggaataaccttatagctattaaagaaattgaatttgttatctaaaatttcccggaaaagacatctgtaggcacagatatgttcacttgcaaattctgccacacattttcatttttttccttctatcaactgtcttcatatctaccacacatttaaagaagaaataacaccaattctacacagtcacttccagaaaatagaagtacaaagaataattcccaactcattttatgaagccatcattaacttgatatgaaaaccagaaaaagacgtagaagaaaaacttttaggccaggcacagtggctcactcctataatccccgtgctttggggggcagaggtaggaggatcacttgaggccaggagtttgagaccagcctgggcaatatatccagaccctatccctacaaaatattttttaaattacccaggtgtggtggcaggtgtgagtagtcctggctactcaggaggctgaggcaagagaatcgcttgagcccaggagttcaagattgcaatgaagtgtgatgacaccactgcactccagccttggtgacagaatgagacaatgtctttaatgaaagaaagagagagagagagagaatagagaaagaaaggagggagggaaggacggaaaagaaaagaaagaaaattgaggctgggcgaggtggctcacacctgtaatcccagcactttgggagggcgaggcaggcaaatcacgaggtcaggagtttgacaccagcctggccaacatggtgaaactccgtctctactaaaaatacaaaaaatcagctgggtgtagtggcaggcgcctgtaatcccagctagtccagaggctgaggcaggagaatcgcttgaacccaggaggcagaggttgcagtgagctgagatcgcaccactgcactccagccctggtgacagagtgagaccccatctcgaaaagaaagaaagaaaattaaactttagaccaatatcattcatgaatacagaatcaaaaatcttcaacaaaatagaaaatggaattcagtcatgcataaaagaatattacggcaggcgtggtggctcacacttgtaatcccagcactttgggaggccgaggcaggtggatcacaaggtcaggagtttgagaccagcctggccaacatggtgaaaccctgtctctactaaaaatacaaaaattagctgggcgtggtggcgcgcctgtagtcccagctacttgggaggctgaggcaggagaattgcttgaacccaggaggcggcggttgcagtgagccgagatcgcatcattgcactcagcctggtgacacagcaagattccatctcaaaaaaaaaaaaaaaaagaatattacaccacctccaaatgggcttcatatagggaatgcaggatgctcaatatgtggaaatcaatccatataattcattatattggcagtctaaaagtaaaactacgtgatcccataaattgatgcagaaaacacatgtgacataatccaacatccaggctaggtggctcacgcctgtaatcccagcacttcgggaggcccaggcgggaaaatctcttgagcacaggagtccaagaccagcctgggcaacatagcgagaactcgtctctacaaaaaatttaaaaattaaccagatgtgatagttcacacttatggtcccagctagtcaggaggctgaggtgggtggatctgttgagcccaggaagtcaaggctacagtgagctatgatcacgccactgcactccagcctgggtgacagaacaagaccctgcctcaaaaataatctaaaaataatttaataaaaacaatccaacatccatccatgtaaaatgacatgatcatataaatggatacagaaaacatctttagcacaatccaacacctattcatgaccaaaaaaaaaaaattctcagcaacttgataaaagacacctacaagaaaactacatttaacattatacttaaaggtgaaagtctgaatgctttctccctaaggtcaggaacaaggcaagatgttaattcatgtcactattcaacattgtactacaagtcctagttagtgaaataaggcaaaaaaaaaaaataaataaaaggaatacagattggaagggaagaatttaaaatcattcttttcgaagataacatgattgtctatgataaaaatgtcaaggaatctacaacacccccttctgcaaaccccacaaaaaaaacccttctaaaactggctgggtgcagtggctcatacatataatcctagcagtttgcgagactgatggggaggatcacttgagcccaggagttcaagactggccttggcaacatagagagacctcctctctacaaaaaagaaggaggaggaggaggaggagagggagagagggggagggggaaggagaggggaagggagaggaagaaggaggaggaggaggagaaggaggaggaagaggaggagaatgagaagagaaaaaattagtgaggtagcgaggtgtggtggcacatgtcagtggtcccagcgacttaggaggctgagcattatgtagaaaatgggattatagaccgggcacggtggctcatgcctgtaatcccagcaatttgggtagccgaggtgggtggatcacttgaggtctggagttcaaggccagcctggtcaacatggtgaaaccctgtctctattaaaaaatacaaaaattagccaggcgtgttattgggcgcctgtaatcccagctactcaggaggctgaggtaagagaatcacttgaacctgggaggcagaggttgcagtaagccgagatcacaccactgcaccccagcctgggcgacagagtgagactccttctcaaaaaaaaaaaaaaaaaaaaaaacagatgaatagaggtcattatggtaagtgaaataagccaggcacagaaagacagacatcacgtgttcttacttatttgtaggatctaaaaatcaaaacaattgaactcacggagagtagaaggatggttaccagaggctgggaagggtagtagggaggaggtggaaatggttaatggatacaaaaaaatacttagaagggataaataagatctagtatttgatagcacaacatagtatctaagtcaaaataagttaactgtatatttaaaataactaacagtacaactggattgttcttaacacaaaacataaatggttgaagggatggatactccattttccatgatgtgattattacacattgcatgcctggatcaaagcatctcatgtaccccataaatatatatacctactatgtatccacaaaaatgaaaaatagaaaaaatttaccttatagggttaagacatctaaatgagttgatacacgaaatttgcttcaataatacctgtatgtgttcaataatgttggctatcgttatgtatacctttaaaaaatcaacaggttggggccaggtgtggtggctcacacctgtaatcccagccctttgggaggccgaggcgggtggatcacctgaggttgggagtttgaaaccagcctggccaacatggtgaaaccccgtctgtactaaaaatacaaaaattagccaggtgtggtggtgcatgcctgtaatcccagctacttgggattctgaggccggagacttgcttgaatccgggaggtggaggttgcagtgagccaagattgtgccactgcactccagcctgggtgacagagtgagaccctgtctcaaaaaaataataattaaataaagtaaatactttttttaaatggcaaacattaaaaaataattataaacaccatataggccaaattcagcacataggtgatcactttacaggatcagtataaaagaatagttgtcatgagtagatggtgagcttcctgacacagaaggtagtctaatacagtcttcgtgacacccagaatcttacagaagggattccctcattagggaggaggtttcaaagattatctgtacaaaaaattctagaatcttaaaatgataggaaatttctctgtagggtgacaagcaaggcagagctgggtgggaaattgctagcgtttgaaaactaaccccagactgctacagttaagtacagcaagattcctgcttcccatggcttcacaccacatagcagttcctgctcggggcaaccaggctggtctacacaggtagggcagacattctcctttagtgttatttggaatttggggaagtatccccgttacccagaaagattgccctcgcatatctgtgtctgaagtctaaaatctgaaatttcatcatgttagacaatattccccaaatcttctgtcattcattcttctttttcttttctttttggagatagggtcttgctgtgttgcccaggcacagatatgatcatatcttgctgcagcctgaaaattcctgggctcaagtgatcctcccacctcagcctctggagtatctgggattacaggcatgcaccatcacgcccagatgattaatttttgttggagacagggtcttcctattgtgtccaggctgatctcaagtaatcctcctgccttggcctcccaaagtgttggaattacaggtgtgagtcacctggcctggccccaaccaagtaaacaacagttagggtgggaacggagctgagtatcttctacaatttcccagatgagaatcttgtaacacaattagctcctagctcctgcaggtgattaatttacaggttggatttcctccaagacttgaagtagggcagggtgccacttggcagggaaggactgggtattgggtagagatgggggtgctcgcaggagaaggatttgctgaagacaagcttaacctgcgtatatatttattttttttaatttttttttttttttttagacagagtttcactcttgttgcccaggctggagtgcaatggcgtgatctcggcccaccgcaacctccacctcccaggttcaagtgattctcctgcctcagcctcccgagtagctgggactacaggcatgtgccaccacgcccggctaattttgtatttttagtagagatggggtttctccatgttggtcaggctggtcttgaactcccaacctcaggtgacccacctgcctcagccttccaatatattttttaataaaaatatttttagtatatttacatttttaataaaaatagttttaatatatttaaacacatacatatatgtatctatgtatgtatgtgtatatatatctttccaatcagactacagctctgggaatcttccctatggctcccaatctaacagctttcccccaacatagacctctctccacagcccttctaccttcctttcaagtcctgacacctggtagaaactactagaaaatttaaaacaaaactaataaaaatgaaatcatgtcttttgcagcaacattgatggaaccggaggccattatcttaggtgaaataactcagaaacagaaaatcaaataccatatatactcacttacaagtgggagctaaataatgtgtacacatggagatagaaagcagaatagacatggagacttggaaaggtgggagcgtgacagggaggcaagggatgagaaataatctgataatggtggttacactaaaagctcagatttcaccaccacgaaatatatcgatataacaaaactgcacttgtaccccctatatctataaaaataaataataaataataaagcaaaactatatatctaacattttcacagtattcctggctaatatttccagccagtcttgattatagctgtaaactaaaaatcctaagccccccaccaactgaatgcatcccctctgggctaaggagaccccagaaaaaaaccttaaactcagttcctggccatgacaggatgggaggtcaaacacacatcattatactccctctcttgtatggtttgaacacaactcatcagcattactgttgacatagagatcataagactaacagaacagactttttgtggcaataaattaccaagttataaagaggacataagaccatgccaggcaaaggctaagtcattcagctctacgcttaaagaataaactgtcctaggctgggcgtggtggctcacgcctgtaatcccaacagtttggaaggtggaggcagtagaactgcttgatcccaggagttcaagaccagcctgggaaacatagtgagacctcatctccccataaaaaatcaaacaatgaggatcaactgagcccaggaggttgaggctgcaatgagctgtgatcgcaccactgcactcccacctgggtgacagagcaagacccaacctcgaaaaaaaaaaaaaatttaaaaagaataaactctgtcgtaactgccacagatttttcttctttggtagctaaacaagcattggtctcaagataagcaatattgatagttgtgaatattaaacaattcgcaactcatccagctcacaaatgctaacaatccctgttccatctgccataactacagctttgattggagaagagagtgatttcagtaactttctcctgatcagaggaccaccaaccacagactggttctggctggtttacagagattgcgtacctgcttacctttgtgctctgaaaagaacttctgaagtataggcctaattgtaatacatttaaatcatttaaaggggtgtacaatcttttggtttccctgggccacattggaagaattgtcttgggctacacaaaaatgaatttgtgctgggccacattcaaagccgtcttgggctatgtgcagcccacggactgcaggttggataagcttgatttaatgctaaatctccaccccaaagtgaacatgggttgtatgttacatgcatgtttattcaatatgcatgtatcaagaccaccttcatgaatattcatagctcctcctgtaatctgttgaatatgtatgtttagccaacccattcaacataaagtgtctaccccaacccctccttcgaggtgcctgtctctggtcttggttggaggcatgtttctcagcctgtgggatggccaccttgcaggctgtaaccctttagaagaaataaagtctcctctctccttttccaaatttatacactgttatttttttttaagtgaacaaagcacaaaccactgatatttacaatacccggcagccgttgattctgtaggtcatgaatactcaaggttttcaggtttgttacagatgtgatgtgcctctcatcttctatggtgaggggactggcttccaccatgagagaataaatgttcttacaggtgctgaggaccaaactgaggcttccagccacaccagcacatctctttatttgcagcctgaggcttgtggcagagctgaatattttccccagatatctgatatcttgcttattcaacttgctgaaatcccggagtgtgacctccagagtcctgaattcctgcttccagttgaagaacaaagatacagccctgctgggaatgtaggtttctggggcctcttccatgtggattccacctgtgtcttctgcagccttttcccatgaagccatagctcccccataaaagtccagtttaatgaagtccagggcacttgcacaattgggcaaatgttcaaagaagtcaaataagtaatcggggatgttccctgagttgatatataagcttttaccttgaaagaaagcttcaaattcttggctcagggctgatttggatgtactctcttgatataaatggatgccacactctacaaaggaattgatgtttatggctttcagaatttcttgctcagtggtgtttttcacactttgcaaagattcctgtctccagagaggcctcttggcgatggaaagtccgagaaggcagccgtgttgatacactgctgcgaggtgcttcataacagccctggtggcttccacagatgacccacaggtgtaccggagcaggctgctataagtggatgtaatgtccgaaatggaaaccattttctgcaagtaaccattccccttggtcacctcctctggctcatgagacgtcaataaactgctgagtcttcgtcctgctgtgtactcctggaatgacttgtgaaagaatttatactttggcttgaacctttgagctgtatatttacagaggagcccagttgtcagcaggacatcctcattcacgctggacacatcctgcagttcgaaatcaaacttgtgggagaacacaccctccagagctaggtctccacagtggtccaggctccgaatgaagtcacttgcagccacacctttatgtttgtgtttgtttttctgtatcaacagatcatagaaggtatggaacagcgttgtttgtgtgtgagagtggaactcactttcacccatctggattgcacaagtgatgaccacaaagagaggggtcttcatgagattcctcaagcacctggatttctgaatttggagcaacaagccttcagcaagctccttgatcagcacttctcggatgagagcctgggcgctgtcttctgtcatatcccccacctcagcagtcagggcaccaaactgccgtatgtgcctcaggcactcagtggtagtggtgacgatgaccatgttcttgaagcggtggttttcctttatcagggcttcgatttctgggcagttctggggcttgaattcattgtagccatcaagaaggaaaagaaccctctgccgcagcttcagcagcatggccatgaatgtctgcttcctgattgtgccaggtatatccaggagttgatcacagagggtttcaaaaagtccaccctgggccctgctgagacggaggaagaagacgaatttgaacttggtcagagccttgcactttccggagccccagagcatggcaattcgctgcagcagagtggacttgcctttgccagattccccttcaatgatgcaggggctctgaagagcctgcaggaggccattcagggtcagctgctccacgcggtgatggtgttggtccttcctccacaggacaggttctgtgaaggtgcttttcaagttaaaaataatgtcaatatcttcaccaaggggataaaagttcagaaaagatggggtatggtacaagtcctttaaatcctgagccaaatcgtccaagtctccttctgatgtctgatgaaaaagacctattagagaagaggtgatgttaaagaagacccaattctgtgtctcctcaaaacctagagttcaggaggatgaacgggggggtgaggctgagaatctgccattggtgaatgtaatgtcctttcccagttctgagctggcacaaagggttctgtctgctccccctttccccagcatcctttaccccactcccctttttgctttctgtttcctcctttccacaaccaaatcttatagcagctggttggaaaagggaggagcttgtttttgggttaaggaaagtaaagaatttggcagagaaagatggttagggataattgtcatcatagtaggccttcactctgagtaaaatctgtcatgaccttatttactaattaaaaaaataaaaacaatattttatgaaacatagaatcatggttctgtgtcagtcaggctgtctttaccaggaggcctggacatggagtaggtagtcagctgggcctctctcccataggtagatctcatccaaccagggaatgctgagaaccactgctgcactggaagcttaactagtgcacttattctccagttttatcttgcagtgagacaatactcaatcatttatttcctggccttggggttatttgtttggcttcaccatcaattgatctactatgagtttttcctaaaatcatctaagcttttccttagcaggtatcaaaggccactgccaggtgatatgaagagaaggaaaagcagaggctctgccatggggaagatggatctttgttgtggtctattctacttgcagaaacagatgcaaaactaactgatacttactttgtccattcaagtcctgaaatagaggatagttccactccttaagggatttaagaaagaggttacaggactctgaaccctttttcaaaatcatgtgaatgatccctctagcagcatcctgctccaccttctcgcagcaaatgatgtttacttcttcgcgattcagaacattccatacaaataggtcatctgtgatttgctttataacagtcattcccattctttgaataagggctcggctattgtcctttatgaaattcactgaggagatggggagaaatatacatatttatttacttatataaaatgtgcatatccggctgggcacggtggctcacgcctgtaatcccagcactttgggaggccgaggcgggcagatcacgaggtcaggagatcgagaccatcctggctaacacagtgaaaccctgtctctactaaaaatacaaaaaattagccgggcgtggtggcgggcgcctgtagtcccagctacttgggaggctgaggcaggagaatggcgtgaacccaggaggcggagcttgcagtgagctgagatagcgccactgcactccggcctgggcgaaagagcgagactccgtctaaaaaaaaaaaattaaatatgcatatcagcatctgtctccagagcattagggccatgcatttttttcctgtgagcatctcctgagttatggagatgccaaatgcctgaattccaggccttcaagaaatgctctgccaagcattttttttctgagacggagtcttgctgtgtcacccaggctggagtgcagtgacgcgatctcggctcactgcaagctctgcctcctgggttcaagcaattctcctgcctccgcctcctgagtagctgggattacaggcacgcaccaccacactcagctaatttttctattatttgtagagacggggtttcaccattttggtcagactggtctcgaactcctgaccttgtgatccacctgccttggcttcccaaagtgctgggattacaggcgtgagccaccgtgcccggcctctgcaaagcatttctaaccccagagttattgatgagcaagatgttttgctttggtgaagaagtaaggtgagttatcttgtccctctgatataaagcagtccccagtgaggttgtagttgtaagaccgttggctttagaataatggcaatggcctaggatctgccacttgctaccatctatgtgaccttggcaagtcactaagcctctttgagtctatttcaattacgtgctgctggccgggtgcggtggctcacacctgtaaccccagcactttgggaggccaaggcgggcggatcaccagaggtcgggagttcgagaccagcctgaccaacatggagaaaccttgtctctactaaaaatgcaaaattagccaggtgtggtggtgcatgcctgtagtggcagctactcaggaggctgaggcaggagaatcgcttgaacctgggaggtggaggttgcggtgagccgagatggtgccattgcactccagcctgggcaacaagagcaaaactctgtctcaaaaaaaaaaaaaaaaaaaagtacgtgctgctaaatgtttcacaaactggccctggccctctgggagtaaaggccctaatttgtagcattcaccaatccccaaggtataaatattcctaccatggcctatttcaagctaacagcgtatgttaactggctaacaaaaatcctgaaaattcaataatcaggtttcacatcacagtaacaaccagctccagcacactggggattcctcatctgtacaatggtgtcaagagcattatttaacttaggaagttgttacaataattcatgtatagtatctcatacaaagtaataactcaatatatgttagctactatttttagcctttattcaggtgtcaccagacaaagagcacattgtatctccacagactttggtcttttctgaagagtatcacatcaaaacactggtttttatccaatgtaagctctctcgccaggtcttgagggtagctgtgtcctttttgtgtctgactctgcaaggtctaattctgaaacgtagaccacaccgtacccaggcactgtacccacgctatgtttgtgacagcttggagaaatgtcttcctggtttttaactctcagacaccgtctgcactagatttcttcctgggctaggctgctcctggttttttttttttttttttttttcagacgaagtttcactgttgctgcccaggctggagtgcaatggcgcgatctcagctcaccacaacctctgcctgccaggttcaagcaattcccctgcctcggcctcccaagcagctgggattacaggcatgcgccaccacacccagctaattttgtatttttagtagagatgagatttctctatgttggtcaggctggtctcgaactcccgacctcaggtgatctgcccgtctcagcttcccaaagtgctaggattacaggcatgagccaccgcacctggccgctcctggctttcaaacctgtgttgactgatcagagagggaatgcactcctctcaaagaccccagaacctctctggcctgaaatgcaccatcaatcactccaagcaccaggaccccaccccagccgtcctttctcaccattgcagagctctgctgctgacctcagctagaatattccctgtctacatgtcctgcaagagtcccatctctctccttctggggtctcatctgttctctagcttccacatcatccctatggaagtaacctctaagtctgtgtcccattgtgatcttcagtttagagctaaagaaatacagcctcacccgggcgcagtggctcacacctgtaatcccagcactttggaaggctgaggtgggcggattatctgaggtcgggagttcgagactagcctgaccaacatggagaaaccctgtctctactaaaaatacaaaattagccagtcgtggtggcacatgcctgtaatcccagctactcgggaggctgaggcaggcgaatcacttgaacctgggaagcagaggttgcggtgagcccagatggcgccattgcactccagcctgggcaacaagagcaaaactccgtctcaaaaaaaaaaaaaaaaaataagaaatacagcctcagaaaggcttagagacccacacacacacaagttcacagcctagccttcctgagactacctttcttcacctataaaatgaagacacgttatttaaaatactctaattatttaaaagactcattatattgaataagtcacataactctcatacccaaaaatgtcttaaaattggaaaagtggctaggcgtggtggctcacacctgtaatcccagcattttgggaggccgaggcgggtggatcacgaggtcaggagatcgagatcatcctggctaatatggtgaaacctcgtctctactaaaaatacaaaaaattagctgggcatggtggcacgcgcctgtggtcccagctactcaggaggctgaggcagaagcatcgcttgaacccaggaggtggaggttgcagtgagccaagatcacaccactgcactccagcctgggctacagagcgagactccatctcacacaaaaaaaaaaatttacaaaaaaaaatatatatataaacagtaagatattattttactatgttatatctccttgtatgtagaccatcatactccttccttatcaagtaattaggtggaaaaaatgctgctcatttattcattaattattcattcttttcagaatatctctttgtctagaccaatgcttttcaatagaactttctgtgataatgaacatgttctatatctgcattatacaatatggtagtcattagccacatgtgactactgagtgcttgaaatctggctacagtgactgtgcaactgaagtttacattttattttatttaaattcacctttaaatagctacagagggctagtggctactattaatatactagatagtgcaggtctacacccagccatttaaagtggaaggagctacattttggttgccacttagatctataccatgtttcttcacaatgagcttgacatgtatagctctctgctgtctggctgaacaggtgatgagaactaacagtttaaaacatacacctggtcactctttgtgtaagtcctatcctatctgtggttctgccttttatcacaggttaccatatttgtaactgaattcctaaaacaacagaagaatatttattggtaattccacatatgactggtcagaggaagccatgaactgattttccatttaaaatcaccagtatttggtagcagactgtataaccaggcagatgttatttctcatatacttacttgttctggatgaaagcttcccacctttctataacacaatagaaaatattatttccaaatggaaaggtcaaaggtgatcccaatattgtcctcttttttctgtaaaactactcttcattctgtaaaacaaacaaaacagaaccagagactatcaggtggaggggctgatgcaattatctaggtaatgccccgcttttcatagatgagaaaatggtgacccaaaccagaaaaaaactcgctcaaagcccctggctattcatggccaggccctaaagagaacccaggcggctggactccttgcctagagctctaaactatgttcagctggaactttgcccttctcttcaaagtttcttctcatttctgctgttcagagccaagaaggcaacatggaattaaatgtcaaaagacggtataagtgtcaacatgaatggtgcagagggtacgttctctccagtatttccaggaaagagtatatggactggaatcatccagggaggaagttttcatggaggagacagcacatgaaccaggtcttaaaggataagtagggctgggcgcggtggctcacgcctgtaatcccaacactttgggaggccgaggcaggcggatcacgtgaggtaaggagttcgagaccagcctgaccaacatggtgaatcctgtctctattaaaaatacaaaaattagcggggcgtggtggcacacgcctgtagtcccagctgttccggaggctgaggcaggagagtcacttgagcccgggagacggaggttgcagtgagccgagatcgtgccactgcatcccagcctggcagacagagcgagactctgcctcaaaaagaaaaaaaaaaaaaaaaaaggataagtaagatgaggccaggtagttgggctggggtggaggtggagatgaggatgtaaaacgccttgcaggtgagaggatgagatcagggagtatggaaaggggaaaagttctcttgtccccttcgcagggcttgcgatgggggtgtggctcacttcttcagtgcccgctgctcagacctctaggggatcatacagatgggcgggctgtggggttccaatcccacggcagtgtctagtggtgaatgtttacagctcctgaagccccagtgggtgtgtgttacagggtgctcttttagttcagctgtccgtaggcgtcttgtattagctcaatgggacccctgccttattgcaaggacagagggctttctgtattccggggttcttgccttggtgtaccggaggaattggatcacacgtggtcttggagaatgagcgcaaggtttcattgagtggaagaagctctcagcagatggggtagccagaagggagatggtttttccccggagtaagaccgccaccaactcttctccaaccctccaggccaaactccgagtcgttcctctggtggatggcctgctggcgtgccgatgtctgttgtgtgctcttccgccagcattctcccttcaacgtcctctggacgtccagctgcttgtatgttcttccgccgatgtgttcctctcgacgtccagccgcttgtgtgtctgcctgcaagggtctctgggatttttataagcataggatgacggtgtggcaggccagggtggccttgggaaatgcaacatttgggcgccaaggcaggagtgcctgtcctcacctaggtccgtgggcacaggcctgggggtggagcccttgccagggacgcgcccttctcttcccagcacttcccttccccccttccctatcaatatgagtaattgaggagacagaaaaaaggagttatgcttccagggtacaaaggggaaaagctatggaaagccttgtacgccaagatgaggcatttgttctttatcctatgagcaactgggagagattatggtataaggagtatgtttaaagtgatgttttaagataagaaacggatttcaatttcctggtatggtcctgtcatttcatcctcctagttgctttaaaagcaacttcctttctcccttcctcctccacacactctgaaaagcaggggcccagaagcctctgagactgctctgtgtgcattcccaaaccaagttagatgatctaccccggctcctcatacacacatacacgaccccctgcatcaggatgaagatgcaaagtctgaattaaagacagcatgagagggcagacaggaagtggggaagagaactagaatcactgggtggagagaaacaaaatgggagctatgtgagtgtgattgtggtatgtgaatggagttggcttgggaactcatgtggatggggttggcatgggaactcatgttatcctaacattaaaactctttttttgagacagggtctcactctgtcacccaggttggagtgcagtggccccatcatggctcacggcatccttaaccttctgggctcaggtgatcttcccacctcagcctcctgagtaactgggaccgcaggtgtgtgccaccatgcctggctaattttttttttttttttttttttttttttagagacagagttttgccgtgttgcccaggctggtctcaaactcctgggctaaagtgatctgtctgcctcagtctcccaaaatgctgagatcacaagaatgagccaccgcgtctggccattaccctaacattttattatgaacattttcaaacatagagaaaatccatccctctattcatttatcaatctattttacttattttcttgcatattcaatgtaagttgcagacgttagtacacttctatgttcatataattaactagaattcaatattggtttattattctttcttaggaaaaattcacctacagtgaaagcagagatcttaactgtaccctttgatgagctgaaaaatgcttctacctcaaacacctatcaagacagaaaacattaccctctccttagtatcctatgccccttcccagtcaaattccatctctgccacaccctcaaagaaaatcactcttctgatttttttaaaccgtaaattagcctgttgaagaacttcacataaacggaatcatacagtatgtgctactcctttcattccacacaatgtctgtgtaagtcactcatgctgttgcttgcagtataagtagtttgtaacatttcattgcttagtagtattgtactgtataaaatactagagtgtattggccgggcacggtggctcacgcctgtaatcccagcatattgggaggccgaggtgggcggatcacctgaggtcaggagttcaagaccagcctggccaacatggcgaaaccctgtctctactaaaaatacaaaaattacccgggcatggtggctcatgcctgtaattccagctacttgggaggctgaggcaggagaatcacttgaacccaggaagcggaggttgcagtgagccaagatcgtgccaccacactccagcctgggcaacgacaaaaaaaaaaaaaaaaaaaacaacgaaaaaaaaaaaactagagtttatttatctattctcctgttgatggattgggttgttttcagattggggctatcataaatacagaacaatgaatacttttgtacaagggggtccttccccacaaaaacttctctaagaatagcttactttgactctgatctttctaatttcacaagctctttgaataaggatctcctcagcttaaactagatgctcacagccatggcaagtttgctgtgaatgttgctgttgtgagagtgataagtgaggataagaaagtcctagataaagtttcctttcattcaaaaagcccccaaatcatatcttttctaataaaaagcagcctgaaaaatcaagctgcaagtatagataagctaaaagcttgcattggtaaatgccagtagctgtgcccatagaaaaaagccacctgggggccaggcatattcaacatggcggatccatcttcccttttctttttcaaccatgtgtacagtaggaacagacaacatagtgccggccagatagagaccccatctgcataataaaacataagggtggaatggccggcttcttcgtgcgctatgcaaacgttataccggttctgaccaatctctcagtccctatgtatatcagacaccaccttctcaagttcatctataaaaccccatgcattggctgggtgcagtggctcacgcctgtaatcccagcactttgggaggctgaggcaggcggatcacaaagtcaggagatcgagaccatcctggctaacaaggtgaaaccctgtctctactaaaaaattcaaaaatttagccaggcgtggtggtgggcgcctgtagtcccagctaatcgggaggctgaggcaggagaatggcgtgaacccggggggcggagcttgcagtgagccgagatcgcagcactgcactccagcctgggcgacagagcgagactccatctgaaaacaacaacaacaacaacaccatgtatttcaccacaaaaccactcactcaggttcccctctctctctgcaggagagagagctattctcttttctctttctttcgcctattaagcctccccccttttgtttttttttgagatggagcctcgctctgtagccaggctggagtgcagtggtgcgacctcagctcactgcaacctctgccatctgggttcaagcgattctcctgcctcagcctcccgagtagctgggattacaggtgcatgcctcctcacccagctaatttttgtatttttagtagagatggggtttcaccatgttggccaggatggtctcaacctcctgatcttgtgatctgcctgcctcggcctcccaaagtgctgggattacaggcgtgagccaccatgcccggcctaaaactccactctcaaactcacttcttgtgtgtctgtgtcctcgattcctttggcgtgagacaacgaacatcaggtatttaccccaatgatgctgcttcaaaagcatatctattttcagaaaataaagtttcccttttatgttaaaactgattcattaacaatataaaaaattgtcattgaaattggagcagccaggcgcggtggctcacgcctgtaatcctagcactttgggaggctgaggcaggtggatcacgaggtcaagagatcgagaccatcctggccaacatggtgaaaccccgtctctactaaaaatacaagaattagccaggcgtggtggcaggcgcctgtactcccagctactcgggaggctgaggcaggagaatcacttgaaccagggaggcggaggttgcagtgagccgagattgcgccactgcactccagcctggtgacagagcgagactctgggtcaaaaaaaagaaaaaaagaaagaaagaaaagaaaagaaattggggcagctcaggagcttaagcaagggcacattttggtgtcaggattgcgttcaaactacagctctaccactgacacactaagagtcctcaatcaaggggtaatgactggcacacaggaaggactcagtgaatggcggcaactgtagattcttctctccctttctacttccccaaaaaggggtgggtttgggaagaatcacaccatccctgactgggtcaaagtttaagtcagagtagaaaaagaggaagaagatagaggaaggagctaagatgtataaagtttttaattgctctcaagaacaaaatcaatccatatactgaagatcatgtaatttttctcagttacccactggcataaagaatagggctgtggaccaggcgtggtggttcacgcttgtaatcccagtgcttggggagactgaggagggtggatcacctgaagtcaggagtttgagaccagcctggccaacatggtgaaaccccatctctgctaaaagtacaagaaattagccaggcgtggaggtgcacacctgtaatcccagctacttgggaagctgggacaggagagtttcttgaacccaggaggtggaggtttcagtgagccaagatagcaccattgcactccagcctgggtgacagagagagactctgtctcagacaaaaaaaaaaaagaataggactgagaccagtgtactctcttggaatgtagctatggccctgcaacccctccccgcaagctgtccagtgaataactgaattgggtggaagaagtccttcccccacatttgtacattggaaaataatataataatatatattatatatatataggcaatctgcctgcctcggcctcccaaagtgctgggattacaggcataagccaccatgcccagctggaaaataatatttagtactaattctaaaattggcattttcttaaaaaaggttacatgagctcctcagagaactgaagtttctctggacccatataacccacgtctatggggtcattcccacacctcacagataaaataagggaaagagtacatataattaggagcagacaggaagcacacagaaatggaaaatgtgtgtgggctttggcattgcagatctgaattcaaatcctcactctgcaccttatgaggtaagtatccctagacatgttacttagcctttccgaatcttgctttccaaatcatgcataatattcacctccctggactattgtgaagattaaacatgaaagtagttgtgacaaagatggtcagtgggtattatctgtcttcctttctagtaaaaaggctctagactagaatgttcttaggtctttaataggcttcagcaatctcacatgttaatattagtgttatgtgctgaactgggcttcccccaaatccatatgttgaagccctgaacctcagaatgtgactgtatttgcagacagagcctttaaagaggtcattaagctcaaatgaggctgttatgagaagaggaaatcgggacacacaaagggagataccaggaatgtgcatacagagagaaaaggccaaggagggaggcgtggggagaagccaaccctgctgacaccttggtcttggacttgcagcctccagaactgtgggaatataaatttctgttgtttaagccacccagtctatggtattttaaacacattaatacgactaatattataaaagtgtgtgaacagttaagaagtgtgctgaccaggttctatcctagttttgtagacaattagcagtgtgatgtagggcaggacatttaactcctctctaccacattttccacctctcaaagccaggctgcaaggatctactgagataatgtacataaagaccctatcacgaaataggtgtcccgtaaagggtgatttccttcacttctgtctccaaatatcaggtttctcatcagtaacttgggagattggatggactaagtagtccacctcgttcctttcagctttgatcatctgtgattctaacaacagtcttagcaacaagagtgagtttcctggccgggcacgttggctcacacctgtaatcccagcactttgggaggctgaggtgggcagatcacgaggtcaggagttgagaccagtctggccaacatggtgaaaccctgtctctactaaaaatacaaaaattagctggggcgcggtgccgggtgcctgtaatcccagctacttgggaggctgaggcaggagaattgcttgaacccaggaggcagaggttgcagtgagccgagatcacgccactgcagtccagcctgggtgacagagcaagactctgtctcaaaaaaaaaaaaaaaaaaagagtgagtttcctttctgtaatgccaaaaagtgtttccaaagtcctttccatctcacagtagtccaaggggtacatgtaccccttgaacctgatgaagccccagcagacccgattaaccacccctaaaggtttctcggcaggcaaatccagccaggcatgcaaatcacactcgtcaatgttaaggcttttgtacatcccagacacaagctttaaatgaatgtaaacccagattttaatatttgggccccagaccttaaaaatcccattctctctacccacagtacctggctgagcaatccaattgccctcttcttgggagaccaagacatgtttttaaaataaagtttctttgtatttgctttccgtttcagtgaggcctcgagttcttgtagaccagataccttcttgttctgtgagaggacagtgtacagagaggggaactgctgagcagttccttttttttttttcaaagcacagtaagagtggtttggacacaagtactaccagttcagaaagggaagatgggtgtaggcaggagtagccggggaagaagtagaacttcagagtaaaagatgcaagagctagaaattccgtcaagaaaggaattactcatttgtttcctgtttgttcacaacatatgaattcattgctgttgagttacttattctataccttaaaatgaaacaaagtcttctgaacatccaacatatattttttttctttttctttcttttttcttttttttgagacagagtcttgttctgtcacccaagctggagggcagtggcacaatctcagctcactgcaacctctgcctcccgggttcaagcgttcctcccgcctcagtcctcccagtagctaagactacaggcgtgcaccaccatgcccggctaatttttgtatttttagtagagacagaatttcaccatgttggccaggctggtctcgaactcctgacctcaggcaatctgccagcctcagcctcccaaagtgctgggattacaggcgtgagccaccatgcccagccacaacatgtatttttaatgcttaaccatgggagatagagcggtaaatgaaatgagccagcttagttggctaaagcacattgctactgcattcaaggtcatgcttacccctgtaccttgaatcccagaggacttccagcag

SEQ ID NO: 2632 - DNA, 41295 bp, Homo sapiens
  source 1..41295: mol_type = genomic DNA
ttactggcttcgagtacactttatttaagcagttactagtttaaaagcacctgtaataacactgagatcatcatcatcaaattgccacccaacaagcctagcttcttgcagaaaagttaacttggataacacttggctaagttttctgactaatgctggatcaggtagaaattctttagtactaaagtcaaaaaacactaattgcttaagattctcaaatacacccatgaaggcaagccatccatcactgctcacacgatttcccgccaaattcaactgctggaagtttttcagagggttctttccaaaaaatgcacctgggtaaagaaataagtatattagttggaagaaaaattttttttaaaaaaaaagagaaataggttctacatttattttacatacttttttttcactctgaaatggccatgtttgaaccagtgctttgcctcagaaagaaattattaatataattctctatagctagggcagtgattgtgaatatggtctattatattttcctagagtataagggaatctgataaatagtgattcgtagtgaggtagcaacaatatgtaaatgaattacttttttttccccttttccttactcctaggaaatggaaggttgctttaattaaatattcagtacttgttttcaaaactggagtcaatctttggcaatattaagtcgtttcctcttctgaaaaagtaaacaccacctaactgttgtttctatgggtatgttcctaactgtaaacttgagtaagtgagcctccttcagtatctaaagatttgggtgtttttgtttacctgtttatgtataaccctcccgagcctcttcaggaagttcctccattccttacagaatagggcacctaaagtatttcctacatagggtaggtggatatcctgtctttctgatacacaaagaatgcacacacacacacatacatacaaaggatgtgtgtgtgtgtgtgtgtgtgtgtgtgtgtgtgtgtatacatacacaaatagtttagtgttcattctttatcccatgttaccagtttaggtggtactggaacccaagtgagtcttgcaataagaaaaaatacctttctttcaggttatttaccatcatacagattggccagtatacaacattaggatttcacaaaactagctctgtgttaattacacatattaaattgtgcaaagcgttagccctacccacctacctggccctttctggatgactaagttcaccttgaagtacagagtggacagacaggcagactggacatgggaactcttacttacatgtttatactccagagtatcacacacaaaatgcagaagatgtatgcctggtttatcaatccacattactcggctcatccgagctcatcttagtcttagtgtacctcacccaactttggagggttaatttgttgtatattaaacttgtgtttcttgggagatgtgtaatattagataatgttccagaaactgacccttatggaaatgaaggtccatgattcagtttggattccaagtaggaaaagaggttttaaaagttcctttccattgtctcagtgagaagaccactaaagagttcaagttaaagaaggaaagattcggtgctgtacaaccttaaggttagcaagcaaagactaaaaggtatctgctaccagtaatgagggcttaatgacagaaatggacagtcttgtccgaccagcttacgtgggtgaggtcaacctagttatgcactgaaactatacccttacccactttcagtaaaggtgtttaccagctccgtagtgagaggagatctgtgaatttggtgtctgatgtcactgcatggccttgtgtagtttgttcagtgcaactaagtacattctagagtgtgtccttagtcaatgtcagccaatgcttttatcaccatcataaggtcttgagtttcgaaaggtcttcaggttcttctttacagacacctaaagtgattggccctgcctgaccgtggtcaagatgctagcggctaaagtgggcaaagccaggtaaggagatgattcacagggttctgccttcatgtctcttacccatggtcagtgtcactgacaccatctttgggccttctttgccacttttattaatttgaaaagtgagacagaggccgggtgcggtggctcatgcctataatcccagcactttgggaggccaaggcgggcagatcacctgaggtcaggagtttgagaccagcctgaccaacatggagaaaccccgtctctagtaaaaatacagaattagccaggcgtggtggtgcatgcctgtaatcccagctattcgggaggctgaggcaggaggatcacttgaacccaggaggcagaggttgcggtgagcagagatcacaccattgcactccagcctgggtaacgagtgaaactccatttcaaaaaaaaaaagagaagaaaagtgagacagactgctagttgttcccaaaactgtctctccttattccatagttaatagagttttatttcggcatatggccactcatatcccaacctcccttgctattaggtgtggctaaatttttgccaaggaagtataggcagaagtgatgtgtgcaacttccatgtcacttttccgcttttcccctcttctactaggttgaaatgatcacagggcagtgacctagctatggccataaagtcaaaaataacactcttaaggaatagaggagtaaaaaaaaaaagtaggggtctgggcctgaaagactgcacagaggaaaaccaccccacctgcctggactgctcatttctggactgttacatgatagagaatcaagttctgccttctgtaagccatggtatagttgggtctctgttatcacagcgtagcctatgcccagcccaaatagtacctaggtccttactttcccctgccttccacctcctctgttccttggaggatggctttctccctgctctctcttccatctcatgttcatgtcctttctgcctttgccccttctccatatgcttcccagcatggcatgcactcagtccaaatgctggttgccagttgtgtgtctatttaaggctctttccccaaagatcaactttttttctccttctcagctagcagaacatattttcaccacctaaaaggaatttaagaagaatttaaagcccattccaccctcacagggtgagcaatttatagtggttatctactaaggtataaggatcttatcatcaatttaagagagtttcttagataattattggaatgtgtgctagtgcaggaaccaagaacaaacaacatttgtcataagccaagggcatgccttttgttcatttaatctgcagtgcttatgttatgaggagcagactagatccaagagaaacagaatccatgacatttagagccataggctgtatgtgggctgtggagagtgcaaatggcttgattggaattccaggaaaaatctcagatgccctgggtagaagggttctgattcttgggggttcctgtatcccaaacacaactcttcatttgtgttgtcctgtagttcacctgaacgagtaccagagttctcactgtttattcattcagcaacatctttagtgctactatgtgctgcggattatgctgggtgctggggatatgtgtaaacgacagacatggtccctgtctaaatgggcttacaaaatagtgtgaagacatgcattataaagtaattagatgggtggtgggtgctatggtaggtcagggtaccctgggagcacacaaaagcaataggctttcccactccactttgttcccagaacacttgcaattgggcttatatgctccaggaggaagactggaggattcttaggagaaatggaactgccccccgggaaaaggccctacaaagaaggggccattttgcttgcccaatcaccccctagtggagttagcctgtcaaaaattcaccgcctcccttagacacacagaactccctatcaacttgtgtctccctctaaaatgtgaagaggacagtgcaggattatcagacatttgacaacagcctcccacaaggaagactgagactaaaagccaaaacaactcccaaagaaatcaggcactgtagaaaacaagaaaaatcaaactccaaagacctaagtttttcagagatcctaagtttttcagtagactgcatctactcagcaacaataagatgctaagaaagagcttttggaaaataaaatatgatagcgggatctatacagcagaatgattgggcccaggatttaacacagagcttctagaacatgaatagggtctgcgatggctttttttttttctttttttgagacaggttctggctctgttgcccaggagtgcagtggtgcaatctcagctcactgcaatctgccccactggctcaagtaagtgatcctgccaactcagcttcccgtatagctgggattataagtatgtgcactacgcccagctaatttttgtatttttagtagagacagggtttcaccatgttggccaggctggttttgaactcctgacctcaagtgatacacccaccttggcctcacgaagtgctgggattacaggcatgagctctctttgagaacaggctggatagcagagttcagcttcaaacatccaagttgaaagataccatttaacaaagggttttgttagagcaggtgaaattggtcaggcatggtggctcatgcctgtaagcccagcactttgggaggctgaagcaggcagatcacttgaggtcgggagtttgagaccagcctggccaacatgatgaaacctcgtctctactaaaaatacaaaaattagctgggcatagtgcacacacttataatggcacatacttatagtggcggcatggaccggtaatcccagctactggggaggctgaggcaggagaatcacttgagattcagagaagcgaatagagaacagagaatcccaggaagcggaggttgcagtgagccaagatcgcaccactgcactgcagcctggaacaaaacaaacaaaaaaacaggtgaaatagatacctgagctagcaatgatttttatgttgtagtctcagattgctgatgggtaagaaacaaaattttgggagtcaagcaaaacatggcaaagcttggagatcaaatgcaatctctgaggaagaacagcagatagtctagaccaagctttaaggaaaactagaaacatttaatatctgggtagaggaatcaccattgaaaagaagactgagaagtagccaaggtggcatggaggtcaagagaatgttttgaaaagaagggaatgctcagtgtcaactcctgcggaggaatcaaataaattaaacacttctgaaagtgtctattgaaattcagccacatggaggggtgtggagagtcagatgcaatgagtagaaagtagcagatggtcaggaaatggagatgtcataagggtacataaaatttgttttagagcttttaccttgaaggagaggagagatagaatgataaccaaaggaggaagataggactcagggagagttttatttaaaatggaagagatttgagcaactttaaaaactgacaggagggagtcagtaacaagaggcacagtcaataaaatgatgtccctgaactggagtgagggtgaggctggcatctcaagcactgctaaagagactgcccttaggtaggagaagagaaacctataagctctaaggagaaggagagaaaaaaataacagtcacatcctctgtgaaataggagacgctgagtactgattgagaagaaaaaagtgtgaaatagtttacatacagtgttgaatacagaaacacagtaagattgccaggaaatattaagagagattgtgtttattcactgttttttgtttgtttgtttgttttgtctcccaggccggagtgcagtggtgccatcctgacctcaggtgacccacccgccttggcctctcaaactgctgggattacaaacgtgagccactgggcccagcccccgctattttttttttttttttttgaggtagagtctcactctcccacccaggctggagttcagtggcgcgatcttggctcactgcagcctccaccttctcggttcaagagagtctcctgcctcagcctcccaagtagctgggattacaggcatgtgccaccacacacagctaatttttttcatactacattttttaatccattcattatttgatggacatttgagttgtttccacttttgagctactaaacatgctattataaacattaatatacaagtttttatgtggatattggttttcatttatcttgagtacctaggaagagagttgctgggtcatatgacaactctatgtttaacattttgaacaacttgccagaatgttttcctcagcagctgcatcattttacattctaactaccagcatatgaatttctccgtatccttgccaacaacacttgttattgtatgtcttttaataaaaaataataaccatccctagtgggtctcaggtggtatctcattgtagttttggtttacattattaccctgatggctaatgatattgattatgttttctgctatttattttgcgatttacatatcttccttggtgaaatgtctgttcagattcttgcccattttacaaattgggttatttgcattttttatcagtgagttgtaagagtttttttgttttgttttttgacatggagtctcactctgtcacccaggctggagtgcagtggcgcaatctcggctcactgcaacctctgcctccaggattcaagcaattcttctgcctcagcctccagagtagctgggattacaggtatgtgccaccacgcccggctaatttttttgtatttttagtagagatgggatttcaccatattggccaggctggtctcgaactcctgaccttgtgatccacctgcctcaacctcccaaagtgctgggattacaggtgtcagccaccacgcccggccataagagtttttttatatattcaagatggaagtcctttattagataatgtgatctgcaatttttttttcacattctgtaggttgtattttcactttctttctttttctatttttttttgtggggggggggtgggggactgggtgtcactctgtcacccaagctgcaatgcagtggcatgatcacagctcactgcagcctcaacttcctgagctcaagccatcctcccacctcagcctcccaggtagctgggactacaggcgtacgctgccacacccagctaattttttggagattgagttttgccatgttgctcagactgggctcggactcctgggctcaagcaatctgcccacttcggcctcccagagtgctgggattacaggcgtgagccaccacacccagccttagttttgaccaaatgtctttttttctgttgcaggaactcatccaggataggacattacatttcattgtcatgtctctttaggttcctcatgcttatgacgatttctcacaatcaccttgttttttatttccttgacagtttcaaggaatactggtcagttttgtgtagaagtccctcagttaggattgtttgatgtttttctcatcattagatgggggatatggatctttggggaggaatatcatagaggtaaagtactattttcgtcatgtcatatctaggtacatactatcaacatgaatcaccactgttaatgttgaccttgttcacctgaccaaggtagtgtcaacagctttctccactgtaaagttactcttttttgctgccttttgctgcatgctacaagttttgatatacagcgttttcttaccattcacttctaaatattttcgttgaaatttgtcagtatgaacttgtatttatctcccaaattttgcagtttttccccagtatcctaagtgtagttacaaaattttaaaaagggaaatttaaggacaatccaggcctggggttttgtcaggaaagtacaccccatctactatatttcatttcatacctctcattccacatctcatgttctgcctgcatctcattaggtagtctttctttaattagagactccatctctcattacactcttcatttcaccattgcatctatcacacacatccatcactcaaagtcattgcctgaattgactcatgctactgtgggccatgagaatttcagctattaaagacaagaatgtttgcagggatggaagatggagttgaaactaggtaggaaggcaagtcaaaatagaaagggcctgaaaaataggtagaaggtagcgggatcgacggactggaagtcccagtgaagtaaaagaactggtgattaggagtagatagaaatacaggaggttgtggtttgagaatgggatatctgcatttattattttgcaggtagaacaattttaagtggcttgtcataatctagtcattgcatgctcatagaatgaatggatgaaggagagtggaagggaaggtcgttgaagaggaaggtccattagcggagcatagtggcctctagtcccagctacttgggtagttgaggaaggaggatcccttgagcccagaagttcaaggttagtgagctgtgatcacatccctgcactccagcctgggcaacagggagaccctgtctcaaagagaaagagaggggtgggggagggaggaaggaaggaaggaaggaaggaaggaaggaaggaaggaaggaaggaaggaaggaaggaagggagggagggaaaggaagaaggaagggagggagggaaggaggggaggggacatactgctttcactgtatcccataggtttcagtatgttgtgtttccattttcatttgtcttaagaaattttaaatatatatatatatatatatatatatatatttttttttttttttttttaattgtagagacgacatgttaccatattgcccaggctggtttcaaacttctgggctcaagcagtcctcccaccttggcctctcaaagtgctgggattatagtcatcagctaccacacccagcctatttcaagaaatttttcagtttccttctgaatttcttcattggcacacttgtcattccagagcatgttgtttaatttccatatgtttgtatagtttccaaagttcctctggttattggtttctagttttattctattctattatggtcagagaagatacttgaatcagatttcaattttgggggattttttaagacttattttgtggcctaacatgtggtctatccttgagaataatccatgtgctgaggagaagaatgtgtattctgcagctgttggatgaaatgctctataaatataggtccatttggtgtatagtgcagattaagtctgatgtttctttgttgattctctgtctgggagatctgtccaatgctgtaaatggggtgtcgagtctccagctattgttgtattgggttctatctctctctttagctctaacaatatttgctttatatatctaggttctccagtgttggggacatatatatgtgtgtgtatatatgggaagatgaagaagctctggagatggatgttgtgatagtggcacaataatatgaatgtacttaatgccacaaagcttttacacttaaaaacagtttaaatagggccgggtgcggtggctcaagcctttaatcccagcactttgggaggccagggcaggcggatcacgaggtcaagagttcaagaccattctggctaacacggtgaaactccatctctactaaaaatacaaaaaaaaaaattaggcgtggtggctggcgcctgtggtcccagctcctcgggaggctgaggcaggagaatggcatgaactagggaggtggagtgtgcagtgagctaagattgcgcaactgcactccagcctgggcgacagagcaagactctgtctaaaaaaaaaacaaaaaacaaagaacaaaaacagtttaataaattgtacgttacgtaaactaaacacattttagacaatctgtaagagaaatgaaggcaatcgaggctgttttcacaagtccttggctttagtatgatagcttccaagttgaacctgatgagcctgacctccttgtattaatgtttccatacgctggattggaataacttgtgcaaccagtgggatatgtcagaagtgaccagaaatgagtgggctgccatgttgtgaggacactcacagcctgtgaagaggtctaatgatgaggaagtgaggcctccagccaacagccagtgttaacttgccaaccatgtgagaagctaccttggaaggagatcctccagcagcccctctcatgagagaggtcaagccagagctaacctgctaaactcctaaattcctgaaccacagaaactgtgagataatggttattgttttaagccattatgttttgaggccatatgttatacaggaattgaaaactaatacagatagtatgaaggcttctttcatcaactgcctgaggttggtggtgtcttcagtcatttatatagatctatttgtttctggataatattacagctatttaaagatattttgtggctctatttagatacagctacattcgcctttatatgttttgaatacccagtaagtaacttgaaaatatttcctgatattggagggaggggcattgctgaatttcagaaagttaaggctagtaagagctatgactaatataatacatcttgttggatactgtgaatgcttttcatttaattctgtaggtaaaggaaatagaatctgaaggaaggccagtgttttaagtcttcttactctaacgtgaatgaattcattagacatatttatattttaaaaaaaagaggaagcaaaataaaataagggggcaaaataagcaaagccaacttaagaattttttaagggccaaatccagttatcttggctctgtatgtgtgtacctacctaaaattctaatctctgtatctgtgagtctccagtttttcaacccaagcttgacgagttgtgggacctcctccaaatgtttcaacaggctgctcaggctgccttgcacgtcacagccccagggcagcatcagtgcggtgagctgttctagcacgttcatcctgtcgactggaagaaacaaagagcagttcagggactggatggtctcaaaactgaggaagaacaaaggggtgttaggggaggaatgatctttatgtttggtggctctgcagcctactcaatctgtaatgagaatctacttaatttttggtttttttttggaaagtattcaagcatatacaaacattatgcagaagaatataatgaaactatatatactaataagacaccttcaaaaacattaaatcatgggcaatcttgcttaatcctgacctaattcctcctgtattattctaaagcaaatcatggacaatatgaatcagttctttccttttttttcttttaaccataatcacatatcactatcacacctaaaaaatcatatcaccaattccttaagcaaatttgtcttgcacatcggctactcttgacagttgcctcttcaaaggaggaaagcaggtgggataccgcctcaaagtgcagtgagcatatgtaaactggtgacttaaaagacatgggcctgtgttccttaagggcagtttaagaaaggcctaaatgattttcctaaggagggtgcatctagtaaggcacacatgggtataaaagacctcaggacccaggctatgtatttcgactacccagtatacatattcaagtatctaattttggctgaattgtcattcttactcagttcatgaagagcttcatttccatctttttccaggtaattttctgataaatcaagaatgctcagtttgaccaaattgtgaagattctgagctggggaaaaaaagtaatccaaaataaaaagattttcaggtaaatataaatgtattttgaagtatccttagaataattctgagttttatcttctctgctaatggtagtgcaaaccataacttgccttggttattttaattatttccaaaggctctggtgtaggtgtaacccccaaatcccatggttatgaccaaatgggcaaatagtcattggtcctaggttctgattaatgaattccaggtcacgtagaacctaaagcagcatgggatgtagttgttatgtcatcatggaaaaatcacttggtctctctaagcctcaatgtcttcctctatagaatgaggtagttggaccagataaaatgtaaagttgcttcaattataaaatgccgttaatcatgcaggagaaacaggaacaacaacaacaacaaaaatgaaatgagctggttttgtgtacctcaacttagatgattttattgacataatagttgagatattaataataaaaacatagtaaaaaatggatgagaaaaaaaacaaatagcaaaatggcagattcaaatttatccatatcaacaattacattaaatcttaatggactaaacactccaattaaaaggcagagataatcagatattcagaactttttttaaagcaagacccagttttatgctgtgtacaaaagacgtgtttgaatgacaaagacacaaatatgttgaggtaatggaaaactattttgcatgcaaacattaattatataatagtaccagtctagctaagaattgcttagtgcttttcttcacatattatcactcttgcttaatctagctgaagttttttctgtcagggctagaaaaatctcctttttaaaaaaatcagacaagtttttcatgaatatgtactcttgttataatattggctattattatttttaatcaatcatatgagcccttttcttaaagtatcttctgggttttgtgctctacaataaaaaacctgctgaacttctctttaaaagagtacgtttgctatttgcagttctaagcctgtctctccccatcagtaagtagagaaataaaggcatgtgctcattgttctcatattcccagtacttatccagcctttttcaactgtgggtttctctagctgtaactttatattagtatacaaatggcttccttagttatctttagagactcccagcagttatatagtttaactttaaaaagattataccactgttttccaaaatctaaattttaaaatatgtctgaattacacatgtatagtttatccagaaatatgcagttagtttccccgtagttgatatgcatccctttgggaactcagaaggctcaattatcatatcatgcacattaacttcatcttaacagggcaatgggtaggaattagaagcctgagatcatttaagaaaatctttatctctcacttctcaatcatttatccattcatttaaatgtttattaggcagtaaattatatgaccggttgtgtggcaagtttcaagcacctatttcttattttcttccttttcactttctctaaaaattacatcttcaattattctgaaattctcccctattatccatcaatagttgatttaattctaatatggagaaaaatcattaaaaacaatctgcttattatcgagaagtttttattttccagttttccttaaaattaaatttccatttgagacatttagtgtgaattagtataatagtatcacatgttctgttatactgtcctcattcagttaatggaagcaacagttacctaggattttcactgcatttgcagacaagcagcaggagactaattgaatttcttcaaggtcacagggttcacttgacagagacttgactatgtaatccattccctctccaatgtcagacaagtgggtcaaatgaaataaacacatcttcttcaggtttttcaggccttcagctgaaaaatgatagaaaggaatgcattaggataccaagttaattcgatttaagcatagattaatgaactgaaaagaaagcaaagaataattgtgcagagaccttgccatgttcttcctgcagcgactttaagttacaaagaatcaacgagagctttttttctttcaattctcactttccagtctcttggaccacacaaaaaatcacttatatggaggttattctcttagtagcatgagaaacactgtagtaaatttgtagtctttttaatgggcatcaatgtatactcttaccgtaattctttacatgaatgaagtcttctagagcactctcctttcaatcttctcaaaaatcttaaacagcgggggggctgagttcagggaggtagatgaggacttggctccttggagtgcttctagtgcaactgtctacagcctcaaaagccttgcctggactcatgatatggggcctgcctgaagctttagaatgaagaccacatccactgcagcatgtttaaccagaagaaagatttaccttatatcaacagtataattggaaacattctaaaatatcccccgttcttaagtctaaagctaatgtgcagtttaggattggttaggcctcactttgtgtcattaaaatactgtcttatcttgatggtactgtagcctacgggaaagaaatatatgattttaatgaccaggcatggtggctcacacctgtaatcccagcactatgggaggcagtgataggcgaatcacctgaggtcaggagttcaagaccagcctgtccaacatggcggaaccccatctctactaaaaatacaaaaattagctgggcgtgatggtgcacacctgtaatctcagctacttcggaggttgaggcattagaatcgcttgaacccaggaggcagaggttgcagtgagccaacatctcaccactgcactccagcctgggcgacagagcgagactcccatctcaaagaaaagaaaagaaaagaaataaaatatatgattctaataatatcagtcttgcagagctttcgggaaggttgcagataatgtacgttaacatatttaatgtggtgcctggcacatagtaagtgctccataaatgttcattgttgtcatgggagtatataccggttaaaggttgtgagcatgagctttgcagtcagttcctggatcccctacttaataattataaacttgggcaagttattcaatcttttagctgaagcgttagggatcattatatctatgtactaggactgttgtggggattcaatggaatgaggtatataaaactgccgaggctagtgtctaatctatagcagagtaactctttaataaagagtaaattattactgatataattagactggtttagtcaagttcacattttgattccttaatagcagaagcaggctatcctagagaggtactttttgacctctttctaccagttggtaagatcttgagcaagtcaataagctattttaggttctagtggagttttctgtgaaatgaatgagttgaattagatgctctcaatccccttccagctctgattttctgtgtaatttatacacatgcaataaatgtttattgaacactgaattaatttgattattctcacgtaggacatataaggaaaagaagtcagccatgttttgcttttgtttttgtttttgtttcaagatggagtctatctctgtcaccgaggctggagtgcagtggagcaatctcggctcactacaacctcctcctcctgagttcaagtgattatccttcctcagcctcccaagtagctggcattacaggtgcataccaccatgcccagctaatttttgtatttttagtagagacagggtttcaccatgttggccaggctggtctcgaactcctgaactcaggtgatccatctgcctcggcctcccagagtgctggaattacaggtgtgatccaccatgcccaggcttcagccatgtttggcttataggctagagttgtctttcggcaggaagcagaataagaaagaacaagatgaagggaagagaggagtattttagtgaggactcaagtagggaaaaaaagagccaaaaaaaaaaaaaaaaaaaatccaacacacgagaaaacagggacattcaaggaaagcagctttaacaggaatcctccctggcctgcagggcctggttccctgtggtaagccatgtgttctgcttgtgttcctgaagtttccttttccttttcatttttttgattggggaaacacaacctgcagtgtagaatgaaagcatgcttcccccaaagttttcttgattcacattgtttcctgtgtcctatttcatttatgaatttttttaactatgaaaccatagtataaactttaaaatattgtttctatgcaactatgaaactatactataaactttaaaatattgtttctatgcattaaataaaaacatagccaatgagccagggagacggaagttaaaaacacgtcaggggctctcttcccaaaagggttaccatctggtgttgtacaatttgaataaaatgatgctgaaggattttaatggcagtagggaaaatgtctggggaaaccaatgtagccacaagtacataaaaacatccttgccttgtgcagacacagccaatgtcagagcctgaagttaactcctcttattatcaaacttacattgatacaaatatgagaacagaaatctgacctagttttatagcatcttcttcattcatctttatgttatccattatgagctttgtaaggttcttcaagttacccaagctgtcagtcagaccacctgtcaaaagaaaaaagattggactctttcagcagatatttgctatttactatgtcatttactattactgtcatttttgttaccaatcaaaagattttaatgatcatcatgagccaaaaatgctcatgaaatagacataaaaatatactttttataagagatgggcattatacttcactgtaagcatgttctgcaaataatagactagataccaatttcccagataacagggaaaaaaatttcctttttttttttttttttttttttttgagacagagtcttgctctgtcgcccaggctagagtgcagtggcgcaatctcagctcactgccagctccacctcccgggttcacaccattctcctgcctcagcctcccaagtagctgggactacaggcacctgccaccacgcccggctaattttttttgtatttttagtagagacggggtttcaccatgttagccaggatggtctcaatctcctgacctcgtgatccgcctgcctcggcctcccgaagtgctgggattacaggcgtgagccactgcgcctggccgataacagggaaatttctaaacacttggaaattaaacaacacatttttaaataatcatgcattaaagaagaagtctcatggaaactttgataatattttgaaaaatataaaaataaaaacaaaacttcaaaatctgcagctctctcctcacaaaggggtgaaaagaaaaaaaaatctgcagctaacacagtgcttacagggacatttacagtattgcatacttatattagaaatgaggaaaggcctcaaatcaacaacctaggcatactacttaagaaattacagaaaagagagcaaaataaatgaaagaagaaagaaaataataaagataagggtgcaaatcaaagttattatgcctttattatacaaattaaaaacagaggcaaggtctcactatgttgcccaggctggtctcggactcctgagcacaagtgatcctttggcctcagcctcccaaagtgctaggattacaggcgtgagccaccatgcccagcccagaaatcaaaattataaacaggtaaacaatagaaaaaaatcaatgaagctaaaagttggatctttgaaaagatcaataaaatttaaaaatttctaccaagactgacaaagaaaaagaagacaaaaattaccaatatcagaaacaaaaaaggggatatcactacacacactgcagatattaaaaggacaattagagaataatataaacaaatctatgcacataaatttgacaacatatatgaaattgaccaattttttgaaaaccacaaactaccaacactcatgtgatacggagtaggtaaccggaataaccttatagctattaaagaaattgaatttgttatctaaaatttcccggaaaagacatctgtaggcacagatatgttcacttgcaaattctgccacacattttcatttttttccttctatcaactgtcttcatatctaccacacatttaaagaagaaataacaccaattctacacagtcacttccagaaaatagaagtacaaagaataattcccaactcattttatgaagccatcattaacttgatatgaaaaccagaaaaagacgtagaagaaaaacttttaggccaggcacagtggctcactcctataatccccgtgctttggggggcagaggtaggaggatcacttgaggccaggagtttgagaccagcctgggcaatatatccagaccctatccctacaaaatattttttaaattacccaggtgtggtggcaggtgtgagtagtcctggctactcaggaggctgaggcaagagaatcgcttgagcccaggagttcaagattgcaatgaagtgtgatgacaccactgcactccagccttggtgacagaatgagacaatgtctttaatgaaagaaagagagagagagagagaatagagaaagaaaggagggagggaaggacggaaaagaaaagaaagaaaattgaggctgggcgaggtggctcacacctgtaatcccagcactttgggagggcgaggcaggcaaatcacgaggtcaggagtttgacaccagcctggccaacatggtgaaactccgtctctactaaaaatacaaaaaatcagctgggtgtagtggcaggcgcctgtaatcccagctagtccagaggctgaggcaggagaatcgcttgaacccaggaggcagaggttgcagtgagctgagatcgcaccactgcactccagccctggtgacagagtgagaccccatctcgaaaagaaagaaagaaaattaaactttagaccaatatcattcatgaatacagaatcaaaaatcttcaacaaaatagaaaatggaattcagtcatgcataaaagaatattacggcaggcgtggtggctcacacttgtaatcccagcactttgggaggccgaggcaggtggatcacaaggtcaggagtttgagaccagcctggccaacatggtgaaaccctgtctctactaaaaatacaaaaattagctgggcgtggtggcgcgcctgtagtcccagctacttgggaggctgaggcaggagaattgcttgaacccaggaggcggcggttgcagtgagccgagatcgcatcattgcactcagcctggtgacacagcaagattccatctcaaaaaaaaaaaaaaaaagaatattacaccacctccaaatgggcttcatatagggaatgcaggatgctcaatatgtggaaatcaatccatataattcattatattggcagtctaaaagtaaaactacgtgatcccataaattgatgcagaaaacacatgtgacataatccaacatccaggctaggtggctcacgcctgtaatcccagcacttcgggaggcccaggcgggaaaatctcttgagcacaggagtccaagaccagcctgggcaacatagcgagaactcgtctctacaaaaaatttaaaaattaaccagatgtgatagttcacacttatggtcccagctagtcaggaggctgaggtgggtggatctgttgagcccaggaagtcaaggctacagtgagctatgatcacgccactgcactccagcctgggtgacagaacaagaccctgcctcaaaaataatctaaaaataatttaataaaaacaatccaacatccatccatgtaaaatgacatgatcatataaatggatacagaaaacatctttagcacaatccaacacctattcatgaccaaaaaaaaaaaattctcagcaacttgataaaagacacctacaagaaaactacatttaacattatacttaaaggtgaaagtctgaatgctttctccctaaggtcaggaacaaggcaagatgttaattcatgtcactattcaacattgtactacaagtcctagttagtgaaataaggcaaaaaaaaaaaataaataaaaggaatacagattggaagggaagaatttaaaatcattcttttcgaagataacatgattgtctatgataaaaatgtcaaggaatctacaacacccccttctgcaaaccccacaaaaaaaacccttctaaaactggctgggtgcagtggctcatacatataatcctagcagtttgcgagactgatggggaggatcacttgagcccaggagttcaagactggccttggcaacatagagagacctcctctctacaaaaaagaaggaggaggaggaggaggagagggagagagggggagggggaaggagaggggaagggagaggaagaaggaggaggaggaggagaaggaggaggaagaggaggagaatgagaagagaaaaaattagtgaggtagcgaggtgtggtggcacatgtcagtggtcccagcgacttaggaggctgagcattatgtagaaaatgggattatagaccgggcacggtggctcatgcctgtaatcccagcaatttgggtagccgaggtgggtggatcacttgaggtctggagttcaaggccagcctggtcaacatggtgaaaccctgtctctattaaaaaatacaaaaattagccaggcgtgttattgggcgcctgtaatcccagctactcaggaggctgaggtaagagaatcacttgaacctgggaggcagaggttgcagtaagccgagatcacaccactgcaccccagcctgggcgacagagtgagactccttctcaaaaaaaaaaaaaaaaaaaaaaacagatgaatagaggtcattatggtaagtgaaataagccaggcacagaaagacagacatcacgtgttcttacttatttgtaggatctaaaaatcaaaacaattgaactcacggagagtagaaggatggttaccagaggctgggaagggtagtagggaggaggtggaaatggttaatggatacaaaaaaatacttagaagggataaataagatctagtatttgatagcacaacatagtatctaagtcaaaataagttaactgtatatttaaaataactaacagtacaactggattgttcttaacacaaaacataaatggttgaagggatggatactccattttccatgatgtgattattacacattgcatgcctggatcaaagcatctcatgtaccccataaatatatatacctactatgtatccacaaaaatgaaaaatagaaaaaatttaccttatagggttaagacatctaaatgagttgatacacgaaatttgcttcaataatacctgtatgtgttcaataatgttggctatcgttatgtatacctttaaaaaatcaacaggttggggccaggtgtggtggctcacacctgtaatcccagccctttgggaggccgaggcgggtggatcacctgaggttgggagtttgaaaccagcctggccaacatggtgaaaccccgtctgtactaaaaatacaaaaattagccaggtgtggtggtgcatgcctgtaatcccagctacttgggattctgaggccggagacttgcttgaatccgggaggtggaggttgcagtgagccaagattgtgccactgcactccagcctgggtgacagagtgagaccctgtctcaaaaaaataataattaaataaagtaaatactttttttaaatggcaaacattaaaaaataattataaacaccatataggccaaattcagcacataggtgatcactttacaggatcagtataaaagaatagttgtcatgagtagatggtgagcttcctgacacagaaggtagtctaatacagtcttcgtgacacccagaatcttacagaagggattccctcattagggaggaggtttcaaagattatctgtacaaaaaattctagaatcttaaaatgataggaaatttctctgtagggtgacaagcaaggcagagctgggtgggaaattgctagcgtttgaaaactaaccccagactgctacagttaagtacagcaagattcctgcttcccatggcttcacaccacatagcagttcctgctcggggcaaccaggctggtctacacaggtagggcagacattctcctttagtgttatttggaatttggggaagtatccccgttacccagaaagattgccctcgcatatctgtgtctgaagtctaaaatctgaaatttcatcatgttagacaatattccccaaatcttctgtcattcattcttctttttcttttctttttggagatagggtcttgctgtgttgcccaggcacagatatgatcatatcttgctgcagcctgaaaattcctgggctcaagtgatcctcccacctcagcctctggagtatctgggattacaggcatgcaccatcacgcccagatgattaatttttgttggagacagggtcttcctattgtgtccaggctgatctcaagtaatcctcctgccttggcctcccaaagtgttggaattacaggtgtgagtcacctggcctggccccaaccaagtaaacaacagttagggtgggaacggagctgagtatcttctacaatttcccagatgagaatcttgtaacacaattagctcctagctcctgcaggtgattaatttacaggttggatttcctccaagacttgaagtagggcagggtgccacttggcagggaaggactgggtattgggtagagatgggggtgctcgcaggagaaggatttgctgaagacaagcttaacctgcgtatatatttattttttttaatttttttttttttttttagacagagtttcactcttgttgcccaggctggagtgcaatggcgtgatctcggcccaccgcaacctccacctcccaggttcaagtgattctcctgcctcagcctcccgagtagctgggactacaggcatgtgccaccacgcccggctaattttgtatttttagtagagatggggtttctccatgttggtcaggctggtcttgaactcccaacctcaggtgacccacctgcctcagccttccaatatattttttaataaaaatatttttagtatatttacatttttaataaaaatagttttaatatatttaaacacatacatatatgtatctatgtatgtatgtgtatatatatctttccaatcagactacagctctgggaatcttccctatggctcccaatctaacagctttcccccaacatagacctctctccacagcccttctaccttcctttcaagtcctgacacctggtagaaactactagaaaatttaaaacaaaactaataaaaatgaaatcatgtcttttgcagcaacattgatggaaccggaggccattatcttaggtgaaataactcagaaacagaaaatcaaataccatatatactcacttacaagtgggagctaaataatgtgtacacatggagatagaaagcagaatagacatggagacttggaaaggtgggagcgtgacagggaggcaagggatgagaaataatctgataatggtggttacactaaaagctcagatttcaccaccacgaaatatatcgatataacaaaactgcacttgtaccccctatatctataaaaataaataataaataataaagcaaaactatatatctaacattttcacagtattcctggctaatatttccagccagtcttgattatagctgtaaactaaaaatcctaagccccccaccaactgaatgcatcccctctgggctaaggagaccccagaaaaaaaccttaaactcagttcctggccatgacaggatgggaggtcaaacacacatcattatactccctctcttgtatggtttgaacacaactcatcagcattactgttgacatagagatcataagactaacagaacagactttttgtggcaataaattaccaagttataaagaggacataagaccatgccaggcaaaggctaagtcattcagctctacgcttaaagaataaactgtcctaggctgggcgtggtggctcacgcctgtaatcccaacagtttggaaggtggaggcagtagaactgcttgatcccaggagttcaagaccagcctgggaaacatagtgagacctcatctccccataaaaaatcaaacaatgaggatcaactgagcccaggaggttgaggctgcaatgagctgtgatcgcaccactgcactcccacctgggtgacagagcaagacccaacctcgaaaaaaaaaaaaaatttaaaaagaataaactctgtcgtaactgccacagatttttcttctttggtagctaaacaagcattggtctcaagataagcaatattgatagttgtgaatattaaacaattcgcaactcatccagctcacaaatgctaacaatccctgttccatctgccataactacagctttgattggagaagagagtgatttcagtaactttctcctgatcagaggaccaccaaccacagactggttctggctggtttacagagattgcgtacctgcttacctttgtgctctgaaaagaacttctgaagtataggcctaattgtaatacatttaaatcatttaaaggggtgtacaatcttttggtttccctgggccacattggaagaattgtcttgggctacacaaaaatgaatttgtgctgggccacattcaaagccgtcttgggctatgtgcagcccacggactgcaggttggataagcttgatttaatgctaaatctccaccccaaagtgaacatgggttgtatgttacatgcatgtttattcaatatgcatgtatcaagaccaccttcatgaatattcatagctcctcctgtaatctgttgaatatgtatgtttagccaacccattcaacataaagtgtctaccccaacccctccttcgaggtgcctgtctctggtcttggttggaggcatgtttctcagcctgtgggatggccaccttgcaggctgtaaccctttagaagaaataaagtctcctctctccttttccaaatttatacactgttatttttttttaagtgaacaaagcacaaaccactgatatttacaatacccggcagccgttgattctgtaggtcatgaatactcaaggttttcaggtttgttacagatgtgatgtgcctctcatcttctatggtgaggggactggcttccaccatgagagaataaatgttcttacaggtgctgaggaccaaactgaggcttccagccacaccagcacatctctttatttgcagcctgaggcttgtggcagagctgaatattttccccagatatctgatatcttgcttattcaacttgctgaaatcccggagtgtgacctccagagtcctgaattcctgcttccagttgaagaacaaagatacagccctgctgggaatgtaggtttctggggcctcttccatgtggattccacctgtgtcttctgcagccttttcccatgaagccatagctcccccataaaagtccagtttaatgaagtccagggcacttgcacaattgggcaaatgttcaaagaagtcaaataagtaatcggggatgttccctgagttgatatataagcttttaccttgaaagaaagcttcaaattcttggctcagggctgatttggatgtactctcttgatataaatggatgccacactctacaaaggaattgatgtttatggctttcagaatttcttgctcagtggtgtttttcacactttgcaaagattcctgtctccagagaggcctcttggcgatggaaagtccgagaaggcagccgtgttgatacactgctgcgaggtgcttcataacagccctggtggcttccacagatgacccacaggtgtaccggagcaggctgctataagtggatgtaatgtccgaaatggaaaccattttctgcaagtaaccattccccttggtcacctcctctggctcatgagacgtcaataaactgctgagtcttcgtcctgctgtgtactcctggaatgacttgtgaaagaatttatactttggcttgaacctttgagctgtatatttacagaggagcccagttgtcagcaggacatcctcattcacgctggacacatcctgcagttcgaaatcaaacttgtgggagaacacaccctccagagctaggtctccacagtggtccaggctccgaatgaagtcacttgcagccacacctttatgtttgtgtttgtttttctgtatcaacagatcatagaaggtatggaacagcgttgtttgtgtgtgagagtggaactcactttcacccatctggattgcacaagtgatgaccacaaagagaggggtcttcatgagattcctcaagcacctggatttctgaatttggagcaacaagccttcagcaagctccttgatcagcacttctcggatgagagcctgggcgctgtcttctgtcatatcccccacctcagcagtcagggcaccaaactgccgtatgtgcctcaggcactcagtggtagtggtgacgatgaccatgttcttgaagcggtggttttcctttatcagggcttcgatttctgggcagttctggggcttgaattcattgtagccatcaagaaggaaaagaaccctctgccgcagcttcagcagcatggccatgaatgtctgcttcctgattgtgccaggtatatccaggagttgatcacagagggtttcaaaaagtccaccctgggccctgctgagacggaggaagaagacgaatttgaacttggtcagagccttgcactttccggagccccagagcatggcaattcgctgcagcagagtggacttgcctttgccagattccccttcaatgatgcaggggctctgaagagcctgcaggaggccattcagggtcagctgctccacgcggtgatggtgttggtccttcctccacaggacaggttctgtgaaggtgcttttcaagttaaaaataatgtcaatatcttcaccaaggggataaaagttcagaaaagatggggtatggtacaagtcctttaaatcctgagccaaatcgtccaagtctccttctgatgtctgatgaaaaagacctattagagaagaggtgatgttaaagaagacccaattctgtgtctcctcaaaacctagagttcaggaggatgaacgggggggtgaggctgagaatctgccattggtgaatgtaatgtcctttcccagttctgagctggcacaaagggttctgtctgctccccctttccccagcatcctttaccccactcccctttttgctttctgtttcctcctttccacaaccaaatcttatagcagctggttggaaaagggaggagcttgtttttgggttaaggaaagtaaagaatttggcagagaaagatggttagggataattgtcatcatagtaggccttcactctgagtaaaatctgtcatgaccttatttactaattaaaaaaataaaaacaatattttatgaaacatagaatcatggttctgtgtcagtcaggctgtctttaccaggaggcctggacatggagtaggtagtcagctgggcctctctcccataggtagatctcatccaaccagggaatgctgagaaccactgctgcactggaagcttaactagtgcacttattctccagttttatcttgcagtgagacaatactcaatcatttatttcctggccttggggttatttgtttggcttcaccatcaattgatctactatgagtttttcctaaaatcatctaagcttttccttagcaggtatcaaaggccactgccaggtgatatgaagagaaggaaaagcagaggctctgccatggggaagatggatctttgttgtggtctattctacttgcagaaacagatgcaaaactaactgatacttactttgtccattcaagtcctgaaatagaggatagttccactccttaagggatttaagaaagaggttacaggactctgaaccctttttcaaaatcatgtgaatgatccctctagcagcatcctgctccaccttctcgcagcaaatgatgtttacttcttcgcgattcagaacattccatacaaataggtcatctgtgatttgctttataacagtcattcccattctttgaataagggctcggctattgtcctttatgaaattcactgaggagatggggagaaatatacatatttatttacttatataaaatgtgcatatccggctgggcacggtggctcacgcctgtaatcccagcactttgggaggccgaggcgggcagatcacgaggtcaggagatcgagaccatcctggctaacacagtgaaaccctgtctctactaaaaatacaaaaaattagccgggcgtggtggcgggcgcctgtagtcccagctacttgggaggctgaggcaggagaatggcgtgaacccaggaggcggagcttgcagtgagctgagatagcgccactgcactccggcctgggcgaaagagcgagactccgtctaaaaaaaaaaaattaaatatgcatatcagcatctgtctccagagcattagggccatgcatttttttcctgtgagcatctcctgagttatggagatgccaaatgcctgaattccaggccttcaagaaatgctctgccaagcattttttttctgagacggagtcttgctgtgtcacccaggctggagtgcagtgacgcgatctcggctcactgcaagctctgcctcctgggttcaagcaattctcctgcctccgcctcctgagtagctgggattacaggcacgcaccaccacactcagctaatttttctattatttgtagagacggggtttcaccattttggtcagactggtctcgaactcctgaccttgtgatccacctgccttggcttcccaaagtgctgggattacaggcgtgagccaccgtgcccggcctctgcaaagcatttctaaccccagagttattgatgagcaagatgttttgctttggtgaagaagtaaggtgagttatcttgtccctctgatataaagcagtccccagtgaggttgtagttgtaagaccgttggctttagaataatggcaatggcctaggatctgccacttgctaccatctatgtgaccttggcaagtcactaagcctctttgagtctatttcaattacgtgctgctggccgggtgcggtggctcacacctgtaaccccagcactttgggaggccaaggcgggcggatcaccagaggtcgggagttcgagaccagcctgaccaacatggagaaaccttgtctctactaaaaatgcaaaattagccaggtgtggtggtgcatgcctgtagtggcagctactcaggaggctgaggcaggagaatcgcttgaacctgggaggtggaggttgcggtgagccgagatggtgccattgcactccagcctgggcaacaagagcaaaactctgtctcaaaaaaaaaaaaaaaaaaaagtacgtgctgctaaatgtttcacaaactggccctggccctctgggagtaaaggccctaatttgtagcattcaccaatccccaaggtataaatattcctaccatggcctatttcaagctaacagcgtatgttaactggctaacaaaaatcctgaaaattcaataatcaggtttcacatcacagtaacaaccagctccagcacactggggattcctcatctgtacaatggtgtcaagagcattatttaacttaggaagttgttacaataattcatgtatagtatctcatacaaagtaataactcaatatatgttagctactatttttagcctttattcaggtgtcaccagacaaagagcacattgtatctccacagactttggtcttttctgaagagtatcacatcaaaacactggtttttatccaatgtaagctctctcgccaggtcttgagggtagctgtgtcctttttgtgtctgactctgcaaggtctaattctgaaacgtagaccacaccgtacccaggcactgtacccacgctatgtttgtgacagcttggagaaatgtcttcctggtttttaactctcagacaccgtctgcactagatttcttcctgggctaggctgctcctggttttttttttttttttttttttcagacgaagtttcactgttgctgcccaggctggagtgcaatggcgcgatctcagctcaccacaacctctgcctgccaggttcaagcaattcccctgcctcggcctcccaagcagctgggattacaggcatgcgccaccacacccagctaattttgtatttttagtagagatgagatttctctatgttggtcaggctggtctcgaactcccgacctcaggtgatctgcccgtctcagcttcccaaagtgctaggattacaggcatgagccaccgcacctggccgctcctggctttcaaacctgtgttgactgatcagagagggaatgcactcctctcaaagaccccagaacctctctggcctgaaatgcaccatcaatcactccaagcaccaggaccccaccccagccgtcctttctcaccattgcagagctctgctgctgacctcagctagaatattccctgtctacatgtcctgcaagagtcccatctctctccttctggggtctcatctgttctctagcttccacatcatccctatggaagtaacctctaagtctgtgtcccattgtgatcttcagtttagagctaaagaaatacagcctcacccgggcgcagtggctcacacctgtaatcccagcactttggaaggctgaggtgggcggattatctgaggtcgggagttcgagactagcctgaccaacatggagaaaccctgtctctactaaaaatacaaaattagccagtcgtggtggcacatgcctgtaatcccagctactcgggaggctgaggcaggcgaatcacttgaacctgggaagcagaggttgcggtgagcccagatggcgccattgcactccagcctgggcaacaagagcaaaactccgtctcaaaaaaaaaaaaaaaaaataagaaatacagcctcagaaaggcttagagacccacacacacacaagttcacagcctagccttcctgagactacctttcttcacctataaaatgaagacacgttatttaaaatactctaattatttaaaagactcattatattgaataagtcacataactctcatacccaaaaatgtcttaaaattggaaaagtggctaggcgtggtggctcacacctgtaatcccagcattttgggaggccgaggcgggtggatcacgaggtcaggagatcgagatcatcctggctaatatggtgaaacctcgtctctactaaaaatacaaaaaattagctgggcatggtggcacgcgcctgtggtcccagctactcaggaggctgaggcagaagcatcgcttgaacccaggaggtggaggttgcagtgagccaagatcacaccactgcactccagcctgggctacagagcgagactccatctcacacaaaaaaaaaaatttacaaaaaaaaatatatatataaacagtaagatattattttactatgttatatctccttgtatgtagaccatcatactccttccttatcaagtaattaggtggaaaaaatgctgctcatttattcattaattattcattcttttcagaatatctctttgtctagaccaatgcttttcaatagaactttctgtgataatgaacatgttctatatctgcattatacaatatggtagtcattagccacatgtgactactgagtgcttgaaatctggctacagtgactgtgcaactgaagtttacattttattttatttaaattcacctttaaatagctacagagggctagtggctactattaatatactagatagtgcaggtctacacccagccatttaaagtggaaggagctacattttggttgccacttagatctataccatgtttcttcacaatgagcttgacatgtatagctctctgctgtctggctgaacaggtgatgagaactaacagtttaaaacatacacctggtcactctttgtgtaagtcctatcctatctgtggttctgccttttatcacaggttaccatatttgtaactgaattcctaaaacaacagaagaatatttattggtaattccacatatgactggtcagaggaagccatgaactgattttccatttaaaatcaccagtatttggtagcagactgtataaccaggcagatgttatttctcatatacttacttgttctggatgaaagcttcccacctttctataacacaatagaaaatattatttccaaatggaaaggtcaaaggtgatcccaatattgtcctcttttttctgtaaaactactcttcattctgtaaaacaaacaaaacagaaccagagactatcaggtggaggggctgatgcaattatctaggtaatgccccgcttttcatagatgagaaaatggtgacccaaaccagaaaaaaactcgctcaaagcccctggctattcatggccaggccctaaagagaacccaggcggctggactccttgcctagagctctaaactatgttcagctggaactttgcccttctcttcaaagtttcttctcatttctgctgttcagagccaagaaggcaacatggaattaaatgtcaaaagacggtataagtgtcaacatgaatggtgcagagggtacgttctctccagtatttccaggaaagagtatatggactggaatcatccagggaggaagttttcatggaggagacagcacatgaaccaggtcttaaaggataagtagggctgggcgcggtggctcacgcctgtaatcccaacactttgggaggccgaggcaggcggatcacgtgaggtaaggagttcgagaccagcctgaccaacatggtgaatcctgtctctattaaaaatacaaaaattagcggggcgtggtggcacacgcctgtagtcccagctgttccggaggctgaggcaggagagtcacttgagcccgggagacggaggttgcagtgagccgagatcgtgccactgcatcccagcctggcagacagagcgagactctgcctcaaaaagaaaaaaaaaaaaaaaaaaggataagtaagatgaggccaggtagttgggctggggtggaggtggagatgaggatgtaaaacgccttgcaggtgagaggatgagatcagggagtatggaaaggggaaaagttctcttgtccccttcgcagggcttgcgatgggggtgtggctcacttcttcagtgcccgctgctcagacctctaggggatcatacagatgggcgggctgtggggttccaatcccacggcagtgtctagtggtgaatgtttacagctcctgaagccccagtgggtgtgtgttacagggtgctcttttagttcagctgtccgtaggcgtcttgtattagctcaatgggacccctgccttattgcaaggacagagggctttctgtattccggggttcttgccttggtgtaccggaggaattggatcacacgtggtcttggagaatgagcgcaaggtttcattgagtggaagaagctctcagcagatggggtagccagaagggagatggtttttccccggagtaagaccgccaccaactcttctccaaccctccaggccaaactccgagtcgttcctctggtggatggcctgctggcgtgccgatgtctgttgtgtgctcttccgccagcattctcccttcaacgtcctctggacgtccagctgcttgtatgttcttccgccgatgtgttcctctcgacgtccagccgcttgtgtgtctgcctgcaagggtctctgggatttttataagcataggatgacggtgtggcaggccagggtggccttgggaaatgcaacatttgggcgccaaggcaggagtgcctgtcctcacctaggtccgtgggcacaggcctgggggtggagcccttgccagggacgcgcccttctcttcccagcacttcccttccccccttccctatcaatatgagtaattgaggagacagaaaaaaggagttatgcttccagggtacaaaggggaaaagctatggaaagccttgtacgccaagatgaggcatttgttctttatcctatgagcaactgggagagattatggtataaggagtatgtttaaagtgatgttttaagataagaaacggatttcaatttcctggtatggtcctgtcatttcatcctcctagttgctttaaaagcaacttcctttctcccttcctcctccacacactctgaaaagcaggggcccagaagcctctgagactgctctgtgtgcattcccaaaccaagttagatgatctaccccggctcctcatacacacatacacgaccccctgcatcaggatgaagatgcaaagtctgaattaaagacagcatgagagggcagacaggaagtggggaagagaactagaatcactgggtggagagaaacaaaatgggagctatgtgagtgtgattgtggtatgtgaatggagttggcttgggaactcatgtggatggggttggcatgggaactcatgttatcctaacattaaaactctttttttgagacagggtctcactctgtcacccaggttggagtgcagtggccccatcatggctcacggcatccttaaccttctgggctcaggtgatcttcccacctcagcctcctgagtaactgggaccgcaggtgtgtgccaccatgcctggctaattttttttttttttttttttttttttttagagacagagttttgccgtgttgcccaggctggtctcaaactcctgggctaaagtgatctgtctgcctcagtctcccaaaatgctgagatcacaagaatgagccaccgcgtctggccattaccctaacattttattatgaacattttcaaacatagagaaaatccatccctctattcatttatcaatctattttacttattttcttgcatattcaatgtaagttgcagacgttagtacacttctatgttcatataattaactagaattcaatattggtttattattctttcttaggaaaaattcacctacagtgaaagcagagatcttaactgtaccctttgatgagctgaaaaatgcttctacctcaaacacctatcaagacagaaaacattaccctctccttagtatcctatgccccttcccagtcaaattccatctctgccacaccctcaaagaaaatcactcttctgatttttttaaaccgtaaattagcctgttgaagaacttcacataaacggaatcatacagtatgtgctactcctttcattccacacaatgtctgtgtaagtcactcatgctgttgcttgcagtataagtagtttgtaacatttcattgcttagtagtattgtactgtataaaatactagagtgtattggccgggcacggtggctcacgcctgtaatcccagcatattgggaggccgaggtgggcggatcacctgaggtcaggagttcaagaccagcctggccaacatggcgaaaccctgtctctactaaaaatacaaaaattacccgggcatggtggctcatgcctgtaattccagctacttgggaggctgaggcaggagaatcacttgaacccaggaagcggaggttgcagtgagccaagatcgtgccaccacactccagcctgggcaacgacaaaaaaaaaaaaaaaaaaaacaacgaaaaaaaaaaaactagagtttatttatctattctcctgttgatggattgggttgttttcagattggggctatcataaatacagaacaatgaatacttttgtacaagggggtccttccccacaaaaacttctctaagaatagcttactttgactctgatctttctaatttcacaagctctttgaataaggatctcctcagcttaaactagatgctcacagccatggcaagtttgctgtgaatgttgctgttgtgagagtgataagtgaggataagaaagtcctagataaagtttcctttcattcaaaaagcccccaaatcatatcttttctaataaaaagcagcctgaaaaatcaagctgcaagtatagataagctaaaagcttgcattggtaaatgccagtagctgtgcccatagaaaaaagccacctgggggccaggcatattcaacatggcggatccatcttcccttttctttttcaaccatgtgtacagtaggaacagacaacatagtgccggccagatagagaccccatctgcataataaaacataagggtggaatggccggcttcttcgtgcgctatgcaaacgttataccggttctgaccaatctctcagtccctatgtatatcagacaccaccttctcaagttcatctataaaaccccatgcattggctgggtgcagtggctcacgcctgtaatcccagcactttgggaggctgaggcaggcggatcacaaagtcaggagatcgagaccatcctggctaacaaggtgaaaccctgtctctactaaaaaattcaaaaatttagccaggcgtggtggtgggcgcctgtagtcccagctaatcgggaggctgaggcaggagaatggcgtgaacccggggggcggagcttgcagtgagccgagatcgcagcactgcactccagcctgggcgacagagcgagactccatctgaaaacaacaacaacaacaacaccatgtatttcaccacaaaaccactcactcaggttcccctctctctctgcaggagagagagctattctcttttctctttctttcgcctattaagcctccccccttttgtttttttttgagatggagcctcgctctgtagccaggctggagtgcagtggtgcgacctcagctcactgcaacctctgccatctgggttcaagcgattctcctgcctcagcctcccgagtagctgggattacaggtgcatgcctcctcacccagctaatttttgtatttttagtagagatggggtttcaccatgttggccaggatggtctcaacctcctgatcttgtgatctgcctgcctcggcctcccaaagtgctgggattacaggcgtgagccaccatgcccggcctaaaactccactctcaaactcacttcttgtgtgtctgtgtcctcgattcctttggcgtgagacaacgaacatcaggtatttaccccaatgatgctgcttcaaaagcatatctattttcagaaaataaagtttcccttttatgttaaaactgattcattaacaatataaaaaattgtcattgaaattggagcagccaggcgcggtggctcacgcctgtaatcctagcactttgggaggctgaggcaggtggatcacgaggtcaagagatcgagaccatcctggccaacatggtgaaaccccgtctctactaaaaatacaagaattagccaggcgtggtggcaggcgcctgtactcccagctactcgggaggctgaggcaggagaatcacttgaaccagggaggcggaggttgcagtgagccgagattgcgccactgcactccagcctggtgacagagcgagactctgggtcaaaaaaaagaaaaaaagaaagaaagaaaagaaaagaaattggggcagctcaggagcttaagcaagggcacattttggtgtcaggattgcgttcaaactacagctctaccactgacacactaagagtcctcaatcaaggggtaatgactggcacacaggaaggactcagtgaatggcggcaactgtagattcttctctccctttctacttccccaaaaaggggtgggtttgggaagaatcacaccatccctgactgggtcaaagtttaagtcagagtagaaaaagaggaagaagatagaggaaggagctaagatgtataaagtttttaattgctctcaagaacaaaatcaatccatatactgaagatcatgtaatttttctcagttacccactggcataaagaatagggctgtggaccaggcgtggtggttcacgcttgtaatcccagtgcttggggagactgaggagggtggatcacctgaagtcaggagtttgagaccagcctggccaacatggtgaaaccccatctctgctaaaagtacaagaaattagccaggcgtggaggtgcacacctgtaatcccagctacttgggaagctgggacaggagagtttcttgaacccaggaggtggaggtttcagtgagccaagatagcaccattgcactccagcctgggtgacagagagagactctgtctcagacaaaaaaaaaaaagaataggactgagaccagtgtactctcttggaatgtagctatggccctgcaacccctccccgcaagctgtccagtgaataactgaattgggtggaagaagtccttcccccacatttgtacattggaaaataatataataatatatattatatatatataggcaatctgcctgcctcggcctcccaaagtgctgggattacaggcataagccaccatgcccagctggaaaataatatttagtactaattctaaaattggcattttcttaaaaaaggttacatgagctcctcagagaactgaagtttctctggacccatataacccacgtctatggggtcattcccacacctcacagataaaataagggaaagagtacatataattaggagcagacaggaagcacacagaaatggaaaatgtgtgtgggctttggcattgcagatctgaattcaaatcctcactctgcaccttatgaggtaagtatccctagacatgttacttagcctttccgaatcttgctttccaaatcatgcataatattcacctccctggactattgtgaagattaaacatgaaagtagttgtgacaaagatggtcagtgggtattatctgtcttcctttctagtaaaaaggctctagactagaatgttcttaggtctttaataggcttcagcaatctcacatgttaatattagtgttatgtgctgaactgggcttcccccaaatccatatgttgaagccctgaacctcagaatgtgactgtatttgcagacagagcctttaaagaggtcattaagctcaaatgaggctgttatgagaagaggaaatcgggacacacaaagggagataccaggaatgtgcatacagagagaaaaggccaaggagggaggcgtggggagaagccaaccctgctgacaccttggtcttggacttgcagcctccagaactgtgggaatataaatttctgttgtttaagccacccagtctatggtattttaaacacattaatacgactaatattataaaagtgtgtgaacagttaagaagtgtgctgaccaggttctatcctagttttgtagacaattagcagtgtgatgtagggcaggacatttaactcctctctaccacattttccacctctcaaagccaggctgcaaggatctactgagataatgtacataaagaccctatcacgaaataggtgtcccgtaaagggtgatttccttcacttctgtctccaaatatcaggtttctcatcagtaacttgggagattggatggactaagtagtccacctcgttcctttcagctttgatcatctgtgattctaacaacagtcttagcaacaagagtgagtttcctggccgggcacgttggctcacacctgtaatcccagcactttgggaggctgaggtgggcagatcacgaggtcaggagttgagaccagtctggccaacatggtgaaaccctgtctctactaaaaatacaaaaattagctggggcgcggtgccgggtgcctgtaatcccagctacttgggaggctgaggcaggagaattgcttgaacccaggaggcagaggttgcagtgagccgagatcacgccactgcagtccagcctgggtgacagagcaagactctgtctcaaaaaaaaaaaaaaaaaaagagtgagtttcctttctgtaatgccaaaaagtgtttccaaagtcctttccatctcacagtagtccaaggggtacatgtaccccttgaacctgatgaagccccagcagacccgattaaccacccctaaaggtttctcggcaggcaaatccagccaggcatgcaaatcacactcgtcaatgttaaggcttttgtacatcccagacacaagctttaaatgaatgtaaacccagattttaatatttgggccccagaccttaaaaatcccattctctctacccacagtacctggctgagcaatccaattgccctcttcttgggagaccaagacatgtttttaaaataaagtttctttgtatttgctttccgtttcagtgaggcctcgagttcttgtagaccagataccttcttgttctgtgagaggacagtgtacagagaggggaactgctgagcagttccttttttttttttcaaagcacagtaagagtggtttggacacaagtactaccagttcagaaagggaagatgggtgtaggcaggagtagccggggaagaagtagaacttcagagtaaaagatgcaagagctagaaattccgtcaagaaaggaattactcatttgtttcctgtttgttcacaacatatgaattcattgctgttgagttacttattctataccttaaaatgaaacaaagtcttctgaacatccaacatatattttttttctttttctttcttttttcttttttttgagacagagtcttgttctgtcacccaagctggagggcagtggcacaatctcagctcactgcaacctctgcctcccgggttcaagcgttcctcccgcctcagtcctcccagtagctaagactacaggcgtgcaccaccatgcccggctaatttttgtatttttagtagagacagaatttcaccatgttggccaggctggtctcgaactcctgacctcaggcaatctgccagcctcagcctcccaaagtgctgggattacaggcgtgagccaccatgcccagccacaacatgtatttttaatgcttaaccatgggagatagagcggtaaatgaaatgagccagcttagttggctaaagcacattgctactgcattcaaggtcatgcttacccctgtaccttgaatcccagaggacttccagcagatgtgttctctcagtcagcagggttctgggcaaggtcacacagggcaaacagatcaccagttttggtccactccaccgatgacgcacggggacaccctccggagtataaacagccaggggctt
